United States Patent 7,214,786 (NUCLEIC ACID MOLECULES AND OTHER MOLECULES ASSOCIATED WITH PLANTS AND USES THEREOF FOR PLANT IMPROVEMENT) - sequence listing, part 18

SEQ ID NO: 66108 - DNA, 531 bp, Triticum aestivum
  unsure (1)..(531): unsure at all n locations
  Clone ID: PAT_TA_66108
gctgccgtcgccgccgcggccgccgccaccgcggggtccggcggtaaagacgatcgcgccgcgcgcaccgacatggcgatggcgtccgcagccacgctggtcgccgcgcagtgcgtggaggcggctgagtccatgggcgccgagcgcgagcacctcgccgccgccgtcggctcggcggtcaacgccaggacccccggcgacatcgtcaccatcacggccgccgccgccactgcgttacgaggcgcggcgacgctgagggcgagggtgcanaaggaggcgtggaacgtcgctgcggtgatcccggtggagaagggctccatgggaatgggaggtcacggccacggccacaagcacggcgccacccagaggcagctgcagcagcagcagccgcatcacaaggtgcaggagatgggcagcagcaacagcagcagcttcagcgacgacctgccggcggtcgatcaggacgagaacaacttcctcggcatctgctgccaagacctgctcgcccgcggcatcgagctcctcaagcgc

SEQ ID NO: 66109 - DNA, 397 bp, Triticum aestivum
  Clone ID: PAT_TA_66109
ggtcgccgccatctccctccactcaacatctccaacatatccgaatctttgcgcgcggcgcacagatgccgctcggccttgacatccccattggccttgcctcctgagtcctgacccaagtcctagggtcacggtccaagattggaagggcgacatgcggcttggtggtgctgcggcggacggcaacgatccaagattggcaggttactaacagaagccacggacaccaggaacactcgattgatatctccctccctctattcctctcttggggtttttctgattggtatttttgtggacggaagacaaatctaaggaagaagatgaggtgggaagctaaccagaaacttgccggacctcgagaaaccctgtgttctggatctgggaggcaccaact

SEQ ID NO: 66110 - DNA, 586 bp, Triticum aestivum
  Clone ID: PAT_TA_66110
ccatgaagggggccaaatccaaggcgccgccaaggccgacgccaagttggcggtgaagagcaagggggcggagaagccggccgccaaggggaagaagggcaaggccggcaaggaccccaacaagcccaagagggcgccatccgccttcttcgtcttcatgggcgagttccgcgaggagttcaagcagaagaaccccaagaacaagtccgtcgccgccgtcggcaaagcggccggtgagaggtggaagagcttgagcaaatcggaaaaggccccctatgtggccaaggccaacaagctcaagggcgagtacaacaaggccattgctgcctacaacaagggcgagagcgctgctgctgctgccccaaagaaggctgcggccaaggaggtagaggaggaagatgaggaggaatctgacaagtccaagtcggagatcaatgacgacgatgacgatgagggcagcgatgaggacgaggacgatgacgagtgaagaagacgcatcttgtcaaggctgctcctgcggacaagtcgggagctgctgtgcgagaacggacctgagctgtgtgcggtggtgtcataaggagcctat

SEQ ID NO: 66111 - DNA, 309 bp, Triticum aestivum
  Clone ID: PAT_TA_66111
ctcttttatatcagctgcagtatgaatgttttgtttggcctacagcagtcatggtctcattctgtcatacggctcttttctcgcacgaagattaacatcatgtgttctttttattgaaaattgccctatgtggtatacttatcctgtaagcatgtgcatctatttctttctttgtgtatcatcagcatttggcgagctagcattttagctaacagtaacacacatttatatattgtccggtgtttggcgtcttaccctctggtctctcttgttaggatgactgttttcctgttctgatttatgctctct

SEQ ID NO: 66112 - DNA, 418 bp, Triticum aestivum
  Clone ID: PAT_TA_66112
ccaagcaaccgacgccaccatgggtatctcgcgtgactccatgcacaagcgccgggccaccggtgggaagcagaaggcttggaggaagaagcgaaagtatgagctcggccgccagccagccaacactaagctttcgagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcgaacaatgagcttgtgaggactcagacccttgtcaagaatgccattgtgcaagttgatgcagcccctttcaaacagtggtacctgactcattatggagttgaaatcggtaggaagaagaaagctgctgcagctgccaag

SEQ ID NO: 66113 - DNA, 368 bp, Triticum aestivum
  Clone ID: PAT_TA_66113
gcgtcttcgtactcgcctctctctcgcgcttccgagctttggcctccctcccctcctccccgcaatctccccaccagcgtagcgcagcgcgcgcctccgccgctccgacccgcagccatgagggagtgcatctcgatccacatcggccaggccggcatccaggtcgggaacgcgtgctgggagctctactgcctcgagcatggcattcagcctgatggacagatgcctggtgacaagaccgttgggggaggtgatgatgctggcaacaccttcttcagtgagactggtgctgggaagcatgttccccgtgctgtctttgttgatcttgagcccactgcgattgatgaggtgaggactggcacctatcg

SEQ ID NO: 66114 - DNA, 166 bp, Triticum aestivum
  Clone ID: PAT_TA_66114
gcaccaggtttccgaagccgacgcagcctccaatcccaccccgtcaatatccatccgacccggcctctcctcggtcgctttctctaacgggatccgccaacattataaattcagcgcccgagcgcctccccgtcccacgactgaatcttgttcgcgaactacagcc

SEQ ID NO: 66115 - DNA, 318 bp, Triticum aestivum
  Clone ID: PAT_TA_66115
ccccggccacctccggaacacagccccgacctctccccccacccctgcaaccccacccgccgccgccccctgcaactcagaccaccgccgcccccgttaacccctcgtgacgccgcccccatcaacctcgcccgccgccacctcggcaacccctcatgccgccgccccctatacctgaagccagatgcgggggcggccatcgtcaggcagggagacggcaactgccactccggccttctgccacgcagcggttgcagcacatagctgcccccttcatgaaattgacatgcatccctgcctcctccctggatccttgct

SEQ ID NO: 66116 - DNA, 551 bp, Triticum aestivum
  Clone ID: PAT_TA_66116
cagccattcccctccggccgccgacccgccggcgatggcgcccgcccgggccgccaagcgccccaagctcgagccctccacctccgccgccggcgcgccccatcagcggggcgacgacgactacgtgccgggcaacatcgtggagatcgagctgtgcaacttcatgacctacgaccgcctcgtctgccgccccggcccgcgcctaaacctcgtcgtcggccccaacggctcctgcaagagctccctcgtctgcgccatcgccctcgccctcgccgccgaccccgccatcctctgccgggccgccagcgtcagggccttcgtcaagcgcggcgaggagtccggccacgtccgcctctcactccgctcccaggaccagggccgcgacatcggcatcacccgcaagatcgacaccaacaacaagtccgagtggctcctcgacggcgccaccgtccccaagaaggacatcatcgacgtcatcaacaagttcaacatccaaatcaacaacctcactcagttcttgccccaagatcgtgtgtgcgagttcgcaaagc

SEQ ID NO: 66117 - DNA, 227 bp, Triticum aestivum
  Clone ID: PAT_TA_66117
ctcttccaaaaccctcgcatcgtcgtcttcctcggtcggcccacctgcgcaagcgcgcctccagcccacatctctcgccctcgcctgggaggagaacgagcagagcgcagcggagatgctcggggcctcaaggcgatccctctgcgccggcgccgcagcccgccgccacgccgccgccttcgcggtctccggagacgccgccgccgccgccgcctccccctcccccc

SEQ ID NO: 66118 - DNA, 500 bp, Triticum aestivum
  Clone ID: PAT_TA_66118
ccgtgggcgtgagggtggagaccaacgcgaggacgccatgagccacgacggcgatgagggggacggcgaggacgaggacgacgacgaagatgatgacgacgaggaggatgacgaggacgaggacgacgactccacccctgatgcgtcgccgagggcggaggtgaaggcggagggcgacgggtcggccgggttggcgcagtgcgccagccagcagccggtggagcccgacccttttctcgagggtcacgactccgggacggaggaggagcaggcggcgttcatgtctgagctggagcgcttccacagggagcacagcctcgagttcaagccgcccaagttttacggcaagggcctcaactgcctcaagttgtggaggcaggtcgctcacctgggaggccatgagcaggtaacagtttgtaaactatggcgtcaagttggagagactttcaggccaccaaagacttgcactacggtgtcttggtcatttcggattttctacg

SEQ ID NO: 66119 - DNA, 616 bp, Triticum aestivum
  Clone ID: PAT_TA_66119
ggttgcaatatctaatttctattaatttgcttttatatattatgaacttcagtttctttatatgccaaaacaaaatcaccaatttggaaacctctgtcggtgttacataattaggcatataataaggtgagatccctttacttcgattcatcgcatagtgtaatcaagttctgtgcctaaagaaaatcttggatatgttttctgggtgccatgtagaatgctaaggtaaaataattttactcttatcttttatattcttttatgttaaagaggttacagtgtatccagatcactgaatattatccaaagtgattctccttcatataggccaaattattttctccctatccatgaggcacactatttgaatagtttgcctaacacgatatgtcctttagcaggtccgtgtgtcacaacatgcaaggaaatcaaatatggagtgtgggtaaagttatatatcaagaaaattggatcaaagcatgtggacaaagttatatatgaagcatatcggatgaaggcttgtggataaagttatatatctaatagatgtagtttactattatgcagtataaaaaacaatgtaaataagttagctgggataaatactatggcctgc

SEQ ID NO: 66120 - DNA, 422 bp, Triticum aestivum
  Clone ID: PAT_TA_66120
cgacaattgccatgcatgcatgatgccagtaatatggtttacgaattaactaaaaaaaaagccgcgtatatcatggaggtatacccagatatataaatagtgctcgatccataatttatagctggatttcaacacttatatatctagatttacgcccctcaaaaaaattatatatctagatctatgttattacagtagacacaatgtcatatatgacccacggtgattgtacttatactattcgtgcaatatatatgtatatatacattcgtgtaagcgtgcaaatatgtaatgatagctctattaaattatgttctcaaagtcaaagttgttaaagaacactctgtgtcagcatcaagtagattatgtggtaaaaccatgtaattatttttcacaaatgataagttaagctagattttatt

SEQ ID NO: 66121 - DNA, 585 bp, Triticum aestivum
  Clone ID: PAT_TA_66121
gcccaccgcgtcgcctgccggccgccctcgcgggtggctgcgtccgccagctccaccggcgacctgctaccccatcgctggcctctcccacacccctctctaaccctagattcccatcactggcggaggcaccttccttccctcatgctgcacctgaagctccctcccgctcccagcttttcttcctgctctgccgccgctagggtttcgtctccccgatccccattccccgaaggtcggatccagcagaagaagtgatggtggccgcgggagatcctctccaaggttcgagccaaggccgctgatggagctgcagctgccagaggagccgactcgtcggatgcggcccccgcccccgccaaggacctcaagatctgggatgcgcgtcggatgtgcttccccaacgccgacgccgacgccgtaaggtgagccctgtactgtacaattggcgggaggcatcgtggacttgccggggcgagagaacgacccctacatcgtctctcccaatgtttaagggtcgtcccaactgttcaaggaactgcatatttggtgtggatatagctaccgctcgtgcgacatgtgttt

SEQ ID NO: 66122 - DNA, 496 bp, Triticum aestivum
  Clone ID: PAT_TA_66122
acgcacggcaacctgccctccgccgccgccgccgaggacgccgccgacgcgctgctcggccacgcccgcctcgccgcccgcctcgtgccccacagattcttcatcaccagctcgattcttgaccttaccataggcggtgttgattctgccgagaatgactcgactttgcaggctcagcaacctcactatctgaaaacatgctgcaaaccaagcctagatcatgggagtgtggtttacctgctggggcataccgggaagaaggaactggtgatcggcgacggcaaggtagtgattggcacggataacctcataaagctctccacagatggggtgacatggtgtcctggctctgccggtttcgacgcccaggggaacttagctttcatgatctgtgaccccatgaagctggcctcctcccccactgcaaggtcatcttcagcatcctcatcctcatcacattcctcgaagaaggatcagcaaatgcagttcgggatcc

SEQ ID NO: 66123 - DNA, 370 bp, Triticum aestivum
  Clone ID: PAT_TA_66123
gcgggcctctgggccaggattactcccttaaagtagtattactatggctgattcttgtcgggtctatccccattttgcggactgtgtcctggtatatcagattaagactactgccgccatccataaggactcgtgtgagatggtatccgttgattattgggtctaacaccaaggcagccaatcctccgtgccggatacttgtcaggttatccctgcgatcaaaagtgatcaggcaggccgaccaggggttgaactttggggtgacaggctctacggcgcgtgtgtctcggagtgcctgtttgcttctccccttcgtcgcgtgaatcatgtccactgttttgacctcatgacccgcttttactgcgtcgtg

SEQ ID NO: 66124 - DNA, 518 bp, Triticum aestivum
  Clone ID: PAT_TA_66124
ccgtggaggaggagcccgcggcggagaaggccgagaaggcgcccgccgggaagaagcccaaggccgagaagcgtcttcccgcggcgggcaagacctccgccaaggacggcgacaagaaggccaagaagaagagcaagaagagcgtggagacgtacaagatctacatcttcaaggtgctcaagcaggtgcaccccgacatcggcatctcctccaaggccatgtccatcatgaactccttcatcaacgacatcttcgagaagctcgccggcgaggccgccaaactcgcgcgctacaacaagaagcccaccatcacctcccgcgagatccagacctccgtccgcctcgtcctccccggggagctcgccaagcacgccgtctccgagggcaccaaagccgtcaccaagttcacctcctcctaggttcgcccgccccccctcatggtgaccgctgttgatcccctgctggatctgcctgcctatctagatatatatagtagtattagtagtgcttgatggaaa

SEQ ID NO: 66125 - DNA, 426 bp, Triticum aestivum
  Clone ID: PAT_TA_66125
ccaggccggtccgtcggatcctctcccttcttcttccttgcctccggtctcccatttcctttgcgcccgtacccgtatacatcactggtccgctggtccgttgtcgcagaagcgcaaggccccggagcccggcgagctccggcggtccggccgcgtcgccggcctcccggagcagcccaactacctcaagggcgactaccgtggagtgtacgaggcgtgtgccgcttcgaaaacaccgaccgacgaggagagggccggcgccgtcgccaaggccgaggagctccagcgccggatccaccgcatccgctggcccgccttcgtcaagcccatgagccacgaatgcgccaccaggtcaatcctgatggtaaagtactgtagcaagaaagcttgcattggatgtgatgtgaagcaatgtggttcttggat

SEQ ID NO: 66126 - DNA, 301 bp, Triticum aestivum
  Clone ID: PAT_TA_66126
cagccctagccctagccctgaccccgacgccagcgccaccgccaccgcggcgccgcccactcccatgtcggcgccggcgtccttcaagttcaacgtgcacgcgccggagttcgtgcccatgtcgcccaccgccacgccaatgtccgcgcctgcgggcggctactactcgcccttcctgcagatgcagccggcgcccgactggagcttcctccatgaccacgagcccgtggggttgatgcccgacttcgcgcacgccaagttcgccgccgccgcgggcgccgccagcaacagcgcccaggcc

SEQ ID NO: 66127 - DNA, 447 bp, Triticum aestivum
  Clone ID: PAT_TA_66127
aacatttcactgacaccgtgacacgtacgccgtgcaatggtgcgtgcagaaagttgatcggcgcgaggtttttcaacgcgggcgtccaggtgccagatttcctggaccagccggtggaaggcaagcagctgaaccagactgatctgaactcgccgcgggactacgacgggcacggctcgcacaccctgtccaccgcgggcggcggattcgtccagggcgccggcgccttcggccgcgggagtggcacggccaagggcggctcgccgcgggcgcgcgtggcctcgtacaaagcgtgctacacggcggggtgctccagcctggacatcctcgcggccatattcgcggcggtcgaggacggcgtgcacgtgctctcgctctccgtgggcgcgccggccgcggactatgcggccgacctcatggcgatcggcacgttgtacgcggtccaca

SEQ ID NO: 66128 - DNA, 482 bp, Triticum aestivum
  unsure (1)..(482): unsure at all n locations
  Clone ID: PAT_TA_66128
gcccgggtggtacgtccgcgcgtccctcgcccagtccgccggcctacgcacagtcgtcttcctcccttgcaagggcggcgtccttgagctcggttccgccgtggccatgcgcgagaaccccgaggtcctgcgcgccatccaatctgtcttccacgtcgaggccgtcgcgccggacgatcgcatgaggatcttcgggaaggacgtctcccgcagccggggcattgccgccggtgcaaaccacggggagcgacgccagttgggcgctgcggctcggcgggcaggctaagcaggaggcggcggcggccaaaccgaaaccccagcaggagcctcccaagaccataagcttcagcaacgccgtcggcgcgcaaaancaggcgggcggcgaggaccggaggccgcggaagcgggggcgcaagccggcgaacgggcgggaggagccgctgaaccacgtggaggcggagcggcagcggcgggagaagctg

SEQ ID NO: 66129 - DNA, 366 bp, Triticum aestivum
  Clone ID: PAT_TA_66129
gccgacgcgacgacagcaatgggcgacgctgaggctgaccaatccaacgagccagtgagcgatctccaaatggagccggtccgtcggtgcaggcgaagggcgcacacggcggacaaggcggcggcggtgcagcgcaaggcctagtgccggctgcggctgtctgcgcgggtgccgccgtgggacgccgtcgtgctcacggccgccagccccgagcagctcgcgctctacgcccgccagctcacgcgcgcgcgccgcctaggccgcttcccgccctccaccgccgccctcgccgtccctaaccccgacggcgcccgcatctgctccggcaccgccacgctccacgctgtcgcctccctctcccgccac

SEQ ID NO: 66130 - DNA, 283 bp, Triticum aestivum
  Clone ID: PAT_TA_66130
ggcgcgccattcatgctcaacgcctacccgttctcagccacgtgggcgacccggccaacgtgccgctcgcctacgcgctcggcgcctccgacgagcccgtggtgcgcgacggcgcgctggcgtactcgggcctgttcgacgcgacggtggacgcggtggtggcggcgctcgagcgggagggcttcgccggcgtgccggtggcggtgaccgagaccgggtggcccaccgcggggcacccggccgcgacgccggagaacgcggcggcgtacaacgggaggatggc

SEQ ID NO: 66131 - DNA, 513 bp, Triticum aestivum
  Clone ID: PAT_TA_66131
atcaactactattaaattataatccctgtccccaacctttcctccctctcatccacggagccatggctctagcctcactccttgaagccataccctcattgctacactccttggtcctgagatccttatcagccctagcatgtggcacttaccatacacaaactactctgaaagtggcttgcacaaatgttcattttagagctaacaaagggtttgttaaaagttttggagatttctagttcgaaagggagccatttctcttttctgctactctattttgttttgtagctgccaggtgtattgtgcggacggcggtttgctcttactctacactatacttcattgagcatttatagctgtgaaaaattgtgcttgtgcatcagttgctatacccttttttttcgaaagctacatctgttgctatatcaaagggtcattgcctagtaaatgcggtgtccttttctgagcataatgagatgagacaactctatccggaatattcaaaaaatatat

SEQ ID NO: 66132 - DNA, 385 bp, Triticum aestivum
  Clone ID: PAT_TA_66132
ggggctgcagcaagcgctctactggcacatcgaggcccgcgtcgtgctggatctccgggaggtcccggatgccgttgatggacgagagctccacttctccatggtcgatggtgacttcaagaagtttgaagggaaatggtccgtcagggctggtccaaggtccgctagtgcgattttgctgtacgaagttaacgtgataccacgatttaatttcccagcaatatttcttgagaggattataagagtccaagccacttaacttgcgtagtgcaacagtcgagaatgatgtcatcccctctagtaagttcaaagaagcgcctgcctcttccggttttggtggtgtgcttgcttcaccccctcctgagttgaatgggaaatggggtgt

SEQ ID NO: 66133 - DNA, 583 bp, Triticum aestivum
  Clone ID: PAT_TA_66133
agtcggcgacatctctgaacccgggcaaatattcagtggaatgcccaaggaatggcaaggataggaattttgcttctctgttctttaatgttcagattcaagtagtatgtcatatgattttcctgatgtctgcttcaagcaacttactgaattcagtttgtttcgacagccgacaggtgaaatactggcgtttcttcatctggctggacaagtacttggacatggtcgaagaagtttggatgataaatgtgctcatcatgggcaatggggctgctcgtagcttgtcacaagaaatgcagcgacgctcaaattgatgctattagggttaagatgcagcactggatcgacccaaaatgcgaagcttcagattcttgatgatcccattcatttgacaagccgaaagatgtgagtgctctaaaattgatgaatgcttccgatgatggagtgattccctgatatcatcttacattttgttacagagattaatcctttcttcatgttcatgatgtctcacttctttttacatgatgaagtggaaagaaatattcccaaatacagaattagcgcggtcaccacagtttga

SEQ ID NO: 66134 - DNA, 345 bp, Triticum aestivum
  Clone ID: PAT_TA_66134
ctccttctctctccccgtccgtctcccacctccgcccgcgccgcctacgcgccctcgtcgtcgccgcctccgcctcgccttccgcccgcagcctccgcctcctcgagtggggcaaggtttgccgcgccgtcgcttcgttcgccggcaccgcgcacggccgcgaagccaccgagaaacagctgtggggtgtggagagcgtgagctatgagcggagccggaagctcctccgggagactgaggcggcggtgcggctgcttggcagctccggtggggcattggatttctccgggctggataccgtcgcggtagagtcagcaataaattgtgtctctggtggttccgtga

SEQ ID NO: 66135 - DNA, 349 bp, Triticum aestivum
  Clone ID: PAT_TA_66135
tccctccgcctggcgctcttgtccctcctctcccactccagacacgctcctccgtcctccggggacctctccggcaggaagacctccgcgccctgctcgccccgtgggctcccccgcctgtccatccgcacgaccgcgccgccggacacgcctgcacgcccccttccaccgagctctcccctcctggtcgcgccctcccttcttctctggactggacccgcctcgggagccggacaatctcttctggtgttggtgcgtgcctcgctcaatctggattgacaaaccatactctgacttctcagagaagatcctattggaccttgtgtccacaacattcctcttttgggcc

SEQ ID NO: 66136 - DNA, 183 bp, Triticum aestivum
  Clone ID: PAT_TA_66136
cccatggtgaaatgctgcctgctgctcctcttcttggcgggtctcttgcccgagcacgcgccacctcgtgccaccccgacgacctacacgcgctgcggggcttcgccgggaaccttagcaggggggccgttctccttcgcgctgcgtggtccggcgccatgtgctgcggctgggatggcgtgg

SEQ ID NO: 66137 - DNA, 625 bp, Triticum aestivum
  Clone ID: PAT_TA_66137
gcaccctccgcgcttaaacccctcgcgctccgcccactccaccacaccgccctcctccctcctcctgctcctcgcccgcggcggcgtacgtcctgctgctgcgcgcgcgctctagcctcggtccctccttcggttccatggcggaggctctggggtaggactggacgtacgagcgagcttttcggctcggcccgaagctcgctccagctcggcccgttacagctcggctcgataggattatcgagcgggccgaggtctgaaaacaggcccgtttcgcgaccgagccgagccgagtttcggccggtccagctcggtggctcgcttgtggcccagcccaattccaccatcgatcacaatagctagcgcattagggcacgagcaaccacagccagagtctctcgtctctccctttctctgctctgcgccgcctcacctctctctcgccacgctgcaaatctggatcgacggcgacgagcgacgccgcgcttcctcgccaactcggcaccgacggcgacgggcggcgcgaccgttcctcgccacaccggacatagtcggacgcgcctcccctggtttctcgcggaacgtgacgagccggagcagacgcctatcgtcgcaacaatggaca

SEQ ID NO: 66138 - DNA, 560 bp, Triticum aestivum
  Clone ID: PAT_TA_66138
agcagcaggagatgaggagaggcccttgctccatcatcaccctcctcctggcctctatcagaacggggattcaaggttaaatacttgcgatggaaccgtcgatgttaacggacaaccagctgctaaggcgagcacgggaaactggagagcctgcttcttcattttaggtatcgaattcagcgagtgcttggcctacttcgccatctctaagaacttagtcacctacctcaccagtgtgctggacgaaagcaacattgacgcagcaaggaatgtgtccacttggattggcacaacattcttcacgccacttgtcggagctttcttggcagacacatattggggaagatacaagacaatcgtgatttttctctcgatttacaccgttgggatgcttgtgctgacgttttcggcgatactcccatcgttgatgcaatcctccaaccatcatgagatccaccgtgttgccgtctacgcaggactctatcttacagcccttggcaacggtggcatcaagccctgcacttctgccttcggcgcggaccagtttgacatggctgacc

SEQ ID NO: 66139 - DNA, 413 bp, Triticum aestivum
  Clone ID: PAT_TA_66139
gcatcctctacctgaccgccgcctctcccaccaccaccatggcgatcgcggcacaatcctccgtccactgcctctcaacctcacgccaacgctcgcccgatcgttgtgtgtcgccaccttagccgcccccgccccagccgccgcatctgccaaggtcggcagacacatcctgcgcgtggtcgccattgacttgcacgcgggcgccctgaggtgatcatcctgtcccgccaggcgctcctccgcgcgctagcaaaccacgcagcgctgagcacgcccagggattgagcaggggggccagaccgccagacgcgcgacgcatccaaccccacatgggaggctgcagccgctgccccgcctccatgtgatgaggagaacccgtacaatatgcatgcatcttgtcaatcccttcttat

SEQ ID NO: 66140 - DNA, 526 bp, Triticum aestivum
  Clone ID: PAT_TA_66140
ccctgtccagtcttgtatttgttctcaaagtgattttcattgatgtctgaaattcagatgtatctgcagctgcaaaacactcgtgtttttggatctgaagttcagatgtatctgcagctgcaaaacactcgtgtttttgggtctgaagttcagatgtatctgcagctgcaaaaacactcgtgtttttggtccattgttttcagtttcacaagccgcagatcatgcgccgcccccaccccatcccaaccgacgacgccgcttccgcccggcccccaaccgagcgcctcccatgttccttcaggcgaagcgccctgtctcgcgtgccttgttccactagccaccggctccgtccgccgtccttttctctcctgaacttctccgtcggcagggacgagcagggagctgtcatccatgtcagtcctcagccaccatcagcttgcgaaaaacagttaattgctggcgcttaggaccaatgccaaaaccaggcaaatgtgcggctgaagaagttcaaacaagtggcgtggag

SEQ ID NO: 66141 - DNA, 187 bp, Triticum aestivum
  Clone ID: PAT_TA_66141
ggccggcgggggcacggctcgtggtgttcccagctcgctcgtgctccttcgacgggtcccggcggcgtccggggcacggatccgggcgaggctgccccagatctgatgcgtggtggtcagcctcgagttcggtgggctgcagaaggcgttgtggtttggctgcggcagcaaggagggaggatggcgg

SEQ ID NO: 66142 - DNA, 143 bp, Triticum aestivum
  unsure (1)..(143): unsure at all n locations
  Clone ID: PAT_TA_66142
tggtggcgttcggcgaccggctgtggtgggtcgaccctttctttggtgtcttctccgtcgacccattcancgaccggccggagcatggcttcgtcgcgctgccgcgcccgctgcccaactttgacattgacgcgccgctgatg

SEQ ID NO: 66143 - DNA, 458 bp, Triticum aestivum
  Clone ID: PAT_TA_66143
atcaagcatatgactattatctcaaggaattgatagtggaatggagtgaaggagtcttgtctagtgatggtgggaatcgaaatttttaccatttagatcgaaaagatgagaggaacgaatcattcgacctttttcttgaaaaagtggcaagattcttgcaaaaagatgttgatcaaaaccaaactgttgatgttcgtgggctttcaaaggttgaagctcgcatagttgttctctcaactctccgcaaaattaaagagaagcatcttttaggaagagcagtccaggatgatttggtcatcatcacgggtcatgagaagacatcatacactgatgtcgaaacgactgctatcgacgtcgagtatgcaataacttctgttttgaaggatgaactgggtcttgaagttttcgttggaccagaaagccgtcctcctgtttcatccaaactcagagccccccca

SEQ ID NO: 66144 - DNA, 233 bp, Triticum aestivum
  Clone ID: PAT_TA_66144
ggtgtcaccgccgtcactccggcagcttcctggggtctgcgccgcgggctgctttcctggatcaggaattcagggtatcgcggggccatctgctccttcgtgttcccttctcttcctttcgaagaaactcgcaccctgccgtcatggcgtgtcttcctaggcttctcattccgtttcgcgtgggtttagcttctcatgtcgtgcaccgtttgctgcaaccgactgctggggtt

SEQ ID NO: 66145 - DNA, 412 bp, Triticum aestivum
  Clone ID: PAT_TA_66145
tcttgaaaaatcaaacgagatgttaagggaggagcttcacaagctgcagagtgaaatgcaactgcttaagaacaacaagcagccagtgattgatgtccggtcttgcgacgcagagatctcgaaattgctggcgaacatgcaaattgccactgccaacgcagctctcttcaaggagaaggtccttgagctcatcgtagcatgcgagagttctgagatcagtgaaatagtacagaaggaggtgttgaaagaggagatcagtcgaaggaactcctacgtggatgcactgaaggacaagctaaatgctgttgagattgagaacaggaggctgaaggttgacctgaatggtgacttcacggtgctaggcgcattgcaaactgaagtcagtgccttggagaaacaaaccctgtcactg

SEQ ID NO: 66146 - DNA, 531 bp, Triticum aestivum
  unsure (1)..(531): unsure at all n locations
  Clone ID: PAT_TA_66146
ctgcagcgctcggctttcgtcgacggcgataggcaacctcggcagctggctgctcgggaaaaacattccggggatagcaagtaaagcctgctcccgctcccacgcccatcctcaacttaccgcggcaccatggcgtccagaagataccactacgtgcctgcatccgccgtcccggatcacctgcggcacgttggtttcctcaacgaccgctagccccgaacaaggttaaggctctagtcttttagcctcttctccacccttcattttttttctccaaatctggaactatgagccattagaattgggtgatttagatgaatttttatactaactgaagcatacgaatggggccttacagcttttccaggaaacatatatagtgtttatttggggaactttccgtgagaatttagtatgactggcacatggatgtatgcttgcactgttgtatgcctatttanaagttagaactaatgcaaagaatgggcaaatactatttacatcaaatgtctatgtccgtgtttcatcttg

SEQ ID NO: 66147 - DNA, 444 bp, Triticum aestivum
  Clone ID: PAT_TA_66147
actcttctaccaaacccttgccccatggaactcgcccgccgagccgctcatcgggccgacgccggcgacatctacggcattcccaccccttccgctgatgagcagatgacgatacaagagctccaccgggaactcttgcacgagaaaatccgccagcgaatcatcgtggacgaactggccaagcagcaggagctggaggctgagttccagcgcgaactcttgaacagtgatgttgatgccaggttccggcagatcacaatgccccaccatggcacatcccctttgcctcatgatgagccactggatgtacccgtgtcgattgcgaggcggcccgtcaaagatcggaccgtggaatgggatcgacctccacggtgcaggccggcgagcgaggaggatgcaccgatcgttggggctaagcagcacaaaaatgcactctctggggtg

SEQ ID NO: 66148 - DNA, 244 bp, Triticum aestivum
  unsure (1)..(244): unsure at all n locations
  Clone ID: PAT_TA_66148
actccacccggcaggtcgtcaccgccctgctccgccactgcatgtaccaagttatccctgctgaanacggccaccaggcgtgggcgtatcttcaggacatgcagagcaacatcgaccttgttctgacagaagtcttcatgcacggcggtctctctgggatcgacctgctcggcaggatcatgaaccacgaggtctgcaaggacatccccgtcatcatgatgtcgtcgcacgattcgatgggcac

SEQ ID NO: 66149 - DNA, 220 bp, Triticum aestivum
  Clone ID: PAT_TA_66149
ctgctgcggctgcagtactactgcgtgctgggggcggtggccggggccgtcctgttcgcgacgctccgctacatgccggccgccggcagcggcgcggccctctccaccacctccgcgctcgccaccgccgcggcgcccgccggggccggggcgggcgagcacaggaagatcaaggggacggcaccggcgcccacgaaggcggccgcgaaggtggtgacga

SEQ ID NO: 66150 - DNA, 328 bp, Triticum aestivum
  Clone ID: PAT_TA_66150
cgggctttggactgctttggactacggtgcactggcgtatgctcgatggtcgttgatcagccgagggcgggcgcttatctttcggcacgcaggcagtggcctgcgcacagggaggctcccaatgccgatggcggtgtccggcgctgatggggcagggtcgcaccggcgatgtctgcttcagggacggcgacgttcgcctctcttcacaaccagcgagaccctgcatgtgcttcccacggaggacgtcgagacctcgcaaagttcacacggaggacgccggggaaacggcttcaacgttggtgtggagtgacagcggacggatctgtgt

SEQ ID NO: 66151 - DNA, 329 bp, Triticum aestivum
  Clone ID: PAT_TA_66151
tgcttgtccggcgctccggccgtctcctgcaccctgccgccaagctcctcggagagcatctgaatttgtaggccgtatgcatcgttctgatgcttaggccggggagtccccccttttcgaaaaaaaatctgaattcaggtaggcgacaagtgttcgacgagtgctggctgcagtgccgggcagtggtgcttcgactgcgaggcgaagctgggcggctcggcggctcccactgcgcccgctccaccgccaccaaccggttgcaactcgttgtcccggttggtactgccagcagccttgccggtccaagcaatcaagatcatcagcaagtc

SEQ ID NO: 66152 - DNA, 462 bp, Triticum aestivum
  Clone ID: PAT_TA_66152
ccacctccttccaccttccccgcaaatccccaccttccccgccggagccaccgcacccaccatcttcctcgccgcccctacaccacctatgcaccctcaccttcttcaccgccggggctcccgtactccacgcgcgggcaaaaccatggactccgccagcacctccatatccaccgccggcttcctagaagtgttgcgccgccggccgcccatggcacagcgacgaggagctcaccgtcccactcctcctggcgcaccgagcagccgcgccccctgccggctagtcgcgacgcccctccccatggtcctcaacctctctctgtgtggactgctctagatccggcatgatccgcgctgtaccgagcttccaccaccggatcccattccccttcttccctcgggcctgccccaacacccgaagcctccaccaccggcgagcgcgggcctccctcccactgcttc

SEQ ID NO: 66153 - DNA, 512 bp, Triticum aestivum
  Clone ID: PAT_TA_66153
cgccgccgtcctcggacccgtccctgccgccaccggcggccatagcctcgagctcccgcccctgcattgcctgccttcccttggcctcttcgctgccaccacatgggcatcttcgttggcccgagtccccaccgatggtggtgagaatatcccatttcccctaaccccatcgctgcatgccttccccagtgccgcggccgtcgacagccccgtccgccggggccttcaccgcccaccgctagctgaggtgcaagacagcgccctcctcttgctcctctcagggaaggatctcgtctccagcaagctcgaccaggcgcccacgccgccaccaaaagcgcgatgtcttgaaaggtttctgcaaagttcgtctactcgtcaccaacagcaacgctcaccctcggcgactacataagtttgcatattggttgtgctagaggcatgccgctggcaccgatgggccctcatttatcttatacaatccatttcaaaatatgacgtgctgatctgatact

SEQ ID NO: 66154 - DNA, 476 bp, Triticum aestivum
  Clone ID: PAT_TA_66154
ccgttcccccttcgcctccttcggtctccagcaacgcaggaaggaaaagctagcaaccatattcatactctcatagtcatatatctattaatctatatgcgggctagcgcttgctagaaagcttcttgctcgtgtactcggagatgggcggatacgaattccgaagggaggagctagatgcactggaatgcttcttacgggatggattaagttgggggccaatgagtctgtcgttgcagctgctcaggcacataacaaatgatttctcccctgaatacgaaattgacacagatgaatttgcagtggtttacctgggggtgcttccaagtgggttccgtatggctgtcaaaaaattccacctgcgtggttgcttggatgacgaaagtgcattcaacaatgacttttctattgcaatgaaggctgctcacaaggacgaagtacgactcataggctactgtcatcacacgcaagagcaa

SEQ ID NO: 66155 - DNA, 291 bp, Triticum aestivum
  Clone ID: PAT_TA_66155
catttcaaaccggcgtaggaagcaaatcgaagccatgcaccaaatttttcaggttatagtccaacttaaaatgaactccacctggtaacatttattctgcatacctgttattttgttaaaactttacttttatcttgaaagaatgcttgctgctaacaaatcatttaagcaagattgtgcgacaggttctccctaatccaagcttaagaacttccactggagtaaaaattggaatgtgcatgggctgtgcaaaatcacttctgaatatgtgaaagtgcaagaacagtataa

SEQ ID NO: 66156 - DNA, 398 bp, Triticum aestivum
  Clone ID: PAT_TA_66156
gtccaccatgctctatctatctatatatatatatggtcatctatgtctatgtgagagacgtagctagcttgccatcaatttgtacctcccggctcttacaccaatggccgatccaagcttcttcgtcggaatcgttgggaacataatctccatactcgtcttcacatctccaattgcgactttccggagggtcgtgcggaacaagagccgggaggagttccggtggctgccctacgtcaccaccctcctctgcacctccctctgggccttctatggcctcctcaagcccggcggcctcctcatcatcaccgtcaacgccgccggcgccgctctgcaggccacctacgtcgccctctacctggcctatgcccccagggacaccaaggtgaagatggcga

SEQ ID NO: 66157 - DNA, 357 bp, Triticum aestivum
  Clone ID: PAT_TA_66157
cagaaggacaagggcgtcgagccctccgagttcgaggacaccgtcgcgcaggctttctttgacctggagaacggcaaccaggagcttaagagcgacctcaaggacctgtacatcaacactgcaatccagatggatgttgttgggaacaggaaggccgtggtgatccatgtgccataccgtctgcgcaagcgcttcaggaagatccatgtcaggctcgtcagggagctcgagaagaagtttagcggcaaggatgttgtctttgttgcaacaagaaggatcgtgaggccacccaagaagggttctgctgttcagcgccctcgcaccaggaccctgacagctgttcatgatggtatcttg

SEQ ID NO: 66158 - DNA, 470 bp, Triticum aestivum
  unsure (1)..(470): unsure at all n locations
  Clone ID: PAT_TA_66158
gcacatgagccaacagaaggccgtcactctggatatggtaagcgtagtggcaccagggaggctaggctccgcaccaagatcctatggatgcggaggatgtgcgtcttgaggcgtcttctgcgcaagtaccgtgaggcgaagaagatcgacaagcacatgtttcatgacatgtacctgaaggtcaaggtaacatgttcaagaacaagagggtcctcatgaagagtatccacaagtccaaggctgagaaggcaagagagaagaccctctctgaccagtttgaggccaagcgtgccaagagcaaggcaagcagggagaggaagattgcgaggagggaggagagatntgctcaggtgcgggtgttgccggttgatggtggcctaagcatttgagtctaactgaaagtgaaccggagcgatgtgcagaaaaaaaaattagcacagagactgaatttgtatactacttagaattta

SEQ ID NO: 66159 - DNA, 576 bp, Triticum aestivum
  Clone ID: PAT_TA_66159
ggtgctctggggcgtcgcccccctcgtcggcgccttctcgccgtgtacactcacaattattgtacagattgatgctacggctgtactgcaggtatacacacatttctgaatttagtcaacacttataacaaaatgttcaccacagaataatccaatttatgcactgcttgtgttacattgagaaatcaagaatgtggcaggttaaatttttcaaagccaattactcctatggtaatttagaaattatgtgcttgtgaatgatgttccttgaatgaccataaaagacgtttggtagctaatttctaatttataaatgaggctaagtatgttaaataaattcagcttcttcttagtccttgtagtatccctattgatattattccaaataaattcaaataaatccaaagccctggagtacttgatcgcgtcaaatcatggacatcgctcgttggcatgcggcacaggtgggcaggggcaccttcggcggcgtagatgggccttgcccgcgcgacagttgatgaggctgagtgccgttggtggctggggcctaggctgctgccgcgagcgacgggggac

SEQ ID NO: 66160 - DNA, 183 bp, Triticum aestivum
  Clone ID: PAT_TA_66160
gctgttgactgttccaagacgggaaccatattgctgtggcaagaaagaattcactcaggatattatcgccagatttgaaggaaacatgttgcatggccctcttgtttcagttgtggcctgatagtgattcagagggcactgacatcaaagtggattccatcgggtgggttcgcgatgatagca

SEQ ID NO: 66161 - DNA, 549 bp, Triticum aestivum
  Clone ID: PAT_TA_66161
ctccctccctccccgcctgccaacccccaatctcccgtcgcagccctcgaatctcccccgagcatcgaccatgtcggcctactgcggcaagtacaaggatgagctcatcaagaacgctgcctacattggcacccctggcaagggtatcctcgctgctgatgagtccaccggcaccatcggcaagcgcttcgccagcatcaatgttgagaacgtggaggacaaccgccgtgccctccgtgagctcctcttctgcacccctggtgccctccagtacctcagcggtgtgatcctcttcgaggagaccctgtaccagagcaccaagggtggcaagcccttcgtcgacatcctcaaggcgggcaatgtcctccccggaatcaaggtggacaagggtaccatcgagcttgctggaaccaacggtgagaccaccacccagggctttgatgaccttggcaagcgctgcgccaagtactatgaggctggtgcccgcttcgccaagtggcgtgcagtccttaagatcggcgccaccgagccatcacagctctccatcga

SEQ ID NO: 66162 - DNA, 374 bp, Triticum aestivum
  Clone ID: PAT_TA_66162
tgtttaatttttctcacctgatgtgctgcgcattctgcaaatattttaagcttcattaagccataacaaagccaatgcaaggattagctaaaactgcttcaagaaatttgaaagaagccacatgctttttgtaagaagaaaaacagtaggagagtatgatatatatataagtggagatatttacgacatggggttgagcccctagaggaacaaagcaaggaggaacattacactgtcaacataagtggaaatataatcgctaagtgggatcctaggccttagcagatgaagccacacggatatcttgcaacaagatgaatcttaaaatgtaggcacagtctaggcaaacccggaatgttgaagatttacttgtt

SEQ ID NO: 66163 - DNA, 401 bp, Triticum aestivum
  Clone ID: PAT_TA_66163
ctcgttttcctttggcgatctccatgatagcactggtctcgttcatctcccatttctctggtatccggcaccaaacaactgtaatcgccatacacccaaaatccccaataaataaatacatacatacacaagaatatctttgtttcgatcggggacccggatattactggtgcttgtcatgcatcttcattacggttcacgatgggatcggtggactactacgagatcctgaatgtcgaccggagcgcgaccgacgacgacctccgcagggcctaccggcagttggccatgcggtggcacccggacaagaatcccaccggcgacaaggactccgaggccaagttcaaggacatcacccaagcctacaacgttctcagcgacgccagtaagagggcagtgta

SEQ ID NO: 66164 - DNA, 146 bp, Triticum aestivum
  Clone ID: PAT_TA_66164
aacgctaaccacccacctattgcccctaatctcacccctcgagcgtgggcggccaccggcgaaagatgccgcgctccagcccgcggcgcggcgggtcccctcccctccccctccctttcggccacaccggtctcctccttaaccac

SEQ ID NO: 66165 - DNA, 366 bp, Triticum aestivum
  Clone ID: PAT_TA_66165
tcggccactcccccgacttcttcctctgtagccgacccagccgccgcactcgtcgccgtgaacaccgccgcttccccatccccgcatccacacagccccgccagggctgctgctccattccccatcaccacgccaccgcacccgcttcctccatccacgccgattgagacagagagaggggggacagggtcgtggagcgccgccacacgcctggatctgggtgctactgtgcgcatccttgcccgatctggacgcctccgcgcgcgtccgtgcccgatctggacgcctccgcgcgcgtacatgccgcatctggccgccacgattgaggattggtggaggagcacgggaaacggcttggttgtggag

SEQ ID NO: 66166 - DNA, 515 bp, Triticum aestivum
  Clone ID: PAT_TA_66166
tgccccgtggtccccaaccgccgtcaacgccaacgccaacggaaatgggaagacctccccgaagctcgcctctcccaaacatcttccgggggagaggacggtgaagaagctaaggctgtccaaggcgctgacgatacctgagggcacgacggtctacgacgcgtcccggcgaatggcggcgaggcgggtcgacgcggtgctgctcaccgatgcccaaggcctcctatctggcatagtcaccgataaggatatatccacacgagtgattgcagaggggctgcgggtggagcaaaccatcatgtccaagatcatgacccgaaatcctacttatgtcactgctgactcacttgctattgaggcattgcaaaagatggttcaaggtaaatttagacacctcccagttgtggaaaatggtgaggttatggctatgctagacattgcaaaatgcctttatgatgctatagcaagattggaaaaggcagctgaacaagggagtgcgatagcagctgcagtag

SEQ ID NO: 66167 - DNA, 343 bp, Triticum aestivum
  Clone ID: PAT_TA_66167
ctgacattttttatgccactcaaaagcgtgaactaccaagtgcatacaaattatttaccggtgagatgctaatgcatttctatatttgtcagtagatactcccattatgtttgagaaaatctggaatcatatattatatgccatgatgctaatggtgtcacgatacacatttgagtatacaggtggaaaattcttaatcatctattcgtttagtgtgtgtcgttgacctgaccgttggttaatggttattcatgcatggcattatattatcaagcatcgactcatagtttgtcacagttatctttgctttactactgtaccaccctgaccaataccacatgaa

SEQ ID NO: 66168 - DNA, 532 bp, Triticum aestivum
  Clone ID: PAT_TA_66168
cgaacaaggctctattttacatcggaatcgcatatacattctctaatgaacgtacttcgatactgctatttggacgagtctctgaatggagaagagagtcttatctgcaaaaatgcttcagatcatctatttaaaacaaaggaacttgactacatgagttacattgtgttgcgtatgtttgagaatacggaggtattaaaattcccttaatcatgtgtaatggatagttgtacctttgtactgttagttgctaacttcacgcacgaaaagaaaatcagtaaaacttttactgtgtcaatctttgttttttagaaaaaagatctactattaaatgaatcagtatacttgctatcaaattgaccaaaaagttgtgaaacctgccagtaaatagctaatgtagttcccatcttttggataaacaagtttgaaacccatcttgccagcattatgccaggaaaaaacatacagcttcaccaattgagcatgtgtgggtgtgtgactctgtgcttcgggtgtctctagtctctacccc

SEQ ID NO: 66169 - DNA, 447 bp, Triticum aestivum
  Clone ID: PAT_TA_66169
catgatgttcccgctgttgttgagaacccttcttcccttggttctcggtcaggtccaaacactgctcagtatgttcagcctttctttgccccagaatcagtccagcagcaaccaggagctccattggtagaaatttttcctgaaagagcatccgctggacccatgctatcaccgcttgatggtaaagtatctgttgctgcggtaccccttgctgatcatttgtccaggttggacattaacacaacaaagaaattggaaggagcagatgatgaaaggcacactcaaaatgtgactgaaacaaaaccttcacacgctgcgagtgaccctagcaccttggttcacaatgttggagttgatctccaacggggcaaacctacagaacatgacggtggggctgttgcattgcagcagtgtggggatatatcggagaacagattaaatatcctt

SEQ ID NO: 66170 - DNA, 246 bp, Triticum aestivum
  Clone ID: PAT_TA_66170
cccctctccgtcctcgtcgtctccctctcccgcttccccccacccaaccaacacgctacgccaggcgcgagaggcaccagcggccatgaagggcggcggagccatcaggagcggcggcgggggaggcggcgggctgatgcggacgcggctgcggctccccacgccctccttgatcccttaccagattttgagctggcaaccccgtgcattatattttccacaatttgcaacagcagaacagtgtga

SEQ ID NO: 66171 - DNA, 193 bp, Triticum aestivum
  Clone ID: PAT_TA_66171
cggcatcacctcggacgcgcggcggcgtgcagccatggcgatggtggcacaggcgggcttcggcctcacccgcgtcgtcatgctcgtcggcgcgggcgtggccggctccgtcgtcctacgaaacggccgcctctcggagatcctcaccgagatacaggagtttctggagaagggggagatgggtaagggagga

SEQ ID NO: 66172 - DNA, 517 bp, Triticum aestivum
  Clone ID: PAT_TA_66172
ttgttcacagaaatgttcttacctagcattggatggtcatcgccatcaagaatccagccgctggtagaaaccgtaaagtgtttgcagcttccagggttcagtgacgacttgtcttggctaaaacaaggatcttacatgggcaggcagatccaagatcagaagctatatcttgaggagtgcttgacgagatatctgacccagtcggctcagttgttaaatggagcccaggcggttgctgaggcaaagattatggtgcagaaaggtgttgatcttgagctccgtgactcgaatcactatcttgtgccgaactgggttactatcttccggcggatctacaactggaggttagcgaggctttctaccggagatttctcagaagcttatgtcctgagtcagcgtctttaccagccccctgcaacacagcatgggctcactgccaacagcgatactataggcgaagcgcccattttggaggaccatgacatgatgcctgctgtgccatctggtctctcgctag

SEQ ID NO: 66173 - DNA, 273 bp, Triticum aestivum
  Clone ID: PAT_TA_66173
tctgtgttgctgtcttcgagcgccggccagaagccgcggccgcttgcttcgcggacattgcggcgcgcgccggaattcttgatttcctcaagtttggccgcgccgtggctgatgccaagaaggaccccatcaagctcctgaggctgcttgatgtgtttgattccctcagtaagctcagattggacttcaaccggttgtttggtggaaaggcatgcctggagatccaaagcaggaccagagagcttgtgaagagggtggtggatggttctgttg

SEQ ID NO: 66174 - DNA, 113 bp, Triticum aestivum
  Clone ID: PAT_TA_66174
cccgtcctgaacaccgcctacaacgccggtatatgatccaaacgattgccggggagtggaacccgaacatgaagtctgttttcgcgggggtagggatggagcagttttgcaag

SEQ ID NO: 66175 - DNA, 464 bp, Triticum aestivum
  Clone ID: PAT_TA_66175
tcccgccacgttctccacgactcctgtcctgctcgccgtcgcagcggcctcgcatcgcagcccctgggctcgggcaggtaaccggtgcccttctcgatctgaaatttgcatctcggttggttgattgatggatggtcaccttcaaaaaatcgcctgttcaagcacggaataaagagaagtcctgctcctgagggacattgtgtttccgcatcagttccttctcatggtggactgacactgactgtagaaacttcagcaattaaagtgcattcatcggttcaagctttgtaatcaagaaaattgggctgaagaaggctggggattctggggctagagcaagagcaggttctggaggtcattcatacttgtatgaaccattatggtggctgggaatggtcactatgattctgggcgagatagcaaactttgcagcatacgcatttgcccctgccatacttgttact

SEQ ID NO: 66176 - DNA, 487 bp, Triticum aestivum
  Clone ID: PAT_TA_66176
ctgggcattgattcacggaccgcgcttgcttttaccatccctctacttctggtcctcttccacctcgcgagcagagcagttcacacttgagagaggcagagacgttgaggatgcaggctgctggtgctacttcggaggaaaggagcaggggctcgccgtcggccatggagaagggcggcgaccagagcgccaggaaggcgaggctggagctggtggtggccaacggccctgtgaagcgacagatggtcgtgcacgaggcgggcgagatcgtgccggcggaacagggcccgacgatggaggtctccgtcaagatggacgtcgccgtgctccactgccccttctgcttcctccccttcaagccaccagtcttccagtgcagcggcggccacctggcctgcggcgactgccgcggcgagcggcccgggagccattggcagtgcgagaggtgcgagcgcggcggccccttccacatacgcagcacggcgat

SEQ ID NO: 66177 - DNA, 535 bp, Triticum aestivum
  unsure (1)..(535): unsure at all n locations
  Clone ID: PAT_TA_66177
gcgcgcacacgacagcaggcgccgcgatctcgcgcaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccnaggtctcatttttgtcgtggacagcaatgacagagagcgtgttgttgaggcaagagatgagcttcaccggatgctgaatgaggatgagctgcgtgatgctgtgctgctggtgtttgcaaacaagcaagatcttcctaatgccatgaatgctgctgaaatcactgacaagcttggcctgcattccctgcgccagcgacactggtacatccagagcacatgtgctacctctgggg

SEQ ID NO: 66178 - DNA, 600 bp, Triticum aestivum
  Clone ID: PAT_TA_66178
ggcaattccacgacctacagagttctccgttagtcggaatcgcctatcagggcatgtaccaaattcattaggtaacctttccaatcaactccaggagatatacttggcagaaaatcaactatcaggggattttccttccggcatagcaaaccttcgcaacttgtttattctaacattggggatgaatcaatttacaggtgtggtcccagagtggattggatctgtcaagattttgcagcaatttggtttagaagcaaacttctttacgggggtcattccgtcatccttgtcaaacttgtctcaattgggagagctctatctatcctcgaaccagttcattggtcacataccagcaagctttggaaacttttcgacgcttcaaaatttggacatttccaacaacaatcttcatggtagggttccattagagatctttaaaatcccaacaatatttcatattaatttttctttcaacaatctaaatggacaacttcctaccgacattggcaatgccaaacaactcgtacatttggtactttcatcaaacacactatcccgtgatattcccaaaactctgggtgattgtgaaagtttagaaga

SEQ ID NO: 66179 - DNA, 503 bp, Triticum aestivum
  Clone ID: PAT_TA_66179
tatccccacacctcctctccgttctcatcctatgttcgcccctgcggctaaccctagccgccaactcgtgttgcgagcactgaggatgggagcggggcggccgcctcacggggtggagcggctggggcgtcaccacttgggtgcagaagcagtggcagcggtggcgctgtgctgtggcggaggagaaggatagcgatgtggtggttcgagcctggagagtagcgctgtcctatattgaggtggactccgatgagaagcgcctaaacaagcttggttacaaggaagagctccggagggagatgacgctggccatcactttctccaagatgacgatcttcactgggatcacgtctttgtacggtagcatcctccaattcgtgaggccggccagcctcgtgcggggctgggtcatcgtctccttcttcacctggttcatcggtgtcgtcatgttggggatttctccttccctttctttgaacctctaactactgaagctgaaaatg

SEQ ID NO: 66180 - DNA, 684 bp, Triticum aestivum
  Clone ID: PAT_TA_66180
tgcaagccaaaatttggtttacctaactcacaggttggctcaaaaatggaccaccccgcaatggctcaacatcaacagcagtcccaccaactacaacaacagcagcaggtccagcaatcacagcaaagttctgcggttcagcaacagcaagcccaattgctacagcagaatgccattcatctccagcagcagcaagaacatctccaacgtcagcagtcactgccacagcagcagcaagaacatctccagaggcagcagtcacagccacagcagcagttgaagaccgctgcaagtatgccgtcaatggagcagcataagctgagagaacaacagccccaaggtggacaggctgtttcgcaagcacaaatgttgagccagattttccagccatcttcctctcagctacaacagttgggtttaccaaagtcgcctacccagcgcccaggatttccaggtttaccaactgcgtcttctttgcagcagccagctctaggccaggcaccacaggtccagcaagcagcagaatatcagcaggcccttttacagagccagcaacagcagttacaacaactgtcacaaccagaaatgcagctccagctgcttcaaaagatccagcagcaaaatatgttatctcaactgaacccgcagcatcagtcgcaattgatgcaacagttatctcagaaa

SEQ ID NO: 66181 - DNA, 604 bp, Triticum aestivum
  Clone ID: PAT_TA_66181
aaacgataaaacagtggtgatgtgaggtccgaaatggtttgtgattttggtttcatccccaatctctccagctagcttcttcttcacatcatatcatatttgcacctgctactgcatcatggattggatggtcacctactagctaagtagcttagcttgtattgccattgaattagtcaatactgtttcactttgcttgtttcttgtactaggtctgtcagttacagcataaacaaacaaattgcttagctttcaactatgaatacatagctagctgaacctgttctttctttctttctttcttcagagctatgaattatatcggtcaagctgctattttgcagtgctcgatgatactattgctgcttgtatactgatacatgtggtgatatttacctaaactgaagttgtgaatgtaccattattttcctgctgctacttatccctggctcacctgctctagttggtttcaattgacatttgtctcattcagcactcttgactataaatgtgttgttttaatcctgatgatgatgttgtagtataaggtggacaccatattcctgtttaaatccaaaaggaataaagcaatcatgtttgttcc

SEQ ID NO: 66182 - DNA, 336 bp, Triticum aestivum
  unsure (1)..(336): unsure at all n locations
  Clone ID: PAT_TA_66182
tgatttctattccaccatcaccagggccaggtttgaggagctcaacatggacctcttcaggaagtgcatggagccagtggagaagtgcctgagggatgccaagatggacaagagcactatccatgatgttgtgcttgttggtggttccaccagaatccccagaggtcagcagctgctgcaggacttcttcaacgggaaggagctctgcggagcatcaaccctgatgaagctgttgcctacggtgctgccgtccaggctgcaatcctcancggtgaggggaacgagaaggtgcaggaccttctcctcctggatgtcaccccactgtctcttggtctt

SEQ ID NO: 66183 - DNA, 447 bp, Triticum aestivum
  Clone ID: PAT_TA_66183
tttcatgtgactcttcaatttgcagcaatctagtggagagttattcacctgaaatgaacagtttgtaagattatttatcatgttgcttcaaaagacttaaagaactttcgaccaacagaccaatccagacataataacatcttcttttactggggggtgattctacctttttgtgcagaaataatgtccagccatgctgggggagagaacttcccatgtgcttcgaatggacaatacagatcatccttgcatatcaattgtggagacaaagaagcaattgtcaatggcgtaaaatatgaaggtgacaccacaccaaaaggtgcttccatgttgtatttaagcccagactcaaactgggcattcagcagcactgggaacttcatggacgacaacatcaatgatgacaactacattgcctcaaacacatcaaaactgaccatgcccaac

SEQ ID NO: 66184 - DNA, 178 bp, Triticum aestivum
  Clone ID: PAT_TA_66184
cgtggaccctgctccgcgacacgacggtgccaacgatgtccccacacggcaagggagacaacgcacccgtccgactgctgcaatgcgccggtaattcaacagtcgccgtacctgcaccggtgcagcgacaacgcgagggggggcatgacgtccaacaagatcccgttggcgccaccag

SEQ ID NO: 66185 - DNA, 157 bp, Triticum aestivum
  Clone ID: PAT_TA_66185
gtgctggtgcgcgacgacggccacatcatgctctccgacttcgacctgtcgctgcagcagtgcgcggtgtcgccggcgctcgtcagggcgccggcgtgcgactcccgaccccagagagcaggcggcgccttctgcgcgcggccctccgcctgcatgg

SEQ ID NO: 66186 - DNA, 249 bp, Triticum aestivum
  Clone ID: PAT_TA_66186
ctcttgcccctggccgattggtcgccatgtttcgttcctggggaacgtagccttggacaacgtgcatgggttatatgcgaatcgactgaattttctttgacgttgtaagtcgatttcgggtagaggaagaaggtgacccatggatgttgcagtgctatgagagctgtgacctcgacggcgatgtcgagctaagacctctccggatactgagagcagcctcgcaagaagggatggggtgtggtggctcgc

SEQ ID NO: 66187 - DNA, 396 bp, Triticum aestivum
  Clone ID: PAT_TA_66187
gggggccacgtgcgggtgcgcgtcgcggggaggcggtggccggggcggctcgtgcgcgccgtggccgccatggagacctccgcatggccgtgctgcacctcgccgtcacctccgtgggccacgacgccgtggtctactgcttcaaccttaagatggaggacgggtgcgaggtgtcgacggcggacgatgtggccacggtggtgcaccagatcttcgcctacgccgccggctcatgctgctagccgaggcgcgcaccggccggacggcgagtgggcgacgacgacgtcgacgccgaagctaacgtactaccccgtagttcaaggagcctgagcgagcagctgggcacgcaacacgtagtaggcgacgataagtcaaagtggcagagcagatgagcac

SEQ ID NO: 66188 - DNA, 133 bp, Triticum aestivum
  Clone ID: PAT_TA_66188
ccgcagccgccagcggcactcaagattggtacgtatcgaccaattcactctccacgcctatacatgtacagtactgtatatgatatgagcgctcaagtaaaagatgaagcaagactgcagtgagctcatcacg

SEQ ID NO: 66189 - DNA, 414 bp, Triticum aestivum
  Clone ID: PAT_TA_66189
ctccgcaccagccccttctcacctttgacgccgccgcctcctctgctctccctcaattctcctcgcgccgccgcacctactccgagcccctcctcttccccatgccaccggcctccctcctctgcttctctcatcgtcggtcgcggatctcctcgccgcggttgcagtggccgaacaagacgaagaggagctgcagcgttgggggcgtgcagcggcctcctcgcggcggccagctgctcgacgcgccgcgccaccgctgtgggagatggtgaacacgaggagatgcagggtggcctcgccgaaagagggtggcgccgggaaccacccactggcgaaggatcgcgtgggctggcacttccccgcgatgccctccttccctgacttcgccgtcgacactgccccctcccctcccgt

SEQ ID NO: 66190 - DNA, 555 bp, Triticum aestivum
  Clone ID: PAT_TA_66190
tagtagaatcttcttgattgatgattttgtagccttctcttagttgtactggattaattcttaaaattggatcatttaaaattagttagatttaatgagttgtttcgctattttcaaataagtagtttaagcccttattgtgttctggagcttattctttctgccttcttatgattgatttatgctctcataagcttaattataactattggcgtataatctcatggctcaaaatcttagttgttgaatgtattaaaatttataagatctggagtttgcactatatttcatccagcggtattcccagtaattgaatgttaagagtactcatgatcccaggttgtacattcagttactgggaaatgcttttattttgtaggccagttttacattcactttttcaataacgagatgaccatgagcagtgtatcaaggtcttttatcaatactaacgttatgttaagattagtaaaagaaggattgatagcggcataccttaactcgactgatgctttaactgctgcctctctaagccttgattagccatggagatac

SEQ ID NO: 66191 - DNA, 594 bp, Triticum aestivum
  unsure (1)..(594): unsure at all n locations
  Clone ID: PAT_TA_66191
ggtttatactccactgtggcaaaattgtagccagcactctaccccttttctgtgagtgagaaatgtgtcctgttagattttgtgggttgccaaccattatttgcatccacattgcaaatcatcatcgattaagtaagtattggggtgtttgagacagaggggatcggattctttttttttttctatcagtgggggggctgatttaatggtttttgatttcatgcacggtggagcgacgggggtgcacaaaaaggaccggctagaaagattgcctttgatgcaaagcttgcttttggcatgcatagcttgcagtgtgccagtgatatatgtcgccaccacattggtgtcaacatggcaaagccgcaaaggcctatttctagcttagctctgaggggcttgcagaattaggatgcatacgtgtccctcactccgacgctccactgggagtaatgtatatgcctctcatgccaagatgcgcatgcatggnttagtttttgggatgctaataacatcagtgtaactttagtgctataatttgcttttttaggaagagtactcttttagaacgatataatcttagtactataactatcc

SEQ ID NO: 66192 - DNA, 522 bp, Triticum aestivum
  Clone ID: PAT_TA_66192
ctatgggtggtggtgcatggccgttcttagttggtggagcgatttgtctggttaattccgttaacgaacgagacctcagcctgctaactagctatgcggagccatccctccgcagctagcttcttagagggactatcgccgtttaggcgacggaagtttgaggggggggcggtctgtgatgcccttagatgttctgggccgcacgcgcgggggagtgatgtattcaacgagtataaagcctgagcctaagccgatgccgaaacccgaacctaagccagagcccaagcctgagccgatgccaaaaccggaacccaagcctgagcccaagcctgagccgatgccaaaaccggaacccaagcccgagcccaagcccgagccgatgccaaaaccggaaccaaagcctgagcccaagccttacccaatgcccaaacctgagcctaagcctgagcccaaacccgagccgatgccaaaaccagaaccaaagccagagcccaaacccgagccgatgccaaagccggaacc

SEQ ID NO: 66193 - DNA, 172 bp, Triticum aestivum
  Clone ID: PAT_TA_66193
cgggcccttcggcgccacggccaccattctgctctgcgccgttgtgcggctggagccggaggagatcgtcctcagcttaccgtggggcgtagaattcgatgaccggcggaacctcgtccggctgccgtgcttccagcggaccaaatctctcatgatggaaaggcttctcttc

SEQ ID NO: 66194 - DNA, 138 bp, Triticum aestivum
  Clone ID: PAT_TA_66194
tgttacagtatttctcgcaacgggatacagtatcaggcaaaaccggggacaacacatccaacaaccaactctcgtcttaaccccctcgcaaaatctggcgttggaagctgccttgccaaaacatatttccccctcccc

SEQ ID NO: 66195 - DNA, 134 bp, Triticum aestivum
  Clone ID: PAT_TA_66195
tcaggtagaacagactacccacacccaacggacttgacatggcaagagtacattcatacgagttcaacaggggcacgacggcctcaaaagtccattcacttcgtcgcagggtggggtgatactttggctggtta

SEQ ID NO: 66196 - DNA, 359 bp, Triticum aestivum
  Clone ID: PAT_TA_66196
tgaaaaccattagaaatgcatgctcataactagaacaaacaaataaatgaataaactgcatgcatgctggcaacatcaaatgaaataatcctcctcctactcctcttatttacacacacacgcgcacaattgtgacaaaactaatgacaatcctcttagcttagcagcttcttggtttagcatgtgcttcttcattcctcaactgcatctgcccatgcagctctccctgcgctggctcgacatgaattcttatgatgcaagtggctgcgcctgcaacttggtttctggttcctcgtgcaaaaaggaccaatgtcctgatttccatagcaacctcaggatgcctgcagccatgcgcaatc

SEQ ID NO: 66197 - DNA, 354 bp, Triticum aestivum
  Clone ID: PAT_TA_66197
caccccgccgcccgctcctctcctctcctcctccctcctccctccgacgagcgagggcctcctccggcccccgcagcagccggcgagcgcggccccgacgcgcccaccccgcctgcccctgccgtcctccgcccccggtcacctccgcagcagccggcgagccaaggacggtgccgtgaccctcgcctttcacctcccgccgtctcttcctgcgcgtggccggcggctgctctccttcgatcgctgcctgcccgtggttttcttgcaatggtttttggtggcggcttcaaatttttagtgggagtgggatgtggcgtctatgtggctcacaactacaacgctccaaatgtcaag

SEQ ID NO: 66198 - DNA, 403 bp, Triticum aestivum
  Clone ID: PAT_TA_66198
cattagcatcacccttcctctcaaaacgcaatgtagcaacaaacaaattcactctgacaacagttcatgaaaagttcattgcaacctaattgatattctcatgggtaccaaatcgaaaagtaatacatcactccaaaattttccaacaaaactgcagcagcaacagcaaaatcccaacatgtgaccgtcgtcacaccctggcccttcaatcctgaacgcagcaattgtttccacatgtgcaagagaatttcaaacatgatcaaacatatcaagtcggcggactgagcttgttctcgtcgtcctcagcgggtgtacagcagtatcgctgaatcaccaaaggagcgtgggatttcttcttctttgatgccctctcaatcttcttgacccttcggcgaagcctttg

SEQ ID NO: 66199 - DNA, 109 bp, Triticum aestivum
  Clone ID: PAT_TA_66199
gccctgctgcacccaactcccagatggcttgtgtaggctcccgtatttggagtggataatggtggacggggctccagtaatcaagtgtattggtcctgaatttgttcaa

SEQ ID NO: 66200 - DNA, 564 bp, Triticum aestivum
  Clone ID: PAT_TA_66200
ccaacacctggcccccactgtgatggcttcctcggccacctccgtcgcacccttccaggtctcaagtcgaccgccggcctgcccgtcagccgccgctccagcagcgccggcctcagcagcgtcagcaacggcggaaggatcaggtgcatgcaggtgtggccgattgagggcatcaagaagttcgagactctgtcttacttgccacccctctccacggaggccctcctgaagcaggtcgactacttgatccgctccaagtgggtgccctgcctcgagttcagcaaggttggcttcgttttccgtgagcacaacagctcccccgggtactacgatggtcgatactggacaatgtggaagctgcctatgttcgggtgcaccgacgctacacaggtgctcaacgaggtggaggaggtcaagaaagagtaccctgacgcctatgtccgcgtcatcggcttcgacaacctacgccaggtgcagtgcgtcagcttcattgccttcaggccaccgggttgcgaagagtctggcaaggcctaaactacgagttgaaacaatggcctatgtatg

SEQ ID NO: 66201 - DNA, 644 bp, Triticum aestivum
  unsure (1)..(644): unsure at all n locations
  Clone ID: PAT_TA_66201
actgctccatctgcttcgagcccctctgccctcccctctaccaggtactaaattaaaaattgaccggacgaaggaagggatgttgctctgccacattattcatgctgctgccgcttgatctctcctctgccgtgcctaattatcggaattcgctaatggagctggcatcgcttctgttgagctaattgagaaaatccatagctatggcaagaggggatcagagatgatgataggcagcaaattaagcagttccttaggacactgagaccacagaacaattttgtaaattcattcttgagtcaatatccccattagtcctgtcaactgaaccagttgaactggtctgacactcacacagcgtcctgatcctaatttgtcttggccacacccagacacaaatctctgcatatggaaggagaactaattttgggattcaaggcactctgatttccctttggttggttgctctgtttcatttccttctgaaacagcagtttctatcttttacgttctagatcaagtaattgtcaaactgtcgagcaagtnagaaataaagatcacactgatctactctatatagttgaagtctcacggtatattgtttctcttcagattcctccctcaccgagctgtgccttttcttc

SEQ ID NO: 66202 - DNA, 619 bp, Triticum aestivum
  Clone ID: PAT_TA_66202
ccattgtttgcatcaaaatgaaacatattgagaaaacataggatgccttttccctaatcagcacatgttacttctctggttgtgcccaaagtacacccaatacgcgtgattcttaatgataaatttttcatagaagtacatactgttacaacgttgtgcattacatttgctatgttaaatctttgtattctgacagatcttctactgaagaaacacacataagtatgtgtttaatgggatgtggctgttcatgcttagtttaattctttgttctggtttgcagtgccgtaagagaaaactgaaagtttcagttgtagctgttccaaagacaattgacaatgatatacttttcatggataagacttttggttttgacacagctgttgaagaagctcaacgtgcaatcaattctgcctatatagaggcacgtagtgcatatcatggagttgggttggtcaaattaatgggaagaagcactgggttcatagccatgcatgcttctctttctagcggacagattgatgtctgcctaatacctgaggtatgtaactgaaaacactgctgatggagcttcaaatctgtctttgcttcacatttactaacacaagcgcacaatctg

SEQ ID NO: 66203 - DNA, 522 bp, Triticum aestivum
  unsure (1)..(522): unsure at all n locations
  Clone ID: PAT_TA_66203
gtcgttcggcgcgaggcgcgccacggtggaggcccgacgagagctcctggtgagcgcgctctcggcgtgcgcgcacctgggcgcctacgacgtcggccggagcgtccactgcgcgctgctgaggaataccgtgacgctgaacacgttcatggagacgtccctggtggacatgtactccaagtgcggctgcatcganaaggcaatggcggtgttcgacagaatggacggcaagaagaacgagtggacgtacagcgccatggtgtccggcttggcgttgcacgggaacgggcgcaaggcgctgcaggtgttcgacgcgatgatcatggagggacaccagcccgacgaggccgtgtacgtcggcgtgctgaacgcgtgcagccgctcggggctgctcgaggaaggcctccggtgcttcgactggatgcggcttgagcgcaaggtggctcccaatgcgcagcactacggttgcatggtggacctcatggcccgcgcggggaggctggacgaagcgcgcgctctcat

SEQ ID NO: 66204 - DNA, 226 bp, Triticum aestivum
  Clone ID: PAT_TA_66204
tgactaggttgcagcgcgccgcaccatggcgtggcaatggcagcaaacaatggccacgatgagtacatgctttcaggcgtccgtccgctgcgcggcggcggctgggcggtctgcccactacggtcccagctcctgggattacgactccctcctccgactctcgcccaacaatggcggacaggcagatcaagtcgataagttgaaggcctgcgtgagggagcggctg

SEQ ID NO: 66205 - DNA, 465 bp, Triticum aestivum
  unsure (1)..(465): unsure at all n locations
  Clone ID: PAT_TA_66205
aggtgtgctgtttgaccatcatacgaagaggtaagacttaatgagctaggttgttctgtatgtcttgccaatttatttattttagaatactaacaaaaaataaattcatctgctcgtgtctttggattggaggataatgactgcttccaaagcattttgcttccggcaaagtaatagttgtgcaacattgattaaacaaatgtccagcaagtcagaaatgacccggaagagattttgttgtatttgatagggccacttatttcatcaatccattgcttctacgtggagaatttactattattcatatggcaaagaagcactgatctgcagttaaagtgaagaagaaattcttgaacctgnagaagagaatcatgttttcacaaaatgatgagaagatctgctaatatggtaataatacaccccagttaaatagacaacgttttctgcattgtgcgctcttgtctc

SEQ ID NO: 66206 - DNA, 145 bp, Triticum aestivum
  Clone ID: PAT_TA_66206
ctctgttcgcgtccaccggggacgacccgcgccgcgacgtgcggatcctcatcgtcaactgcagcctgttcaacccgacgccgtccctggcgtccatgatcatccaccattacaagatgcgcgaggatgtcaagtcgttcaacct

SEQ ID NO: 66207 - DNA, 524 bp, Triticum aestivum
  Clone ID: PAT_TA_66207
ctccatgccaatcctggtgttactcaacatcgacctcgagacggccggctgggggttccttcttgccgttgaggacttccacgactgagtccacagtaccacccagtaagctctttttcttccttttcctctctgaaattttgtttagttctcttcttgatctggttcctaatacagaactcgagcccgatcttgatttcttggttatgtcctgcactattgttgttgatacaaattcatcgaataacttctaatgaagacggaataataaaagttatattgttcttctatttcacgacttactgtgatttcttcatggtttgtgccaagtacggtgcaggttcatgtgcccctgctaaccgtcatatttttcaggttaaagaaaaggtatgggcatggacctctaatatttctctatacatttgacaatttgattatttctcaaaaaagatagtaaatccatcattgctgatatgtagatgtaggagaaattatatttttcagttttgtaactactgacggag

SEQ ID NO: 66208 - DNA, 384 bp, Triticum aestivum
  unsure (1)..(384): unsure at all n locations
  Clone ID: PAT_TA_66208
gtcctcaatgcggcaaggcaagtctggctcgaccccatgagtcaacgagactcctggccaactcccggcagaacatccggaagctggtaaaggatggtttcatcatcaggaagcctcagaagatccactccaggtctcgtgcaaggagggcacatgaggccaagcagaagggccgtcactctggatatggtaagcgtangggtaccagggaggctaggctccccaccaagatcctgtggatgcggaggatgcgcgtcctgaagcgccttctgcgcaagtaccgtgaggccaagaagatcgacaagcacatgtaccatgacatgtacctgaaggtcaaaggtaacatgttcaagaacaagagggtcctcatggagagtatccaca

SEQ ID NO: 66209 - DNA, 533 bp, Triticum aestivum
  Clone ID: PAT_TA_66209
cgttccagccggcacatgcgcaggcgcgatttccacattattatcccgcttccgctctagcaaaaagcaagttgtataaaactatacttgggcatctataaccgcggtcatctaatttgagccactatgcgtccgacctgtccgggcacgccggctggggtgacccggcagaccatatttctcgcatttgacagacacatactcatatgccttagttaaatccatacaagaccatgcaggcgacgtttctacgtagatcaacacgcgaacatagcaatctggcaaagatgcatcacgagacgcagctacctagtaccatggccttgtacagtttggtcgttcctccatgaccgcgtgctcgatcgatcgagatgtagcggcgctcggcaagatgttgacacccccttttatcgctgagaagtacgtaggtcttgatagctcatggctggtattgcagaaaaatcagtgtgccttccctgtgttgtttcttcacttcaatatgcacttgtgccttttcagctcaatgtctggac

SEQ ID NO: 66210 - DNA, 425 bp, Triticum aestivum
  Clone ID: PAT_TA_66210
cgaatgcatccggtcgatcccagcgatcggaggagcaggatccggatcaaggcaagaaatgtgggggcgagggagataatggcaggcgcctccccttcttgaaactgctctgctctccttgaagctcgcaatcatggccctcctctgctggaactgctctcctctccttgaagctcgcaatcgtggcgtattattcattcatggctggtaaattcgcaaacctttcttatgcccagtggtactatataatgctgccctccctgactgtatgcacacactactcccgcatcttcatcttcttcagcaccatgctaaggtgatgtttatgcacaattgatttgggcagattatgaagattcctactgtccatttttgtgctcagctgttcatcatctctcaaatggctcttggacaggtaattactc

SEQ ID NO: 66211 - DNA, 254 bp, Triticum aestivum
  Clone ID: PAT_TA_66211
gctacgtacgcctcgcttcacttaccacagaccacggacaacccaggcaaaaacacaatggccgctccttctcccgccgtcgccgccgtcagcagtgcgccctcgtccgggctcctgccggcgcggcgcgcggcgccgtgcagcgccgtccaggtccagctgccgtcgataaggagagccgcgccggggggcaggatggcgacggtggcgcgcgcggtgggcgacgtgggggcggagggcaacacgtacctcat

SEQ ID NO: 66212 - DNA, 257 bp, Triticum aestivum
  Clone ID: PAT_TA_66212
cttacaagatacatactacaaaaagtgaaaatatttctggagcacagaacacatcagtagagtgaaactacgcatggtcctggccctttattgtgccttctttgtcgattcaccgaattatacatggcttccctccttgtggggggcttcttttaaatagcggaggtgttccaaaataagccacacgatggggatgagctcaccaccggtgctaagcttcttggcatgtgactccctaatgcaccggttggctgcgt

SEQ ID NO: 66213 - DNA, 463 bp, Triticum aestivum
  Clone ID: PAT_TA_66213
catccacatggtctcgctcccggacggcatgggccccgacggcgaccgcaccgacatcgccttgctgggcagcggcttgccggcggccatgctcggacccctcgaggagatgatcaggtccaagaagatcaagtgggtgatcgccgatgcgtccatgtgctgggcgatggagctggccgccacggccggcgtccgcgtgggcctgttctcgactttctcggccgccgtgttcgcgctccggctgcgcgtgcccaagctgatcgacgatggcgtcctcgacgagtctgggaacgtgaagaggaacgagacgatccagctgagccccaagatgccgccgatcgaggctgccgagctaccatgggtctgtgtgagcagcttgccggagagacgcaggttgatgattcagatcttgctcaagaccaacccggtgataccgctggccgccatcgtcatctgcaacacg

SEQ ID NO: 66214 - DNA, 491 bp, Triticum aestivum
  unsure (1)..(491): unsure at all n locations
  Clone ID: PAT_TA_66214
gctttgcatcttgtgtttgcatcaaaaaatgcgccatcagtgtgaagcctgtatgtggcagtgacggagtcacgtatgacagccagtgtgacctcgacatggttaactgcaatgaaaacagtgacattagagttgcttctcaaggcagatgcccttcttgcgaccccaaatcctgtaagaatggagccgtttgcagtggtggcctcacttgcgaatgcgtgaataagtgtggcaacgagcaaaaccaaatgtgtggctctgatggcgtcacatacgcgaatccctgtcgcctcaagcttgcaacatgcatatcagagggtttcatcactttacttcgtacgggagtgtgtgctacagcaccttcgcctactccgcgcgtttccacaccttacaactccaattcttattcctcggcctcgactccttatgcttnctctttcgcaacagctccctcgagtcggggtacctcagactcaggcggcagcgttcct

SEQ ID NO: 66215 - DNA, 513 bp, Triticum aestivum
  Clone ID: PAT_TA_66215
tgttggtggccgcaggtggagccggggctgagcgcgtacgccggccggccgcaggaggcggccaagtccatcgtgcctctgctggagaaggccaagagcaccgtgccccgctcgctcatgaagaaaacgcccgttaaactaggggcgacggctgggctcaggctcatcggagacgagaaagcagagcaaattcttgaagcagtgagggatgctgtccacagccagagcaaattccagtacaaccctagttggatcaatgtcctcaaggggtctcaggaagggtcttacctgtgggaggagactactccaagacggtgggtgtgatcgaccttggaggcgggtcagtgcagatggcatatgccatctccgcggatgccgccgctaccgctcccggggtgcctcaaggggacgatccatacgtcaccaaaaagtatctcaaaggaagagattacaacgtctatgttcacagctacttgcactatggcgcaatggcttctcgggtagagatcttca

SEQ ID NO: 66216 - DNA, 243 bp, Triticum aestivum
  Clone ID: PAT_TA_66216
ttccatccctaccgcggcgtccaacctctaacgctgcttgaaaccctatcccgaatccggcagagcgcacagcacgggatcccctccaaaacagctgaaggaaggggcgggccattgttaagctgctaggtgtgggcctgaagccgtggatggatagcgtacggcgaggaggcactgaacagagcggcgggcaaggacgaagtgaagctgcgcgcaccatcgtcatatccctcctccacctgc

SEQ ID NO: 66217 - DNA, 186 bp, Triticum aestivum
  Clone ID: PAT_TA_66217
acgagctgcgggacggcccaaaccggtggcgctcatcaccccttggccgtttccaggcttggtcgctgaggtggggctggcgggcacgccgggcctgttgtcggcggccaacgtggtgttcacggccgggcggcacctttttttcacgctggccatgctgggctcggtacagaacttacgggtcac

SEQ ID NO: 66218 - DNA, 166 bp, Triticum aestivum
  Clone ID: PAT_TA_66218
tgccgccgccactaatcatctcctcgcagccgccggcgccgatggctcccaccccaccacccccaacgaacaaggccaaggatgccttccctcataggagcagcggcaggctggcggccaagccgtcgcgggttctgagcgccatggacaaggcccagctggttct

SEQ ID NO: 66219 - DNA, 135 bp, Triticum aestivum
  Clone ID: PAT_TA_66219
tcaccatgcagtaccttcccagcaacttcttcggggtgcccttcatccaccccttcaagaggaaccttcagcctggtagcatggtcgccatctacggcgtcgtcctccccggtgctgacaggttcgtgctgaacc

SEQ ID NO: 66220 - DNA, 120 bp, Triticum aestivum
  Clone ID: PAT_TA_66220
atacttacgtaaaacaaaacaacctcgagaatgcatgcatgttaaaaccatcgagttagaacttggcctataaatccagctcccgtttcctcacagtgttcatcacttcatcagcctctt

SEQ ID NO: 66221 - DNA, 192 bp, Triticum aestivum
  Clone ID: PAT_TA_66221
cttttgttagctttccaatggcggcagccaccatgtccctctcctcctcgacctttgccggcaaggcggtgaagaatgtaccatctttggctctcttgggcgaggcccgcgtcaccatgcgcaagaccgcagcaaaggcaaagcaggtttcctccggtttcccatggtacggtgctgaccgtgtgctctacc

SEQ ID NO: 66222 - DNA, 158 bp, Triticum aestivum
  Clone ID: PAT_TA_66222
gttagctcagcgctgaattgctcgctcgctcctgcgtgcttaactcggcgcctaccttgacttggaggggaaagtgcgtcgcctgattggggagaccccagccggcagccaggtgccggggctccgtgccaccgccaccgtccgtcggtgggtgggcc

SEQ ID NO: 66223 - DNA, 200 bp, Triticum aestivum
  Clone ID: PAT_TA_66223
tccagcacggcgccgtcagggtcaaccgcaacaagctgctgcgggtcgccggcgggaccggcggcgacgcggcggccgcggcgctcgacctcgccggcgtcgcctacgcccgggcgccgtccaagccgaccaacgcgtccagggacacgggccggtgccgccggccccggtgcgccggctgccacgtgcaccccgccgcc

SEQ ID NO: 66224 - DNA, 293 bp, Triticum aestivum
  Clone ID: PAT_TA_66224
cgacgacgtcatggcatcatttcccttcatgaaggcgtcgtcttgattgctcgtggcatgctcggtactggttttcgagattgttacattgattcgggtcttttctctgggtgggtagttttgcgctgtgttgtagcttctgtctgggccgagcatcccacgtctctctgctccatgcatcatgtttgcgccatcttgtggttgtgccatgtgatgttcaacttcttctatcaatgaaaagatacgcaagctttgcgtattcgtgaaaaaagatatataggctgcttcttttg

SEQ ID NO: 66225 - DNA, 220 bp, Triticum aestivum
  Clone ID: PAT_TA_66225
accagccaccccgtgataatatatactgtatacagcaaacgagctacgagcaagcaaaagcaagttaggagatggcaatgatggacgtcgatgctccctttcttgaggataaggaagagccgctcgccggcgtctgcgacttccgcggccgcgccgtctaccgcaccacctccggcgggtggcgatccgccttcttcctcgtcgtggtggaggtcgccgt

SEQ ID NO: 66226 - DNA, 347 bp, Triticum aestivum
  Clone ID: PAT_TA_66226
tcgtgttcgtccgttggaagcttcccgagccgtcgtccgcaaccaccgtcgtcgttctcgcggccagactcgtccccaagccacgaggagttgtccaggaggcgcgtcgtcgtcggcttcgtcgtctacaccaccggatcggagccgggaggtcgcctcgatgacgccccatcgccttccacctccacggccaccgcgacgccatcgcccgattcgccaccgtcagctcctacccggcctccccgagctgctcttccgcttcgctacgttggagcccaggagccagacgccatcatcgacgactactactactactcgggaggtgcctactactacgtgcagcccgc

SEQ ID NO: 66227 - DNA, 127 bp, Triticum aestivum
  Clone ID: PAT_TA_66227
gggagagcgtcgccatgaaggtgctcgatcgctcctccatcctcaagcacaagatggtggatcagatcaagagagagatatccataatgaagcttgtgaggcatcccaatgtggtcagattacatga

SEQ ID NO: 66228 - DNA, 241 bp, Triticum aestivum
  Clone ID: PAT_TA_66228
tgttactgcaccctgtgcagctgcttcaaaggagtccaaatcttggtggatgccaaattctgtatcagctttcaactcaggattgctgttttttagatgtcacttgattgcagcaacaaggatatcattcggcatgctgatgattttattgattggttggttgatattccagcgttccgcaatgactggacccaacatgccaataacattcaatcttgtgttattgggaggtgtttgtggt

SEQ ID NO: 66229 - DNA, 367 bp, Triticum aestivum
  Clone ID: PAT_TA_66229
ctccactagcttgcaatggccgccgcactgagcctccgcgcgcccttctccctgcgcgccgtcgcgccaccggcgccccgcgtggccctcgcgcccgcggccctcagcctcgccgccgccaagcaggtgcggggagccaggctccgcgcgcaggcgacgtacaaggtgaagctggtgacgcccgagggcgaggtggagctggaggtccccgacgacgtctacatcctcgaccaggccgaggaggaggggatcgacctgccctactcttgccgcgccggctcctgctcctcctgcgccggcaagttggtgtccggcgagatcgaccagtccgaccagagcttcctcgacgacgaccagatggaggcag

SEQ ID NO: 66230 - DNA, 207 bp, Triticum aestivum
  Clone ID: PAT_TA_66230
cgcaagtcgggggccatcggcaagtcgggccccatggaggaggaggaggacgacccgttcatagacgacgacatccctgacgacttcaagcgcgggaagctggacgccctcaccatactgcagtgggtcggcctggtgctcatcttcggggcattggtgtgcagcctggcgatgaagcccttgtcccggaagaaggtctgggagctg

SEQ ID NO: 66231 - DNA, 556 bp, Triticum aestivum
  Clone ID: PAT_TA_66231
ccggcactctcttctacttcctggatggggtccatcattgtcgcggccgaagagagagtagcgctgcagttggccgggttggtcgacatcatcgccggtgatggttccttgggcagcggtgaaggtgaggaccgacgaagatgcaccgttgtggtcttgaggaagccagcctgcttgagcacaagatcatgttaacagccaaattactactagtccttcctgccatacccatccatcatcaaaagcaatctgaatgctcacacgtgaatcgtttgcatgagtgacagtaatgagaatgaccaatcattcaagaacaagaacgagcatacaaggaatctgttgctgccacactaactcaagatcaaatttataagagaccgccatcggcgaggaagacgcgagagggatcaatggtcgactgtgatggcgagttggcggcggccgccggtgatgcgggatgagggctcgccggggaaggaccgatggtcgacggcgatgacgatggtccgacgatggcgacggtcgcgagcgacgccagatcagttgtcgttggggc

SEQ ID NO: 66232 - DNA, 205 bp, Triticum aestivum
  Clone ID: PAT_TA_66232
cacgcccggggcacacgggcgggctggctgctgcggggaggcaaggcaagggcaaggcagcgagcatttaggcaggcagcgagagaaaagcagcgtgccgactgcccccgagccaacccccaccccacaaaaggagggaaggggggagagcgcgagacacagaggcggccgcgaccgagggaagcggtggcggcggatgggggag

SEQ ID NO: 66233 - DNA, 223 bp, Triticum aestivum
  Clone ID: PAT_TA_66233
cgccgccggcgcgccatcatctgcgccagctttgccgtgctcgtcctgctcctcctggctgccgtggccgccatcgtcctgctggcggtcctccgcccgcgggacccgaccacggagctcctctccgcgaacgccaccggcgccgccccgcgcgtgacgttccccaccgtctccgtccagctcaacgtcaccttcctcctcgtggtgcgcctgcgcaacccga

SEQ ID NO: 66234 - DNA, 298 bp, Triticum aestivum
  Clone ID: PAT_TA_66234
atgccggcgtgaacaccagtgtggtcggcctcaagcccgccgcggcggtgccgcagtccgcctcgccggcggcggcaaagcgcgtgcaggtcgccccggccaaggaccggcggtcggcgcttctcggcctggcggcggtcttcgccgtcacggccgcctccgccgggtcggccagggcaagcgtcttcgacgagtacctcgagaagagcaagctcaacaaggagctgaacgacaagaagagggcggcgacgagcggcgccaacttcgcgcgcgcctacaccgtccagttcggcatctg

SEQ ID NO: 66235 - DNA, 305 bp, Triticum aestivum
  Clone ID: PAT_TA_66235
caacatgacgcttaagctcttggccgaagtgagcccgcaggagttgctccaagctcttgccgagctccaaaaccacatgctcggttacgtcaaatccatgtcgctcaggtgtgtggttgatctaggcatccccgaggccatccatcgccgcggcggcaccgccaccatcgccaacatcgaggcagacgcaaaggtacatcccggtaaggttgccgacctccagcgcgtgatggaactgcttaccacctctggcattttcaccgccactgccggcgccggggatggtgacaccgtggtgtttgggc

SEQ ID NO: 66236 - DNA, 526 bp, Triticum aestivum
  Clone ID: PAT_TA_66236
gtagtcacatgtagtgcggtgtcctattggttggcgtgctccctgtgaagcttgaggtcccacgttagattccgtcaccgcccactctcctttgctcttttaacagagaaaatggccggttcacaaaacacatattaacgggcgcttgaagcgccaaatagggaatgccgccttcgaccccctgcacacgaatactcgaggcgttgatgagggcctaacttccgctcttgcgcccacgagcaagacctgacaactccctgcacacgaagacgcgacacatcgatgagggcctatcttccgctcttggtgtagcgcgcccacggcaaagacctgacatggatgatggcgatgcacaacaacacgccagagtcgcagccgcaccaagacgggtcatcgacaagctcaccatcgcgtggtcgcccattagctccccgttctcctctcctgctggatggagctcgccattgcatattcacacgcatgacatatgcgacggcgacgagcacccatccatccatggcacttc

SEQ ID NO: 66237 - DNA, 452 bp, Triticum aestivum
  unsure (1)..(452): unsure at all n locations
  Clone ID: PAT_TA_66237
caccggcgacacccccctccaattgccgcactccctgcacctctatgtgatgctcactgcagaccacccgtcgcatcctctgcaacgaggagtccgggggctgacggcaagtgctggcacagggatgacactttctctcccacctccttgacgaccacagcatcctccgcctactcttccttgggttgcgcacatcacgggcgtggttacagccagaggcctanctctcccactatgcggacgaggaacctggctcgctccaagtgcccggcgccctaagatctggcagctactcccggtccagggcatcactggtatgtagtacatattttcaaatataattcacttcctaattcctatgccttgatttagattaagcataccaaattctgctatttacacgtgaataaattgaatattttttatcctagctaaatgcctaacctctcatc

SEQ ID NO: 66238 - DNA, 424 bp, Triticum aestivum
  Clone ID: PAT_TA_66238
atgattttgatgacaatttgttagtgtatttctagctggaattgcattatatcttacaaattcacaatgcaaccaattaataaggagaatagaagcatttgcatccatctaacatatttgtatgatattttttcaaaagctcaaggttgtagatgtggcgctgtatgaggcgatcattaggatggaaaataaattaatgggagaatattgtttgaatttccttcgttctgtaaatggcaatacaagctatgtttgcgccatgattctattccaatttttttaataactggtcattaacgacagataaaatgttctgtattgaaatggagcatttgtcagtttgggtttagtaggtcagaatggttctattctacagcacgattatgtaaccagttcaagaattgatgagtttttgagccctatg

SEQ ID NO: 66239 - DNA, 294 bp, Triticum aestivum
  Clone ID: PAT_TA_66239
ctctctctctcctcgcgccgcggagtcttgcaaggcgtggctggtgcagtccatccccaccgacatgccccacctccgccgcgtcccgggggtcctcgccacagcggacgtgctccagtggctatcggggaacacgacagagagccttgacatcctcgcgcaatactggcagttcatagcacacccgaagaacccgaaatcaggagagtacgggttctccgagagcgacatggcgaagtttggggctgaggaggggcgccgggtttacaacgcacttgaaaaagctgcagatcg

SEQ ID NO: 66240 - DNA, 170 bp, Triticum aestivum
  Clone ID: PAT_TA_66240
tcctcccgcggcgaaaccctagcgaccggagcgctcggcggcgcagccatggcggacgacgattacaatgaagttgacatggggtatgaggatgagcctccagaagctgatattgaggaaggggttgaagaagatcctgagaacaatgaggatgcccctgatgatgtggt

SEQ ID NO: 66241 - DNA, 574 bp, Triticum aestivum
  Clone ID: PAT_TA_66241
tgaacatcttttaccattgacatctccatcccggtgtctcgaattggactgttgatggtatagtaaaatacgtgtcatctaaaatggaagaggaaaaggcgcaagaaaatgagtcagccagtttacagagacgacaacccgttgaggtgtcacctgaggcgaaaaagagatcattggaagccaaatcgagaggtgatgatgcattcagaagaaaagacttcctagtagcagtggatgcatatacacaggccattgaattcgacccgaatgaccccgcgttgctttcgaacagaagcctttgttggctgcgggcagggcaagaggttcgaggaagccgcgaatgcgttctacgagggggtgcagctcgagccggagaacaaagagctcgtgaaggcattcagggaagctgttgaggacgggaggaagttccactcggcaaacaagccaacaacaaacggaacaaagtcagaatgaggatggcggcgatgaactgaacaaagccgtgctagtatcaaaagcttgtatgagtatctccgtggaatcgcattggagattcgttttactttgtcaagtg

SEQ ID NO: 66242 - DNA, 362 bp, Triticum aestivum
  Clone ID: PAT_TA_66242
ggccgtgcctggtgccccgcgcgactcccactggccgctgccgcctctgctgctcctcccctcaccatgcatattgcctgcttcgcccagcgcctagctggcagcagccagccaagaccgcgatcgcatgtgatctatctatccacctgtagctagctgcctaactagtaactacgaccctgcagatctagttgttatcttagcttttcgactttcaaagttactgcatgatgcgctccgtgccgtttctttttgaagttacagcaccagcctactgcatgcatctccaagcatcaggctgctagtagtttacctgtgcaagttaggcatcattggacccttgttcagaaatcaagggctgg

SEQ ID NO: 66243 - DNA, 311 bp, Triticum aestivum
  Clone ID: PAT_TA_66243
catggtcattgtcccctgacgccaaagaggttggaatgtttctttctgccctaggatatccatcaagcaccccagtttacatagctgcaggggagatatatggaggtgaatctcatatggtcgatttgcaatcccgattcccaattctgatgaacaaggagaaactggcctctgctgaagaactgcgaccgttcagccaatatgcttctcaaatggcagctttggattacatcgtttcagtagaaagtgatgtatttattccatcatattctgggaacatggcacgggctgttgccggtcatcggcgtttc

SEQ ID NO: 66244 - DNA, 360 bp, Triticum aestivum
  Clone ID: PAT_TA_66244
tcgggcctccagcagtggagttggttgtccacctggtgtggatcctcattctcaaagaagctatttaccaccaccacatgttcctgactatcatgcaaggaatttttcaagcaacggtgctgcccctggtcctagattctttgttgaacaagagataatgttcagaatgatatgtggaaatgacatggtgggcggcgtaattggaaaaggcggttccactatccgtgcattacagagtgaaactggtgcttcagtcaaggttatagaccctgttgctgattcggatgaacgtataattgtgatctctgcgcgtgagaattctgagatgatgcattctccatctcaggacgcattgattcg

SEQ ID NO: 66245 - DNA, 583 bp, Triticum aestivum
  Clone ID: PAT_TA_66245
cggcgcactacgggtccccgccgccggctcaacggggcgagtggccgcggcggccgtcgaggcaacctccgtctgcgcgtacattgactgctcgacctggcggccatcatcgaggctggcgctctccgggtccgcgccgaccgactcaatggggcgacgtgggcggagagcgagcgccgcctgctttcccgcgccgccgcagcgagcgcggccgtcgaggccgcctccgtctgcgtgcacctagccgccgtccatggtcactgttggattgaggaggcgcactactcgatgacgggcgtggcggtcctctgcatcttcttctgctgcaaggctgcagggaatccatgctcgtcgttgttcgctaggtgacgccgcagccgcaggtcgagcttgaccaccacggcggcgaactgcaaaaggcatttggatccttttccactgcaggtggcaacatcctccaacccccttctttttttcatttttgttagtttgattatctgcaaattgatgtgccatgacccaatagaggcacattccgagttttgtgtttagttttctcaccccaaattgcatcccatgaccc

SEQ ID NO: 66246 - DNA, 669 bp, Triticum aestivum
  Clone ID: PAT_TA_66246
acagccgcgcatccaccgttgctagcaaggtcgaccaagcagcaccgagatggctgctgccttctcctccaccgtcggtgccccggcttctacgccgaccaacttcctcgggaagaagctcaagaagcaggtgacctcggccgtgaactaccatggcaagagctccaaggccaacaggttcacagtcatggcagcggaaaacatcgacgagaagaggaacacagacaagtggaagggtcttgcctacgatatctccgacgaccagcaggacatcaccagagggaagggcatcgtggactccctcttccaggcgcccacgggcgacggcacccacgaggccgtcctcagctcctacgagtacgtcagccagggactcaagaagtacgacttcgacaacaccatgggaggcttctacatcgctcctgctttcatggacaagcttgttgtccatctctccaagaacttcatgaccctgcccaacatcaagatcccactcatcttgggtatctggggaggcaagggtcaaggaaaatccttccagtgtgagcttgtcttcgccaagatgggcatcaacccaatcatgatgagtgccggagagctggagagtggcaacgccggagagccagccaagctcatcaggcagcggtaccgtgaggctgcagacatgat

SEQ ID NO: 66247 - DNA, 312 bp, Triticum aestivum
  Clone ID: PAT_TA_66247
cgcgtcctgggccgccgggccatgaggggcggtggccgggggctcggtgtgggagccatttccactggcttcgtgcgtcagatctgaagagggcagattctccgcgcacggcccggcgagctccatctgctcaaatctccgacgtcctttggttcgtcgggtctgcgggctgggtggtttgctcagggcggagggagggaccgggggaaacccttggtcggcggtgacagcgcacgttgttgacggcgctgcaggcgcgtttttcctcttgtgggcgataccgaggtccatccattaccccctctcccccca

SEQ ID NO: 66248 - DNA, 312 bp, Triticum aestivum
  Clone ID: PAT_TA_66248
gcgccgtagtcaagatgtcgtcggtcagtgcccgcgctcccgtggccgctctccggccggcggcgtcagcgtcgagcccccggttcctgggcgactccggccgcgtcggcctcgccaagtccacacgccgcgacgtcgccgtccagccaagggtcgtggctccccggcctcccctcccctgcctacctcgacggcagtttggcgggtgacaatggattcgacccgctggcgctggcggaggacccggaggacctgcggtggttcgtgcaggcggagctggtgaacgggcggtgggcgatgctgggggtggcg

SEQ ID NO: 66249 - DNA, 539 bp, Triticum aestivum
  unsure (1)..(539): unsure at all n locations
  Clone ID: PAT_TA_66249
gctcggtctcctcaatcttcgctgtgatggattgggtgcaaggaggcgagtcaatggcgccggcgctcgccgcaccgggaatctccccggcggccgactgcaggtacgtatctagactggatactggtgtactaatcgcaacgctcgtctgggatgcgttatagtcgatttcttaagattccccaagcgagtttatgaatcccctctccttcttgttcctgagccggagcacagatccaaccaagctgccggcgacccgtcctgcgcagtcaggccgatcgatggagggttgtcggggtcggatctatcgtggcgtccagccatccaggatatcgcgcgagtcccagacgaaacgccattctccaatgcgcacatagggctagtaacgcctccggccacactganaggcgcgaatgcatgcgcctacagctcagattttaatccagatgtacgtgacgatgattctgggaacgttatagttgtgcctggatggaagaaacggaatgttggggctaatggccctgacacgaggacacctc

SEQ ID NO: 66250 - DNA, 720 bp, Triticum aestivum
  Clone ID: PAT_TA_66250
ggccccactcctgcgtcgattcctgaatctgtacagtcaaatgttctacatccgctcggtctccctccagcccctcccacagacttgatcaacatgactgaagctgaatcagctgatatctcgcatacttccgaaaagcatggtgcttctgatggtctgcacaaagcaaccaatgaggttgttttggagaacttgaatgcagacttaaaggctctgaagaaatacaacagtgttgaatttctaaagagacagcatgaagagttcaggccagcatttgtatgcagaggtctgttgttacctttccaagttgacgatactgagaccaaattcatactcaaggcatatgagcgtgccttcaagggccaggcccccaagcttctcaattcctttgatgcaacaatcaatcttagaaatatgcctatggatttctggaaacactctttagatgacttcatgaagcagcacatcgtggtatcaaatgattgggacgataaggcgggtcggccagctgtgtatgtccagtgcttaccttacgagattggcccgacatatcctgaaggcatccagtacttgagaggtgaatgcgatgcttcgtatgatctgcatacgcactttggagccatagctaatgctatatggaacaagactgaccttttgtggtacgagatctgccgtggcttccgtttcaactcgatcttacatgctgaagcccatgctgca

SEQ ID NO: 66251 - DNA, 306 bp, Triticum aestivum
  unsure (1)..(306): unsure at all n locations
  Clone ID: PAT_TA_66251
cgtagctcgagtccgcggccaattcctgatccatggatcagtgcccgttaatgacgtcaatgggctagagtaaatgaagaaatgggtaggtggggatatggcaggctccttcctctcncacctgngtcgggttctatcggggcatctcggtggcgacaacagcagctcttctagggttcgagaatctttgctccggcgcgcatggagtttttgatgccgtcattcaacagtagaactctgattgaagaagtgactgacagatccgcgccccgccacttgaagcactcgcagctaccacttcaacgt

SEQ ID NO: 66252 - DNA, 189 bp, Triticum aestivum
  Clone ID: PAT_TA_66252
gggggcaaccaaaccaacgcaaaccccaaatccccaatccgagctgccctcttcccctgaggtcgatcgggtacgattcgattcgatcagatggcggcggtctggatggcgttggcggtgatgctggtcgctgctgctcaggtggcggtggctgccccggtgacggcgccggccttcctctgggctccc

SEQ ID NO: 66253 - DNA, 535 bp, Triticum aestivum
  Clone ID: PAT_TA_66253
ccacgcccacttctacaatagcgccaccggcatcctcgaccagtgctattcctgctacgtgtgaggtgagcatagaggtcaattccatggctctgatgaatataaccagttcgtctccaatcctcacaaaggtcacaaccacccaagcattgtcgcctaccaagtgttcgacagaaggcctgaacggcgagagcagtgtggcttgtctcaagtatttagtcagttcacatcaccagttgtagcaggacgtgtggctcgccgagttcaaaactgaattgaagaagagccgtgaggaattgttggcagcgagaaaggagatgaactcagtatccttgctcacaatcaggttcctgtttcagtgtgttccaggttatgggctattaacattatcatgggatccaggacagctcgcagttgattcggctgcaactatttgcgatcaaggtatccgtgccatttgtcaccagcaactttcggtccataataggttacagattgcatggtcatttgtttcgaaattctcttgtgttggatc

SEQ ID NO: 66254 - DNA, 513 bp, Triticum aestivum
  Clone ID: PAT_TA_66254
tggttctctactgggcgtcagcttcagacacgcacctccgccgatctctggccttgcgcgccctgctgcggggctacgacctgaccatggacgagcgcggcgtgttcacgagctaacaaagcgcaccgctgcgagctcaactcgttagagcatcttcagccgttgagcccccgaggaggcattttttgcgccgcttggagggctgccggcggaatttttggcctgggggtgaaaaagttttcagccgtgtggggggcaagccgtgcccatgccgtgcccgccccacgccacggctggcccggcctcgccgtcgagctcgagcagagcagcatgagcgcgagcgcgagccggctgagcagaggagccacagcttcaccggcgccgtctccgtcctcccctccgtctccgacgccgtctcatccgcgcaggagcccgacgtctgcatcctcacctggaaccccacgacagggtggccggtgaacagctgcctgtcttctccgcagccgcgcgctc

SEQ ID NO: 66255 - DNA, 423 bp, Triticum aestivum
  Clone ID: PAT_TA_66255
attatattatattacaacgaacaatcgtctcacaacaaaggcccaccacaagcttacaacggagctgagaaaacacaggaccaaataaacgacatgctagtacacaggggagtggcatgatttatttagcgagcaccactttggacaactttgggctaaacagagagcacctctctcccatccatggcttagcacacattacccagacagcccctgctacttgccaccggcatgtgtgccagaagtggagagcagggaccaagcaacggtgacctgcatcttgcagaaacgaagatcacacatgccaacgctcgtcccggacatcttgggctcgaagacggcctgatttctcgtaaggaaaccgacgcggcgcgcctgcacggacaccatgagcttatccctcccgcccagctctgcgcaaac

SEQ ID NO: 66256 - DNA, 722 bp, Triticum aestivum
  Clone ID: PAT_TA_66256
tgtggtcaatacaaatccaccatgaagacctttctcatccttgccctccttgctatcgtggcgaccaccgccacaactgcagttagagtttcagtgccacaattgcagccacaaaatccatctcagcaacagccacaagagcaagttccattggtacaacaacaacaatttctagggcagcaacaaccatttccaccacaacaaccatatccacagctgcaaccatttccatcacaacaaccatatctgcagctgcaaccatttccgcagccgcaactaccatattcacagccacaaccatttcgaccacaacaaccatatccacaaccgcaaccacagtattcgcaaccacaacaaccaatttcacagcagcagcagcagcagcaataacaacaacaacaacaacaacaacaacaacaacaaggcatgcatatcctgctgccactatctcaacaacaacagttgggtcaaggtactctcgtccaaggccagggcatcatccaacctcaacaactagctcaattggaggcgatcaggtcattggtgttgcaaactcttccaaccatgtgcaacgtgtatgtcccacctgagtgctccatcatcagggcaccatttgccagcatagtcgcggggattggtggccaatgaaaaaagcaagatctatactaatagatagatggatcatcgttacttagcagatgcaccaatcgatgtaacgatga

SEQ ID NO: 66257 - DNA, 446 bp, Triticum aestivum
  Clone ID: PAT_TA_66257
tggggatttcggcgtcccagatccgctcctccggccggttcgctcggccgcacgtccgatcccttcgcgccgccgtcgactgctgaccgcccggtcgattctccggggatttgttgcgggggctctcgcttgctcccgatggcgtcgtccccggtctcctactggtgctaccactgcagccgcttcgtgcgggtctccccggccaccgtcgtctgccccgactgcgacggcggcttcctcgagcagttcccgcagcctccgccgccgcgcggcggcggcggcagcggccggcgcggggccatgaacccggtgatcgtgctgcggggcggctcgctctccggcttcgagctctactacgaggacggctccggcgacgggctgcggccgctgcccggcgacgtctcgcacctcctcatgggggtcggggttccaccgcctgctcgacc

SEQ ID NO: 66258 - DNA, 581 bp, Triticum aestivum
  Clone ID: PAT_TA_66258
acttttaacaaaacatcttggctttttacattaattccaaatacctcactaatttttttgaggaacataagtacagagccttaatcagcatactacttgcacagaaaataaacatcgattatgctctcaccaccttatgtagcagtcacaccatcaacacatacataccatattacaaccaaaagcaccctactacatacataccacgagcctattttcaagttgcagcacagccttaataggcaccatctccaaccctcaacacatcagcctgacctccagcatccgcatcatcggcagtactctcatcgtgatggccatctacgcgcccttcagcttacagcgtctccgcgccttgttccattacctcctcaataaccgtcatttgatactgtaggtgatgacaacgatggtggatagttgctatatgcgaagctttgcgctgtggaagcacacactctctcaatctgtaatgttttcatgtccaacgtgcacaagtctgggcataattcttcgtcgaaggatagtccccagtgattcaaaagcaaatgtgtccccattgaatgtctgagcacataccc

SEQ ID NO: 66259 - DNA, 509 bp, Triticum aestivum
  Clone ID: PAT_TA_66259
gtcgccgcctcggtcgccggccgattctggccgctccggtgagctccgacgcctcccagcacacccattgctgctccttggcaagctctaccagctccgccgcatcgatctacttttcctccctcctgtggtcgtccccaacgatttcctcgctagggttccggtggtggaggcgggtcttgtcgccgacggcccttcggtcgtcgcggggtttcatccggcacctccagcggctcaccgtgatgcggtggtgcccctggggtggcgtctccgtgcggtgatgccctcggggtggcgccaccgtgcccggcgctcgccctggtcgtcgtggttgtgctccggcggcctccagaccctctcctggatgtggtgatggtcacaccacagccgttgtgtggttgagctacagctatggctacaatctccctctggtgaggtcctcccggttccttctccattgattttgctcctgcatggccttggccatgatttgggttggatgtgggatt

SEQ ID NO: 66260 - DNA, 384 bp, Triticum aestivum
  Clone ID: PAT_TA_66260
tgtcttttattcccagtttgaactagtatagttcaggttcttacatgatagtgcatgtcactttattttttcaccgctacaacgaccaaaccatggactaagaaaacggtgtatcatatatctactactagagttcttctcttctcagttagtaccgaagatgccaaatggagcaatggtgcaatatggagggatatacacattgcacattgcaggtagcgtctgtagcgctaggttccttattgcctcaaactggggcagttgttgaggctggaaagagccctgggcctgtgggttttgctgagatggttggaagaagccctggcctgatggatattgttgctgaggctgttggaaggagacttggctcaacggttgttgttg

SEQ ID NO: 66261 - DNA, 229 bp, Triticum aestivum
  Clone ID: PAT_TA_66261
tccctttattcttgttcatatatatatgcatgccacacatccatggatggaacatgcttattcattcatgagagacggatctatccatctttatatgtccaaaccgaggcagtatggggtgttgtgaacggtcatcacgttgcagtgccccggcgtaacgagctccttggcgaagtccctctggggctccctggggcatccgggaaggtccttgagcacgccggaattg

SEQ ID NO: 66262 - DNA, 147 bp, Triticum aestivum
  Clone ID: PAT_TA_66262
tttgagttcttccggttgatgctgcgtcaagggttgctgcagatcagttcaccctcaccagtgcagttgcagcgtgtgcaaatgcagggatggttgagcaaggtaggcaagtgcatggatgtgtcttataagctagggcacagtttt

SEQ ID NO: 66263 - DNA, 110 bp, Triticum aestivum
  Clone ID: PAT_TA_66263
tcttggacatgttccgtcgtcggtgccgctactcctccatcaagtacctcttacttgtcctcgacgccataagtgattcctcactcatctacacaattgggctgatgcag

SEQ ID NO: 66264 - DNA, 356 bp, Triticum aestivum
  Clone ID: PAT_TA_66264
ccatggtggaggataggccagcgatggatgcaaggagctacgtgagcaaagctacaggcggtgctccgccgcgataggttggagctacggggaggggaaggcgaccaatgacagagatcagaaagcatgtcgttgcgggtgctagcagcagggtaacataaacaagaagtggggggaaggtagagaaagaatttccaatgttctggagtacaccaatggatgagagccttttgaaactattgtaagtttatcatttgaaatgattgaattcgtattgttctctgtgagattattgaatgttacatgaccatgttctgattagctatatttgatgctctacccttttgactcatggt

SEQ ID NO: 66265 - DNA, 299 bp, Triticum aestivum
  Clone ID: PAT_TA_66265
tcgccggcgcctgtccagtccacgcccatggcgactccgaccacgagccgtctccaccactacctcctccccgcccttccatctcgcccacctcgcacctcgtcctcctcagccccctcagtccagggacccagccgccggcctacctcccggctgtactgctcatcgccgccggtgggagcgccgccgtcagggaagggcggggagtaccggccctccttagccgacgacttcctcctcgccttcttccgggccaagatggtggagctgtaggaggttgggtgggattctcaaaagcc

SEQ ID NO: 66266 - DNA, 196 bp, Triticum aestivum
  Clone ID: PAT_TA_66266
ggcatccctgccttgtttcttagggttctagccgtagcttgatgtctcatcccaccaccagcaccacttgacagattctccatcctcatctataaatagatgcataagcctgcaagggaactcactcctcaagctgctcacaacactccagccagctgctagcaagagatggctctacttgctgctgctaccctga

SEQ ID NO: 66267 - DNA, 330 bp, Triticum aestivum
  Clone ID: PAT_TA_66267
ctgcaaggctgtgacatacttcaaaacttgcctgcaacccttggtcatctccaaacacttgagcatcttagggtgtcatgtcgttatgatattggtgagctagctgactctctctgcaatcttcatgatcttcggtttattgatttgtggaggggcgctgagcttccacagttgccttgttcatttggtaatttagtgaggggggaggatctaaacctatctagtggcttcaacctcaaccagctaccagaatcttttggcaacctttattttcttaggtctctgaacatgtcgagctgctctgagctcgaacaattgcctggatctttt

SEQ ID NO: 66268 - DNA, 527 bp, Triticum aestivum
  Clone ID: PAT_TA_66268
ctgtgctctctcttgtcctcctccctgacccctagcactggcaggagaatgtggctccccactaaggagggcaacacttaggccgccggggagccggacgaggtcgttgtccgggtcgctgccaagcttgtggcctggcacttagctcatcgttaaatgcatggccttatgaatggcacctgctgcagccggtgagttgaagacgaccgtgaatgtattttgttttcccatcaccgtctgcaatttatgaatcgtaatatgggtcctgtttgttatgataggctcttgtgaaatgctgagaaattttgattctgtttgggtttgtaccttttgcctaccacacctatgcttatcgtttgttttatctgtatttcttacaagatgatgataagatttatcatatgtgcaattttagatctgagtcgcaactcatttagtggtatgctcacatccgttgagtgcttggagcaaggagaaagctcgaaatgcgaatcataagtcgaaaccgtgtgcctacaaaatccata

SEQ ID NO: 66269 - DNA, 495 bp, Triticum aestivum
  unsure (1)..(495): unsure at all n locations
  Clone ID: PAT_TA_66269
gtgtcgctgaagctgcagaagcgcctggcctcgagcgggctcaagtgcggcaagggcaaggtctggctcgaccccaatgaggtcaacgagatctccatggccaactcccggcagaacatccggaagctggtaaaggatggtttcatcatcaggaagcctcagaagatccactccaggtctcgtgcaatgagggcgcggggaggccaagcagaagggccgtcactctggatatggtaagcgtgggggtaccagggacgctaggctccccaccaaaatcctgtggatgcggaggatgcgcgtcctgaggcgccttctgcgcaagtaccgtgaggccaagaagatcgacaagcacatgtaccatgacatgtacctgaaggtcaagggtnacatgttcaagaacaagagggtcctcatggagagtttccacaagtccaaggctgagaaggcgagagagaagaccctctctgatcagtttgaggcccagcgcgcccagag

SEQ ID NO: 66270 - DNA, 255 bp, Triticum aestivum
  Clone ID: PAT_TA_66270
acgccgccgcagcggcattcacgggcggcgggaggcgctccccctgcgcccgtccttgtccggggaaactccaatgagcagggtgcccggctcgacgccgttggagacgccgtttgcgagcccgagggcggccgggctccaagtccccacgcgcgcggcggcacggctgctcgacggagggctcgacgccgtgaagccgaaggacttaaggcggcgacgaggaggaggcgtggttggcgtgggggatggtagatg

SEQ ID NO: 66271 - DNA, 395 bp, Triticum aestivum
  unsure (1)..(395): unsure at all n locations
  Clone ID: PAT_TA_66271
gtcctctttgaactatggggatgctctgtcgtctgttctgaagtcatggataatattgggatgaaagaaaatacaaagagacacatagtgaaaaggcggacaaaatatccaagagatattttgccagatcacttgaagcactaccggctggaccagatcaacaacacatccctaacttttcggcacaaccggatgtacattagggcgttggaactggttcgacttggagacgcaagtgttgaggcatatcaaactctgatggggcttttagaccaggccatgccggtgatggacccttttgacaaatgtcgtgacaggctanggcttggaagaccgtggataacaacaatgtggcagataccgaccgggagtgagctgggagaagtgtgtgaaga

SEQ ID NO: 66272 - DNA, 254 bp, Triticum aestivum
  Clone ID: PAT_TA_66272
gctacgacgacgactatcgactagctagccagcggcgaagctcgtgagctctctcctgtgcccggacatggcggcgagaaggctcctcgaggaggcggtggccgccggcgcgcagcaggactcgctcaactcggacctggtcctcatcctcgccggcctgctctgcgcgctggtctgcgtcctcggcctcggcctcgtggcgcggtgcgcgtgcgggcgccgctgggcgcgccccgcggacgccgccccgcccg

SEQ ID NO: 66273 - DNA, 143 bp, Triticum aestivum
  Clone ID: PAT_TA_66273
ccttaatgaataccctagtttcagcgatcaaaatttcctttgtgaccaacgaggctacccagaagagcttgtcttctatcagttgtgccatttcaagtacatggataaagcttgatgagctcatttttttaatccattccatc

SEQ ID NO: 66274 - DNA, 353 bp, Triticum aestivum
  unsure (1)..(353): unsure at all n locations
  Clone ID: PAT_TA_66274
ctggcatcaaccggagtaaccacaaagagctccgcgccgtcgtctctggccacggccatctggaatccctgtcgatatggcttgacaaggacaccgaggggattgatgacccttgcttgcctatcaatgatgacttcaggcctgcaggggggctactgangctcaaactccacgggcacatcggcaacctgggggggggggggagcactctcaccatgctggatttggtggaagtgtccaagtctcttgctcaaaatccatgatctaataattctgcgacaattaagcagtctcacaatgctgcagcacgtacaagtgtcaaggtctcttttgttggctttctaggatcggcc

SEQ ID NO: 66275 - DNA, 376 bp, Triticum aestivum
  Clone ID: PAT_TA_66275
catgccccacgtttcttggggagccttcttcttctactgctctgttttgcttggtgggagagcagagtcgccaagtcaagatccgaagcacctgtcaacaccagaatcaagaccttattggtagaatgactcttgctgaaaaaattggccagatgacacagattgagcgttcggttgcatctgcagacgtcatgaaaaattacttcataggtagcatcttaagtggtggtgggagtgtccctgctcctcaggccacacctgcaatgtggatcaacatggtaaatgaattccagaaaggtgccttggcaacacgtctgggaattcctatgatttatgggattgatgctgttcatggtaataacaacgtctacaacgc

SEQ ID NO: 66276 - DNA, 354 bp, Triticum aestivum
  Clone ID: PAT_TA_66276
gattatgcagcgacaggattatggatccaggggcatgtgtcagcgaagaatctgtgcatcagtttataggctatgcaattgttgagtattttgtttataggctgtatatgcaattgttgagcattcagcttataggctatgcaattgaagagcctgtggcctttttccttgtgttggtttccgggcaacaataattaacctggtgataaacatcattttgtttcatgtcgtagcttgtcatgtctatcagccagagcatgtactcgcagtcttgtacaggggagaggccactctgctctctccactgttctgctgtaagcatatctctgttatgagcactagttttgaccctga

SEQ ID NO: 66277 - DNA, 312 bp, Triticum aestivum
  Clone ID: PAT_TA_66277
tttgacatggcactgttatctacagaaggagctacacaggatctcgtcaggaaggttcctattctttatttttggtatgctgagatggaaatatcaatatctacttcaagaaacaattctgactcggcacatcgtgcaatttacattctttcctgcttgggtagcaatatcaagtattcttcttttggcggtcctatatcacgcccgctggtattaagggctcgtcaaggatttaaggagcagattagaaacctgcggtctgcatttgcaagtggttgtttgaaagaagaatcaattgctctgatttgctgt

SEQ ID NO: 66278 - DNA, 138 bp, Triticum aestivum
  Clone ID: PAT_TA_66278
tcctcttgcatgcccgccttgtagagcatgcggccggtgaggatcagcctgcactgagcatcgaggaagttcatgggagcaatggcagacaaagtggtgccgagggcactgtatttcagctcacttttgcctgcaatg

SEQ ID NO: 66279 - DNA, 164 bp, Triticum aestivum
  unsure (1)..(164): unsure at all n locations
  Clone ID: PAT_TA_66279
ccgcggccccggcggcgtcctcggcgtcctccgccatcgacttcctcacgctctgctaccgcctcaagacgacgaagagggcggggtgggtgangcgcggggtgccgggtccccagtcggtggccgaccacatgtcccggatgggagtcatggcgctcgtcgcc

SEQ ID NO: 66280 - DNA, 352 bp, Triticum aestivum
  Clone ID: PAT_TA_66280
aaagttccaatgatgtcaaatctgaagctgtcaaggagaagataccgaaagaagaaagttccattgatgtcaaatctgaggagaagccaaaggttgctcagagcgatagcagcaacctagccagtgagtcatataacagatggcatcaaattttcagacacagtcatcgatttcgacaacgtgaaagatttcagcagcttcagcatcgtcgtagatggcctggtcatcgactgcgagttccctgaccacctgcgcgagacgtactacgagctgtgctgtgcccagaagtcgttccttcacaaggagctgctcaaagggctaaacctcacactcgtggtgggagccatcatgg

SEQ ID NO: 66281 - DNA, 472 bp, Triticum aestivum
  Clone ID: PAT_TA_66281
tcggcactggcgcatccttgttccccttttcctccgtctctccccttcttcggttcctcaattctccaaatttatccactctgcttgtgttcttctgctgatctgttagggttcagttcaggagctcaagcgcgcggcaatggcggcccccgctgctgaagccccggcgcccgttctccctcctgccatatagaaggatgcggatccggctcgtctccaaacctcgccgctccttcccgccgcaggctggtcggaccttccgcccgatctcgtccgccgcgtcgccgactccctcctcgccgccaacgacctcgactgctacatggacttccgcgccgtctgctccggctggcgcgccgccaccgacgaccccaggagcgaccccttcgacccccgctttcgcccgcgccggtgggtcatcctggacgacggcgacgacctgctgctgctgaatgccgccacggggcgcttc

SEQ ID NO: 66282 - DNA, 488 bp, Triticum aestivum
  unsure (1)..(488): unsure at all n locations
  Clone ID: PAT_TA_66282
gcgccccgtttcttattccccttcccgcagccgccccccgtgtcccgcgcgcaccttctcgaagcctcctccctccctcccccatggcggaccagctcaccgacgagcagatcgccgagttcaaggaggccttcagcctcttcgacaaggatggcgacggttgcatcaccaccaaggagctcggaaccgtgatgcggtcccttgggcagaaccccacggaggcggagctgcaggacatgatcaacgaggttgacgcggacgggaacggcaccatcgacttccccgagttcctgaacctgatggcgaggaagatgaaggacacggactcggaggaggagctcaaggaggcgttccgcgtgtttgacaaggaccanaacggcttcatctcggcggcggagctgcgccacgtgatgaccaacctcggggagaagctgacggacgaggaggtggacgagatgatccgggaggcggacgtggacggcgacggc

SEQ ID NO: 66283 - DNA, 157 bp, Triticum aestivum
  Clone ID: PAT_TA_66283
ccgtcctggccgtcgtcctggcggcggccgcggtcacgccggccacggccgagcagtgcggctcgcaagccggcggcgccaagtgcgccgactgcctgtgctgcagccagttcgggttctgcggcaccacctccgactactgcggcccccgctgcca

SEQ ID NO: 66284 - DNA, 398 bp, Triticum aestivum
  Clone ID: PAT_TA_66284
cccctcgccagctgggacgctgacttccagcgccgtctccaggaagacggcctcgccaaggaggccgctgcagccgcccaagaactctgccgctatggcgtcgaccatggagggcgtccccatcgccacgccgccacggccgcatctgacgtcgatgctcctgtcaaggcggcccgtgctaatcccgtccgtgcctggtgcccacttgttcaccacctcaagggtgtcaaccatggagaacgcagcccggcgcctgcggtgtccagcaccttccatgcctctgatatcgccgccgccgcgcgccctgggcctgccaccaccttgccggctgctgctggtgctgaccccgtggacgtccggtgcgccatccgtgcccgtggacgccagatggctgaaga

SEQ ID NO: 66285 - DNA, 485 bp, Triticum aestivum
  Clone ID: PAT_TA_66285
tattcctccagcagcaatgcagccctgtggcaatgccacaaagtcttgctaggtcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggttcagggttccatccaaactcctcagcagcaaccccaacagttgggccaatgtgtttcccaaccccaacagcagtcacaacaacaactcgggcaacaacctcaacaacaacaattggcacaaggtacctttttgcagccacaccagatagctcagcttgaggtgatgacttccattgcgctccgtaccctgccaacgatgtgccgtgtcaatgtgccgttgtatagaaccaccactagtgtgccattcggtgttggcaccggagttggttcctactaataaggaaaggtctct

SEQ ID NO: 66286 - DNA, 476 bp, Triticum aestivum
  Clone ID: PAT_TA_66286
atctgagctcataaagaagaagcaatatctggtgaagaagttgaacgacatgtacaatactcttgtcgcctgtagcaagttccgaggtttacgtaagacacgacgacgcaacgataatgacacaggtggtaccaagataaggataggtccagcttctgtaacagaaagagagttagtataatgcctaatgccaaaaggaaagatgtgcaaaaatatgatgtggttactgtccgtggcacttatgtatgattggggatcaaagaccaagattatattggaccagactattataaccgaattgctaaaaaggaaataaatgcaaccatgcatatctctgcaagaagcttagaaagttgccacttcaaaatgttgagcagctatttctgcctacactatcggacaaccattggattctggctgtcattaacctcacgccaaacacaattgaaatttatgactctaacttagaagtcaaa

SEQ ID NO: 66287 - DNA, 527 bp, Triticum aestivum
  Clone ID: PAT_TA_66287
gccgccggttggctgcagtgtggcgagcccgccaaggccatcggagtgctcggtcccatgatgctcgaaggaattaggccaaacaactacacattggcgacggcagccaatgcctgcgcgaccctcgccggtccgagcgaagggcgcaaggttcatggatacgccatcaaactgggagagggctctgatgtcgccgtgaacaacgcgctcatcgacatgtactccaagtgcggcctggtggacaccgcgcacagggtgttccagtcaatgcggcagcggcccgtcatatcctggacgacgatgatcatggggttcgcgcggaacgggcaacctcagaacgccgtgaaggtgttcgacgacatgcttctggaaggcgtcacgcctaaccacatcacgttcctctgcgtcctccatgcctgcagccaaggcgggttcatggaggaagcctggatatacttcaaagccatgacagacaagttccgcatcgagcccggcgaggatcactacgcctgcatggtcgatctcct

SEQ ID NO: 66288 - DNA, 232 bp, Triticum aestivum
  Clone ID: PAT_TA_66288
attgcaagcagatggtgggatttgcatgcctggtttagatgatgcagcaatgccagaaggtgattacatggattttccctttttcagtaacagtgatgagtttgatctcctgaacggtgaaaattttctgaattctccacatgatacgaatcaggaagacttgtttgatcctgatccaaaaggtgtactgggtgcagactccgtcatgcagaatatgttgcaccctgatgag

SEQ ID NO: 66289 - DNA, 213 bp, Triticum aestivum
  Clone ID: PAT_TA_66289
catcatccatagccagcagccacaatggaagcgagcgtgcaacaaggcaactatgtccaagtctacgtcatgctcccactggacgcggtgagcgtgaacaacaggttcgagaagggtgacgagctcaggccgcagctgaagaagctggtagacgccggtgtggatggcgtcatggttgtacgtctggtggggcttggtggaggggggggccct

SEQ ID NO: 66290 - DNA, 590 bp, Triticum aestivum
  unsure (1)..(590): unsure at all n locations
  Clone ID: PAT_TA_66290
tctaacacaaatcaaccatgaagaaattcctcgtccttgccctcattgtcatcgcggcgaccaccacggccgccgaaccctttactgcattccgtattgcttcggagccgcaacatccatcatctccagagcagcaaccaactctgcagccacaagaacatccagttccacatcaaaagttgaacccttgcagggatgccctcctacaccagtgtagcccagtagctgatatgtcgttcctccggtcacaagtggtgcaacatagcagctgcttggtaatgtgggagcagtgttgtcagcaactaaaagcgatccccaagcagtcaagatgtgaggccatccacaacgtcgtgcacgccattattttgcaacagcaaaaacaattggtacaaggtacttcaacccaacctcagcagcagcaacaacaaggtcaacaagaacatggtcagggttctagccagccacaacaccaacaacaacaacancaactggatcagggttggatcgtggcgatagggacatgggtgattcanaccgttccggcaatgtgcgacgtgcatgttccaccatactgctacaccaccatatca

SEQ ID NO: 66291 - DNA, 501 bp, Triticum aestivum
  Clone ID: PAT_TA_66291
acagaaaccaaccaaggactggagctgtgcactatgcctggttagtcgacaatgtgaagctgctctaaatgcgcatcttggaggaacaaagcataaggcaaagttggcacagtgtggcgtcagcaagacgatcaaagatggcaaaaactgctcgcagacgaccactgggaatgagaacagcacagatccttgtgatgcacctaaaaaaatatgcatgctagtagacagtgcaatgcatgaagttgttcggaaggacaactacctgtggtgtgatcactgcagagtcagttgtgataactacgccaccatggcttgccatctgcaatgcaagaagcagagtaaattaaccaaggtttgttcatcgataaaggctgtgaggacaaataccaatactaaggaaggtttaccttcttttggaagtcaggtaaatacaaatggctctactgaaattccagcggtaattgaaagcgacataaatatgaccaccgcggtagatgaaag

SEQ ID NO: 66292 - DNA, 407 bp, Triticum aestivum
  Clone ID: PAT_TA_66292
gcgcacttgtggtggtgatatgctttggttacccccctttccataacaccatatttgatctcgcctgcctgccttgccattgtcactgtcattgtcatcatgcagctgtgctctcctcctcttcttcttctcccttcgcttttctctactgctcccaccagcttcatatagtggccggtagctcaacgacgtcgttgctgggttcgttccgttcactgtgtagagagaaacaacattgcctccttgggttctggtggcgaggaggagaaacttcagaagcagaggagggcctctctctatatgggaagacggccggataggtcgctaggggcatcggcgtgttgcaagcgagtggtggccgtcatcttcctcgtgtgtgttgcccttcttgtggtgatggtggcgac

SEQ ID NO: 66293 - DNA, 189 bp, Triticum aestivum
  Clone ID: PAT_TA_66293
gcctccctgctccccctccgccgctcgcccctgcactcgtcccgcttccagccccgagccgccatggcctccgatgccgccagccagttccagaagatccagatccagcgcgaggacacgacgtttgatgcctatgttgttggcaaagaaaacgctcctggagttgtagtgttgcaagagtggtggggt

SEQ ID NO: 66294 - DNA, 388 bp, Triticum aestivum
  unsure (1)..(388): unsure at all n locations
  Clone ID: PAT_TA_66294
aagcgaccgcgcctccccgcctcctccgccgtgccgtcctcccggcaccgtggcctgccccctctctgccgcgccctcctcccccgcaccgtccaagtcctccgtgcgcggttcgcccacgccgaggcccaggccgccgcgctccgtgcccgcgccggccggccggctcgagcgcgcgccggaggagaggaggtcggctggaggggagcgaccaacgtcgtggtggtctcggcggcgagcgacgggaggagggcggagatgatgcgtatgagggcnaagcggctgtgtgcaggaggcttcccgacggattggggagacagcgcgaggcatcttccacggcatgggccggggcgccgtgcttcctcagattcgcgttttgagtgtgtgt

SEQ ID NO: 66295 - DNA, 507 bp, Triticum aestivum
  unsure (1)..(507): unsure at all n locations
  Clone ID: PAT_TA_66295
cctctgacaccatcgacaacgtcaaggccaagatccaggacaaggagggcattcccccggaccagcagcgtctcatttttgctggcaagcagctcgaggatggccgcacgctcgctgactacaacatccagaaggaatccacactccacctggtgctcaggctccgtggtggcatgcagatcttcgtcaagaccctgaccggcaagaccatcaccctggaggtcgagtcctctgacaccatcgacaacgtcaaggccaagatccaggacaaggagggcatcccaccggaccagcagcgtctcatctttgctggcaagcagcttgaggatggccgcactttggcggactacaacatccagaaggagtccacacttcacttggtgctccgtctgcgcggtggccagtaagctcctggccatggatctgcttctgtctctgggttcacaagtctcgttgtcctcggtgtnctccaatggagtctggtctgtgtccgttgatgcctgaact

SEQ ID NO: 66296 - DNA, 399 bp, Triticum aestivum
  Clone ID: PAT_TA_66296
tcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggttcagggttccatccaaactcctcagcagcaaccccaacagttgggccaatgtgtttcccaaccccaacagcagtcacaacaacaactcgggcaacaacctcaacaacaacaattggcacaaggtacctttttgcagccacaccagatagctcagcttgaggtgatgacttccattgcgctccgtaccctgccaacgatgtgccgtgtcaatgtgccgttgtatagaaccaccactagtgtgccattcggtgttggcacc

SEQ ID NO: 66297 - DNA, 344 bp, Triticum aestivum
  unsure (1)..(344): unsure at all n locations
  Clone ID: PAT_TA_66297
tccccgtcgccctcacgctcttcgtgctcgccgcctcccttcgcgtgctgcctcatggcttccatcgccggatctgccgtgtccttcgccaagcccgtcaaggcaatcaacacgaactcactctctttctctggtgcaaggaggggcaatgcatttcttcgcttgcagccagtgccgatgagatttgctgtttgctgctcagcaaagcaggatacagtggagaaggtttgtgaaattgttaagaagcagcttgctgttcctganagcactgaagtttgcggtaccaccaagttttctgaccttggagctgattcactggacacggtcgagattgtgatgggcct

SEQ ID NO: 66298 - DNA, 238 bp, Triticum aestivum
  Clone ID: PAT_TA_66298
cttatagccagccaccatgaagacatgttcatcctcgctctcctcgccttcacggcgacaagcgcagttgcgcagctgtacactacctgtagccagggctacgggcaatgccagcagcagccgcagccacagccgcagatgaacacatgcgctgctttcttgcagctgtgcatccagacaccatatgtccagtcacagatgtggcaggcaagcagttgccagttgatgcggcaacagt

SEQ ID NO: 66299 - DNA, 212 bp, Triticum aestivum
  Clone ID: PAT_TA_66299
cttcgccccagttccgccaatcctcactcttcgcctccccaggtgactcttgattgatttttctcagctcaagattcggttccaagatagcaagatagtccggttgtgcatgactaaccctgccgtgctgatgcatatctatagttggggaatttagttgaatttcaagatctttggctgtttcgtgcccagaacagagcagggggaagggg

SEQ ID NO: 66300 - DNA, 526 bp, Triticum aestivum
  Clone ID: PAT_TA_66300
ggcgctacgagacgcggcctcggcggacccgctcggcgccggcggcgtccacggcagcctctacgcatccctccgcaccaacctgccccgcgagtccatgggcttcctcgacttccccttcgtcgccgatgagggctccattgacccgcgcaggttccccgggcaccaggaggtgctccgatacctcgagacgttcgcgcggcgcttcgatctccttgggctggtccggctccagaccgaggtggtcggcgtccgccgcagcagggtcgacggcgtgggcgcgggtgcggcgggctggacggtctcctactgctcgaggaagctcgccggcggggaactacaggaggaggaggagcagtcggaggtgttcgacgccgttgtcgtctgcaacggccacttcgccgagcccctcctcgcggacatcgccggcataggcggctggcccgggaagcaactgcacagccacagctaccgtgtgcccgacccgttccacggccaagtcgtggtggttataggataccacccc

SEQ ID NO: 66301 - DNA, 503 bp, Triticum aestivum
  Clone ID: PAT_TA_66301
gacgcctctcctccgcaacctccccgatgagatcgtgctctgggagatcctcgcccgccttgaccccagatcgctcatccgctgccgcgccgtccgccgcgcctggcgccgcgccacctccacccgtcgcttcctcctggcccaccacgcacgccagcccgcattccccatcgccgccgacaacaggtaccgtaacttcctcgccttcgaccaccggtccgccgccaccgccgacgcccagttccacaccgtcgcccggcttggcgggtccttcagtctggagctctgctgcgacggcctcctcctcgtcgccaagtctggcatgcttggcaatcgcgcccgcctcgccgtctgcaacccggtaacgcgtcagcacgcctccctcccgcccctgccggacttcaacatcctggggatgtacctacacggacctaccgacgagtaccggctgttactgcaatggaggggcgcaatggactggggggacgacagtgactttgact

SEQ ID NO: 66302 - DNA, 358 bp, Triticum aestivum
  Clone ID: PAT_TA_66302
taccccctgctcccctcctccttcccttgatttatctctctctcccccaccctatcttcccccttccgtgttgccatggcccgtcgctccttcgaccccggatcccggtgatgctatctcctgtgcgccgcctcaatccactgcccttccccgcaggctcttccgcgctggcttccacgagctgggttgttgcctcctcccctcccgtgcactatctcaacttttctccacaaaaatgatgaaaggcagcggctcaatgcctccttggaactccaccctgtttaacttcttcctcctgattccttccactctaaattaatttagggtctgggtgtgtagtttttatggtggggtgtga

SEQ ID NO: 66303 - DNA, 459 bp, Triticum aestivum
  Clone ID: PAT_TA_66303
cactactttccttccacatccctcgtgccgtttgcacgtacgctctctcccgttttctcctccctcggctccggtggacacgtcttaaccggagcaagctacctagcgcgccgcggtcggccattgtctcggcgactggtcagtaactgatctgcagctacctagagagtagtgtgagtgtgtgacggagctaggcggcctgcagcaacgcacagctacatatacaggcagctgggttggcgcggttctcggaaaagaacaacactccaacaagaaagaaaggcttttagctaggcacgagaggatggtgaacacggcgtcggccggcgtgaacaaggcggcggcggcggcggcgcaggggggtcaccggcgctgccgctggcgtcgctgaccacatctctgtggtgtgcccgtcgctggagagctcgctcagcttctaccgcgacgtcctcggcttca

SEQ ID NO: 66304 - DNA, 587 bp, Triticum aestivum
  unsure (1)..(587): unsure at all n locations
  Clone ID: PAT_TA_66304
cctatcattaatgccttcgggtctatacgtatctacctattactgcaggtaagcaatcgtccttttatgtttatatatactggattgtttgctactgaagaacctagtcttactttcatttgagccttgctcatagattagtactgaagaacctagtcttactctgatttgagccttgctcatagatcagtactgcagaacctacaactaactgaaactatatatttttacgatcgatcggcatactcgacttcaaccataatccaaaaaaaaagttgaatccttcatttttcaaatttgaagatttgatggtcaaataatacactaagtgattaggtagaattatatacgggctgtgagtgattgatttagatttgaacctttgtcgccagcgtagtggttctgagaagaaagtnntactagtactagaaattaaggtcggcactaacacatcttcatcttgtagctagtggctatgttattttttaatttagagaatcacttacccttcttgatgaattatagatgcgaccaattctcaaaatcagtatttttgtcaaacaacatctgctaatttggaactatta

SEQ ID NO: 66305 - DNA, 219 bp, Triticum aestivum
  Clone ID: PAT_TA_66305
gtggcatgggctcggctcatggcagcggtgttgcgtcggcgtggttcagctcatggtggtgtacaggtcgtggtgcagcggcggctgggctctccggtgtcggctcgtctgcgtgcggcccttggggatgctgttggtctctctcgtggatgcaggttgtggccagtccggctcctcgcgccgttgagcgggtggccggtttgggccaggtgctgatcc

SEQ ID NO: 66306 - DNA, 601 bp, Triticum aestivum
  Clone ID: PAT_TA_66306
cacgggtctggcctaggtgagtcccggcctccctcctcccttcgtccaagccaggagttcccctcccgacctgatctgacggagccacatccggctgggagagcctccatagagcctccacgtcggtggagcaacagctgcccgatagaaggtgggtgtccaattgttgtccagcagctcaccgttttctcgatctggtgcatggttcaacctacacggagggcggtggaaccgagacacggcagcttcacctccacaagcggctttcttatcgacctcctctgagcggcgggggcggcggccaggtcagagcttgatatattccaagttccaaaaaataaatccattaacttctatgtttgtaaattttgtaaggagtgcatatggcctgatgttccttgtgtgtatcgtgaggatttgggagcatggcgacggacaattaactagctaattttcgtctctcagctctgcaggaacggtacatcatgtgtggcaacttcagatattgtttctaattgaccatgaaattccccactacatgatgtgtggcaaaaatacttcaggtactgattctaactgagtgtgcatctctactgacagc

SEQ ID NO: 66307 - DNA, 461 bp, Triticum aestivum
  Clone ID: PAT_TA_66307
ccaaccaggccgcctgcttccccgagcgtatcctgtacggtgacgtcatcagcgacaacgaggccggccgctaccagccccgccacagccgcagctccagcaagtcccacaagtccagcagctcctcccgcaagtcctcccccaagaccgccgccggctgcaccagccaccgcgtcaaggtcatcgagcaggacggccagatctgcttctctctgcgcccccagcccgcctgcaacgcccactgccagcccacccagaaggtcgagaagaagatcgacttccactgcgtgtctgacagctccgcttcccgtcactgggcccagatgatcaagaagggtgccaaccccgacttcagccagaagggcgccaacaagtccctcaaggtcaacatccctgagagctgccgcgcttgagtagatttacattatgtgtttgtgtttaaataaaaagtaaaacacagc

SEQ ID NO: 66308 - DNA, 524 bp, Triticum aestivum
  unsure (1)..(524): unsure at all n locations
  Clone ID: PAT_TA_66308
gtgccttcccgccgcgcgcgccacacgcgcaccgcccttccttctcttctcgtttgctatctgatctgttatgtgtggtttctgtgtgtgatgaagtgtgccgaatcttgccctnaggtctgatgaaatcgttggtcgggccttctttgatacgtttgcggtcgactaaagctgattgtaaatccctagatagattattgctgtcgcgtcgttcttgattgatctgatttccgatctgtaaaactctctgtgacggttctctaataaagagctaatgtctcgtcccctctcctcaagttttactgattttctttttctgaccgtcgattccaagtttgaaatagctatctgctttaagattccaagctgttcttcatgtcaaaatgtcgaatccgaaccttggactgaaagcttaatttttcttgcaccttgttttgtcggcgcagtatttagtctcggttgcttcctagccatctgtgtgtatgtactctgcgagttgtatatacgcactgattcatgacgtg

SEQ ID NO: 66309 - DNA, 357 bp, Triticum aestivum
  unsure (1)..(357): unsure at all n locations
  Clone ID: PAT_TA_66309
cttagtgtgatacatgcgccagtggacgtcgatgtcaacacttgctccgtcacggttatgcgggcggagggtggtggccttggtttcctcttcctgtcggactactgcgtccaagtatggaagaagaagacggactgtgatggtgtagcttcatgggtgctgggaaggactgttgcactanacaacctactttccatgaattcanangaggggagtcagagcccgaggatactcgggtttgctgaggacaacaatgtggtgttactgtggacatttatcggcgtcttcaaagtccattttgaatcattgcagtctaaaaaacttctctaatactacccctcttacccctggtgtcac

SEQ ID NO: 66310 - DNA, 478 bp, Triticum aestivum
  Clone ID: PAT_TA_66310
cccgggctgacgcagacgagcttggacatgagcaagatccagtacaacaaggatgtggggaaatcgatcctggagagctactcgcgggtcatggagagcctggcctccaacatcatcgcgcggatcgacgacctgctgtacgtcgacgagctgagcaagcaggcagaccagaagctcccatcgggtgtggcagacgacggcaagatcgcttgcaagaacaaaaaggctgctgccatggccgccgtgcccgcctcgggcacgacgtacgtcacgccgagcttctcaccggcgcagctgtcgagcccgtccaagatcgggcgggcgctgctggtcgacaggcgggcgcaccacggcagggccgccaagagtccgcgctggcggaccacggcggcggcccggaggtcaaggggatgctggtcaccagccccgtgttcgacgccccgttgggcacggagctgtgagcctgcgagtgatccgt

SEQ ID NO: 66311 - DNA, 583 bp, Triticum aestivum
  Clone ID: PAT_TA_66311
cagcgccccttccctcccccctccctcgaagcagcgatggcgcccaaggcggagaagaagccggcggcgaagaagcccgcggaggaggagcccgcgacggagaaggccgagaagccccccgccgcgaagaagcccaaggccgagaagcggctgcccgcgggcaagaccgcctccaaggagggcggcggcgagaagaggggccggaagaagggcaagaagagcgtcgagacctacaagatctacatcttcaaggtgctcaagcaggtgcaccccgacatcggcatctcctccaaggccatgtccatcatgaactccttcatcaacgacatcttcgagaagctcgccggggaggccgccaagctcgcccgctacaacaagaagcccacgatcacctcccgcgagatccagacctccgtccgcctcgtcctccccggagagctcgccaagcacgccgtctctgagggcaccaaggccgtcaccaagttcacctcctcttagattcagtctctggcagctgtagttgggtgctgtttgcccagaattagtgttgctcaatggaaatcggtggaatatcgtttagttt

SEQ ID NO: 66312 - DNA, 525 bp, Triticum aestivum
  Clone ID: PAT_TA_66312
cccggtcgcctcacacgactccgcgccccccctcctcctcctactcccctgccaatccggcgacccccccacccaccccacctgatcggccgcctcccccaggcccctgcgccacgcaatcgagcccaggccccgccccgcaatgccgggcctcgccgccgccgagcaggacgccgtctcgctggtgcgccgcgtcgcccgggccctcaaccgccggatctccgacctcgtcgccctcctcttccgccacaagagcgcggggtccttcggcgccgtcgcgggcttcgccatcgccgtcgtcttcgcgtggaagttcctgcgctcctcctcgacgcccaggccccgccggcccgccgcccccaagcggccctcggccgccggctcggccgcgctcgcccccgacggcccggccgagcccgccggcgactctgggacgctgacgaggcggcagatcgtggcgaggcggctcggtgggtgcagaagggtcacttgccaactaatcggtattgtatttgaggagaaaac

SEQ ID NO: 66313 - DNA, 383 bp, Triticum aestivum
  Clone ID: PAT_TA_66313
tctgtgctcgcgttcgtttccacggtgcagttctagtttgggttgagtccgagtcaggccggtttgttgccaggcatgtgatcgtgaggcgaacgcgttcgtgtggagcggaagcgtaggcgctgcgtttctgttagctaaaaagctggctgatctcgtgtttgttacgagatgtgtggtgcgtccaggttgttggcgtttttttagcaccggtgacgtgcgtctgcctatataggtctatgtagctcgtgatttgtttacagtttgagctggagaaaaacgctgtttggcagcgaggcgttcgtcgccgcaaacacctgtgcgtttacgtcttcttctacctctgtctctgaaaaccagttcgtgctatctagggttagacc

SEQ ID NO: 66314 - DNA, 623 bp, Triticum aestivum
  Clone ID: PAT_TA_66314
tcgacgaaatcgggtgcccgtcggtgcgatccctctgctgcattggcatggcggagccggaggacggcggccaggtcgcccctcctgagcggcggcggcggcgacgagcgcggccgcccattcgtctccccctgctaaggaggagccggcggcagcggcagaggcaaagccggccagctccggcgaggcggtctccctcaactacgaggaagcgagagctctcttgggaaggctggaatttcagaaaggcaatgtagaagatgcactttgtgtgtttgatggaatagaccttcaagctgccattgagcgcttccagccatcatcctcgaagaaaacaacagaagctactcttgttcttgaagccatttacttgaaagcattgtcccttcagaagctaggaaaatcaatagaggccgctaaacaatgcaaaagcgtcatcgattctgttgaaagtatgttcaagaatggcactcctgacatcgaacaaaagctacaagaaactatcaataaatctgtggaacttctcccagaggcctggaaaaaagctggttctcttcaggaaacatttgcttcatacagacgcgctcttctcagcccatggaacctcgacgaggaatgcatcg

SEQ ID NO: 66315 - DNA, 205 bp, Triticum aestivum
  Clone ID: PAT_TA_66315
gtgtggtatcttgtcgtctggtggtggttgatctggttctattggtggatccttttcttcgtggtctgtgcaagattcttgggcgacggcgtgtctgctgacatccataacctttttgtgtttactggatatattattaacttcatgctcttttgtggtggtcgcatgcataatatgttcttttggcttgggatttggcggaaac

SEQ ID NO: 66316 - DNA, 655 bp, Triticum aestivum
  Clone ID: PAT_TA_66316
cacaattgtttaagtcacaaactatccaaaggatgactagtgtaagagatccttctttaccgtctgcaacagaaataagtaaatcaagtggacctgctccagaaacagaaccagtcatcctcatactgagtgcacgtcaggcaaatattctgctttcatcgctgtggacccaggcactgtcacctgaaaatgttccacgaaactatgaagcaatttcacatacttacagcttgatgctactattttctggagacaagaactcacatctagaaattctggtcggcagctttcagctttctttttctttaagaaatatgtcattacaagcaggttttctgccaccatcacgcaggcgttctctttttactctggcgacgtctatgattgtgttcttttcgaaagcttttagtgttccaacactcattccagttgtgaaagatttgttgattgaaagtaccgttgatccatttcttcgtttagttgatgacctcagattgcaagctcttgacagtggtatcgaatctgtctttagagactacggttcgaaagaagataacgattttgctacgaaatctctctctaacatcaaactgaatgatcagtcaaaacaaatagcagtttctcttattcttgataacttgaagctatctgaccc

SEQ ID NO: 66317 - DNA, 210 bp, Triticum aestivum
  Clone ID: PAT_TA_66317
gcgcgctcacctgccccgcttgctcaatggccggcgccgccaagactatatcctgcgcccgtatgagcagtgctcgcggttaggtgcgcgcgcgcgtgctcagagcgggctcacgtacgtgcacactcgtcggcgtccttacgaacgttcggtcatcatggccgggatgttgcccggggtggagtgcgcgcggcggcggcggatgtggca

SEQ ID NO: 66318 - DNA, 604 bp, Triticum aestivum
  Clone ID: PAT_TA_66318
tgcttgggcgtggaacaaaaacccagtgttttgttttggtgttcagctaaaggggaagatctggatttacattgttttatcatggtatggcgttctttattttcgcaggaagtgctccagcggaaacacatctcaaattccaggtgtgcaaccatctattattgttgattttaaggtataatttggccagcaaagagttctgaagattttagttcatagatcttctacctcgattttctgattgatggagcttgtccatacagtaatgagccatctttatttgctgaactgtactgtaaaattggtgtctacactctttaattggtttatgacttgctcatatattcatgtctagctaggttcctgcaaattggatttaagagatgtctacgtctagctgggctccaagaaaggagattctttgttgtccttttaggtttgttggctacctcggttaagtttttgcatgtgaatttttgtttgttcctatccaatagatgctcatatctagctagattcgtaggatgttttgttgcctttcttagtttgtttggtactttcttctttctttggcgatgatgggggcagatttatccggggttct

SEQ ID NO: 66319 - DNA, 632 bp, Triticum aestivum
  Clone ID: PAT_TA_66319
ttgtctacgagtattgcatataagttgtaatgatgtaaatctcatggagtttccggagtatgtctgccagctcaagcatttaagatacttgctactcaggggcacaagcatatcaaaaattccagaaggcataggagacctaaagtttctgcaggccattgaccttgtagggtctataaatttgtgccaacttcctgagagcatcttgaagctacagaacctgagatgtatcagcttgtacggaacaaagataacctcaattcctcgtggattcgggaagctaaaaaatttggtcaatctgcaaggtattacaacacattcagattatagcggagatggttggtgcagcttggaagaactagggtctctgctgaaactcaaatatctttacataacatgtttggataaggcgccttctggttctgtggctgctagagccaagctgagtagtaaacaacacctcatctggttacaattgatatttactagcgattttacagtgaattggggaggttcaagaccctccaccttccataggataatctctgtcctccaccttccatagaagaccttaccatacccatactttggacgtatgctaccccagtggatgagaaatatgtcagcctttg

SEQ ID NO: 66320 - DNA, 634 bp, Triticum aestivum
  Clone ID: PAT_TA_66320
ttacttctactttgtttgctgctcaatctatggatcttaactcccggtcagctgcagaagccagtcttaagctattccaggagcaaaatctttccgcttttctcctgtccttgtcagcagagctctcaagtgatgcaaagccacaagcgtctagggtacttgctggtattattcttaagaacacattggactcgaaggattctgaaaagaaggaattactgattcaacaatgggtgaaccttgatacatctgtcaaaatgaagatcaaaaagtctttgcttacaacactgggatctttggtggctgttgcaaggcacgtcacatcacaagtcattgcaaaggttgcatccatcgaggtaccccgcgggaaatgccctgatgacctcattggcattttactagtcaacttaaaggagcaggctgcatctgctccactgaagcaagcaactctagaagtgtttgggtatgtatttcaggacattcatcctgagaacttggaccaggatcaagcaagtgttattctgactgctgtggtccaggtagcgagtgaggcacatctaagctctgaagtacgtctcacagcagttaaagttctatacagtgctcttgattttgcttatagcagctttgcaaa

SEQ ID NO: 66321 - DNA, 362 bp, Triticum aestivum
  Clone ID: PAT_TA_66321
ccactccactccccctcccacctcaccctcgcctcgcctttttagagagagaaacacgagctcccccacccccacccccatccccaccgaggtagtagagagagaaacccagacccaggcctccccccgcccctgcaccgagctcaggccgtagcggaggaggaggaggagatggagaggccggcgccggtgaggaagtcccacaccaacacggcggacctgctggcgtggccggagggggcgcagccggagctcgccgacggggccacgccgccgcccaaccgccgcccgcaccagccgtcggaggcgatccacaaggtggtgttcggcgggcaggtcacggaggaggaggccgagagcct

SEQ ID NO: 66322 - DNA, 144 bp, Triticum aestivum
  Clone ID: PAT_TA_66322
tctcctcccccattccgccgcattgcgccaagcacacaggcagagcggaaccaggcaggggacagccggcagcagatcgtcgagacagaggagatggcggccgcgtccttcaccgccgccaagttcttggcgccggtggccgcg

SEQ ID NO: 66323 - DNA, 641 bp, Triticum aestivum
  Clone ID: PAT_TA_66323
cttcagtctcctactctcccccgacccgcgtcgccgccgtcgccgccgtcgccgtccccgttcctccccgccgcgcccctgccgtctccgcccgcccggccgtccgcccgcagtctctcgatttcgaggacccggcgctcccatggcgacacccgacgagcatgccgatgccgagggtctgatgggagaacatgctgagaaggagcatgccgatttcgaggcgagggtcaagaggacgatatacatcgaccacctctcccctgtggttactcgccaagttatccgagcagctctttcccagtgtgcgaatgttgtcagcgtggagttcattgagaactacacaatcccgtacgacatccctgccgccgcgctggtggaattggacgacgagtcgcaggccaagtctgctgtggacttgatgcgagatttccccttcataatcggtggaatgcccaggcctgtccgggctagcttggcaaggcccgaaatgtttgctgatcgtcctagcctgcctggctcgaagatggagttcctttggctgaaacaaggagatccggagtatgatggggatgagcaagctgaagagccttgctaagaggcaggaagcagagaacatggcgctcatcaagagtatactggag

SEQ ID NO: 66324 - DNA, 617 bp, Triticum aestivum
  Clone ID: PAT_TA_66324
cggggctacaccccaacgccaactcaaatcgcgcctgttgacctctcaccgacccagattgaaagggctgagctgtatcaatttaagaaacatcttgatgatcttttgaaagaggcgaggcttaggttgaagactcctgatgattttgaaactaatatttctgtgaccctcctgaagccctggcagggtgttcttttgaagtcagcgattgcctttgcgtctatgaaacgaccgggtgcaattcaaatgcgttggaaacttggcgtcactgctgttgatgtagcgatggagaatcaatctataaatagcaaatatgttagattgcttaacgagttcacttggaatatgaaagctttggttgatcacgctcgagaaaatgatgaaatttctgctgaatccgctagtaagttgctaaatgagctgaggaagtttcacacaaatgtttcaatggtgttggctcgtgatcgcagccgttttttggaggcattgcaacagctacctgaaaatgtctcctctcttgctgataagctcttatcttttggcagtgtgttcagagtttttaatagctttgccgatgtggcatatcgtgtatcccagatgggtggtgaccctgcact

SEQ ID NO: 66325 - DNA, 560 bp, Triticum aestivum
  Clone ID: PAT_TA_66325
cgtcttcgtactcgcctctctccgcgcatcctagccttcgccctcctccttccccatttcgccagcggcgcagcccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcatgtcccccgtgctgtctttgtagatctcgagcccactgtgattgatgaggtgaggactggtgcttaccgccagctcttccaccctgagcagcttatcagtggcaaggaggacgcagccaacaacttcgcccgtggtcattacaccattggcaaggagattgttgatctgtgccttgaccgtatcaggaagctttcagacaactgcactggtctccagggattccttgtattcaacgctgttggaggtggaactggctctggccttggctcgcttctcct

SEQ ID NO: 66326 - DNA, 542 bp, Triticum aestivum
  Clone ID: PAT_TA_66326
cagcaggtcgctccggctctccccgaggcattttcatcacggtgcgcctccaaaaacaggtggctcgcttccagtccatgtacctgggcacgtgcgacgcgctgctgccgctgatgggcagccgcttcccggagctcggcgtgaaccggacgcactgcagggagatgacatggatccagtccgtgccctacatctacctgggcgccaccgccgccgtggaggacatcctgaaccggaccacctccagcacccccttcagcaaggctacctccgactacgtccggcaggccatcgccgaggacgtgtgggcggagatcttcgcccggttcgccaagccggaggccgggctgatgatcatggacccctacggcgccaagatgagcagcctcccggagacggcgacgccgttcccgcaccgcggcggcgtgctgtacaacatccagtacatgaacttctggttcgccgccacggacgggtcggcgcagacgaggtggctcagagacatgtacgcgttcatggagccgtacgtgagcaagaacccc

SEQ ID NO: 66327 - DNA, 286 bp, Triticum aestivum
  Clone ID: PAT_TA_66327
gtgtggaacgcatgcgcggtggcgctgctgtggcagcggccggccgctgctgcgagctgcagagatgagggcacccagatctgggttgcgcgtttctgcccccaacccacccgtccctctccttccacccctcccggccgccgtcagtggtagccgctgggcgggtgagcacgcgcgcgacagtccttcacggctgctgctctgctgtgccccggcggttcctggcggcggaggctgcgggccggcgcggcggcggcgcggtgcaggtggctgttgttgcctgctc

SEQ ID NO: 66328 - DNA, 335 bp, Triticum aestivum
  Clone ID: PAT_TA_66328
ggcgcggtcgcacccgcgcgtcacgaaggtgaagcgcgaacctttggcggcgcggaggccggagacgccgccgtactacgtctcggccgccggatccggcccttccacgagcggcatggaccgggcgcggtcgcggcggcggccgcgcgtgagcgagaaggcgcaggcggcggcggccgcgtggacggacggccccatggcggcatcgagcccggagacgcccttcgactacaccaacgccgctggatcaggggcgtcctcaagcggggacgaggtggcgcggtcgacggccaagcgcaaggcgcaagggtcgggcggatccggagtgccttcca

SEQ ID NO: 66329 - DNA, 379 bp, Triticum aestivum
  Clone ID: PAT_TA_66329
gcctgctccgggctcggccttcccgccgcggtggtgcgcgtggcctctctgcgacctgagagggaatgcattctccacttctgccagtgctgtgacagctgggaaaccggctgatgacaacgagcataaagatgccccgaagaaggacatcgatgatcagatagcagatattcagatccttcataacctttggaagtacttgaggctgaacaatagccgcgatttcaacatcaggattgtgttgtccttgggtctcttagtcggcgcaaagcacttggcggcgctgaagcctcactggcaggatttacagatgctaatgcaaccctgttggctctctttgcaagcccagcagcagttctgattggatatggtattgcac

SEQ ID NO: 66330 - DNA, 422 bp, Triticum aestivum
  Clone ID: PAT_TA_66330
gcctggccaccccctcctctctctcaccgcagaaccggaaggagcggagccgccgagccgggaagagccaccaccccatcccatcgcccgcctccgcttccgaaggtcagagatggcggaccgagctaaccacccgtctgtcatgcagaagtttggtggacagttccaccttgcctccagcttctctgagggtgttcgtgctcgcaacatctgcccttctgtgccatcctatgagaggcgcttcaccacaagcagctacatgactcagaaccttggcatcagtgtcccaatcatgtcatcttctccaatgtttgccaatgcaccccctgagaagaaaggtgtcaagaactttgcgattgatttcctcatgggaggagtgtcagctgcagtttccaagactgctgcagctcccattgagcgtg

SEQ ID NO: 66331 - DNA, 527 bp, Triticum aestivum
  unsure (1)..(527): unsure at all n locations
  Clone ID: PAT_TA_66331
acctctggtattgttgtcaacattggattcaatgtcacaaccgttgttcccatctttcaagtagggtgatgcgtgagataggcattgaaactgtggggcaaggtgctctgaaacttactggatttctaaaggagctattgcagcgaaggaatatttcttttgaatcactgtacactgttcggacaatcaaggagaaaatttgctacgtcgcggctgattatgaagcagaactatgtaaaaacacacaagcttcctatgaggtggatggtgaannaggtgggttcacntctatcanaagaaagattcaagatggcagaaatccttttccagccccagattggaggagttcgtgctatggctttgcacaaagcagtatctctatgtatggatcactgctacaacacagaggtgctccgtgatcacagctggttcaagacggtggttttagctggtggatcgtcgtgcttacctggtttgccagagaggctcgagaaagagctccacaaacttcttcctccatacatctc

SEQ ID NO: 66332 - DNA, 337 bp, Triticum aestivum
  Clone ID: PAT_TA_66332
tctgcctttgcaagaatcgcagctgacaactactcggctctagctggcccggatcgacgcggcatggagctggagctcgggctggcgccgccgaccaacgccggccgccccccactcggcagcgggaagaggggcttcggcgaggcgttcggggaggacgaggagcagcgcaggacgtcgaccacgacgctgccgctcttcgacgacggcagcagtagcagcagctgcgacagcggcagcggcggcggcgttggggggagcaagaaggcgctggtggggtggccgccggtgagctccgcgcgcagcagggcgtgcggcaggcacgtgaaggtgtgga

SEQ ID NO: 66333 - DNA, 350 bp, Triticum aestivum
  Clone ID: PAT_TA_66333
tttttttttttttttttttttttttatttcgcagctatcacttgcattttcttcatacatattccatctgacatcataccatatgtttccaatcaaatgttgttcttgtgcatcagacatcgaaaaggaagagggtgattgccgaacctgaaggagtaccagcaaagtccttgaaaaacatggtggtgccggagaaatcaaaaagcaccccacttttattggttgtacaaccagtgacacaaaacgtaggaccgactccagcacactatacccatacttcactgtccacaccactagcctcaccatacaggacctgcactccagcaaaaggtataccgatttaatttgcc

SEQ ID NO: 66334 - DNA, 431 bp, Triticum aestivum
  unsure (1)..(431): unsure at all n locations
  Clone ID: PAT_TA_66334
gctttctttgaagcaggaaccgtgctgattctttagtttcagacatttatgactggggtgcttcagccataacaatacatggtcgatcgcggcaacaacgctacagcaaaaatgccgattgggactatattaaccagtgtgcacagaaggcccctgacgacttgcatgtcattggaaatggggatatattctcctttaccgactggaacaggcatgtttctggcagctccaaaatttccacttgcatgattgctcgaggtgcgcttgtcaaggttagtatgtacagcagtttacatgatttaagttgttatatattatgagaataaaacaaatggttcggagtatnttgggaaagcatgattatgaaccaaatttttagcttggaattgtgttcagttctagatcagtgaactatgctccagtgtttagtc

SEQ ID NO: 66335 - DNA, 313 bp, Triticum aestivum
  Clone ID: PAT_TA_66335
ctgaccgaaaaaaccatgctcaaccaccccactgccgccccagtttcccccacccctgcagcgccgccgatcttgctggtatggacgcaggcagcccgaatcaatctgactgatctcgcctatatgcgtgcagcgggtgttccatgggtcgggcgagcgatgaagagtggcccgcattcagatgatgatgggctcaaggtggaacccaatttgaagtttctacctgggtctcttgtatcatgtggccgtgaagatcctgatccatgtcaaattcagcccgatgttgtatatggttgattgttcgtgcagactc

SEQ ID NO: 66336 - DNA, 369 bp, Triticum aestivum
  unsure (1)..(369): unsure at all n locations
  Clone ID: PAT_TA_66336
acaccatccacccttctctactgactcgcagcagccccaccaccagcgaatggccgcgtcggcgctgcaccagacgaccagcttcctcggcaccgccccgcggcgtgatgacctcgtccgcagcgtcggcgacttcggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacgggtgggacaccgccggattgtcggctgacccanagaccttcgccaagaaccgggagctggaggtgatccactcacggtgggcgatgctcggcgc

SEQ ID NO: 66337 - DNA, 340 bp, Triticum aestivum
  Clone ID: PAT_TA_66337
cgttcatgcggcaggtgtttgtgcgccaccatattctctgtgtccatcttcttcctctccggccgtgtctccggtgatccccgtcgagtgatagggctagctgcgccaacatcattctgctccctggcttctctgcgctcctctctcgtctctccggccggcaagaaccgaagcagcagcagccagcaggagtcctaagtcagtggaccatcgaggtgatctacggccgcaacatcatcgtcctaagctgtcctggccggtccgctgctgaatcaaggtgagctctcatagttctcatatgtagctagtcatgccaaccgttggcgagtgtgtgtgtgtg

SEQ ID NO: 66338 - DNA, 157 bp, Triticum aestivum
  Clone ID: PAT_TA_66338
ctcgccagggacctccggaagcagatggaggccgacgacgatgtcgaccccaaggcccagaggaaggccatgaaggacctcggcctcaccagggcccggcactttgggtggcccaacacgtacgtcttcaccaagtccatggggggagatgatgctg

SEQ ID NO: 66339 - DNA, 516 bp, Triticum aestivum
  Clone ID: PAT_TA_66339
ctgcctgcccactgccacaaccaccaaggcgacagagcggccgccagccatgtcgccgcctaccatgttcacgttgcagctgctccttgtcctggtggccgcaaccaccacggccgctcctgcggtcctcggcggaggaaagcaccaccgcggcgtcctcagcacccccgtccgccggctcaagccggacgtgcgggtgtcgaagatcggcggcggcggcgccggcggcggcgctgtcaccgtcacctccgtcggcgaggcgttgcgtctctggaataatctgacaggagggcacttcgtcatctatgtgaccgccggcacctacgaagagcagatcatcgtacaacaaaggcgcaccaacgtggtgcttatcggcgacggcgtcggccgcacaatcatcacgggagccctgtccgataggacagggcacaacgtgatgcaatcggccacaatcagtgtgtttgctgatggtttcatggctcgggacgtgacgattcaaaacacggcgggcgggcc

SEQ ID NO: 66340 - DNA, 282 bp, Triticum aestivum
  Clone ID: PAT_TA_66340
tacgccactgacgtgtacagcggcaacctcgccgccacgggcgggtctcgtgctggctggatcttggggcggtagcagtacttggtgcagcgccgccgcggcgactacggcagcgtcgaggtcgtcgtcctcctcatccgcacagggaagctggactgggaggtttgctgcttccggtcggcagacgatggctatgacgctatgcccagcacgagtgctaacgccatcacgaccggcaccactggcaccagcagccgtacggtgtgctctccgggatgctgc

SEQ ID NO: 66341 - DNA, 415 bp, Triticum aestivum
  unsure (1)..(415): unsure at all n locations
  Clone ID: PAT_TA_66341
tgcacaagcatacatggttccgatcagtaatttgtttaccctgatcatcttgctatccagttgtgttggtatggtctgaaacagattcacaagtatttatgatgatcgtttgcatggtgggtcgtgctagcaatgtgctttgcatatacacgattcaaatatttgttaggtgttttagtttacacatttctcctgaaaatctgtatatgtgtatgcagccatttttgaattggctatgattctttttagtattttagtttacacatttctcttgagaatcttcatttcgaactgtaatagtatgtataatataggtttgtaatttttccattagttggttcttgcccnagtcttctgtttctataccatactgttctcgtgtcattcccgttagttcttatagggcctgcagatc

SEQ ID NO: 66342 - DNA, 502 bp, Triticum aestivum
  Clone ID: PAT_TA_66342
tcctcccacccccaccgtctcgccgccgccaccaccgccgcagctagataagaagaaaaaaagagagagaagaactcgtcgggagggctcgagatctgtgtcgggagagagggaattcttgagatcggaatcggaacaagcgggcgcgctcgggatcggggttaccatacaatttttcccaggaacctttagtgaatgtgctaatggagtcaaagggtggcaaaaagtctagcagtagtagttccctgatgtacgaagcacccctcggctacagcattgaagacgttcgacctgctggaggcgccaagaagttctctgctgcatactcgaactgcgcgaagaagccatcctgatatcgtttttggcatccccttctcgtagtttaggatttttatgcaattttattctgactcttttctcccaccaatctctctggcttgctgcttcacgattatcgaccagttctctagtctttctccctctggtcctctctgctctgctc

SEQ ID NO: 66343 - DNA, 364 bp, Triticum aestivum
  Clone ID: PAT_TA_66343
gaattcgccatggcccagcatctgctcgtggcggcggacaagtatcgcatggagaggctcaagctgatctgcgaggacaagctgtgcaagaacatcgcggcgggcacggcggcgagcatcctggcgttagctgaggtgcaccactgccatgagctcaaaggtgcatgcttccatttcctcagctctccgaagaacctgacggcagccatggccggcgacgacttcgagaatctgcgctcaagcttcccctctcttgtcaaggagttgattgccacgtgctcgatcgatgcctcagctcagtgatggttgattattgattgatcctaggatgcttattgattatatatgctctgcaagctactcc

SEQ ID NO: 66344 - DNA, 363 bp, Triticum aestivum
  Clone ID: PAT_TA_66344
attgacgacattgctggcagaatcgaaccaattaaacattgccaccactgagcaactacatcttcactggccattaattttgcctttcaattaagacattctttttgcattgtgaggaggtattgatgcataatccaacacttgatccaaggggtgacatgagctgcctgtgtgatgtcaactttgcaagtgaatccggagatcagttttttattatttattgtcttcttgatttttcagtgtcgaaaccctaatcaatcttagggcaccttctgacacagtgcctattttgatgatacgctatgttttcttaccatcttagtttggtggtattggctggtgagctgtgttttcttttacact

SEQ ID NO: 66345 - DNA, 456 bp, Triticum aestivum
  Clone ID: PAT_TA_66345
tcctgccgcgacgcctcgacctcctgttcagccatggattcttgccatcatccacgtcatcaggaacacgattgggccgggggagaaggcagaacctctgggtgcatgatggaaaccatgatgcatggtagaacaggttatgcttttgcttttcaattatttttccttgtcgatgattccacatttgcacctttgggttgtaggttgatatgagaaaaaagattactgtttaatgtaacaatgttcaatctcttcgtaattcattcagtccaaatccaacacacgcaaagaaagctgcgttgagtgattttccagatgtgtgtgtcttctgattctgtgatccgtcctttttgtcaatcaagatcactttgtagaagcaatcaatataactaaatgtatattttaagcaatcaacatcaatattttcttctcaaaatatatttttaccatcagtgg

SEQ ID NO: 66346 - DNA, 517 bp, Triticum aestivum
  Clone ID: PAT_TA_66346
cggcgtccacctacgacgcggccgcgagcggcggcatgacggtgttctgcccctccgacgacgccgtggcgtccttcatgccccggtacaagaacctgaccgccgacggcaaggcgtcgctgctgctgttccacgccgtccccgtgtactactcgccggggagcctcaagtccaacaacggcgtcatgaacaccctcgccaccgacggctccgcccggaactacaacttcacgctgcagaacgagggcaacgtcgtcaccatcaagacgggcgcctccgggggcgtcgcgcgggtcaagaccacgctgctcgacacggaccccgtcgccgtctacgccgtcgacaaggtgttcgagcccgtcgagctgttcaagcccgcgccgtccccgacccccgcgcccgcgcccgccccggcggccgacgcgcccatagcgggcaatggcggcgccgcgcgccaccgctcgccccccgccgtcgcggacgcgcccggacccgaggctgaagacaccgccccggc

SEQ ID NO: 66347 - DNA, 270 bp, Triticum aestivum
  Clone ID: PAT_TA_66347
gatgtaatttcggtctcaaaggaactttgggttggttcactgggaaaagtgctgcagagcactagttcgatctaaattcgaggagtttggcccattaacaaactttttattttatccttccaaagaatttgccttgattgaatatggaaacatagtgcacgctgttcgggcatgtggatatatgcggggctcctctatttggggtggtgatcttcaataaggtatttagatagacttataggtagcaagggatttgttggtggtatagct

SEQ ID NO: 66348 - DNA, 450 bp, Triticum aestivum
  unsure (1)..(450): unsure at all n locations
  Clone ID: PAT_TA_66348
cccgtctcgcgtcgcagcggcagttccactccctcgccatgggcaagataagcatcggatcaacggtttcggaagatcgggaggctcgtcgccagggtcgccctccagagcgacgatgtcgagctcgtcgccgtcaacgacccctttatcaccaccgagtacatgacctacatgttcaagtacgacaccgttcacggccactggaagcacagtgacatcaagctcaaggacgacaagacgctgctctttggcgagaagccagttaccgtcttcggcgtcaggaaccctgaggagatcccgtggggtgaggctggtgccgattacgttgtggagtccaccggtgtcttcactgacaaggacaaggccgctgctcacttgaagggtggtgccaanaaggtggtcatctctgccccaagcaaagatgcccctatgtttgtggttggtgtcaat

SEQ ID NO: 66349 - DNA, 555 bp, Triticum aestivum
  Clone ID: PAT_TA_66349
cttctcgacatcttcctccgcctgcccaacctcccggacctcgtccgcgccgcgctcacctgccgcccatggctcggcgccgtccgctcctccccgtccttccgccgcctcttccgcgccatccacccggcgcccctcctcgggatcttcctcaaagtggacgacgacaccgccccctccttcgcccccctgcgccgctcggatcccgtcgtcaccgccgccctccgccgcggggacttcttcctcacctccctccccctggacgatgcctggactgtcacggactgccgcgacggttacatcctcctatggaatactttctgggccgtggctgtggtgaaccccatgacctgggctgtggatgtcatctccttccccgacgacgtcgcggatgggagccttcgcgatttcgccttccttggtttccacctgctgacttccgacgagaacccccggtcgttccgtgtggtctgcctctgcgccgacgtgtctagggttcgtgccgcagtcttctcgtcggagacctcggattgggccgtccacccgtgggtggag

SEQ ID NO: 66350 - DNA, 656 bp, Triticum aestivum
  Clone ID: PAT_TA_66350
gcattttcttctctgcaagtcatttctcaagtgtacattgagcaatgcctacattttgaatctctagacctctctccagtgtttgcttatttgagtttggctacatatagtgctcttcatgatgttgatcaaacagacatgagctgctctgagtcgacaattgtcaaccagtcattggaccatctgctgagatgctatgacagatttgtaaatggatctgttactgtttccactgactcaacgtcaacattgaacaagaataagaaatctgcagaacatgaacatcagcagcatgtcacccctgaaggaagtccagcagaaggcacaataaatgtgattatgcttggcacttcaattctcaagttcattgttgattcgacaaccatcaagctggtcaatgagagtaaagtaagatgtgtggggatttgcatcatcttacacaaaatatgcagtgtcagccatgaaaaggcacagtgagggctcatcttttaatggggacgatctgaaagacatactgatccttacacgaagctccttcacttacgcagccaagctgcttcatttggtgctagcaagctcaagcgagtcgtcgagtcccccagaagaggccttcctcctcgcaataatcttcttgatcttgtacctgctgtcgaatc

SEQ ID NO: 66351 - DNA, 595 bp, Triticum aestivum
  unsure (1)..(595): unsure at all n locations
  Clone ID: PAT_TA_66351
tccgtctagcgtcggcggcagttccactccctcgccatgggcaagattaagatcggaatcaacggtttcggaaggatcgggaggctcgtcgccagggtcgccctccagagcgacgatgtcgagctcgtcgccgtcaacgaccccttcatcaccaccgagtacatgacctacatgttcaagtacgacaccgttcacggccactggaagcacagcgacatcaagctcaaggacgacaagactctgctctttggcgagaagccagttaccgtctttggcgtcaggaaccctgaggagatcccgtggggtgaggctggtgccgattacgttgtggagtccaccggtgtcttcactgacaaggacaaggccgctgctcacttgaagggtggtgccaagaaggtggtcatctctgccccaagcaaagatgcccctatgtttgtggttggtgtcaatgaggacaagtacacctcanacgttaacattgtctcaaatgctagctgcaccactaactgccttgctcccctagctaagatcattaatgacaacttcggtattattgagggtttgatgaccactgttcatgccatcactgccacac

SEQ ID NO: 66352 - DNA, 143 bp, Triticum aestivum
  Clone ID: PAT_TA_66352
cgccccgccgtactgcgacatgctgacgcgggtccgccgctcgtcttccgagtctcctcgtcctggccgcgattgagtcaggcagaccagcgccgacaaacgagcggatccgagggagtccgacgaggatggaggcggtgggc

SEQ ID NO: 66353 - DNA, 637 bp, Triticum aestivum
  unsure (1)..(637): unsure at all n locations
  Clone ID: PAT_TA_66353
cacaaagtgggtatctgcccccgagttccgctcaggccctccttcatagttagcgtcttggactgacgtaggacggaattatgggcccgctggcgatgtaccagaactacagaatcgtattcgggagcttattgagagggacataaatcttgtcagcataatgcaagtgatgctaatccgacggatgttgccgtgcaaacgccggcctcttcggatgtgggaatttaatccagagggtccgcggactattaagcacttcttcggcttgaatctcgaaggaatgtgtaaattattcttcggaccacaagtaaagtgtccggacgccaccgaggatgcgggcctaagctgcaatcacctagatgcccaagtaagtaaccttaaagccggacacttcatttatatttatcataactattattctgaaaatccctccgtggccaggaatggctcaacaaggcggagagaatccggtgtccgacgccacttcccgaatgctcgcctggtccaactatttcaaagatgctcggccgggcgctcagaaaaatcccctcagggaaaggcgnaagaaagggcagtgaagacgcactatgcatccaaaccggcggaatcgctacctctactatggaggatagccggg

SEQ ID NO: 66354 - DNA, 561 bp, Triticum aestivum
  Clone ID: PAT_TA_66354
cgcagcggcgcgcacacctctccctccttcctgaagacgcgccgccgccggccagagcacaggatggcgaccgtccccgctcccgcagccgagaccgcggcctccacggcgcgcaccgtgaaggatgtcaacccccacgagttcgtcaaggcctactccgcgcacctcaagcgctccggcaagatggagcttccagagtgggttgacattgtcaagactgcaaggttcaaggagctgccaccttctgatgctgactggtactacatcagggctggtgagtacatgttttctgccttcctggttgcatactcgatttattcacatgtagtattgatgtccttgccactctctgatttttatctgccatttcaaatcatgacagcctccatggcaaggaagatctacctgaggcagggaatcgggatcggcggcttccagaagatctacggtggccgtcagaggaacggttcacgcccaccgcacttctgcaagagcagcggtgctgtttcccgcaacatcctccaggagttgcagaagatgggcatcattgatgtcgacccc

SEQ ID NO: 66355 - DNA, 630 bp, Triticum aestivum
  Clone ID: PAT_TA_66355
ccgcagcgccgccactccacccgcagcggcaaccatggcggtcggcaagaacaagcgcatctccaagggaggaagggaagcaagaagaaggccgtcgatccgttcaccaagaagcagtggtatgacatcaaggcgccgctgctgttcaccagccgcaacgtcggcaagaccctcgtgtccaggacgcagggtaccaagattgcctcagagggtctgaagcacagggtgttcgaagtatctctagctgatcttcagaacgatgaggaccaggcctacaggaagatcagactccgtgctgaggatgtgcaagggatgaatgtcctcacaaacttctggggcatggacttcaccactgacaagctcaggtctcttgtgaggaagtggcagacactcattgaggctcatgtggatgtgaagaccactgacaactacatgctccgcatgttcgccattggcttcaccaagagacgcccaaaccaggtgaagcgcacttgctatgcccaagcaagtcagatcagacagatccgccgcaagatggttgagatcatggtcaaccaagctgcaagctgtgacttgaaggagcttgtgaacaagttcatccctgaggtgattggaaaggagattgagaag

SEQ ID NO: 66356 - DNA, 595 bp, Triticum aestivum
  Clone ID: PAT_TA_66356
taccatttatgcacgccatcaaattatttgtttactattgatttagaataataatttgcatatgtcaaacattcataaagtatgttcttcagctcataagtttgagcgatgagggttacttacctttaaatcaatgctcggttgcaattttcttattctatacgagcattcctgaatcatattgttctggttgattggaagtcaggtgaacttgatattgaacaaaacaattaagagttggaacttgtaacaacatcaaattacaccttcacttttctgatgatacaagtgatcggtcattgttaagctttgaatatattttgccatatggtattcttgttcttttctcttcactggtctgccatacgtttttgtgatgcagcattctaacaaggctccactcatttattgtaagatgttacattttcctcatctacgagttagaaaaaaaacttaacacccattcttaattgtgaagcacacacatgattaggacatgaactgttattcaagcctagaaatttgtattattaatattaaatactttttaagcactacacctctgctgcaggcaattcttttgggttattctact

SEQ ID NO: 66357 - DNA, 609 bp, Triticum aestivum
  Clone ID: PAT_TA_66357
ttcatcaacacccttttggccggttcttctcttcacgaggaggcaggcaagaagaggaacttcgttgagaccatcgagctccagatcggtcttaagaactacgaccctcagcgagacaagcgattctcgggaaccgtcaagctccccaacatcccccgacccaggatgtccatctgcattcttgccgatgccgccgacattgaccgagccaagcagatcgagctcgagtacatgtccgttgacgacttgaagaagctcaacaagaacaagaagctcgtcaagaagcttgccaagaagtacaactccttcctcgcttccgagactctcatcaagcagatccctcgattgctcggtcccggtctttccaaggccggtaagttccccacccccgttgcccacgccgaggacctccagaacaaggtcaacgaggtcaagtcgaccatcaagttccagcttaagaaggtcctctgcctcggtgttgccgtcgctcactgcgacatgactgaggaccaggtccttgccaacgtcatgctttccatcaacttcttggtctctttgctcaagaagaactggcagaacgtcggatctcttcacctcaagagctccatg

SEQ ID NO: 66358 - DNA, 628 bp, Triticum aestivum
  Clone ID: PAT_TA_66358
ccttggggtccgttgtgtgggcagaaaagaccccgaggtcaggcttgacacacatgtttctgtctggtcagtgttctcttctgacatggagggtgtggctcatgacatgttttatattagcatgaactatttcgtgaacaggactagtaaacggcttcagtctactttatatcgggcggaactagatcatctcaagacagatgagggagttaacttggcatacaagttggctgagacccaactctcgttgatctatgacttcttgtacaccaagtttggaagcctcgatggtgtgttgcaccgtctcaccatccttatcataaactgtacagctctcgctctgtttgttcttcatcataagggagggaagaggcgatcagaagctggaccaggaggaggtccggaaagcagcagattggagtggtcaggtaagctgcggcagtataacttgattgatggaatcatccaagaggagaagacaaaagggcagtatggacggctgaaacggatgatgtggcgtattggcatcaagcaataccatcacgcaaccaaacatgttgccatctccccagagctcgaccgaagaaagtcagacgcatcttcaaagacatgcatcttgtatcaagtg

SEQ ID NO: 66359 - DNA, 308 bp, Triticum aestivum
  Clone ID: PAT_TA_66359
ggcgctccctctccaatgcacccagtcgtcgcgcgccctttgagggccgcttcatcgtcgagcgcctcctccttgacgggctccgtcttcacgacggggagccccgactctgacttgatggcggcgaggcccggctccgtcttgggcttgacgaaacacggaggagccgaggaggtggcacgccggccgccctcgttgatgacgatgccggcgctgcgggtgcgccagccgagcggcgtctccgcggcgggctctgccttgacgccgaagagcgccggcgagccggaagagtgggaggaggagtgggg

SEQ ID NO: 66360 - DNA, 255 bp, Triticum aestivum
  Clone ID: PAT_TA_66360
acactcgcctccccattccttcccccctcccctctcctcctcttcaaagacaccactcctccctccctcccccgacgcccaccccgaggccagggatcccgaatgcaatcgcgggccgcagtcgcctagccgccgcgagggctccacagcgcgatcgagagggagggggctccgcaggcgagggctagctgcgtggcgcgtgcgccggggttggatgagaagggcgagggcggcggcggaggaggaggatgcgga

SEQ ID NO: 66361 - DNA, 593 bp, Triticum aestivum
  Clone ID: PAT_TA_66361
atgttccttcttgaactgcaccgtcggtagaggacctttgcatcacagtatgggatcataagtgccgaaagaagtcacatgagagttactccaagaaaacagaagtgaagtgggaggcatctgatcctgattttaagcacaagaatctggcgaggctaactatttacggcttccagtccgatggcaatttcacaagatatgtcaggcgtgttattcaagctgcggtgaatatcaggaaggtatctctgcacgacaggaaggcatgcaagctctgtgctgaaaagtttcctcatgctgaggttcgtccttcgggttatccacggaccagcgaggagatggattcgttgaggaagaagatggcagcggcgtcggcggtggcttgtcctgatattcacttttgctcataaacagttgatttgaacatgaatgtggttggaaggagcaatgttggttttctgcagtaatgtgctccctcttgtccataaaagtagacgttttagaccaaccatacaagtctctgaaacgtcttatatttatgaacagagggagtatctcgtctatcaatttgttggaagaactcatttaaattcccg

SEQ ID NO: 66362 - DNA, 495 bp, Triticum aestivum
  unsure (1)..(495): unsure at all n locations
  Clone ID: PAT_TA_66362
tggcaaacaccgcgctgtgccggcgagaactgggcgctcgagagtccgtctggatctgacgatggcgatccctggggcgacgacgacggcgttggcctctggatcgacgagggcgacaaccgattcagcggtgcgcgaggtggcgtacgacttggacgccgccggccaggcgggcggctctgtcgtagccgtgggctcgccggagatgcagccgttgggccagggcccggcgtcgcggggccagctttgcgatttgcctggcgtctcgtcctcgggcgcgtcctgcactacgttaagttccggtggcggaggcgtggcggaggcaggctccggcgacggcgcgcgcaccgtcnagttgcacagtcctgtccagtcctacagcctgggcgacgccgatccgggcggcttttcgggcgtaggtgtgggctcgccggagatgcagccgttggatcgggggccgacgctgcggggcaggggttgcctagtgcctgatgt

SEQ ID NO: 66363 - DNA, 454 bp, Triticum aestivum
  Clone ID: PAT_TA_66363
gcctggccaccccctcctctctctcaccgcagaccggaagagcggagccgccgagccgggaagagccaccaccccatcccatcgcccgcctccgcttccgaaggtcagagatggcggaccgagctaaccacccgtctgtcatgcagaagtttggtggacagttccaccttgcctccagcttctctgagggtgttcgtgctcgcaacatctgcccttctgtgccatcctatgagaggcgcttcaccacaagcagctacatgactcagaaccttggcatcagtgtcccaatcatgtcatcttctccaatgtttgccaatgcaccccctgagaagaaaggtgtcaagaactttgcgattgatttcctcatgggaggagtgtcagctgcagtttccaagactgctgcagctcccattgagcgtgttaagctgcttatccagaaccaggatgagatgat

SEQ ID NO: 66364 - DNA, 529 bp, Triticum aestivum
  Clone ID: PAT_TA_66364
tcttctccctccatgtcagacttttgatccttgtgcagatgtctatcgacgacaaggaggtcgtgacttacatcgacattgtctgcaaagccttcgagggccgagtcaacatccgccccgcccttagtgttctcttcgtgttcgaagttttggcctggaccgtggcgctgataatccttttcgctgacaacacccactccgtttggccctcactctctatcacctctctcaaaatcatgtcattcttcctcattcttcccacgacgttcctgcccctccgccttctttccttctcatccctcctcggcgtcctctcttccgcatggcttgtagcgatcatcttcgccaatggattcacctctcacaccactcctggttccatcctcgtgcctgctgcgacgtcgctttggcctgagtttgggccgggacaggccgggatcgcgatcgggctgttgatgagcgggtttggaggccacagcatcatgccaacgatctgttatgacatgagagataagactcactggcgggt

SEQ ID NO: 66365 - DNA, 454 bp, Triticum aestivum
  unsure (1)..(454): unsure at all n locations
  Clone ID: PAT_TA_66365
cgttctcccaccgtggccgtggttactgggtggatctcttgcttggtggcatgtactgtgactgcggtgatgtgttctccagccagcgttacatggacgcccactccttagacctccctgtggggtgcgagagatacttaggctgtagagattacataccagagccgagggcctttcgagctgtgggctgtgttggggactccatcaagtttgtctccatcaccggcttccttgagcgtgtggatcttgtggatgaccgcatggtgagggtctggagactcaaggaagatatgagttgggatgtagactacgagctcaagctggggagcctgcgtgaagagggggctttcaaagggaaccacctgccgacctccatggcacccatgtaccccttcctcaacttacangaagaccgtgtcatatactttgcactgggatcttttcgcttgacggc

SEQ ID NO: 66366 - DNA, 641 bp, Triticum aestivum
  Clone ID: PAT_TA_66366
cgtccgcgccggcgcagtctcaacgcggtggcggcacctccctcaccagctctcgctcgtggcgctcggcatccgccacttccgccgcgccacgctggccgagaccatggacgcgttcgcggccgctttactctccgtgtgccctccggccgagcgccactgcgaatgccagcgcagctatgccatcaaggacctccgcctctgcttctacccttcggcccctcacctgagctccatcggccgcaccgttgaggacgtcctcagctgcggcaggaccgaatccctcgaatttctgatatccctgctgcccggggaatacactccctcgcagctcgccgagttcgggcagcaattgatgtccttctcccgtgcctaccaggatgctttccggtgcctcacaaggctatccctcaagggccttgctttcggggactcagacgtcaacgacctcattagagcttgcgataagctcaagtgcctcacactgatatcctgcagactagttcatcgccactctgtcctcaagattgacacaccgttttctgggctccaggagctcgagttcatccactttgtgtgcaggaggatcgagctcatctctgtccccaagctcagtaaagtgaactgccactggtccttga

SEQ ID NO: 66367 - DNA, 618 bp, Triticum aestivum
  Clone ID: PAT_TA_66367
cagtttcttggtccggcgatggttgctcccgctcatccttcctgacaatgcccacggccggtgcatcaccggagcccccactaccgggcctcatctccattcggcggcccgtccccccttctctcctccgtcgctgcagcttcatatgttctggacacgccccctcctcccagccaggctcagtcactccaaccatgacgcgacggctggatggagcccatatggcgtggcggcggcttcacaacggcaacgacacccatcggttcccactagcccaatcaggtgtcggctctcggccaagatcccggtggtggagctgtgtcacggcatgcgaggccatccagtgagcgccctccggcacatgacgcgcggcacaacgacgccctccggcgtggctgaccgtggccatggtcctacaggtgcgcgctatgtggggtcaacgaccttccggcgcggttccctccgggcgtcgtgtggcgctcgatcgtgactcccatggcagtgctcccctgtggcggtagccagccgctcttcacgtggttctagcagtctgcatagtgttcgtttctcccgatgccgatggtagcgtcgtgccttccttgacgagtggcgggcatg

SEQ ID NO: 66368 - DNA, 381 bp, Triticum aestivum
  Clone ID: PAT_TA_66368
caaccctgacaagttcccttcgtccccatctctgggtttgagggtgacaacatgattgagaggtccaccaaccttgactggtacaagggcccaaccctccttgaggcgcttgaccagatcaacgagcccaagaagccgtcagacaagcccctccgccttcccctccaggacgtttacaagattggtggcattggaactgtgccagttggccgtgttgagactggtgtcatcaagcctggtatggttgttacctttggtcccactggtctgacaactgaggtcaagtccgttgagatgcaccatgagtctctcctggaggcgcttcccggtgacaacgtcggcttcaacgtcaagaatgttgccgtgaaagatctgaagcgt

SEQ ID NO: 66369 - DNA, 357 bp, Triticum aestivum
  Clone ID: PAT_TA_66369
cgcgcctccgaaggtttgtgagtatcggcggtgaccagcacgcaagagacggcagcgtggtgctcggcgatttggatctgagtgaagccatcggttggctggctgccggggcggcgcgctactcggcggcgtggtctcgatgttgtggtggtcgctgggcagttggcgcggcgtggtgtgcggcgtctgcctaggtcttgggcggcgtcatgcgtggtcgtcgcggcggagctatggcgagtgattgtagcggcgctcaagtgcgtgcccgtgcttgtgctgctacgtgaaggcgttgcttgccatttggattgaattttggttgggtgtgagtgcacgggttgaggaacacaatgt

SEQ ID NO: 66370 - DNA, 600 bp, Triticum aestivum
  Clone ID: PAT_TA_66370
ctggtgagcccgcgcctcccccacgcgacgcctgcgccctgctctcagtcagcccctggtgccaccgcgccctcgccgccaaccccaagctctgggaggtgctcgacctgcacgagatgaagaaagctggcgagcggctcatttcggcgcttacactggcaaggtatcgccatctcaaggtcgtgaaccttgaattcgctcaagatattgaggaccggcattttctccatctgaaagaaacgggtgctatcttactggaagagttggaactcctgaacctgaatgcatgtcagaagatctctgatacagggattggatctgccaccagtctttgtcctaatctccgggccctgtcgatctattggattgttggattgacagacgcaagcattgaacacgctgtgaagaactgcaagcagataatcgacttgaatctgagtggctgtaagaatatctcagatagaggaatacagctagttgccgataattatcaaggactacagaagttggacataaccaggtgcattaagttgactgatgatgcattgcaaaaagttcttgagaaatgctctgctcttgaaagcttgaacatgtatgccc

SEQ ID NO: 66371 - DNA, 535 bp, Triticum aestivum
  Clone ID: PAT_TA_66371
gtgtttactataacagataacagacaaatggcaccgtctttattctgcactcacgagaattttccaacatttgtaggagcactgtgcgcaaatgtgctactcacagacggtcgcatggtactaaccatattaagttccagttgtaaataatttgattgtggcgaacttcaccaaactagcttaatttactactccctccatcccaaaataatcaactttatactgaagttagtagtacaaagttatactaagcttccgacacttattttgggacggagggagtatgatgcaaaaccacttgtttatatgagtggtcgctttctgtttcagttgtggtgggtgtggttgggctgccacagttcattgatcttggcaagtttgaagtgtcgtcttgtagctagatagtgatactttatgcaatagatgcacatttcttttgcacattctagaaacaaagataaagatgtctaattttaaatttctgtgatgttgatacttgatacaagcacagcttgtcgcacatgccttattggct

SEQ ID NO: 66372 - DNA, 487 bp, Triticum aestivum
  Clone ID: PAT_TA_66372
caccgtcgcgcgcaggcagcgtcgccttcgacgccgtcgtcaagcagggcgagaacgccaagaagatcgtctactccaagcacagcgacatcgtgcccaagatcgccacggccgactccgaagccgtcgaggacgaggagtacgataaggaggtcgaggagaccaaagagcgtaccgtagctgccctgcagaagattgtcaacgtccgcctctctgctgcccagcccaaaaacgttccgacgcatgattcggaatcgaagttcatcaagtataagccgtcgcagcagtcggcagctttcaattcaggtgccaaggagaggattattaggatgtcggagatggcttcagatcctctcgacccaccaaagttcaagcataagcgagtgccccgtgcatccgggtcgccgcctgtgccggtgatgcactcgccaccgcggcctgtcacagtgaaggaccagcaggattggaagatcccaccttgcatctc

SEQ ID NO: 66373 - DNA, 485 bp, Triticum aestivum
  Clone ID: PAT_TA_66373
atcgcggtgtgaggcggcggccgtggggtaaatgggcggctgagatccgtgacccgcagaaggcggcgcgggtgtggcttggcacgttcgccaccgccgaggacgcggcgcgcgcgtacgacgccgccgcgctccgcttccgcgggagccgcgccaagctcaacttccccgaggacgccgcggccgccaccgcgcgccgcgccagggacgccgcgacggccgcggcggcggcgtcttcgaagccggctgcgctgctcgagtcgcaggacggcgacgtcatggactacctggactactccaagatcctcgcggagccggagccgagcaacgtgatgggccggctcatgggcggcgacgggaacggacggttcctggggtcctggagcatcgggacgtcgccgacgtcgtctgcgtcgagcgcgtcgctcgtcgtgtccggacccgcctccgctcctctgtttcagtgcggtagcggcttgaagcag

SEQ ID NO: 66374 - DNA, 609 bp, Triticum aestivum
  Clone ID: PAT_TA_66374
gtggataaatttttcataaggtattgagactttaccggccagctgaagaagtgtttcagcgcatgcatttgcatgtggagactccatagggtgctgtgtctgcaaggctgtattaggaaaccaatatataagttagagattgtacataggatagccgactttcaccaacaggagcaagacaagacgtacgggttatgaatgttggactagaaagatgggcaacattcccagtgaaggatcgctcccctctgcgtgcttctgctaaggcttgttcttgaggaagactcggtgatggcacatcttgtcgtcctggtacacctacgaaaattcaaggtttggcgtcagaagaagaggcgtacatgataaagtgcagattagtttggtatgagaacatacgtaccctgggtaactactagtgctgtagctgtgcaatccagagggctggggtttagatgcatagcatgtgtgttaaggcgagctttttctgcagcagcaagtcggttcatgaactctttgtacatggcagaggcgactgaagataggtcgctggaaatatggttaacaatgctgctgcaacgttcttggtgttgtgctgacaggatttgccct

SEQ ID NO: 66375 - DNA, 298 bp, Triticum aestivum
  Clone ID: PAT_TA_66375
tagattgtagaccaccgacgcaatatggatgttggtaggtcgcgttccggattttattttcgtcccacctcgcccggtttttttttggtacctattttggtacctcctcccacctaccacctcccaacgattttctcctggaccgtcgagtgatgccccccgtggaggtagcgatgcctcaggtagcgagcgaggcctgcacgtcgaaaaaaacctacgaaagaaaacctacgaaagaaaaccaacgagaaaaaaacccacgagcgacggagcgaggcaacgcacaccctccctccgc

SEQ ID NO: 66376 - DNA, 631 bp, Triticum aestivum
  Clone ID: PAT_TA_66376
gacgagggtggtagtcactccacctagttctactagttgtagggatgcgacctacttgaggtgacccgatatagtttttcccctttttttccttcttttttcttctctattttttattcttttattctttcttctctgagtttttgttatcttacattcttcaatcctctcaacatgcaaagtgtccatctcaacatcaaaccaagcaatgcatttaagtcttctctcccagtaagccatgaaaaatctgccacatcttacattcttaagaagttggtcccaactctctcaacatgcaaagtgtccacctcaacatcccactaagccatgcaaaatctgccacatgagcgagtcatgcatttaacttataaatccattagtctatgcatgtacgctgccacatcatatattcatgttattgattattcacattttttctcaaaatgacatttcaattgtaatttaaaaatatattatatttttagacactttctcttattgtttttcaagcttctactctcttttcattgtatttagcaactacttacacgggcatttttcaacaaagttaccgcaggaacgcgctgggagagagtcattctcactactcatgtccaatatttcttcaatg

SEQ ID NO: 66377 - DNA, 528 bp, Triticum aestivum
  Clone ID: PAT_TA_66377
tctctctccatcggccggcggccggctgcgccccgaatccctcgccgtcggctgcgcccccaaatccctcgcctattccattctctcgttcgccccctccgcccccaaatccctcgcctcttccatcctcttgtccgccccctccgcctgattcgttggtcagtagcccaatgacccgctgcctccgaagtgtcgccggcaaagcttcccgcggcttccggaagagggtcgtcgtcaacgaccccgtggccgccgtcgctcaaccaccgcatccttccctgagcggcggcctttccaatccaggattagatcttggatttgctagtggattttgggagtttcttagccagcttggtgactccatatttttcactatttcagcaagtctttggagatggttgtgcttcgtcatagaagtactagacgcggtgccaagcgtgctaaccagaatactgttgctggtataggcagccccaacaatgatagctcgcaaatgtctcgatctgatggcgtcaatactactgctcc

SEQ ID NO: 66378 - DNA, 675 bp, Triticum aestivum
  Clone ID: PAT_TA_66378
gctctcgctgccaacgtagccgaactagtggattatggacaaacgatgaagcaaggcaacccagcttggcccaaacacaacttgaaaatctcatgacagaaaaagttggaaaacaacataaggaaaaaaaacacttaggtcgactaacggcacaatctacccctgataataaatgggctattgcttcaagcggtacgtgattaaaattgtccccaaagttacaaaatattacccaccaatgccacttataagtgacaaaaaaacgttttgcagggaatccctgcctaggccggcccaaacatagagacctactataccgctctgctcgttagagaaaacacagcgcgcccgtttgggccagcccatacccgcacaccttttttgtttttttttctgttccacttttgttttcttctatatcaaataattgggaacttcaaaaaacatttgaaatttataagaactaagaattttcatatcaaatgttcaagaaaacataaaatgtttgtgaattcaaaaaatgctgatttttctaaacatgtgcgcaattttgaaaaaatgttggtaaaataaaaatagtctaccattttgaaaaacattacgtgtattaaatattataaatgaaattgaaaaaatgtttgctaattcaaaaaatgttcatgcatttcgaacatg

SEQ ID NO: 66379 - DNA, 248 bp, Triticum aestivum
  Clone ID: PAT_TA_66379
taaactccggcacccagcccccgtcgtgcgggctgcagaatcgctcagatggacgccgcgggcggtgccggtggagcggtcgtcgtcgacaaagcgggcgggcaggcgccgcccaagacgctggttgactgggcgctgaagatcctcgacacggccgaccccgacgaaaaggcccggctgggcgacctcgccgccaccaagtggctccgcggcgccatcccgctgccctacgacccggcgcagcccgc

SEQ ID NO: 66380 - DNA, 302 bp, Triticum aestivum
  Clone ID: PAT_TA_66380
tcgagttcaacttctccgtcgccggcgacgccgcgtccggcggcgaggtggtggccgtcgaaccggtggcgccggccagtgagactgagaacggcgtcgggatagagacggagcctgctgcgacggcagaggccccggcggcgtcgttcctccgtccggcgaccaagttccgcgtgctgctgcttaagctgaggaagccgaaggtccccgcgcagccgcagcgccgcgacgactcgctgctgcagctgcaggacggcatccagggcgccattgcgcactgcaagcgctccttcaacgcctcc

SEQ ID NO: 66381 - DNA, 615 bp, Triticum aestivum
  Clone ID: PAT_TA_66381
ccgcagcgccgccactccacccgcagcggcaaccatggcggtcggcaagaacaagcgcatctccaagggaggaagggtagcaagaagaaagccgtcgatccgttcaccaagaagcagtggtatgacatcaaggcgccgctgctgttcaccagccgcaacgtcggcaagaccctcgtgtccaggacacagggtaccaagattgcctcagagggtctgaagcacagggtgtttgaagtatctctagctgatcttcagaacgacgaggaccaggcctacaggaagatcagactccgtgctgaggatgtgcaagggatgaatgtcctcaccaacttctggggcatggacttcaccactgacaagctcaggtcccttgtgaggaagtggcagacactcattgaggctcatgtggatgtgaagacaactgacaactacatgcttcgcatgttcgccattggcttcaccaagagacgcccgaaccaggtgaagcgcacttgctatgcccaagcaagtcagatcagacagatccgccgcaagatggttgagatcatggtcaaccaagctgcaagctgtgacttgaaggagcttgtgaacaagttcatcccctgagtgatcgga

SEQ ID NO: 66382 - DNA, 295 bp, Triticum aestivum
  Clone ID: PAT_TA_66382
ttttgtatttcaattataaagccagtgtagggtcagggtgtgcattttttacaatgtggtttggccagacctgtgtctagaaagtgattttcccttgtagtaccttcatgagattttgacttcttatcctaactcgaattatgacattgcagatgctgggtgcaaaactccaacaatacttccatctgcggcaacaaactctggtagagttaactcacgtcagcataaggcatgaagctttggaatttgcagaaaaagtacttacactaataggtaatttgtagttaaaatatct

SEQ ID NO: 66383 - DNA, 506 bp, Triticum aestivum
  unsure (1)..(506): unsure at all n locations
  Clone ID: PAT_TA_66383
ttctgcttcgactggatgagcttatccagcgctgtcctcgactgcgcgtactagaggtcggcaacggctggggtctcggtaagatcagagtccactcaccgacgatcgaggagcttgtcgtggactacccctatgatgtgtgtggcatcgacatcatggcacctgtgcttaggaagttcgaggtgtggacctggatgagcttggatttcagcgtgtcgttcaacgcgccgatggtggagaatccatggtgggacatctattgcaactttgaaaaaatgtcgggtttgatgtctggcgcttgcgcagactaagcccagggaaggaggagagcggcaataccctacggttatccatagatgatgctccgttttatgcactagatgcggcgaggaacttcagtcaagagatagcatcacttcccaaattttttgttctgcatctaagtctggtnacacgggggcatatttttgggccactggtgttgaatctacttgggatctgcactg

SEQ ID NO: 66384 - DNA, 494 bp, Triticum aestivum
  Clone ID: PAT_TA_66384
gtgatagcaagagaaaagttggctggtggttgcagacttgcagttcgaggtggagcgcaaggacgagggccgcggccacggcaacacctgggtggaaaagagaagagatcatgatgtgctttctttggagaacaaagaaaatgctactctccattttggatggaaagtagaaatttttcctagacgggcggcaggcgcggcgtgccgccggacgggttaagctagtctccaaccaagcagcgacgtcgtcgtcgtcgatcctttccttttaggcaatcggaaaacgctagctcgcacggaaaagacgtacgtacgacgagcttgccgcgcgagcgcgcccggctggcgccgtgccggcaaggcacttcagtgcgcgttcgccaccgtggccgcgcgcgtgcccggcagtctccgcgggcacggatcgtacgtgcgtgcgtgtcgacgctcgcgcgctggagcgcggggggcaggcatgcacggacccgcgagcc

SEQ ID NO: 66385 - DNA, 627 bp, Triticum aestivum
  Clone ID: PAT_TA_66385
gccctgctgctccactcgccgcctcctcccctgcccaaagcgccgtcgcctcccgcactcttcccgtcaccgcggctcccggatccggaccagcacaccagcaggtcgcaggcagctaggcgtcagcggcaccggtcaccgacggcagaggcaggcagcgtacgtcaccggcggacggacgaccttgtgcgcgcgcgtcaacggacgcactaatttcctgcctaatagcaagagaaagagcaagcatgacaatccagtactcctcctatgtggtgacagtgacactgctgctcctagtcgtagcagcagccagcagccggcaaaaacttagcatggcggcgccgacgacactcccgggctgcccggacaagtgcggcaacgtgagcatcccataccccttcggcacccaggatggctgcttcctcccaggcttccaaatcatctgcaaccacaccttccatccaccccgcgccttctttcctgctgagtattttcggtcaggccctgacatggtgtacagcaagccgctgatcaggaccgaacacgtctactacaacaacacacagaacggtgatgacatgcctagaggaatttcatcattctccccagtggagctcatgggcgtgt

SEQ ID NO: 66386 - DNA, 420 bp, Triticum aestivum
  Clone ID: PAT_TA_66386
gaattcggcacgaggaacgagttcccttctttcctattacatcttcgctactactcctctccgccatggattggataactctcaagcggccgtgatgtgaagcaaggacggccgctggctcagcccgtggtgggatgcggcgctcaccggcgctgcagggggacacccgcgcgacgctcaccggcgtcctttccctgctgctgtccgcgcctctccgccattggcgtgctgcccccaagctactgcccaaagcctgtgcatctctccgtgcatggacgtgttgtccccaagccactgcccacaagcccatacatccaccatggatgcgctgtccccaagccactgccccaacccaagccagtgcatctctccgccatggaattgtcccaagccactaccccaagtcgtgctcttcatctc

SEQ ID NO: 66387 - DNA, 276 bp, Triticum aestivum
  Clone ID: PAT_TA_66387
gttgacaatggccgtctattattcattattccaccccgagtcccgacacgggagagaagaacactgctagcactcatggattttattagatcaacagcactcatggatttctaggcagcagaactagagctcgggattgacgacttgccctgcaaaaagcactatgccactctcgtcctccctgatgaggaacaggaacgggtgatctgcaacgaagtcgacacgcaccggctcctcccatccgatggagcagcccgtcatgatgtgagcttcggt

SEQ ID NO: 66388 - DNA, 519 bp, Triticum aestivum
  Clone ID: PAT_TA_66388
gaattcggcacgagcaccagttcatctcactgagctcgcaggcagccccagccaccagcgaaatggccgcgtcggcgctgcaccagacgaccagcttcctcggcaccgccccgcggcgtgatgacctcgtccgcagcgtcggcgacttcggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacgggtgggacaccgccggattgtcggctgacccagagaccttcgccaagaaccgggagctggaggtgatccactcacggtgggcgatgctcggcgccctggggtgcgtgttcccggagatcctgtccaagaacggcatcaagttcggcgaggccgtgtggttcaaggccggtgcccagatcttctccgagggcggcctcgactacctgggcaaccccaacctggtgcacgcgc

SEQ ID NO: 66389 - DNA, 122 bp, Triticum aestivum
  Clone ID: PAT_TA_66389
agaagtgaagtgcaaccttttgactttagaacacaaccttgtcagttatatcagcttggtcaaggttgaatgatttaacatgcattatgtatatactcctagatagataggagtgacaactt

SEQ ID NO: 66390 - DNA, 143 bp, Triticum aestivum
  Clone ID: PAT_TA_66390
gaattcggcacgagcgaggagcttttatgctttcttagacaaatgacacacgatcgtttcatccattcactagagcacaccttgtgtttaattaattcacattgggcgcaactagcgagaggacctctcgattgctcgatcat

SEQ ID NO: 66391 - DNA, 536 bp, Triticum aestivum
  Clone ID: PAT_TA_66391
gaattcggcacgagcacactaggtcgccttccgattcgaacctcccccaaatccgcagcagtcgacaggaggcgaagccaccgcgatggcccgtacgaagcagaccgcccgcaagtccaccggcggcaaggcgccccgcaagcagctcgccaccaaggcggcgaggaagtcggcgccgaccaccggcggagtgaagaagccccaccgctacaggcccgggaccgtcgccctccgggagatccgcaagtaccagaagagcacggagctgctgatccgcaagctgccgttccagcgcctggtccgcgagatcgcgcaggacttcaagaccgacctccgcttccagtcccacgccgtgctggccctccaggaggcggccgaggcgtacctcgtcgggctgttcgaggacaccaacctgtgcgccatccacgccaagcgcgtcaccatcatgcccaaggacatccagctcgcccgccgcatccgtggcgagagggcctaagccgtcctccccgtcaacgccgttagtggatcggaagtgg

SEQ ID NO: 66392 - DNA, 261 bp, Triticum aestivum
  Clone ID: PAT_TA_66392
agtacaacacttgaggctggatgggttcgaaaaatgaaatggcctagcttacaacgatgggcatcggccctatatatagtgtaatgaaccgactatactacgcataggctgacgtcaagcaagtgaattacgtcactgctgacctcttactacttagctactaaggcacgcctgctgctcttgcaagtaaatttttttttacttgctgccgtgccgacatgcagccatgcatgcatctgagacgtaaatgctgctgctgct

SEQ ID NO: 66393 - DNA, 560 bp, Triticum aestivum
  Clone ID: PAT_TA_66393
gaattcggcacgaggagcaggaggaggagcttgcaggaacaatggcagcccagggtcttctctctgggaggcagctgctggggaggcctctgcagtcctccatctccaggtcgtcttcctcccggaagtcccccttcgtcgtcagggcatcgtccagcccccctgccaagcaaaatgacaacaggcagctgtggttcgcgtccaagcagtccctcacctacctcgacggcacgctgcccggtgactttggtttcgaccccttggggctgtccgacccggagggcaccggcgggttcatcgagcccaggtggctggcctacggcgagatcttcaacggccggacggcgatgatgggggtggtgggcatgatcgccccggaggccctgggcaaggtgggcctggtgcccccggagacggcgatcccgtggttccaggcaggcgcgatcccgccggcgggcacctaccagtactgggccgacccatacacgctcttcgtgttcgagatggcgctcatcggcttcgcggagcaccggcggctccaggactggtacaacccgggc

SEQ ID NO: 66394 - DNA, 565 bp, Triticum aestivum
  Clone ID: PAT_TA_66394
gaattcggcacgaggcgagcttggccgcgggcggccgaacagccggccgccatcctccaggccggcgtgttcgcgtgctccgtcggcgccgcgctcgcaggccagggcaggccaggccgaacgtttttctttttcttttctcaccctccccacaggaacagaaagctacccaatcctcacccccgacagagacggcagcggcggcgcgcgtcgagctagcaccgagagatatcctggcctggtagcaccacaccagcaccgtttctctccctaaaagatcagagctgaggctgctcggtcacccgccggaagggcgcctggaaaaatggtgttcacccttctcccggccttatggccaccagtttcgcgtgccaccgccttcctcctccgaaccccaccaaaacccttccgctctcaacatctgcttttccgcagcctcctcacctcagcttcttccccatcaacctctcctattcaccgctctctcgtcaccatggcctctgcgggtatacccacccgccgggatctcctcatgctcggcattgagaccagctgcgacgacacc

SEQ ID NO: 66395 - DNA, 550 bp, Triticum aestivum
  Clone ID: PAT_TA_66395
gaattcggcacgagcttccacgccattctccccaagatagccgtccactggctcatcaacttgtaccgcgcggccaggaagctccgcagcaatgccttccagtactgtcgtgactccaccagcagcaccaagccatccaccgaagccatctccagctccgagcgcaccatgccgtccgctgctgataggacggtggtgtgcgacttccacggcgggctcctgaggtccaccggcatcttcccctacttcatgctcgtcgccttcgagggcggcagcctgctccgggcgctggtgctgctctgcttcttcccccttgtatggatactcggcgagcgctccgacgccggcgtccgggtcatgacgttcgtcaccttcgtcgggctcaggccacgggacactgacctcgtggcccgcgccatcctgccaaagttctacatggagaggctccacgcgcaggtgtacgaccacctgtggctgccggcgaagaggaaggtggcgttgacgagcactccgagggtaatggcggagtgcttcctcaaagagtacatgg

SEQ ID NO: 66396 - DNA, 229 bp, Triticum aestivum
  Clone ID: PAT_TA_66396
gggcaacccccgaagtaagagaaaactcaataaatccactactcctcgaacggattacattacataggagtaactaatattgggcgaattttgatttgcaggacgcgggtattttaaaaacacgctcagttggtgggcgagtcctttacttggggaccacaccgtcgttcccggggagcatgatgtacttgtcacggggactaagcccggggcattcgaacccaagcgc

SEQ ID NO: 66397 - DNA, 254 bp, Triticum aestivum
  Clone ID: PAT_TA_66397
agaataatactctctctgtaaagaaatataagatcgtttagattacatcattgtaatggcacataagtaaggccgatactcctagttatatcattcaacttctggatggtagacgaacaaccagattagatttaatattacccacgaaactaacaaattattacaaagtaatttcatgagacgttcatattcagcaatacgggatagtaagatctttgcaaatgtgatccttcagagggaagaacagaagttcc

SEQ ID NO: 66398 - DNA, 215 bp, Triticum aestivum
  Clone ID: PAT_TA_66398
aaccattcacaaacaaaaagcattatcaactccaagctccatccgggccatgaaggaaaaggctccataaaacccagcccccttttttatcaatacaaaccaaacccagggtcccgggcaggttgagaggcagtactacctagtttcaaggggggggcttgttaatgaagacccgggggggggggagcttggggggggggccccctccttttttt

SEQ ID NO: 66399 - DNA, 620 bp, Triticum aestivum
  Clone ID: PAT_TA_66399
gaattcggcacgagatctcactgagctcgcaggcagccccagccaccagcgaaatggccgcgtcggcgctgcaccagacgaccagcttcctcggcaccgccccgcggcgcgatgacctcgtccgcagcgtcggcgactttggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacgggtgggacaccgccggattgtctgctgaccccgagacgttcgccaagaacagggagctggaggtgatccactcgcggtgggcgatgctcggcgccctcgggtgcgtgttcccggagatcctgtccaagaacggcatcaagttcggcgaggccgtgtggttcaaggccggcgcccagatcttctccgagggcggcctcgactacctgggcaaccccaacctggtgcacgcgcagagcatcctcgccatctgggcggtgcaggtggtgctcatgggcttcatcgagggctaccgtgttggtggcgggcccctcggcgagggcctcgacatcatctacccgggc

SEQ ID NO: 66400 - DNA, 453 bp, Triticum aestivum
  Clone ID: PAT_TA_66400
gaattcggcacgagggagagcctagccgcatccgtccatcgaatcgagccgagctaccacgcacgccgtcacgtctgccttgtgcggacctgccccctcctccaatccaacccaccacaggcaaagcaaaccccagccagagccgacggcaagctggacacctacgccatggagcgggtggcgctgctccgcacctccggccgccgcctcctccagcgctgcggcaggcccaggcccctcgtgcccgccgcctcctcctccgcgccgcgtcgccggttgacctcctcgtcggcgtccccttcctcctcctcctcctcgtcgcggggcgggtcgcctccaacctcgccggtgccggccgcctctgcgacttcctcatcgacgcagagggcctccgcgcggcctccggcgatgccggattcgcagcccgcatcaattggcgcctcctctcacgcg

SEQ ID NO: 66401 - DNA, 237 bp, Triticum aestivum
  Clone ID: PAT_TA_66401
accaaaacttaagggttttttggtttccaaaggctacccaaacttagaccgccaaaggcttacaaaggcctttggcaagtcgttcaatttcctttaccttaccccccccccctggcccgggcaaacttttaaccccccaattccggattttaaaaaattggccccacaacctttttttggattccctttttccatggcaaaatcttttcaaaaaatagggccccttggcctattttg

SEQ ID NO: 66402 - DNA, 388 bp, Triticum aestivum
  Clone ID: PAT_TA_66402
ggacggggaaacattttttaaaatggaaacgcttaaatccaaatttccatttttggaattacattaccccgatcttggggatgctcgcgagcggtttacttgaaacgacgaaaaaactttggtttaaagcgagaggccgccggactccttgtccttgtcgaggccggaggtgtaaacggtgtaaagcgaccaaatgaggccgaaaacccccaggaggatccaccccagcgggttgttgttcacccccaggttgagcccggggccctccgtaaacatccgtttgttaaccaaagcgagcgccggccccggggacgcggtcaccgcccccgccgggggaagcagggaccccccggccccggggacgggggccgccggggtcccctctttg

SEQ ID NO: 66403 - DNA, 413 bp, Triticum aestivum
  Clone ID: PAT_TA_66403
ggacaacaaaccctttttgaggcgcttttttgacagcatttgccttaaaaaccaaaatattgttttacagggatggacataaaatttttttcgcccatatagaatttaccctgccgggaattcctacacaaacctttgttttttgggccgccataaaaaaactgggggggggacaaattattttttgggagtatattgagaagaatttttaaggggggttaaaaatccgattttaataataacaactcgtaatgggattttggttccaaatcgttatttttttaaggggcatccgtttttgacggtttttccggggattaaaactcgttggatgcaaattttgaaaagcccgccttctccttgatagctttttcttttacggggggttttttttaaaccttgggtttgggttt

SEQ ID NO: 66404 - DNA, 569 bp, Triticum aestivum
  Clone ID: PAT_TA_66404
gattcggcacgagcacagcacaggcacagctccgccccacgaactgcatgccggtgtaagttcagcgctcaaatcgggcctgcagcgctagctggctagcagcggaggcgcctgagacctaacgtgccgtcgcttccgccgcattgcgctgagctgagctgaacttgcacgtagctggctgtggtggctagagcggccgacatgcttgccgtgtcctctgcgaggtgcctcgccgccgacgcggacgagcagcgcgccgaagtcgcgcccatggagacggttggggatgcagcagtggtggtggacctggacatagacttcgacttcaccgtcgatgacatagacttcggggacttcttcctcaggctggaggacggcgatgcgctcccggacctggaggtcgaccccgccgacatcttcaccgatctcgaggcggcggccgcgggcgtcgaggagtttcaggaccagcaggtgccctgcgccgagctcttggccgccgtggaggacgtcggttcggtcagtccagccggtggtatcatcggcgtggataacacggcgttcgctgagtc

SEQ ID NO: 66405 - DNA, 558 bp, Triticum aestivum
  Clone ID: PAT_TA_66405
gaattcggcacgaggccacgcaaggtggagccctcgtcacgatgaagcagcgggaagaggagccccacccagatgagttcctccacgtcgcccatggacggtccttcttccctggagacgcccagggctgacggatgttgcttgtcgtcagcccagggcccggttggccggagcagtcggagaggagtggcaggctcgccgtcgccatcgccggtaggagcgccaggcccatcttcctcgcatcggccgggctgttcgcgcggcggggtggagttcgtgcgaggcggatgttcgccgatctgttcctgcgagcccttggttacctgtgctgccttatttcctaggtgccgccatcctagcaagcacggccacgccggcgtcttctctggtgctaccggcaagcaatcgaccacgccgctgccaagcctctggcgctccctggtagccatccctacatctctctggtacaaccgtccccttccctctcctctagtatggatcgaatttggccatagatacttggactgtagataatttccagatttgtgagcattgatg

SEQ ID NO: 66406 - DNA, 589 bp, Triticum aestivum
  Clone ID: PAT_TA_66406
atatcatcagagtcataatattaagtcattacatgtaatagaaattgcatgaggacaaaatgcttcgatggaatagtctaaaattattcacaatggatatgtagtactttaataccaactatatcccaaccgaatgaatctacattctcaagatagagcaagtaatacaatgagtataacaaattgaggacagtgtcaaagcacagcatctggacaagcaagcaataaaagcaaagttgggcaggaagatctgttgctgtatgatgcagtacgtagaaggttgcatagtcaaattaaaataaactaccactggttttgaacagaaaaactgtacagaagtcaaggggagtaattgtatatgacataaataaaagaatatataaggaatacagattcaggcataagttccaggtaagcttggtactaaagtacagaaaacaagataatatgttgctcataaaattatatacaatttacctgctttctaattctttgagaactgttctctttctctttaagtactttttgaactctttgtacaacagctctagcattttcaatctccatgcgtgcattagttcgttcttcg

SEQ ID NO: 66407 - DNA, 657 bp, Triticum aestivum
  Clone ID: PAT_TA_66407
gaattcggcacgagctcttggcgccccactccctgttgcgcacgggaaaaaaattgtgtatcaaaaactaaatgaaaaaaccaacaaaacgttgccatgatcttatgatataaatgcttaggctataatcttatgggataatccatacaataaaatgtacacttcaaaatgccatgatccatacaccataatttccgtgatgcataaactatatttgccactgtcccgtgcaaaataaatatgtgatgttgcaaaaagaaagaaaaattggtcatggtgcatatagttaaaattgccacaatcataaccaaaatcatgttaatttgtatgtatttgacatggcaaaaaaaagtaaaaccagccatgttaataaaggtcaaataaaaagtaaaacttgccatggcaataaaagttaaaaattgcaatgggaatttaagtaaatttgacatgttaataaaggtaaattagccatgtcaattaaaacgtaaaacttgccatggcaataaaagttaaaaattgccatgggaatttaggtaaattttcaatgttaataaaggtaaattaccatggcaaataaaaaataaaacttgccatggcaataaaagataaatattgccatggggatataggtaaatttgccatgttaataaaaaaatc

SEQ ID NO: 66408 - DNA, 544 bp, Triticum aestivum
  Clone ID: PAT_TA_66408
gaccaaaagaatgcagggctgcaccttcttattagactttcaccatcacatgcaggtcctacttaacaataattattgtgaagccatcacttcttctctaattagactatggcactaatcctcccgtttacaaaaaggagagtaaaatttccacagaacttcggcgatgtgtttcttgcaaaaaaggagagtaaagtctgcttactcaactgttctcgacttctagctcagccgaccgccaatacaaaatcaatgattgcgttggagcatgaaaattatatgacatattggataattttaaaaaaaaattgcagcaacacacacgtattatagcggatgatggacaaaaagaagagtgaatttgtcttttcggtaaaaaagaatcgactacgttgtttaaaataatacttaccatcggatgtgaatgatgtttcacataattgatgttttcccgttgcaacgcacgggcatgtagctagtacataaatgaaacatacatcattcagagtacaatcaaggtccgactacggaaccaaaataaaag

SEQ ID NO: 66409 - DNA, 513 bp, Triticum aestivum
  Clone ID: PAT_TA_66409
gaattcggcacgaggaaacacataagcgaatatgcagagcaccggcgagctttacacatggatggtcaggggccacctacatcccatgacacagttcgcccaccatctcaccgcacatggcgttcctgtcaccgtcaccgtcgccgacgtcccgagtacaggcatgtcctctgagaccattgtcggcctcgccgcatcctatacttgcgtctccttgcacctactaccggcggcagcgacccgttccgcccagacggctgaccccgatgccgatccattcatcgaccttgtcggtgacctccgcgccatcaactccgacctcctcgccttcctgaggtccctcccgtccgtcaaggctctagtcaccgacttcttctgcgcctacgggtttgatgccggcgcagagctcggcgtcccggtctaccttttcttcacctacgctgagtcggtccttgctgcctacctgcacatcaacgtcatgcgctccactgtctccttccgggacatggggcg

SEQ ID NO: 66410 - DNA, 563 bp, Triticum aestivum
  Clone ID: PAT_TA_66410
gaattcggcacgagggtgctacgcaaccgtcgcgccccgtgcccgctcctccaccatcgtcgccagcctcggcacccccgcgccctccaactcctcctccttccgccccaagctcatcaggaacacccccgtccaggccgcgcccgtcgcacccgcattgatggacgccgccgtggagcgcctcaagaccgggttcgagaagttcaagaccgaggtctacgacaagaagcccgatttcttcgagcccctcaaggccggccaggcgcccaagtacatggtgttcgcgtgcgccgactcccgtgtgtgcccctcggtcaccctgggcctggagcccggcgaggccttcaccatccgcaacatcgccaacatggtcccgtcctactgcaagaacaagtacgctggtgttggatcggccatcgaatacgccgtctgtgctctcaaggttgaggtcatcgtggtgattggccacagccgctgcggtggaatcaaggctctcctctcactcaaggatggcgcagacgactccttccacttcgtcgaggactgggtcaggatcggcttcc

SEQ ID NO: 66411 - DNA, 399 bp, Triticum aestivum
  Clone ID: PAT_TA_66411
gaattcggcacgagaccttccctccgcatttccaacgacagcacagtgagagagaggagatccgccgcgcgagtagatttcctagccgcgctccgttagcgcgccgcccgtgcgagaatccaagaaccggacggaggagccggggccgcgagatgcagagcatggcggcgtcctcctcgtcccactcctcttcaagaggctgggcggcggtgcgccgttgcccctccccttccctgcccgcgcggcatgtcgccttctcctcctcgtcctcttcccgctgccccgtcgcgggcgccggcgcgcccgtcctgccgctcggcattcgcgggggccgactgccgctcccctgccccctgctcccgcccggcggtaagaacggcgcttcggcgagaagggcga

SEQ ID NO: 66412 - DNA, 592 bp, Triticum aestivum
  Clone ID: PAT_TA_66412
gtttaaccaaactgtattttcaagcctacaatccatcccccatgtttattttcttacaactccttgcttcccctattaggtctacaatatgcatgccatctgtggttcctactcttctctagaatggtctactttaaatccgactctttaccaccatatgttcattcttgttggacggcacaccagcaaaaacaggcctcacgttaaaatgcctgggcttttcaggtcaaccgcgctgatacattaccaggacgcactgtctcaatattagcatagtccaccatagctacgaacacttcacacctatctgtggcgtaatatcatataaaataccatttgcttccagcacaagtcgaggcaatcatcttacgaatgagaaatatcatcccgtttcttcttttttcatttccagtttgtgccggcacctgcctctgcaactgacttgcgaaccgtctgcaacaaaatgtatcactaattccttgtagatctaaccgtggcgaaagtcagcatcccaggtgtaaatctcacaggctggagggcagacatgtctgtttcatgctgtctgcgacgtgggcgatcacaccggcacccg

SEQ ID NO: 66413 - DNA, 134 bp, Triticum aestivum
  Clone ID: PAT_TA_66413
agaaactacgtatgcatgctcaagaacctatgttcgtacatacttactcattgcatataaacattgaggtatgtgctggctggatagtataaattttctttaacgaacggaacagtggatactcttaagatgaa

SEQ ID NO: 66414 - DNA, 293 bp, Triticum aestivum
  Clone ID: PAT_TA_66414
gaattcggcacgagcacagactgcgccatcaccaccagtccatctcgcccccagcccagaggctcctccactcgcctttcccctcccctcctccgccgccgcctctccctcggcgcagcatcaccccctcgatcccacgctcccccggccagttcgcggtctcccgccgcgattccgcgcggtgggacggccgatccggccgggccctgttcgtgtggtgtgggcacgtacttcgctcggacttgcggtaagaatcggcgcccggatcgcactatgggcagggatcttttact

SEQ ID NO: 66415 - DNA, 638 bp, Triticum aestivum
  Clone ID: PAT_TA_66415
gaattcggcacgagctctctccctcgtctcttcccatcccctcctcttccccatgccgccgccaccacttcccccaccgcctccatcacctcctcctcccctgcctccgtaccggaccacacgcttggacaaggaggcaatagcttgggaggcaggcaagaggaaaaccggagggatcccctcccgagccccgcgcatctcctctttcccactgcggtgccgccagcccctttccctcccatcgcacgctgctgcagctcctccctcaacccgtggcgcgccttcttctccgaccgttgttgcccgcactactaccgctgtgccctgctactgctcatccttctccagctcctcgtcccagcggcgcgtcctcccctcctctcatgcaaggcgtcttggggtgtggaggcggcggggcagtagccagtcgttgccctgcagcggcagcagcaggtcggggcagccgtgccgcataggaggtcgaggaggaccaggagaagctgcacgaggctccatcgcctcctgctcaaatttgctttctctatgcctacatggtgtttgataaaaatccaagaaggacggggaggattgatctatcggatagtagaagaaaactgaaacatgttcactagagtggg

SEQ ID NO: 66416 - DNA, 630 bp, Triticum aestivum
  Clone ID: PAT_TA_66416
gaattcggcacgaggttaagttaaatagacagaaagatagcaatattgcaatgtttcatcagtggtagagtggagaagaggttgacttcacaatttgcaagtgcgcaactgcaccttgatgtcccagttagctcttagtctctttttcttaacacctcctggacaagatggctctcctgcaggtttatatcagcctaaaaaaactctaaattttggctgaaatgttgcaagacggaagacaaatgctggctggcgaacgcttagttagtcatgccaacaaaggagcctgtccagacaatcagatgatacatccgagcttgacactcttccgctgctctaacgaaccttccctttattatctttccagacaacaggagatgatagacttagagtcagtcatgccaacagaggagcctctctgctcccatgcctacaaggctaagtacaaattattttggttgttagagtttaaagcagatcatatgctataaaggtttgctgattgagtctgtggaattggttagcatgtgaggatctggagtgcctttatagagacagaagaatgagttcactcacatgcaagtacgcagccaagttgaataagttgagtatataatttaggagacaggc

SEQ ID NO: 66417 - DNA, 436 bp, Triticum aestivum
  Clone ID: PAT_TA_66417
ggtttttgaactaaaatctttattttctatcttttaatgaggcccactaatgatagcttgcattggaaaataaataaatgtagatgccttaaattattttttgttatggggcatatgtatccatatgccaccattgtacatgccctaaaggacatctgccaccatcatggcacagaggaaaaagttagacggaagcttataggtcaggtcagatcacatcaactttggcactagaaaatatcacatcgacgtggcaatttgggcttgatcagccccggtggaattgtggcaaccattggttgatcattgattcatgtgggcgttgcggattaggtgggggccagtcccgcaaacaaagcatgcagttgcacatgcccaccagcacaaggtggtactgtttgccagtcttcagcaagtggcttggccacttctctcc

SEQ ID NO: 66418 - DNA, 410 bp, Triticum aestivum
  Clone ID: PAT_TA_66418
aaacagaaaaacaagggcccgggggttggtatataaaaaataccaccccggtttggtatatgggaacccggttctaaaattaacataggcatgccggaaaacctatgttcgaacatccacacccagaccatatagaaggaaaaatctgctggggtcgcccagcaaagggggggacaaaagttaagtccaaaaaagaccttcatacataggccatggtttaaactcgtagttaaggccttgccaaactcctcaaaacccgggggcctgaaggcaaagaaactgccccactgccccgggcgcaggttgtaaaaaccgatgacccggacataggcgtaaggggacccctttttgacctcctccacctcgtggagcccctggggggggtgggggcccccaaacataggcgggtt

SEQ ID NO: 66419 - DNA, 147 bp, Triticum aestivum
  Clone ID: PAT_TA_66419
gatgtcgctgcgagcgatactcatcttatcggttccgcgtagacaagccaacgccaaaccctagctctgccgtcgccgagatgtctcatttcgctcccatggcggagcccaagcccatgtgtgtccgccaggccgaggaggccaagc

SEQ ID NO: 66420 - DNA, 404 bp, Triticum aestivum
  Clone ID: PAT_TA_66420
gaattcggcacgaggcagagtgtagataagcttgctagccatgggaggaatggcggccgagcaggaggcaccggcgccgacacgatctccgccgcacacctacaccatcggctacgcgatgcagccggacaagctggacaccgtcatccagccgtcgctcgtcgccctggcagcggagcgcggcatgcggctcgtcgccgtcgacccctcccgccccctcgtcgaccaggggcccttccacctcctcatccacaagctctacgacgaggcgtggcgcgcgcagctggaggccttctccgcggcccaccccgccgtccccgtcgtagatcctcccgccgccatcggccgcctgctcgaccgcggctccatgctcgacgtcgtctccgagctcaacgccaccgtcc

SEQ ID NO: 66421 - DNA, 371 bp, Triticum aestivum
  Clone ID: PAT_TA_66421
ccaaagccaacgaggcaaagatcattattcgttactttaggaatgcaaaattgatctagtactctagtagaacaacaaaaatcatacgacagagagtccagaacgtcctctaatgcacgctcaaacaacgttggaggctggggtaccgtctgcctcgtcacgtgtagcagcggcggcgccacaaatcatctcgtcgaaaaaatccgtgagggcgatctcgtaccccggcagtttgttgaaccccgggaagtagttgatgtcgatgatgaagtactggccccgggccttcctcccgcggatcatgtcgaagttgaacagttgcagccccagcgcgcgcctcatcccgtgcccgacctcctccacgaaccccg

SEQ ID NO: 66422 - DNA, 235 bp, Triticum aestivum
  Clone ID: PAT_TA_66422
gaattcggcacgagcgcagttggatgtttatgaatggatgacatggagcatggcgttattggtgtccgcgcacacggcgcatgcgttcatggtttgttcgcacgcgccgcacagggacaggtgccggtaatggagcagtacaacgcaggtatcctacggtggcgtacgcgccatcaagctccaacaccaatccaagccacgtctgtccctgtgtcgtcatctgcacgcatgccat

SEQ ID NO: 66423 - DNA, 223 bp, Triticum aestivum
  Clone ID: PAT_TA_66423
aacctgggccgcaaaccgaccggcgggtagtaaaaccctaaacccgggttttcggctagcccttcaaaccgaggttcaaagatggaggaaccccaccccgccccatgggcccatttattacccaggaaaagcaaagggggaaaagaaacccaacgaccaaaccagggggctaaaccctcaagcaggagggaaagaaaggcccaaagggggggggcaaaaaaca

SEQ ID NO: 66424 - DNA, 516 bp, Triticum aestivum
  Clone ID: PAT_TA_66424
gaattcggcacgagtgccaatccatgtgtatttaaggcatctcatagctgggcctctatactttgagcagcagcagtcattcatcaccgatcaccagcacagccgcgcatccaccgttgctagcaaggtcgaccaagcagcaccgagatggctgctgccttctcctccaccgtcggtgccccggcttctacgccgaccaacttccttgggaagaagctcaagaagcaggtgacctcggccgtgaactaccatggcaagagctccaaggccaacaggttcacagtcatggcagcggaaaacctcgacgagaagaggaacacggacaagtggaagggtcttgcgtacgatatctccgacgaccagcaggacatcaccagagggaagggcatcgtggactcgctcttccaggcgcccacgggcgacggcacccacgaggccgtcctcagctcctacgagtacgtcagccagggactcaagaagtacgacttcgacaacaccatgggaggcttctacatc

SEQ ID NO: 66425 - DNA, 535 bp, Triticum aestivum
  Clone ID: PAT_TA_66425
attgctgataagcgcagtcaagcattgttaaatcaattcaaccaaactgaaactcatacaacactcaccagatcatctgagccacaatggattcatggaacataggaaaagcaacaagcacaaacttagtgtctgatatttgcagcacccaccaaatatgaagcagcagaactacacaaactactacctagttttaagttcttacttggctagggcagggaggtctgcactggcacgagcggcgacatttgcaaggtgggcaagaggcctgtcggtaccatccacgaggccagaggagtcgatgcccttggtgagagttgtagactgctgtaccatctccagcgcttgtattctgagctccattggatagtccttcacacaaccaattcttggaccattcccagtgctccatttcagggacagcctgtggccgagctggtaggattttgacttgctcatggaattcaccctctcaagaatcgcctcctgcgagacgccggcatctccagggcattgcaggccacctgataaggtt

SEQ ID NO: 66426 - DNA, 126 bp, Triticum aestivum
  Clone ID: PAT_TA_66426
gaattcggcacgagaatatacgtggatccacctcaccctgcaatggcttcctcgctaaccaccgtgagcctgtctaccttcgcgcgcacggacaggggcgacgtcttccccaggcctcaggtggcc

SEQ ID NO: 66427 - DNA, 540 bp, Triticum aestivum
  Clone ID: PAT_TA_66427
gattcggcacgagcaccagttcatctcactgagctcgcaggcagccccagccaccagcgaaatggccgcgtcggcgctgcaccagacgaccagcttcctcggcaccgccccgcggcgtgatgacctcgtccgcagcgtcggcgacttcggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacgggtgggacaccgccggattgtcggctgacccagagaccttcgccaagaaccgggagctggaggtgatccactcacggtgggcgatgctcggcgccctggggtgcgtgttcccggagatcctgtccaagaacggcatcaagttcggcgaggccgtgtggttcaaggccggtgcccagatcttctccgagggcggcctcgactacctgggcaaccccaacctggtgcacgcgcagagcatcctcgccatctgggc

SEQ ID NO: 66428 - DNA, 176 bp, Triticum aestivum
  Clone ID: PAT_TA_66428
gaattcggcacgagccttgtgatgcagacagcgagggcctacactcttgttctcgtccacactctcgcacacacttctcgactcctctgatctctccactcggagtccaacagaatggcgaccaactccgcccccatcattcccgccgctccccacctccatcgcttgcgcgggcg

SEQ ID NO: 66429 - DNA, 326 bp, Triticum aestivum
  Clone ID: PAT_TA_66429
gaattcggcacgagcttgtttgtccttcttgcagatgctgcagtcatggcgacgctgatctcaatagacgtgtgtaacttcaccggcacgtaccgtgtggagagcaccaagtgcatgcacgggaccggctgcatcaagctcttcactgacaacgactgccgcctcgagatatgctcgtagaagaagaccatcctgtctgtccacgacatactgtcactcatggtggatcactgccatggtgtcatcgaccagataacataggactgcgcggaagtgctcttgtgtgcgctcaagcgcgctgacgggacagacttcagcaacatggc

SEQ ID NO: 66430 - DNA, 574 bp, Triticum aestivum
  Clone ID: PAT_TA_66430
aagagaggaaatggaagcttcttctgtaacgttagcaggatccaaattaacctgcagcgactcatacacggcacaactacacaacaagtcaacaatccaatgaacagacggcaagaccactagctagtagctaatcgaagatcgaaccccgcacaagctgatctgcatctgctccgcgtgccggcgaccgggcgggcgggaggctacgcgccgcggttgagcatctccttgtagttgagcagcgagttgagcctctgcagctgcagctgctgccggaacttgttgatgaagtcgtccgccctctcgtccacgcacgcggcctccggcgcccctgcgtcctgccgcctcgcctccgtcagcaccgcgcgagccgcaggagccctcggcgcgcgttgcaccagccgtgccggcgccggcaccggggcgcgctccagcctcctcacctccgtgaccggcttcttcgccaccttcgccctggccgccttctccgcctcgttgcccgtcttgctcgccggcttcctcgcggctcgtgccgaattcggcacgagcatccatggcgatgacgtcgtccttc

SEQ ID NO: 66431 - DNA, 570 bp, Triticum aestivum
  Clone ID: PAT_TA_66431
gaattcggcacgagcccgccctcacgctcaccggccgcaagaaggaggccgacaagctgcagaccgccgaaggctggtcccagttcaccggaggcttcttcttcggcggcgtctccggcgccatctgggcctacttcctcctatacatagactctttcaaccaaccaccaagaagagatcgatcacatcatctgcagttgtgcacccatcgtacatgcatgccaataataaataatctacttgaagaagtatgggaggtcgactcgtgccgaattcggcacgaggccctgaccgtcccaagtacctgggcccgttctccgagcagaccccgtcgtacctgaccggcgagttccccggcgactacgggtgggacaccgccggattgtcggctgacccagagaccttcgccaagaaccgggagctggaggtgatccactcacggtgggcgatgctcggcgccctggggtgcgtgttcccggagatcctgtccaagaacggcatcaagttcggcgaggccgtgtggttcaaggccggtgcccagatcttctccgagggcggcctcgactacct

SEQ ID NO: 66432 - DNA, 311 bp, Triticum aestivum
  Clone ID: PAT_TA_66432
ggcccaaaatactctggggagggaagagtacccatcacaagggtacgtacgtacaacctactgtataattaatgcaataatgcatgcacccccgtacggttttttaaggaacaaatacgagggacagacccgtataaacatggggtacatccaaaaatggaggcgcccacgcgggggtatataacttaggcagctgcatgctaaaaaacatgtttcatcaaaaggagatgaaaaaattggccatgtcgaacttaattttctcgaggttgggcaaaatggcaaacttgatcatgggcgggggccccaaggca

SEQ ID NO: 66433 - DNA, 573 bp, Triticum aestivum
  Clone ID: PAT_TA_66433
gaattcggcacgaggccattggtactttagcgtcagctcggtcgggctttcactgatgctagcaggatcgaccaaacatgaccgcgctgaatgctgtattatcctcgaccgacggcgcccggtcttactacgccgaccaacttcgtagggtagaagctcaagaagtagtgcacctaggacgtgaactactatgccaagagctccaaggccaacaggttcacagtcatggcagcggaaaacatccaccagaagaggaacacagacatgcggaaggctcttgcctacgatatctccgacgaccagcaggacatcaccagagggaaggacatcgtcgactccctcttccaggcgcccacggacgacggcacccacgaggccgtactcagctcctacgagtacgtcagccagggactcaagaagtacgacttcgacaacaccatggtaggcttctacatcgctcctgctttcatggacaagcttgttgtccatctctccaagaacttcatgaccctgcccaacatcaaggtatgcatcatgactattgattagcagcaagaaaatcattctgattct

SEQ ID NO: 66434 - DNA, 360 bp, Triticum aestivum
  Clone ID: PAT_TA_66434
ggcccaaaatgggaggaaccatcataggttggcctctcaggacataccataagggggggacccctaatggccccaaccccacattcaactatataccccagttcgaatgggcccaaaggaccaacattcggtaaaaagaacaagggttgcagcaggttgggccccagggaaaacccacccggttggccctctggagagccacccccgtctaaagggcaggctgaccaaaaagaggggcccgaatcactggctattggcggaccccggccttaaaccatgggtaaacgtccggggatgaggccagccttgctgtcaaaacttcaactccggtttccgccaccaaaggggggggcccaaatg

SEQ ID NO: 66435 - DNA, 596 bp, Triticum aestivum
  Clone ID: PAT_TA_66435
gaattcggcacgagatgcgcggaggcagccggcgccaagaagtcccggcacaaggacaagaaggagaagaaaagcaagcgcaaagaaaccgcggagcacctcggcggcgagcccgcgacggccgaggaggaagccgtccacaagaagaagaagaagaagcacgcggaggaggaggagaaggcggatccgaagcggaggccgacggtgagcatcgccgtcgcaggctccgtcatcgacaacgcccagtccctcgagctcgccaccctcctggccggtcagatagcccgtgcggcggccgtattccgcatcgacgagattgtcgtcttcgacagcagtccagcggcggagaacggcggtggcgccgaagaggaagaggagagcggtgcacggttccttgtccgcatactggagtatctggaaacgccgcagtacctgcgccgccgtctcttcccaatgcacaagaactttaaatatgtggggttgcttccaccgctggacgcgccgcaccatgtgcgcaagcatgagtggtctgaatttcgtgaaggtgtaacattgggtggggatcgttcaaagggtacacttgttgatgttgggtt

SEQ ID NO: 66436 - DNA, 359 bp, Triticum aestivum
  Clone ID: PAT_TA_66436
gaattcggcacgaggaccacctccacgaggcgccgcgcccaggagcaagggccgccgcaagccgcgagcgccgggagccgcgcaggagcaaggagagggccaccgcgcgccatggccagggttcaagccaatatgcccaggagcaaggagagggccgccgtgcaccatggccaagcttcaggccgacgcgcccaggagcacgcactgccccgagctgagcgtcatggccaggggctcgggctcgggccgccgcgcccaggaagagggaggaaagagagaggccgctcggctgggacttcacggcggctccagccgcgagcgccgggagtcgcgcaggctccgaccgcgcgccatggaca

SEQ ID NO: 66437 - DNA, 368 bp, Triticum aestivum
  Clone ID: PAT_TA_66437
gaattcggcacgaggaaacacagagcggtaatagaagagagaatcatagcttgagacggcgcaaaccatggcgtccatgaccggcctgtcgcagggcgtgcgtctcccaggcccggtcggcaggcgcgccagcaggttcatcgtgagggcgttgtccgcggaggcggaggccgcctgccgccgcgcggtccttggcctcatgggcagcggagtcgccggcagcgcgttcgctcaggtggtgcacgccgtcaccgtcacggccatcaaggttgtgccgccgtcgccgctctgcggtggactccccggaacggacaacttcgacgaggcaagggacttcgacctgcccctgaagaaccggttctacctgc

SEQ ID NO: 66438 - DNA, 566 bp, Triticum aestivum
  Clone ID: PAT_TA_66438
tcggagtctgtgtgttcgtaggctgatatcagcggacttaaagaacctggtatgagtcagctctgaggcgcccccccccccccccccccgaagcaccacgttacccaccacgtgcatccgccgctgcgacctacatgccatataactccgcgagcatataagaccccataattagagcatataaaagaaacacaaggatggcgtcctctacttccccatacactatacttcctcgtcattaataagagcatataaaagaaacacaaggatggggtcctctacttccccatacaccatacttcctcgtcattaatacgagcccgcattacgagagcatatccgcaacgagaaagagagagagagccttaagtagaatatgtcacaactgaggccgacaccttacgagaatatatcgcgcgccttctttatacttactccgtccgctctggactacgagcgtcttaaataataggataaccgctgtaaaaaggaatagcggcgataattgtagtcctcttgtttagtcaggcgcgcacgctattgtgatacaagaaaggaaaataaga

SEQ ID NO: 66439 - DNA, 267 bp, Triticum aestivum
  Clone ID: PAT_TA_66439
aacaggagaaaattctatatgtttttttactttctctaactgaataaattttgcgagcctacaccgacaacaccaacattaacggaacagaaggaacaattcacaggcttcttgcacaagaattaggcaccagcgaagcatttccaactctccatgggcgggcctacccacgctatgaccagctccatcgctgaatgaatctcaaagctgccgctcctcctacgggatctaaccctggcggtacaggtacaggccgaaaccaaaccg

SEQ ID NO: 66440 - DNA, 345 bp, Triticum aestivum
  Clone ID: PAT_TA_66440
aatcccggaaaaaactccggccctccccccacccaaatttattaagccataaaaaatggccccaacccaacaaaacttccaccccaaaacacaattccgggttggggggaaaaaaaaccggcttggatttttaaccaaaagggccccggactacagtatttacaagggaacccagcccgggaaagggacatctaaactccccctttccagttcccaggaatgaaaaaactttcccaacttggcacccaaaaatttggagaacaaacccgggccccaacccaaaaatgggggggcccccaccccaggttaattcgggccctgggccggggggggagggcccccccc

SEQ ID NO: 66441 - DNA, 589 bp, Triticum aestivum
  Clone ID: PAT_TA_66441
gaattcggcacgagctacaataaaaaattaactcagaagtgaccttttcaatttctccctcgtatccaagtgtgacaatagagaaatggtttctagagctcgccgtggatccttttttggctgctgtgatttttttaacatgctgccaaaatgttcaatgtctctgttatcacatggatttagtcttccaatgcattctcgtcgaacaatgtaggatgtgagcttcttcggcttcttccagcggcccggccatgacgtcctcaagccgccgacgctcagagcgacatcaatggccctctcccaagctgcactgctcctgatcttcatcgcctcacactgttgtgctccgcacagttcagcctgaccatgatgttctcaagccgccgatggtcacaacacacgtggcgacccgctcccaagctgtgttgcttttccatcagcgctgacaaacttagtttgtttttgaatgtgggcatcaggtctccgagtcgtttaaatctgaacgcaagaccaaggctactagcctgagcattgcggaacaaagcaggaaagcatttgctgaacttaataaaagcaagcatggaattta

SEQ ID NO: 66442 - DNA, 585 bp, Triticum aestivum
  Clone ID: PAT_TA_66442
acatagccaccgattgcattcacatacgagcacgctttctcgagccatgttgttacatgaacatggacatacacatattcttaggaacaagtaagaaagacaaatggagaaggaaaacccaaagcaatgtcagagttgacaaaactgcaatggcactttatatgtggcccgtggtgagtgagctgtttaggccttgccggactcctcgcagcccggtggcttgaaggcaatgaagctgacgcactgcacctggcgcatgttgtcgaatccgatgatgcggacgtacgcgtcagggtactccttcttgacctcctccacctcgttgatcacctgtgtggcgtcggtgcacccgaacataggcagcttccacattgtccagtagcggccgtcgtagtacccgggagacgcattgtgctcacggaagatgaacccgaccttgctgaactcaaggcaaggcacccacttggagcggatcaggtagtccacctgcttgaggagggcctccgtgctgagcggtggcaggtaagacagggtctcgaacttcttgatgccctcgatgggccacacctgcatgcacctgatcct

SEQ ID NO: 66443 - DNA, 639 bp, Triticum aestivum
  Clone ID: PAT_TA_66443
gaattcggcacgagatcctcctctcctccgataatacaataccatggcccccgccgtgatggcttcgtcggctaccaccgtcgcacccttccaggggctcaagtccacagccagtctgcccgtcagccgccgctccagcggcagcctcggccgcgtcagcaatggcggaaggatcaggtgcatgcaggtgtggccgattgagggtatcaagaagtttgagaccctgtcttacttgccacccctctccacagaggccctcctaaagcaggtagactacctgatccgctccaagtgggtgccctgcctcgagttcagcaaggttggcttcgtcttccgtgagcacaacagctctcccgggtactacgacggtcgatactggacaatgtggaagctgcctatgttcgggtgcaccgacgccacgcaggtgctcaacgaggtggaggaggtcaagaaggagtaccctgatgcctatgtccgtgtcatcggcttcgacaacctgcgccaggtgcagtgcgtcagcttcatcgccttcaggccaccaggttgcgaggagtccggcaaggcctaaactacaagttgaaacaatggcctatgtatgatggtcatttgtgaacttcacttttgtccacgactctgctt

SEQ ID NO: 66444 - DNA, 504 bp, Triticum aestivum
  Clone ID: PAT_TA_66444
tcggagtctgtgtgttcgtaggctgatatcagcggacttaaaggctgcctcacatgaacccgttcggtaagcgcgcggacgagaccgggacgcacaccgggaagtcgattgactcgaagcctgacctactaaaaaagtatcattacgctaaggcgcccgataagtagtgaagcgacatgatgacgctccgtaaacgtatcgcgtaagaggacgggaagtccgcgacttataaggccgaaccgaattagacatggtagtcggcggaggatacacttcgttcgcttaaagaccccgacccaaggccgacgccgtgcataaaaaggacttcgaagaatacagatttcgaagcggaaaacgttacaaagagtccagcgctcctagtcaccgccgacttcgacgttaaagggggatccaaacggttatccgggaacgagctgaccggcgagaggcctagtacagccggggcgcggtacataagtcacagcgtccctaggaacaaaattc

SEQ ID NO: 66445 - DNA, 267 bp, Triticum aestivum
  Clone ID: PAT_TA_66445
gggcgcgcgggcgcgcgcacaagagacgcgcaacgcacatagcatttttgtgtacacacacacactgggggtgcaaacacacgcggagagacacatgtggcgaaaagagtgcgcgaggggcacactctgcccagcttttgtgcctataagacacactctcagagctctagaacaaaggggataccgcggcgctctttgaaaaagagcgcggggtgagacacaatattggggtggcgcacatctatagaatataaaaacacggggtgt

SEQ ID NO: 66446 - DNA, 574 bp, Triticum aestivum
  Clone ID: PAT_TA_66446
tcggagtctgtgtgttcgtaggctgatatcagcggacttaaagaacctggtatgagtcagctctgagccccccccccccccccccgcctagtatgcagcggcacgtctcccaccgttattcaggactcgattcgaaccaactacgcacacatagagcgcggtgaggtcaagactcatcctataaaccctcgtatcctgtcggcgctaataaatctacctattttatccgctaataaaaattccctaaacagacttatcgttacggactcgtaattattgggaatataagatcgtaggccgagcgtcacaccggggccacgaatatctcggtgaacgcgaatttatttcagtggctctcgggatctgctgcagaatcccgtctcgcatacgcaggtgctaatgctgaccggacggctgccgccgcttataaggtactttctactaatttagtagctgttataactacttagtatttagttgtcaagtcctttccttctgacgcaccctccgaaagttctgattgtgctgatgttttgccgccctgtgtctccgggcctgtttatgacgcttactt

SEQ ID NO: 66447 - DNA, 169 bp, Triticum aestivum
  Clone ID: PAT_TA_66447
ttaattcggcacgaggctcgatgcattagtcagccttttcagcagggctaatatatcacccgatgtacgtgtagctggtggctgactttttaggcaactgctgtcccatgtagaggacgagtctactgcttttcatataaaattactaaaggattcacacaaggattgc

SEQ ID NO: 66448 - DNA, 580 bp, Triticum aestivum
  Clone ID: PAT_TA_66448
acatagccaccgattgcattcacatacgagcacgctttctcgagccatgttgttacatgaacatggacatacacatattcttaggaacaagtaagaaagacaaatggagaaggaaaacccaaagcaatgtcagagttgacaaaactgcaatggcactttatatgtggcccgtggtgagtgagctgtttaggccttgccggactcctcgcagcccggtggcttgaaggcaatgaagctgacgcactgcacctggcgcatgttgtcgaatccgatgatgcggacgtacgcgtcagggtactccttcttgacctcctccacctcgttgatcacctgtgtggcgtcggtgcacccgaacataggcagcttccacattgtccagtagcggccgtcgtagtacccgggagacgcattgtgctcacggaagatgaacccgaccttgctgaactcaaggcaaggcacccacttggagcggatcaggtagtccacctgcttgaggagggcctccgtgctgagcggtggcaggtaagacagggtctcgaacttcttgatgccctcgatgggccacacctgcatgcacctg

SEQ ID NO: 66449 - DNA, 612 bp, Triticum aestivum
  Clone ID: PAT_TA_66449
gaattcggcacgagcatggtccaaaattcaaacatgccactttacagagcttatttgtaagaatatattttgagagttcagtagctttaggtcggatattttatcatatccatatgcttaaaagggatgcaagcaggcaacccacgaagcccacatattatgttaagatcaggtgaaatatttacactggatggaatagcgcaggctgcccgcttgcatccctacaatttccggtaagtttcatccgtcagctatctcttcccacttcaaaagtcagaatttacacagaaaaatataggcataacaaacaggatataagttacagttctttgatcccaggtgcattgcatggcgtgatttcagaaagaaaaaagtgcagttaagtttaacaaaattaacagccgaggccaggggaaagacagtgcctttgtgcagggtagagcgcagcagaatcttccagctacttcacagtcacagcactgtctgtcccagctcctctataagcttccagaacttcaggaatagtttgctggtaaccagtgacatacttctccatgaacttcttctcccccagtatcaagtggcctcgtgccgaattcggcacgaggcaca

SEQ ID NO: 66450 - DNA, 552 bp, Triticum aestivum
  Clone ID: PAT_TA_66450
gaattcggcacgagtctccagactttgtcttgcgtgcctttctctgaattctgcgcttgaaaaggtctccagagctcacatggcccctctcgttccatttcctcttgacgacctgcctctctcttgtggttgtggccttgtgggttccggtgggctgagctggccactcgagacaagcacgagatggagtctctgcctctctcttgcagttgctcccatggccatgggctacggtttccatgcccgtatctctgaggtggattaaccggtagcggcccatggaggaggaatcccactgcccgctccggtgggagagcacgggcgaccagtggtggtacgccacgccgatcgactgggcggccgcgagcggccactacgacgtcgtcagggagctgctccacctggatgccaacctcctcatcaagctcacctccctgcgccgcatccgccgcctcgagtccgtctgggacgacgacatgcgcttcgccgacgccgccaccaaccgcgcctccgtcgcccggtgcctgctcctcgactgcgagtcccgcgctc

SEQ ID NO: 66451 - DNA, 512 bp, Triticum aestivum
  Clone ID: PAT_TA_66451
tttgaattcggcacgaggcatttccgtcgagcacgatggccgccgcccttctcctctcctcccgcctccccaagagcacggccatcacctccgccgccgctcccagccccacaccgcgcttcctctccttccccctcacaaccgacaaggcttgccgccgccgcgcgggatgtagtatcctcgcctcctccgcgacgtcgccctccccggccgcccagcctttccgctccctggccccctccgagaccaccgtcctcgtcaccggcgccacgggctacatcggccgcttcgtcgtccgcgagctgctccgccgcggccaccgcgtcgtcgccgtcgcccggccgcgcagcggcgtccgcggcaagaactcccccgaggaggtcgtctccgacctcgcccccgcccgcgtcgtcttctccgacgtcaccgacccgggcgccctcctcgcggacctctcggagtcgggacacggtcccctgcacgccgcggtctgctgcctcgccagccgcggc

SEQ ID NO: 66452 - DNA, 328 bp, Triticum aestivum
  Clone ID: PAT_TA_66452
agccacactgggactgaaacacggcccacactcctacgggaggcagccgtggggaactttcctccaagcagtccctcacctacctcgacggcacgctgcccggtgactttgggttccaccccttggcgctgaccgacccgcagggcaccggcgcgtccatccagcccacgcggctgtcactacgccgagatcttcaacggccggacggcgatgatgggggtggtgggcatgatcgccccggaggccctgggcaaggtgggcctggtgcccccggagacggcgatcccgtggttccaggcaggcgcgatcccgccggcgggcacctacc

SEQ ID NO: 66453 - DNA, 232 bp, Triticum aestivum
  Clone ID: PAT_TA_66453
gtctttaggacattttataaatcaatgtccgggggacaaagtacactgtagatggtgctgcgtgtaacgagcgaacagtgtatgctttatcagcaacaatggtcgtagtatagccgtcttgtcggtgtctggtcgatgcggcggttgacttcgtgtagcaggccgggttgcagccggattgggacccggccgggcggccgggctgaggagtccggccgggttgagggacttg

SEQ ID NO: 66454 - DNA, 569 bp, Triticum aestivum
  Clone ID: PAT_TA_66454
gaattcggcacgagccgcgcgagatccaggaccccgaccggccgccccgccgtcgcgcatgcgctcgccgtgaccggatctcgcgccatggccatcgcggaggcgtcccccttcgcggacctgcccttccccgacgacctgccggagttcccgcacggccccgtcggggacgacgacgccttcgccctggacggcttcgatctcgacgatctggacatcgacttcgacttcgacctcgaccttgacctcctccccaccgacgacgtgcagctcccgtcgcccccgccgccgctcgccacgtcttcgtcctcggccgggtcgccgggcggggcaggggactcctcctccggctccggtggcggagcggacggcggcctgaagaacgacgagtcctcggagacgtcttcgaggagcgcgagcgacaaggctggggatggaggagagggtgaggacgccaagcggcgcgcgcggctggtgcggaacagggagagcgcgcacctgtcgcgtcagaggaagaagcagtacgtcgaggagctggagggcaaggtcaaggccatgcaggccaccat

SEQ ID NO: 66455 - DNA, 497 bp, Triticum aestivum
  Clone ID: PAT_TA_66455
gttttattaacaagccataacaatactcatgaagggccaaatttcttgctaaaatttctacatcatgtaatcagtagcaccccataacaatactccgtcatgaaggctaaatttttttctgagatttggacatcatgtattcggatgaaataccactgttcctgaatacatctcactctgcctttcaaactagtcctacttaagctatagctatagtcctcgcattgtccatcttagtcaacaccatctagtatgttgcctagagatctgtggtaatgctgaccaatgacaaggcgataaaatacggggccactgatgagacaaaaataggatctaatggcacttgatgtaactatctaaatataaattgtcgaaattaaacgtgtgctttgcagtaagtataaccatctgtagaaaagactactccaaggaacaaactaaatgaaatttttacttcttgaatcttttgtaatataggtgcactacgtcttggaatg

SEQ ID NO: 66456 - DNA, 458 bp, Triticum aestivum
  Clone ID: PAT_TA_66456
gtttttttcccacccaaaaaaaaagaaaaaaaaaaaattccccccacaaaaggggagaaaaaccccaaaggcccaaccaaaaaaggggggggggggccccccccctttggaaaacccaggggggccccaaataaaggaaacccccggcccaaacccgggggcccaaaaagggccccccggagggcgggggaccccaagttttggccccctaaagggggggaaaattccggctgggggaaaccaagggcaaaacgggcccccgggggaaaagggtaccccccccaaaaccccaaaaaaaaaacaaccgggaaaaaaaaagggaaacccgggggggcccaaaggggggcccaaccccaaaaaattgggggcaaggggttcggggggtcaaaaaaccaaccccggtaaaaaaaacccccccacggaaaaccccaacccccaattgggccaagggggggggg

SEQ ID NO: 66457 - DNA, 113 bp, Triticum aestivum
  Clone ID: PAT_TA_66457
gaattcggcacgagctgatcaccagcacaggcgcacatccaccgctcctaggaaggtggagcaagcagcacagagacgggtgcggccttcatcttcaccggcggtgccccggc

SEQ ID NO: 66458 - DNA, 176 bp, Triticum aestivum
  Clone ID: PAT_TA_66458
gaattcggcacgagagacagagcgcgagcgcgccgcgattgacatcacaaaacagagagccctgctctgctaagcgagcggatcaccctcgcccgcaccgcagtgggaagagaagcgcttgcttgcccaatatgatgctcgcctacatggaccgcgccgcggccggcgccgccgcg

SEQ ID NO: 66459 - DNA, 419 bp, Triticum aestivum
  Clone ID: PAT_TA_66459
gcacacacctaccaagatacacaaaatccatacagcaaatactcaaagtctcaaaaagggaaaacctactagtaaccgggttttagcagaatccggactactcaaatccacatttacttttagttcactgtaataagaaaacaaatgcagtacaaggatacagtattatggcatcccgaatctttgcatgccgctacacaattttgcaaaccccttacagtcttagtgtcttactgaacctagcatgtgaccaacacatgcagacgtggcctttttcagctttgggcgctgcatttccatctccttgagcaacgcagctagctggaacgttccctctggacatcgatcagcctgtacagatcccctttaccctgcgtttccaaagggaggttcgcccttacagcttcaaccaaagacag

SEQ ID NO: 66460 - DNA, 449 bp, Triticum aestivum
  Clone ID: PAT_TA_66460
ggttattcatttataaatgtttttttttttttttttttttttttttttttttttttttttttttttttaaaaacaggcaaaaaaaaaaacttccaccccaggcacgtaggtggcccaccaaccaatgggttaaaaaccacaggcaccccaccaagccaaccaaacccgaaaaaaattgcaggggcaaccagtccaattgacccgggagcaccccccccggaaccccccctggcggccggccttgacggaaaccccccccacaccgcccaaggcctggggaaacccgaaggggaagcggcaccccaaacaccccccggatgttcccggggaaccccggcacaacccccggcatcccgccgtccccccaaagccccggggccaaccccaacgcggggtggccgccccccacgtccctaaaaaaggccgcgtcaaaggacccggcccccccc

SEQ ID NO: 66461 - DNA, 443 bp, Triticum aestivum
  Clone ID: PAT_TA_66461
gaattcggcacgaggccattcatcgctgatcaccagcacagacgcgcatccaccgttgctagcaaggtcgaccaagcagcagcgagatggttgctggcttctgctgcaccgtcggtgccccggattttacgccgaccaacttcctcgggaagaagctcaagaagcaggtgacctcttccgtgaactaccatggcaggagctccaaggccaacaggttcacagtcatggcagcggaaaacatcgacgagaagaggaacactgacaagtggaagggtcttgcctacgatatctccgacgaccagcaggacatcaccagagggaagggcatcgtggactccctcttccaggcgcccacggacgacggcacccacgaggccgtcctcatctcctacgagtacgtcagccagggactcaagaagtacgacttcgacatcaccatggga

SEQ ID NO: 66462 - DNA, 413 bp, Triticum aestivum
  Clone ID: PAT_TA_66462
gaattcggcacgagtttcaccgaagaatgatgtttatagtttaggaattataatcatagaaattttggttggacgtagaggctacttggaatttcatgaaatggatgatgtcacaccatttaataagctggtaattgagaaatggcagaaatggatatgtgcaatgacatcaccatgcccatcagcagaaatagatcaagtggagacttgcatcaaaatagcaataaaatgtgtggatcgtgaacgagagaatagacccactgtagcagaaattttgaataccctgcgggagacagaaaaaaggtttcatctcttgggccagagcttgcccactcccacttagattggaccaaggggtggaatgggaggttctatttgtgatatcgaagaaaatccttggcgcctgacaagtc

SEQ ID NO: 66463 - DNA, 517 bp, Triticum aestivum
  Clone ID: PAT_TA_66463
gaattcggcacgagcccattcccctccctcaggctttccacacgggtcgatagaatccagcaatccctagccgccggaattcgacccaccgtagccggcgagagtccaccgccgatggggagagcctttccagttggaacgaccacccacattggggtagaggggaaccgcgtgcgtggccaacaagtggaccgacgggcgagatgctgcgccgcggacgcgacggggagaagagaggaagggggcgcgcgtgggcggctggcctacaaggaaccaacgcgtctctgccacatctacaaaccgcgggcaacagaaaatagtggaaactaggcactagacaaccttttccgccattccctggcttggcaggttttaagatggaggactttccagatcaatacgatggcgagaagcaaggtgcaagacaatacagaagatacaattcaagatttagcaacttttatctagcattcatttttacagggtacggggatgcaagaacaggggacaagatcca

SEQ ID NO: 66464 - DNA, 531 bp, Triticum aestivum
  Clone ID: PAT_TA_66464
gctaaaagatcatctcttgtcttattttaaataaaagaagacaagccttttcttatgagttctctctcctccacctcatcatttatcctatgtggcactcctaagatagcatcaatgtacatgccctaatcatctatggacgttgctacacagcgcccgcgcgctatgcgagcggatctcgcggccggcacttaagaaaagtgtccctatcggtcccccaccccatgtgctaaaaaaggcaagtccaatttccctcgcttgttgccacgtctcgacaaccaaccatcctttccctcacttgttgccacgtctcgacaaccaaccatcctttccctcacgtgatcctcccctccacccaccactagaaaacccaacgcccaccagcccagatctcctgtgcaactccttccccagccaccgccggatgccatggcgtaccgttggggagctctcctccttcccccctaatcttctagttacaaaaattgccccatgtaccaaagtgtttgcagaacatgacttggatcttgt

SEQ ID NO: 66465 - DNA, 503 bp, Triticum aestivum
  Clone ID: PAT_TA_66465
gaattcggcacgagacctaagtagtaagtaaattctacaatcaaatggcacacctgctgctgcttcagaatttggaatgactaattgatgcatttgtacatgagtgatgctacatctacaaaaggttatttcaattttttacacacaaactgatgtggaagattatgattggtaaaaaagggatgaaggagacaaacccagttggattaagtggggagagttattagttcggaaagttaagtaaacgttgtagagtctttgtaggtctagcattattgtttgtacgtattacgcagtggaatggtgagaagagctccgaagaagaatgaggaggtggagcagccgagaaaggacgagcttaacatcttgacggcgatctggaaatgggtcaccgaccttcttttccccaacgaacacatcaagacgtacctaacgactaaaatgctgataaagcttatcccacaacgcacagctttagaatctgaaatactttgatgcatttt

SEQ ID NO: 66466 - DNA, 137 bp, Triticum aestivum
  Clone ID: PAT_TA_66466
gaattcggcacgaggcaaagtcttgctccaggatctgccctatacagcctgtagagcattcattacgtgaagttcacggacaaacatgtcttcggtgaaggtgttcgggcacccgatgtttacaaacgtcgcacggg

SEQ ID NO: 66467 - DNA, 131 bp, Triticum aestivum
  Clone ID: PAT_TA_66467
gggcttgttcggggaacagcggcacctgggccaaaaaacctataccccagggtcagccaacaggagtccccagcaacatgtggcatgcaacacacaacgaaaccacatgtaccaaaacaggagatccaaac

SEQ ID NO: 66468 - DNA, 361 bp, Triticum aestivum
  Clone ID: PAT_TA_66468
ggaaagggaactttaattaccttgggaaggccaaacaggaaaaaaaaagggaaggggcccaaacccacaatgggggaccaccgaatttttttcggaccaagggggcaccctccttgcgagaaaaaaaaccgccaaaaattcggggccaaggggaaaaaaaaaaacccccctaaaagggccggcccgcggataacaagggggggccacgggccagttttccgaaaaaggcatttccgggaaaaagggaaaaaaaccgggctgggaaaacccggaaagggggccaaccccgggaaagaccccctggggggggcccagcggggaaaaggggcccgccaaggccgcaaaaaagggggccgggggg

SEQ ID NO: 66469 - DNA, 421 bp, Triticum aestivum
  Clone ID: PAT_TA_66469
gaattcggcacgagcatggaggctgcttggctttggctgaacttgctcggagggggctgttgctgccttctagctttcctgatgttattcccgttataacgaaggctttacactatgatgtgcgtagaggtccacatagcattggttcacacgtaagagatgccgcagcatacgtttgttgggcgtttggtcgtgcctatactaacttagatatgaaggcggtcttggaacaacttgctcccgaccttctaacggttgcttgttatgatcgagaggttaattgtagaagagctgcttctgctgcctttcaagagaatgttgtaagacagggaacttatccgcatggcattgatattgtgaatacaacagactactttgcactagcttcacgatcaaactcttatctgagtgtcgctgtttc

SEQ ID NO: 66470 - DNA, 118 bp, Triticum aestivum
  Clone ID: PAT_TA_66470
gaattcggcacgaggttcatcgcactgagctggcaggctgcgccagccaccagcgagatgggcgcgtcaccactgcaccagacgaccaggttcctcggcaccgcaccgcgtcgcgatg

SEQ ID NO: 66471 - DNA, 447 bp, Triticum aestivum
  Clone ID: PAT_TA_66471
gaattcggcacgagggcttctacgccgaccaacttccttgggaagaagctcaagaagcaggtgacctcggccgtgaactaccatggcaagagctccaaggccaacaggttcacagtcatggcagcggaaaacctcgacgagaagaggaacacggacaagtggaagggtcttgcgtacgatatctccgacgaccagcaggacatcaccagagggaagggcatcgaggactcgctcttacaggcgcccacggtcgacggcacccacgaggccgacctcagctcctacgagtacgtcagccagggactcaagaagtacgactttgacagcaccatgggaggcttctacatcgctcctgctttcatggacaagcttgttgtccatctctccaagaacttcatgaccctgcccatcatctagatcccactcatcttgggtatctggggaggc

SEQ ID NO: 66472 - DNA, 627 bp, Triticum aestivum
  Clone ID: PAT_TA_66472
gaattcggcacgagataaagcaatctgaatattgtgaatatatatgaagtattgataaaagtggggatctgaaagcggtcttggtctggtcattggacacaaacaaagtacatgaagttgcaatgactaacttttaactaaacaaatcacaaggaaaaaactaggggattgatctacttataggtggctgccaaggggtgcaatgacgtcccaaggcagcctaaaactaaccctaggtcgtagaaggcccatggacccaagtggaggtgatgcaacaccttttgatttggattctgactcggattctgtagcactgtgttgcctctatcttcgtactcaaaaggaatttgaaggtggatcaaattgcgttggaaagtacacgaagtaaactttccaataaaaaataatcgcccaatttggagtccagatgtaaaagttgttggcattttgagtcaggtttgttcgtgcagtttgaatttgagtcccgaacatggggggcttggtctctattttctcctaatcatttcattttactttgtcttcacacgtggttcgtactagtgttcaacaattctgcatttagacatgaaataaaagtaggtgaagtatttttattctagataacat

SEQ ID NO: 66473 - DNA, 680 bp, Triticum aestivum
  Clone ID: PAT_TA_66473
tcggagtctgtgtgttcgtaggctgatatcagcggacttaaagaaccggtatgagattattattttattattattaaaggggaatgagtgttgttgagtgagtatgtatgtatgtttgttcttttttattggagtatgtgtgttgttttgaaacttttcgctgtacttgctgggtggctcttcttttgcgtcttctatcccctcggaacggtgctgagtggcgatgtagttggagccgctgcgttgaggaatcccagatcgtcggaagagtccgagagaggagagaagggcaccggggacggaatagccagtcacggaacggacgatgtagacgacactcatacgtgtcttcggataggaataacaaccggcttttataatatcgcttacgagggttggacccactagccgaagtcccctcgcgataaggatcactttgataggttattgatcgccaggccctatctaagaactaatacgattcgcgcaaacgttgagatcggaccggcggattaaaggaagcccagttcgtcgcttaatcggtgttgcgagcatataacggagaatactccgacatagtccaagaaagagacggtgatactatataattggaaaccagcgtagttcttggaggggatgcctcatcgaaagaatatccgctgtgcagaatgcgctacctt

SEQ ID NO: 66474 - DNA, 475 bp, Triticum aestivum
  Clone ID: PAT_TA_66474
gaattcggcacgagcgacaccgcccaccaacacctccctccccgcgccgcaccacacctccctgcccaccttctcaggtgcggcgcacccctaccctgcttaccttctcaggcggcgccacccaccaccacctccgactgcgtcccacggcacaaccccagggacggatccgactgcagtcatggcgggatccggccgtcctcctgcacctccccagggacggattcgggcggttccagtccgccacgctaccaggcaacgggatcgaggagcacaccttcgcctccctcacccgtccccatccaggatccctcctctcacgccgcctctggatgcgagccatcgccaccaacggctcgcgccccgccggcaatagggcccgccatcacccccatggcctcgcctccgtcacccccagggccgtccatcaactcgggctacgcccccgccaagaaaccaccaaatccaggggatc

SEQ ID NO: 66475 - DNA, 506 bp, Triticum aestivum
  Clone ID: PAT_TA_66475
gaattcggcacgaggaaggcttgagatatttactggtgccaggaggagttacccggttcttggagggaggctccactttgtcaagtttgagactgggaagctaaacgagtgtttggactttatttcttccaaacaactacaccggggtggagttgattcaccttcatggcgctcaggagctcagcccgataacatcgtaatcaaggcaacaggtggtggagcattcaagtatgctgatctttttaaggaaagattgggagtcagtcttgagaaggaagatgaaatggactgtcttgtagctggagcaaattttctgcttaaggctatacgccatgaagcctttacgcacatggatggccaaaaggagtacgtgcaaattgatcaaaacgatctgtttccttaccttctagttaatgttggatctggtgtcagcataatcaaggttgatggtcatgggaagtttcaacgagtaagaggaacaaacgttggtggcggtacatactggg

SEQ ID NO: 66476 - DNA, 662 bp, Triticum aestivum
  Clone ID: PAT_TA_66476
gaattcggcacgagatctcactgagctcgcaggcagccccagccaccagcgaaatggccgcgtcggcgctgcaccagacgaccagcttcctcggcaccgccccgcggcgcgatgacctcgtccgcagcgtcggcgactttggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacgggtgggacaccgccggattgtctgctgaccccgagacgttcgccaagaacagggagctggaggtgatccactcgcggtgggcgatgctcggcgccctcgggtgcgtgttcccggagatcctgtccaagaacggcatcaagttcggcgaggccgtgtggttcaaggccggcgcccagatcttctccgagggcggcctcgactacctgggcaaccccaacctggtgcacgcgcagagcatcctcgccatctgggcggtgcaggtggtgctcatgggcttcatcgagggctaccgtgttggtggcgggcccctcggcgagggcctcgacatcatctacccgggcggcgccttcgacccacttggcctcgccgacgaccccgacacc

SEQ ID NO: 66477 - DNA, 611 bp, Triticum aestivum
  Clone ID: PAT_TA_66477
gtataatattatgcgtccgttcatatacatagccaccgatagcattctcatacgagcatgctttctcgagccatgttggtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctggcgcatgttgtcgaatccgatgatgcggacatacgcgtcagggtactccttcttgacctcctccacctcgttgatcacttgtgtggcgtcggtgcacccgaacataggcagcttccacattgtccagtaccggccatcatagtacccaggggatgcgttgtgctcacggaagatgaacccaaccttgctgaactcgaggcaaggcacccacttggagcggatcaggtagtcgacctgcttgaggagggcctccgtgctgagcggtggcaagtaggacagggtctcgaacttcttgatgccctcaatgggccacacctgcatgcacctgatcct

SEQ ID NO: 66478 - DNA, 272 bp, Triticum aestivum
  Clone ID: PAT_TA_66478
aaaaaccttgaactcgaattccgaaaccaccgcccaatttaagcctttaaaattcaaaatggaatcaccgggggagggaggaccaacaattagccttaagctgaaatcaaccatggacccaaacatgccttattggattggttaccaccctggtgcttccgacccaaaggtccaccaaactttcagcccaggggatttgattggcacccaagactggatcaaatggggtatttgaaagccactaacttaagcgaccctcttgatcttggggc

SEQ ID NO: 66479 - DNA, 153 bp, Triticum aestivum
  Clone ID: PAT_TA_66479
gaattcggcacgagaccagcagaagttgctgagcgcgtacacagaccctaacactagcgacaaggtcacgtcgcatctgctccagacaactagatccatggcgacgaccaagggcgaggggcagcccatccgcatcgaccgagactccagcta

SEQ ID NO: 66480 - DNA, 613 bp, Triticum aestivum
  Clone ID: PAT_TA_66480
gaattcggcacgagcatcaagccattgcgctgccgcgcgcgccttcctttcctttccttccctgcgccgcagctagcagcagcagctagctcgcctgactagctataggagcaaacaaatctaagatgagagggacgccgtgctcggagctcgggagtaggataagctaaggtagctagctacggagatgcggtgcccggcgctgctgctgctgccgctgctggcggccgtgctgctgcacgcggcggccgcggccggcggaggcaacgggagctgcgtgcggagctgcggccgcatgacgctgccgtacccgttcggcttctccagcggctgcaccgtacgcctcggctgccacgtcggggccgacggcgtcggcgccgcgtggctcggcggcgcgccggagctgggcctgctcgtgcgcaacgtcacgccgcgcgcgctcaccctcaacctgcagcccgactgcgatcgctcgttcaatgcgtccgtcgcggcgctcttctcggacagctacgcgccctcctcccggaacgggctcgtcgtcaggtcatgcagcagcgcgaggctgaccgcatcagaaactgcagcagcgactacatcaaccgaaccacgt

SEQ ID NO: 66481 - DNA, 601 bp, Triticum aestivum
  Clone ID: PAT_TA_66481
agactaggtaaaaagtttcatttacagattgcctggaaccaacggaaaaggaaatgagcggcacaagaagagacccacaaatcgtacgttttcttttctttggtagctatactagaagaaatcgtacatctctaaattttacagctaaactaaacaacgacggaatggatgtcaggactaatggcggcgtgtttcagttcagtgaagcgagctgctattcccgagcaggctattggaggaaggggagctcctgtcgctgaaccacctctcctggacggacacaggggaggaccccgccgcgcccttctccgtctcccgctcagccaccgtcgtcgccggggcagacgtcggcaacgcctcgcccctgcctttgtccggccccagcgacttgtccgtgccgcgcgacggcgccgacgagcagagcgacgacgtggtcgacatgaacgcggcgtcgtccgccgacggcgcccacccgctgacctgtatctgatccagctcgtcggcgacctcggccatggacggcctgatctcgctgtggaacgcgaggcacctgaaggccagctccgccaccttgtggatggacgtgagcgttcacgcgtcc

SEQ ID NO: 66482 - DNA, 207 bp, Triticum aestivum
  Clone ID: PAT_TA_66482
ggttacatcttggattactctagcggaaaaaacagcgtcaaagtggacgatactaaagtgtgcatatacagtcacatgcagttctaacctcaaccagtccgcctgcaagctagctaaccgtagattcttactcaacgactaaaatgccgtgtcgagtatgactatataaacccattgccgcgggatgtgaaacatgaggcctcttca

SEQ ID NO: 66483 - DNA, 583 bp, Triticum aestivum
  Clone ID: PAT_TA_66483
atcagaaagtgacagaaactgaagccatccttttcattttcctgaacaaaactggaacagaagcacccttttctatacaacaagattggacatatggtacatggaagtatgacagccgaacaactctacaggtacatctaggaaacgtcttcacagacatccctctgcaatactacaatctttaatcttctttcatctccagtacaatatcagcctcttcacaacacccatgaaccacctaataaatgaataaaattaatttcctgtacagagattgccactttttcagcccatgactgcctctgttggtacactatacacagactcgcaaactgtccacttcaccatcaaaatttgggatggaatgtcaggaactgatcttctgaacttccggcgagaaaaatccatgtcactggcagcgctcatgctcaacaagtgattttgttggcttggcaggaattgtaagttgcagctgttgttgcacagctgcagcagagtagatgtcagcaaccaccaaaagatccttggcggttggcttcactcgggtcttcacctcctcgatgatccgacacggctccttctc

SEQ ID NO: 66484 - DNA, 165 bp, Triticum aestivum
  Clone ID: PAT_TA_66484
gaaagaccattttaccttttattatgaaatggtttgatcagatctcgcccattaatgaatccggggggatgcaccgaacaagaagacatagacctaggaggaactacgtacgcatgcccaagaacctatgtccgtacatacatacacaaaccatatagaacaaaa

SEQ ID NO: 66485 - DNA, 154 bp, Triticum aestivum
  Clone ID: PAT_TA_66485
gaattcggcacgagaagccacactctgcagcgccaacagaggccgagggcaatgcagcgcacaccatggcgctgttctcctcctcctccgccaccgccgtcgcggagctccccaccaatgtgctggccggcgcccggagctccttcctcggcgc

SEQ ID NO: 66486 - DNA, 557 bp, Triticum aestivum
  Clone ID: PAT_TA_66486
gaattcggcacgagcttttcgccgcccccctttcgattcagttcacagcttgccctttcagcttttctttttttcttgtaaagcatttagttatcctcttgaatcgccttaatttgtttgcgcacgctctccctttccgtgggcacagctctgtctctcgaaattcgcatggcatatcgagtgtttatttgtttcttcctgctgtgagtgtgtgtgtgtgtgcgcgcgtgtgtggcgacggcaactaatttggtgttgatcctctcctccccttgcagatggacgccgccgtggagcgcctcaagaccgggttcgagaagttcaagaccgaggtctacgacaagaagcccgatttcttcgagcccctcaaggccggccaggcgcccaagtacatggtgttcgcgtgcgccgactcgcgtgtgtgcccatcgatcaccctgggcctggagcccggcgaggccttcaccatccgcaacatcgccaacatggtcccctcctactgcaagaacaagtacgccggtgttggatcggccatcgaatacgccgtctgtgctctc

SEQ ID NO: 66487 - DNA, 142 bp, Triticum aestivum
  Clone ID: PAT_TA_66487
gaattcggcacgagctctcattcttcctgagagggcgagacagacctggccactgcctgagggctccacttggaagatcagctgactcggttgcaccttggagctggaggacagagatgggggcgcggaggatgccatgcgg

SEQ ID NO: 66488 - DNA, 352 bp, Triticum aestivum
  Clone ID: PAT_TA_66488
gaattcggcacgaggcagtatctaacactcctggtccggcgtctgcaatggcaagagcagcggcggcggaggccttctcgcggcgcctgggcgcggccgtgcgcggcctctccggcgcctggtacaaccgtcatatggccgccgccgaccgcgccatccgcgcccgactcccccttgtagacctcgtactcgaggtccgcgacgcccgcgtacccgccacctcggcgttcgagcttctccaccgccgctccccggaggagcccgacgtgcgtcggctcgttgcgctcaacaaggccgacctggctgataagtccgaaaccgagaagtgggtggcgctcatgaagcaaagggg

SEQ ID NO: 66489 - DNA, 624 bp, Triticum aestivum
  Clone ID: PAT_TA_66489
agttagtgggggttagctatttagatataaaagataccaagcataaacaatctgctaactacctattaacagtccctaactttccttcattttacactaggctagcactgtagcaccgtgactttccttctccatgttagaggatccggttccgatttccgtctgctgctccgtgccggagcttccggcgctactttaatgatctgatgatttgcgacatgactaatactcccttcataaagaatataaagaaatataagagcgtttaaatcactattcatggagggagtatgtcatgtttttttttcaaaattagtgatgagcagactccgatacattttcataccataaagaacacatgtgctaatacattcgaaattttgtaggtctcgcttgagattgtgagaatgtattgtggcatcaagtgtgagcatatcaagcgatacgaatccatgttaatagtttttatgtctttttttaaattttttggtagttgaaggtcatgaattttgattaagtacgcttgcatttgcagctaaaaaatttgagaacttaaatatttgccccggctaacttcaattcctagtccgccactattgacatgaaacacccaaaaggctttag

SEQ ID NO: 66490 - DNA, 480 bp, Triticum aestivum
  Clone ID: PAT_TA_66490
gtacttataatattatgtgcatgtgcatatacatagccatcggtagcattcacatacgagcatgctttctcgagtcatgtcgggaacatggacatacacatattcttatcttaggaacaaacaagaaagataaatggaaaaggaaaacccaaagcaatgtcagagttgacaaaaccgcaatggcactttatatgtggcccgtggtgagtgagctgtttaggccttgccggactcctcgcagcccggtggcttgaaggcgatgaagctgacgcactgcacctggcgcatgttgtcgaatccgatgatgcggacatacgcgtcagggtactccttcttgacctcctccacctcgttgatcacctgcgtggcgtcggtgcacccgaacataggcagcttccacattgtccagtaccggccatcgtagtacccaggggatgcgttgtgctcacggaagataaacccaaccttgctgaactcgag

SEQ ID NO: 66491 - DNA, 664 bp, Triticum aestivum
  unsure (1)..(664): unsure at all n locations
  Clone ID: PAT_TA_66491
ggccgtcctctgcatcatatacaatgcagacaactacttttatttaagacataatagtatccagtagctaaatagtcttacataaaagtaaaagaaagaagattacgtgactcaaatcaaacaacacttatttgtggtccttcccagtaataatgagcagcgctaacgggtgatgggcatgcactaccatgggtagtctgaccatgagattgacacttcaattacagcgccaccagcgcccatgacaagttccatatgctgaccatcggtcgcgggatgaaacgcgacagcacctctcacgatctcatcgccggagtcgcgacgcaggtccagctcaaccgtgagcggcatgtgcaatggcaccgcaaggacatgcctcgccaacggaaccagctccccggatcccacccgcatgttgttgccatcgccgtgctcgttgcagaagagcacgcagccggcgttgaacagcttgctgcgcgcgacgatcctccccagaacgccagcggggccttctccatccaagcaagcgagcttcacagtgacgcggccttcgacgccgttgctcaggacggcgtaggtcacgtcggcggngccgtagcgagtgctaactgtttcgactatggccctgttgtagttggagaagctgccaccgacggtgtcgcag

SEQ ID NO: 66492 - DNA, 634 bp, Triticum aestivum
  Clone ID: PAT_TA_66492
gaattcggcacgagatcctcccgcgtgccaagccaccgaccaacatggcagcgtctctccaagccgcggctacgctgatgccggccaagatcggcggccgggcctcctccgcgcggccgtcgtcgcacgtcgcccgggcgttcggcgtcgacgctggcgccaggatcacctgctccctgcagtccgacatcagggaggtcgcaagcaagtgcgccgacgccgccaagatggccggcttcgccctcgccacctctgccctcctcgtctccggcgcgagcgcggagggggcgcccaagaggctgaccttcgacgagatccagagcaagacctacatggaggtgaagggtaccggcaccgcgaaccagtgcccgaccatcgacggcggcgtcgactccttccccttcaaggccggcaagtacgagatgaagaagttctgcctggagcccacctccttcaccgtcaaggccgagggcatccagaagaacgagccgccggccttccagaagaccaagctcatgacccgtctcacctacacccttgacgagatggaaggcccgctcgaggtcggcgccgacggcaccctcaagttcgaggagaaggacggcatcgactatgcggccgtcaccgtgcagct

SEQ ID NO: 66493 - DNA, 235 bp, Triticum aestivum
  Clone ID: PAT_TA_66493
gaattcggcacgaggagagagaacatacacctccgtactccatagcccccacccttcctcgaaccctcccccttgcggcattcaaggacccctccgtccatccaaggaaccctcccccttgctttgattcgatccctcccccgcccccgctccacgaacctctgtcgctcttgctcttgattttgcggcctcgcgagggaggacgcctggttgattcgctccgcacgcctttgcg

SEQ ID NO: 66494 - DNA, 657 bp, Triticum aestivum
  Clone ID: PAT_TA_66494
acaatggcgaaaacttttactcaaattcagggatgttgacacaaaatccacttttaagtgcaacagttgttggcactgaccaagagatgtactggacatataatttagtaaaagaagacatcattactcgaaatattattgacagctcaggtaaagttaagatgttcttttggtccaagcaggcacgggattggcaagtggtctatgcccaaccacgagctctgtgtgatgtctatgcaatctgtggacctttcacaatttgcattgataatgagcttccatattgcaattgtatggagggcttcaccataacatcccccgtggactgggagctagaagatcgaaccgatggctcagactgccccaaaagtagaagctgctataagcgcgagtgaatgtgcacaagtttgccagaatgattgctcttgcaccgcctattccttcagtgacgacagatgttctatcttcgcgtttctgcaaaagatttccccagattgaaaaacaacagaaaggagattgttactggagttgcaacatgcatttctgctctaggtttatttgcacttgttctcctgagcatgtgagacgcggttgctgacagtttttgccggcgtgagggagacggcgacgatgtaaatcccgggcgctggaaactcg

SEQ ID NO: 66495 - DNA, 584 bp, Triticum aestivum
  Clone ID: PAT_TA_66495
gaattcggcacgagtggaggtcgaagggatctgcgaccgcgcggcacgcaagtacgtcgcgaggaagatgggcctcggcggcggcggcctcggcatgcctccggtggtcatgcgcgtcgacctcatgagcgcctacgcgcagcacctccgggacatcatcaaggagcgcgtcgcccacccgacccactacgacaccccgctggagggcttcaaggtgatcgtgaacgccggcaacggctgcggcggcttcttcgcgtgggacgtgctggagaagctgggcgccgacacgaccggcagcctgcacctggagccggacggcatgttcccgaaccacatgcccaacccggaggacgcgacggccatgtcgctcacgcgcggcgcggtgctggcccgcggcgcggacctcggcgtggtgttcgacacggacgtggaccgcagcggcgtggtggacggcgcgggcgccgccatcaacggggaccgcctcatcgcgctcatctccgccatcgtgctggcggagcaccccgggacgacggtggtgacggacgcgcgcgcgggcgacgggctcacgcggttcatcgaggcgc

SEQ ID NO: 66496 - DNA, 464 bp, Triticum aestivum
  Clone ID: PAT_TA_66496
gaattcggcacgagcccagctcgatcgtcccaccgtcccctccttcctccggcgagatgctcctgtcggagctcccgaatccgccccgcccatggcgcccccgcgttcgagaagcccattccgctcgccctcgccacctccctcttcccggctcccccactacgcccttaccgagaagacgccacctcctgctgtccccttccgcgactccgtccgacgaccccgcgctccctccgtcgaggcgaccgtcccacccgaagagggcgtcgggtgagggcgaggggtggacgaagaaggcggtgccgcccggcacgctcgggctctccagccccgttcccgaggagccgctgtcgccgccccggtggacggccgcacggcaggcgcgcaccgcgtggcggaaggcgacgtcgatagtgcccaggagggccaggagcgtcatgctgctcaacctgctcgttctcata

SEQ ID NO: 66497 - DNA, 469 bp, Triticum aestivum
  unsure (1)..(469): unsure at all n locations
  Clone ID: PAT_TA_66497
gggggncaatggtgccatcgggatgctctttcaccttgatcacccattttacaaccgatgacattttgacggggaggccgaggaacaagtgaccacgtgttatttgcttgaagtgcacgaaattcttcgagcatggcggcacgccaccgttcatcagagagggcctggcgtgacgaggtgggcacgggaaggaacgcacgacggcgcgggtcgtaccgaacagtgccatctgacggtttcagcgtcttgatgacattattcttgagccgggtcaccatctgatgcgaggccgccggtggcagcaccggacgaggcgcaggcggggacgacggagtggtcgatgtcgttggtgtagaaggcgaagcagaagctgtgggcggagaccaagtcatgaacggggaggcgggcgccatgacgtcagacccagcaacagccaggctgggggcgtcaaggtccgccaaggtagctc

SEQ ID NO: 66498 - DNA, 686 bp, Triticum aestivum
  Clone ID: PAT_TA_66498
gaattcggcacgagaaatgacagcgcaactacctcagctcggctcaactggccaccagcaaactgcctcgccaagaacacttcaaccgccattataatattcacgaaatttgccctcccgagctgcccttttgctccacgcctctccgctctccggttttgactcgccatccatcccctctccccggctcccccccaaagattttcactttccacgccggggagatcagcacggtccaaagatcgccggggtttcttggccggcattttctgacggccgggcgagatgagctgcttcccgtgctcggggtcctcggggaaggccggggaggacgcggcggcgctctcgccgtcgccccggccgtcggcggcgaagccggcgccagatcgatacaattctcgtagttcaagctctgttcgcagaggaggaagtgctccacatggcccggcaaagattttcactttccgagagctagctattgctaccaagaatttcagaaaagattgtttgttgggtgaaggtggttttggtcgtgtctataaaggacacatggagaatggacaggttattgctgtgaagcaactcgacagaaacggtttccaaggaaatcgtgaatttcttgtggaggttctcatgctaagcctcttgcaccatcccaatcttgtcagattaattggctattgcgc

SEQ ID NO: 66499 - DNA, 532 bp, Triticum aestivum
  Clone ID: PAT_TA_66499
ggggatcaaacccagcaaacttgctactatcgatatttccacagaaaaaatgtaatttggggacagaaaagcacatacaggggaccaaaacaggaagactgaactgtttgcattactctgtttccctaggaaaatcaacgaagtaaggatgtaacgtactacaaagatgtgaccaagtccacttcaccaaggtacatatcgacaactaggtttaacagcagtcagccttctggactcctgatcagtatggcaatagtgcaacataacacaggcctagcaccgaactgacacaagccggcgagtgaagcgcatgggtatccatttccgcattttcatggacctccacattgacaggtatatgggagcttctgaagacagctttccaaaaaagtttgctacttagtttcatgaactgaacaaaagcacagcaggcctgaagccagctcgcacctcttcaccattgaaagggtttcttctacttctacagtgagtcaaaccacgaatcaaagccagctgatacattcgaggaacc

SEQ ID NO: 66500 - DNA, 203 bp, Triticum aestivum
  Clone ID: PAT_TA_66500
cacctccaatttccaatggaaattacaacaacattaaagaccgcccaggggggcgtccaagcgcgcccaacgcggccttatgcatcaaacctcaaactgaaccaaaaaaaaaaaccgtccgtagtacaatattaaccgcccacccgaataataatcgccccctcccaacaataagtgggggcaaattttgccgggggccatgg

SEQ ID NO: 66501 - DNA, 575 bp, Triticum aestivum
  Clone ID: PAT_TA_66501
gtttaattgttgcacttgcatgtagtagggatgtaacaagagctatatatgtgtgggaacacaacaaaactgctaatcggctagtagtcacctacacagctcgcggcggtttgccgaccaggtcgtctcaacacatcaaggacagcgcgaagagccatggtcgcctttttttaaaaaaaaaaaattccaatctattcatcttcaatcatagtagtacaacgaaaactagaaatactaaaaattacatccaggtccgtagaccacctagtgacgactataaggactgaagcgagccgaaggcgtgccgctgtcatcgcccctccctcgccggagccgggcaaactttgttgtagtagacagtcgggaagtcgtcgtgctaaggccccgtagaaccaacacaccagaacagcaaccgccgcggatgaagagtgtagatcaaaaggattcaacctgaaaacgaacgaagacgaacgacgaacagatctgagcaaatccaccaaagacagatccgccggagacacaattctacacgcccaccgacgatctcgtgccgaattcggcacgagcgcctgcgt

SEQ ID NO: 66502 - DNA, 615 bp, Triticum aestivum
  Clone ID: PAT_TA_66502
gaattcggcacgagcttcagagtcccgtgcctggagccccgtgacgtcttgtgagcaccctgacttgcccctgcacgtcatcagctctcggcccaatgcccttgtgggagatgcagtgtatttcttgtgccatcaggaaacgttcatcctgcagtatgacttgttgaaccaggaactatcaatgatttactggccacccttgccaaagtgtaagtgcgacgagtatatcgttatggccacagaggacggtgagctgggatgtgccaccctgaaggagtccaagctcgaactatggtcgatggaggctgacgcaggtggagctgtgaaatgggtaacacgcagagtcgtcgacctccagaacttgctaccctctccccccagatttttggtctgctgcgccaatggggttcatgtctttttcgcgaggacagatcttggcaccttcacagttgagcttaattcaggccgagtcaagaaggtatccagcagcagcgaagtcattccctacatgaggttctacactccagatctagctccatcaaccatggcctcctcctcagagaacattgagacggcccaagacgagcaccatgatcaactgttaccgcactcaac

SEQ ID NO: 66503 - DNA, 734 bp, Triticum aestivum
  Clone ID: PAT_TA_66503
gaattcggcacgagctttctcagaccaagacgaccaaaacaaggtgccacattttcctccgcctttcttccgcatggtggcgcctcgtgaatctcctaagtacttcatatcagcctttggcaccaggatcttggccatgcatccgagagatcccgcgggtgacttgttggaaggttacttccccatgttggacgtccgctcgcggtgcgtcaccactggccctgggcagagagatcttttttatcccatctaccacctcccggtcggcaacaagctattcactatgagctcatactccttcgagatgctctgcttggagtccttcgagatgctctgcttggaggagctctcagccaaggtatcgcatcgagattccagcaaagagtggtcgtggaaagagctcgagcagcagccatttaatgtttgggacgtcacttcctactccttgcaccctgaagaacggaccttcctcatcagcaccaaggaggacaccaccgaggccacctatagctttgacacggagaggcattcatggaaactacttggcaattgggttctgccctttgacggccagggtcactttgaccagcacctcaaggcctttgtcgggctctccaaagaaccggacaccctcggccaaatttactgctgcgacgtgcccatctatggtacccctgaagggcggtgccctgtcccttcgatgaatctctgcaaggagaatctgttcatttctg

SEQ ID NO: 66504 - DNA, 205 bp, Triticum aestivum
  Clone ID: PAT_TA_66504
aaaaacaaaagacagtacattgactgaaacacaggagtgcagactttataaaaacatcctgtataaggcaacagggttgcaacggagtgaaaataaaataaaactgattatgaggacattaccccttcaacattctacatccaaaaggccacaggatcttgaacgagtaaccacttgggggttgttttggacactttgtaaaacg

SEQ ID NO: 66505 - DNA, 269 bp, Triticum aestivum
  Clone ID: PAT_TA_66505
aaaaccaaaaggaatatatccccaaccccggcgttttcccaggaaaacacctgggtacaaaccggtccaaataaaaaaaatcacggttttaccaaaccaacccagggggcggtttttatataaaaaatttaacaccccccaaattaggttttcaaaaaaaatgggtcttaaaccccccaacccaaaatttttaaaattcctgggccgaaaaccccggaaaaaaaggggttttttgccccccataaaaaacaagccccccggtataagtt

SEQ ID NO: 66506 - DNA, 698 bp, Triticum aestivum
  Clone ID: PAT_TA_66506
gtccgctgttgggttcatcgagagaataccgaaagcgctacggctatgaagatgacatgttgaagaagcaccatcggcgtcagcttcacccttctcctcggcatggagaagatgtcactcccaagtcgtgtggagagcgggctgtcacgcagctgcagcctcctctcgcgctgctcccaggatgaggctgccgcctcaataccctgcctagcccccgcttcgttacgagcagcgagcccggctttgacatagggtttggcgagcgagctcactgccaaccccctcagatctggtcgactcgtcgctgcccgccgtcagatccgtggtgcgtggcatgttgatgctagaaaatgatgtgggtacaagaaaatgatgtgagatatgccaggattaggcggagatgatgaaagactttgtaaaaaagtcagatatgttttgaggtttccatagagccggccaatgaaacaacgctggtttatagaacacatcgtttcttcacaatttgactactatggtcaccgaatccttggaacaggtttcagctaagggttgcagatgttttgtttggcttgcatgaattaaaccatgcttccagttttaaagtacacttgagccacagttgctaatagttccaagctgatgtttgatccccttgcatgaattgaacatgctactctgaaatcagagagcagacaact

SEQ ID NO: 66507 - DNA, 698 bp, Triticum aestivum
  Clone ID: PAT_TA_66507
gaattcggcacgaggttcatctcactgagctggcaggcagccccagccaccagcgaaatggccgcgtcggcgctgcaccagacgaccagcttcctcggcaccgccccgcggcgtgatgacctcgtccgcagcgtcggcgacttcggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacgggtgggacaccgccggattgtcggctgacccagagaccttcgccaagaaccgggagctggaggtgatccactcacggtgggcgatgctcggcgccctggggtgcgtgttcccggagatcctgtccaagaacggcatcaagttcggcgaggccgtgtggttcaaggccggtgcccagatcttctccgagggcggcctcgactacctgggcaaccccaacctggtgcacgcgcagagcatcctcgccatctgggcggttcaggtggtgctcatgggcttcatcgagggttaccgcgttggtggcggccccctcggcgagggcctcgacatcatctacccaggcggcgccttcgacccacttggcctcgccgacgaccccgacaccgcagctgagctcaaggtcaaggagctcaagaa

SEQ ID NO: 66508 - DNA, 572 bp, Triticum aestivum
  Clone ID: PAT_TA_66508
gaattcggcacgagcacacaccacgcctgcctcatctctcggagcaggaggaggagcttgcaggaacaatggcagcccagggtcttctctctgggaggcagctgctggggaggcctctgcagtcctccatctccaggtcgtcttcctcccggaagtcccccttcgtcgtcagggcatcgtccagcccccctgccaagcaaaatgacaacaggcagctgtggttcgcgtccaagcagtccctcacctacctcgacggcacgctgcccggtgactttggtttcgaccccttggggctgtccgacccagagggcaccggcgggttcatcgagcccaggtggctggcctacggcgagatcttcaacggccggacggcgatgatgggggtggtgggcatgatcgccccggaggccctgggcaaggtgggcctggtgcccccggagacggcgatcccgtggttccaggcaggcgcgatcccgccggcgggcacctaccagtactgggccgacccatacacgctcttcgtgttcgagatggcgctcatcggcttcgcggagcaccggcggctccaggac

SEQ ID NO: 66509 - DNA, 438 bp, Triticum aestivum
  Clone ID: PAT_TA_66509
aaaaaaaaaaaaaacccggccgggcaaggcttaaggttaattaaaaaggtcaaactgggggggggggggacaaaccgtggggcccagtttaataaaccccccactagttccggcagggccccaggaccaggatttttttaacgggaataattggcccaacggccctaggggtttccaacaaacccaaatcaaaaaagggggacccaaaaaattattaacccaaccgggtaacttgggttggcaaaaacaacccggcaaaaaaggctttcaagggattcgaaaagggggaggcttaaatttcaaaaggcccgccgaaaatccaaaccaggggggaaaatctaaaaagccccaaatggactttccgggttcaaattggggggcggaaaatttaagctggaacaacccagggaaaacgtggggcccaaaaatggggggccc

SEQ ID NO: 66510 - DNA, 318 bp, Triticum aestivum
  Clone ID: PAT_TA_66510
gaattcggcacgagctccattgacaattgggtccgcctccccccacctccaccacccccgcctccgccgcgccgcgccgcggggctcccctccggcgcgccctccccagatggccgcgccggcgatccacccattcgcccaatggcataaccggcccccctgggagccccgaccactccatgattgccttttgtccaaataccacagaagtacacatttataagtttttcacagacaagtgggagaaacttcatgttcttgcaaagcatgatcagatagtgtctggaatagactggagtagatcttccaacaaaatgg

SEQ ID NO: 66511 - DNA, 302 bp, Triticum aestivum
  Clone ID: PAT_TA_66511
gaattcggcacgagctccagcgcattttcaggttatcacactctcctaccctagcttgtcgattactacaggcaccaactatggcaaacgacatagacgcggcgcccatcgatggggagtacggggccaaggactactccgaccggccgccggcgccgatgttcaacacccaggagctgactaaatggtccctgtaccccgcggacgtctccgagttcgtggccacgctgctcttggtatacatcaccgcggccatcgtcatccgttacaatcaccaaacagaccccaccggccccattgct

SEQ ID NO: 66512 - DNA, 168 bp, Triticum aestivum
  Clone ID: PAT_TA_66512
aaaattgggggcaattgaagggaaatttagaacacacccaaatgcgtgtaataaaatacagacgcgtgcactgtacgtgatctgaacagtattacactgatatatgtactgtccgcgcttgcgatcatccatactgaggtttgttgatatacctcctgccgaaggagg

SEQ ID NO: 66513 - DNA, 633 bp, Triticum aestivum
  Clone ID: PAT_TA_66513
gaattcggcacgagctcctccttgcccgccgccgtcgcgggccacgtcgtcgtacggatgctgctgccaccgcccgctcctcgcgtccacctccgcgccggcgaggagcagaggcgctcgcctcacgctcacgctccgctccccatccctcccgcctcccgccggccctctcatcaggtcggggagccggagggtcgcatgccgagcggacgacgagcctgagccagccgccagcaatggccacgaggctgtggctgatgccccatcgcctccacccgacagtgttgtccaagaagatgcagctgcagagaccgattctggtgcagacaatacgatagatgaatccccgaatgcagagccgctaaactccgctctcacatcgcttcagaacatcgaccggtatgctaaagcagccgctgacagcgctgcgcagacgaaagatgaatccccgaatgcacagccggtaagcgccgctgtcacatcacttcagaacatcgaccggtatgtcaatgcagccgctgacagcactgcgcagacgaaagatgaatccccgaatgcagagccggtaagcgctagcgacacggttcagaacatcgacggagatgcgactgcagccgctgacagcgctgcgca

SEQ ID NO: 66514 - DNA, 365 bp, Triticum aestivum
  Clone ID: PAT_TA_66514
cggaaaaaaaagcttcaggggacaaaattatccccctttaccacaaaggggggggggaaaataacctttccctccagaggggttacccaaaaccagggggggcctaccccggcttggcccccaaagcagggcccggcaggaggttgggtttttttctgggaaccccctggttttggggcgggggattggccaaaacccggggggggatgaggggcgggaaattcaaggggtcccccgggggggccgccaccccgttgccgagcttaaccgggtccccgagggccttgagccccatttccaccccgccggggcaccccaaaagttgcacctcgttgggggggccaagggggccaaccctaaaaacc

SEQ ID NO: 66515 - DNA, 686 bp, Triticum aestivum
  Clone ID: PAT_TA_66515
gaattcggcacgagcgcccctcgcctctttgtcgcccgcagggggcgcctggttcagggccgccctcgcctgctgcagctacgtcctgctggcgctcctcgccctcgcgctcctcctccttctctccgttgggtacctcggccagaaaaggagggcaccattcaccatggaggactgccgcgtccagtctccctcactccctcacttcctccctcccgcctcaataccttagcacccatgaccatggtgactccactggaggtgcagcaagcaggtgctgctgtgtgaaggacaggagaagagggtagaggagaggactgctactgtctcacctgcttctccgtcttcttcttctactatgtcctatgttggtcagaccaggaggcgttgccatcgattatagggtgtcggaccaacgtcctcgtgttcgtgcatcttcgggaagaaatgacccgaggtgagtcgcctctggtccgccgcacgaagagagcggggggctagatcgcaagggcagagttgcagtcctccagggccgcgggaagaagaagatgggactcatatacaagcctccctctcgtggtgaacactcttccctggaattgatggaagatctgccttgcagccttagaggatccatgcatcgtgtgatgtatggcctacaagctaccaatgcaactgatgtagtc

SEQ ID NO: 66516 - DNA, 295 bp, Triticum aestivum
  Clone ID: PAT_TA_66516
agaagtgcaaagctaagcaagctgcttgattgattttactgggatggcagcgtagatgttcgtacaagaatgacctgaaccttggttctggctggctacagatttagtcaatcaaatcgaccctccctcatgcatgtgagctggtgatagcccaaggtgtgctcgaagcatgtcaagatccgccctgtgtgggatcctaaacacatgctgggtatcctgcaaggaccaagagcataaaacataaggctgcaaggaattgcatgaagcaactgtaatacagtatgagacagcgagc

SEQ ID NO: 66517 - DNA, 318 bp, Triticum aestivum
  Clone ID: PAT_TA_66517
ccgggggaaccgatggaaagtcccatatcctaggagcccaaaccctacaaattacctaacaaaacccaaacaggggggggggactaacttagttaaccccccccctcccccctccaaataatcaaacaccggggggcccaggaaaatctcccaagccgaaagggccaaacaaaaacccaaaatagtttggaggggcccccccccccctccccccggggaaaccttacccggggaaaaaaaaaaccgcaagggaacccgaaaacacccccccaaataattccacagccgatctggccttttttttcctccggccctccg

SEQ ID NO: 66518 - DNA, 683 bp, Triticum aestivum
  Clone ID: PAT_TA_66518
gaattcggcacgaggaaatgctatgatggagtatgccaatgtaactgttccaaaaccaaaagtagctcctgaatccaatgatgaaccaaatggcaggcttaacggctttgctgaagttgatgattttagtgatcaaacgggaagtggccatgacttcagaccttctagcttctcaagtgctaaacattatgaggaccagattgttgatcgtggctttcctgtttcaaagcgtggcgaggtcaataatactgtgaaagcaagagacgtcaaccttaattcatgcctggacacaatatctttcccgattgctagtgcaaacaatcaaacttctactgctgttgatgaggctaatcaatcatccattgctggaaaatgcttcattggcagttttaataataatgatggtgcatctactacatcatcctgttctggctcaaataataaagtatctggttcccttggtggatctaacggatcctctaatgctgccagatgcatcggtggtagttatggtaatgatgctgcagctaacatttttggaaacaagaacaataccatggtgtaccagcctagtttgaacacatgccccatctctcatgttgcaactaatgtggattctcttgtttcccgttcaacacatgcaaagaacagtgacaaagagcgtgcatactataccaaggaac

SEQ ID NO: 66519 - DNA, 621 bp, Triticum aestivum
  Clone ID: PAT_TA_66519
aatataagtttgcacaagcaaacatccacataataacagagaaaaagaaattatatacacatgactgaaacacacacacacaaacacgacttcaccaacatccactcggaaccgcatgccgcgacccacacggtgtgaatcacatcgcacccaatagaaactgcaagaaccaccaggctcgtctcgtctcgtccacttctcggcctgcacaatgctttgcccccaccggagtgcactgcggacttcaaactgcacttgggagctgctcacaccgctgaatgtgggctgcaaaaactgaacttcatttgaacatctgcccaaaatcaaaaaactgaacaggaagatgtcgttttggcatctcctgcactacaccccttttttgagacgaactggggaagatgaagatgccagcgctgcaatccatgccagcgcactgcatgccacggcttgccgaactgaacggcgtcgcgcgaggaaacttggctcattttttagtccacggcgagctataaaacaaaatgaagtgagcttcaaaagatgcctcgacggactgcaccgcccagttttttatggcttcagcaacgttcctgttctccacatggggtggagctccctttgtcg

SEQ ID NO: 66520 - DNA, 643 bp, Triticum aestivum
  Clone ID: PAT_TA_66520
gaattcggcacgagcgccgtcgccgacgatgcctccccgtccccaaagccggcgcctttccgccccggcgcgcggcagccccgctctccgccagcaacctccccgcctccgagcagaccccaccacccacctccaccccaacctctacctcccccgcgcgcccctccccggccttcgcggcggggggctaccgcgcggccgggccgggcgaggacccgctggtgtccaagctgcggacccagctgggcgtcatccacccgctgccggccccaccccctctcccctccctcccgcggtccgtgctgggcctcttcgcgctcttcttcttcgtgggcgcggccttcgacaagctgctcacgctgcgccggcgccgccgcgccgaacgcgaggtgagggtgaacgggtcgtggccgcaggtgcccacctccggcttctcgctcttcctggaggagaaggacctgcagcgcaaggagtcggtggagtgggtcaacatggtgctgggcaagctctggaaggtgtaccgccccggcatcgagggctggatcgtcggcctgctccagcccgtcatcgacaacctccagaagcccgactatgtcaaccgcgtcgagatcaggcagttccacctcggcgaggagccgctctc

SEQ ID NO: 66521 - DNA, 247 bp, Triticum aestivum
  Clone ID: PAT_TA_66521
aacaaggaccaccatcctttatggcatccattcaaaccctaaggaaagaacaaaagggaaccattattgcttttcccaaagggataaaccaaaccataatccctttacagggaaaaatctaatctctcgaccaatctctcttaagcaataggccccaaaaattgaaataacccaccggttgaaatcccctaacccacccccgtgatcggaaatacaaacatgccccctaaacccaaatttccaacgc

SEQ ID NO: 66522 - DNA, 192 bp, Triticum aestivum
  Clone ID: PAT_TA_66522
ggggatattttttttttttaagaaggcaaaaaatttccctggacaacccggtatacctaagcaaagaaattatatcatatactaccaccaaaaggtgaagaaccctaacatggaacatttgggaacaaccaaaaacgaattcttctgctgactgacaaacacaaacattatgcctgcctactgttgcgcgca

SEQ ID NO: 66523 - DNA, 685 bp, Triticum aestivum
  Clone ID: PAT_TA_66523
agaaacatcatgttttattgtcaatgaagctaaggaaaaagagaacatacaatttgttgagatttttcttatgacaattcgatgccatgtcacaagttttgatctgcagagttgtcgcgagataatttggttaagaaaaggatcacaaataaaatattttggtgccatcaaaattttccaatgaataaaaaataagtagaatgctatagaacagattgctaaattaacaaatgtagagcaaaaacgtaaagcccgacaaggtaaaaaagcgagaacacatcctacaatcttacctacagatatcggcacactatcaagtgttgcctctttgctagaagtgcagttagacattttagaatggctggcttctttcagctcttagaaacaatagaaactggcaatatgcacaacacctaatattatcatgtcgacaataactattccgactgatgagaagcatatttcctggtatcccattatggccaagtacgaactgaagataatatctacattgaaatacagccgtcattaaaacactaaatcctcaattgcacatgtttttcgactcttactaaagtaaatatttcagcatacaagttcaatggtattcacacacgtcaatttgtcatggcccggaaatcattctagtattatcacgaatttaaaataaaacatagctagatac

SEQ ID NO: 66524 - DNA, 624 bp, Triticum aestivum
  Clone ID: PAT_TA_66524
gaattcggcacgaggttcatctcactgagctcgcaggcagccccagccaccagcgaaatggccgcgtcggcgctgcaccagacgaccagcttcctcggcaccgccccgcggcgtgatgacctcgtccgcagcgtcggcgacttcggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacgggtgggacaccgccggattgtcggctgacccagagaccttcgccaagaaccgggagctggaggtgatccactcacggtgggcgatgctcggcgccctggggtgcgtgttcccggagatcctgtccaagaacggcatcaagttcggcgaggccgtgtggttcaaggccggtgcccagatcttctccgagggcggcctcgactacctgggcaaccccaacctggtgcacgcgcagagcatcctcgccatctgggcggttcaggtggtgctcatgggcttcatcgagggttaccgcgttggtggcggccccctcggcgagggcctcgacatcatctacccaggc

SEQ ID NO: 66525 - DNA, 697 bp, Triticum aestivum
  Clone ID: PAT_TA_66525
gaattcggcacgagcaccagttcatctcactgagctcgcaggcagccccagccaccagcgaaatggccgcgtcggcgctgcaccagacgaccagcttcctcggcaccgccccgcggcgtgatgacctcgtccgcagcgtcggcgacttcggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacgggtgggacaccgccggattgtcggctgacccagagaccttcgccaagaaccgggagctggaggtgatccactcacggtgggcgatgctcggcgccctggggtgcgtgttcccggagatcctgtccaagaacggcatcaagttcggcgaggccgtgtggttcaaggccggtgcccagatcttctccgagggcggcctcgactacctgggcaaccccaacctggtgcacgcgcagagcatcctcgccatctgggcggttcaggtggtgctcatgggcttcatcgagggttaccgcgttggtggcggccccctcggcgagggcctcgacatcatctacccaggcggcgccttcgacccacttggcctcgccgacgaccccgacaccgcagctgagctcaaggtcaaggagct

SEQ ID NO: 66526 - DNA, 573 bp, Triticum aestivum
  Clone ID: PAT_TA_66526
ggaagggcattcttcttttcaaaaaaacatatgcacgcgcgtaccacccatacaccacaaacaaaaggactcatcaaaacataagagtatttaacacatgaatatggccaagaggccattttttaacaaggataactcccgacatctacatcgattaatgcacacagccggctaattaattaagcaaggcagttcttcttggctcttgcttccatgagatcatcgacgagacgacgcagatcacggtgggaggagcccccttccgcaacggcggcacgacacttggcggcgaggtccatcaccctgctcctcgccgcgtcccctgcccctccagggagcatgaacgccgtcacggcacgtgccacgtctccggcggggaccacctcgtgctcctcatgcctggtgctccgcaggccggcgccgcacggccacaagcgctccccaatgcccagcacctccgtcaccaacctctcggtgatgaactgctcgaacaccatgggccacgtcagcactggcacccccgccatcaccgtctccaggacggagttccacccacagtgcgtcacgaacgcg

SEQ ID NO: 66527 - DNA, 679 bp, Triticum aestivum
  Clone ID: PAT_TA_66527
gaattcggcacgagcacagagctgagggcgattcgtcaagacaaatatggatggatattgcatggagaaagtgagtggcagagccaaattcaacagcttgtacatgaaagaggtattttccccatttgtcaagtatccacagaacctgcatggcagttatgtgctgttgaaggaccatatagaatgcggaagaaacttgagaactccaaatttaagatagatactattcagaatgttctaaccagcagccttgggtttgatgatgttactagagccaaggaggaggatggagacatgatgacatctgggtcagatacaatgtcgggcttgaatcttttgacctatgatactgagcagagggaacttgatgctgctgattttgcatctttcaaagaggatgatgacatattcaaaggaggaagcacagcgtcacctccaattggctggactgatgataaaagcagcatcaatgaacagagtcttcactctgcaaatgatttcggagcaaaatcaagttccttttcttatcacatgtcagagagtgtccaaggtagatctgagttatattcaccaagacaaccaccttcagttaaaggtactgatacgagaacctcagaggataaatcagataaggagttgcttgacaacggagaatatcttatcaggccttatatggaac

SEQ ID NO: 66528 - DNA, 256 bp, Triticum aestivum
  Clone ID: PAT_TA_66528
cccgggaaaccctaccaattaatatacctacccaaatggcgggaaaaatcaacaactagcctctgggatcaacaaacacagaacgagtcaagagaaaaagaaaaggaggcggcaaacatgaccggaagcccgtccggcgcggaatctggcaaaacaatccaatttggcaaataaccccctgcatctggaaaaaattccacgcgggccccttggtccatctaatctaatccaaccaggggcaaaaaagggggaaggg

SEQ ID NO: 66529 - DNA, 646 bp, Triticum aestivum
  Clone ID: PAT_TA_66529
gtagaaaaagtaaagattcagattctatatagacttgtgaatcttctggagacaacaataaaactgaaaactgacagacaggtcagccatcctatacagactacgtactgaatctcttggaggaaacaccgaaactgaaagccgacggccagcaatccagcatgcatgccctgatctggcagatgcagagaaccatggacttttcagctacctaccacgtatagtattatttctagcaaaacgacgatgcgtcgggtcgtggaccgttgcagagcgaggaggacgctgttgttttcgctgctggttttctcggtcgccccggttttccgtcaccaagtcagccctctctggcctcatcccagcgtttttgcacgtagataaggaccgaacgttcggtctgggacaacgaggagttcggtgcgacaggcgcctggtacgaatgaaatcgttcgggaggagaggcctcccagcccgaacgctctccttcccatcgtccctacgggccttttttctggatgctcctcctgaccagggtcttcttgagctcatccagcatgcccctcctgacgatgctgctgatggctgcaccctgtcgaggatgatgtactgcacgtcggtcttgcccttggcactggcccgttcgtcg

SEQ ID NO: 66530 - DNA, 618 bp, Triticum aestivum
  Clone ID: PAT_TA_66530
gaattcggcacgagctcttcttctccttccttgctcgaattttcggaggaagaaatcccaatccaaagagcttacctaccgccaccgttctcctccctctcctcgcagaattttaagaggaagaaacccacaatccaaacggcctatcgccaagaaagtgagaggaaacgcagatacatattgcttccacctgcgtgagaggatgatcccgttcatacagcagaggagttccaagttgatctagccgtgctagccctcgagcggaagtccatcgatggcgatgatggaagcgcatggcggcacgccgaggaccgacgccggcgggagcagggtggagtccgagcagaggaagctacggcgcgtcgagctcccctcatggtcctgccctcccaaccggcctccgggcacctgagctgagcctgctctgtgttcttgtcttctgcttactcctctctctcgatttgcctctttgatttgtgttcctacgactcgtagtctgagggagcaagctacgatccttgtgcccttctccttcttgtgtctgatcctgtcctcctgcggcgcaacgacacggctttgctccccaagggtctcgccatttctgaggcgattgacctt

SEQ ID NO: 66531 - DNA, 591 bp, Triticum aestivum
  Clone ID: PAT_TA_66531
gaattcggcacgagccgcctcgcgactgtcctgcgcgcttccagaacccaatccctagccaacctaacgctagatcccagtcccccagcctactcacgggacatgggcgtggacaatccgccgccgatcaccggctccggcagcgacgacggcgcgttcgccttcatctccaagggctggcgcgaggtgcgggactcggcgaccgccgacctgcagctgatgcggacgcggaccgacagggagctggggcgcctcctcgcgtcggcgtcggctctcgcggggcccggaccggcgccgccggtggccgcgggggcgcccttcgcggagctggagttcgtgcggaagcggatccaacccaagattgcggagctgaggaagcagtactcgtcgacagtgctcgacgggtggccgccaaagtccggcgccagcctccgcgtcgacctctctgggattacggctatccgcaacgccattgtgtccagcgggaaggctgatggcggtgacgaggggaacaaggagtgggaggtggtgaagatgatacggaacgggctcaaggagttcgagcgccggagcctgtcaagtgagatgtct

SEQ ID NO: 66532 - DNA, 478 bp, Triticum aestivum
  Clone ID: PAT_TA_66532
ggaggaactggcctatttaaagaataaaagggagataattccgggcaaagggtccaaacaagacaagccatacaaaacctaaggaaattttacaaaggtaggggctctactaatctatggcctagccattagttactacgggaaagggacaacacttagtatgcccatccctagggagaaaagcccttcaactatccattagtttagtaaaaccagattcacatcacaggccatatccggggggttgaatttgggggggcaagaaattcaaatccaggcccgggggcttatcatagccccgggtcccaggagtggctcctgtggccattctgaggatctaattgccggttgcccagtaatgagcaaatgccagccccccatccaaaatgtctgaaaattgggggagtaaacgaagcttcctcactccttttctttttacaccttttccacactgaccatttttatttttaaaaacttt

SEQ ID NO: 66533 - DNA, 409 bp, Triticum aestivum
  Clone ID: PAT_TA_66533
acctctactattcaattttcttttcgaggcgatcaatcatgtcgtcacaatggattgttacccttttgacccaaggagcctttcttgttacaattattgttcccaaaaaaacaacaaacatatattactcgtatgtcacaaaaaagaagaagaaatgatactaccaggaattaaagaggagagggggcgcctaattaatcaaagggcgggtctggattacttgcggcgggtcttctcctcggacgtgccccggttgccctgcccggcggcccaaaaggcgtcggcgggcccgccgggccggatcacgtagggccccagcgagggcgtgccgttgccggcgacccggttctcgcggaacaggaactccttgctcagcacctgctccacctggaagttgaagccgggcacc

SEQ ID NO: 66534 - DNA, 673 bp, Triticum aestivum
  Clone ID: PAT_TA_66534
cttcagaaaagactatattgaagtaactttttagaatcgtctcaagacataagaatatctcagaccaactaaattatcgtaaaaaccgcagtcttgcgactttacgacagaagttgtgcgttctaagattgtcttaggacatacgaaaatgtcagttgacttagatacacacaaccctgttttatccaagatattgccaagtaaatgtgcttggagagaccgtgtcaacgtcctcggactgcaggcacttgtggcccaagagagcagcgcagcatttcctaccaaaaccgcttgatgaagtctcaagtgtggcttcgctgtcacagccagacctgttcaaaggtcaaccttcatgggattacacgcaacaataaccatgacaaatccatcacccataatacccggacagggagctcagctcgcacatatttgtcaacgagagcaacatcagcagctaaagaccaattctgccggcggataaaactatgcgccgccccgggagaaggattactcaacaagaaacataagaggattactcaacaagaaacataagacgaacagagacagctcggatcgccgacaggagaagattcaggggtaagaatgtacaaatgaagacacagttcagaaccagttcttttatacttgctgtcaccctatatctagtatgcga

SEQ ID NO: 66535 - DNA, 440 bp, Triticum aestivum
  Clone ID: PAT_TA_66535
aaaaccaaaaaaaaggccattatttgggggaaaaagaaaaccccgcctctccaaaccctaaaagggctaaaaaaaaacccaaaaaaacaaacccccccccaaaaaaacaggtggaaaaaaaaaaaagggaaaccgggatagtggaaaaaagtcccggggggggccggtgccccaactaaggctaaggccacccgttagtggggcggaacacactaaacccggggggccgaaggcttgaacggcccctaaagggggaggctaaggaaccaaaacgggaactgggggagttgggaaaaccgggccccaactttgccaaaggggggggccggaaccttttcgtaggggggctggggaaaaacaaacacctttttttggaactggccaggggccttttggttccaaaactaaggcggagaaaaaaccgggtgggggaaggacca

SEQ ID NO: 66536 - DNA, 567 bp, Triticum aestivum
  Clone ID: PAT_TA_66536
agcaggtcaggcaccaactattcagagagaacatctgttctcttcatgtatatacattttggtatcgacactgaaagtaatctgccaaattttgtggtttatctctgtaacgcgagaagtcatgcgatctaatgctcagccagatcactttggtaaaaaaaaagtgaaaagaaaaagaaaaagaaaccgtgtttcagttctgaatctattcaacgtttctatttgtaatttgctgagaccatttccacaagcttgtcatgaagagcaccgtttgtcgccagaacaccacccgaaggatagatgattctacgcccggttaggtcagctccaaaatccaatggtttcccgctccaatcacatgtctgacctccagcttcctcaacacaaattaccccaacagcatgatcccaagccttgagtagtttttccgcccgtgctaggaggataaaaactgacattctcccacaagctaccaagagatacttggacaagcttccaccacaagaattttggagaagaattttgttctcatctctcggctcagattcatccattgtcgagctgaag

SEQ ID NO: 66537 - DNA, 388 bp, Triticum aestivum
  Clone ID: PAT_TA_66537
gaattcggcacgaggtggatgagggtcgcggcgggcgagtggtggagccagaatgttgtcgacgtcgagaaggacgccgtcatggccggccagctgcccagccactccgacgccttcaccatcaacggcctcacaggccagctctaccagtgcgcaaatgagacgttcacggcggtggtgcagccgaacacgacggtgctgctccgggtgatcaacgcggcgctcaacacgcacctcttcttcaaggtggctggccacaacttcacggtggtggccgtggacgcgtgctacaccgtcaactacaccacggacacgctggtgctggcgccggggaacaccgtggacgcgctcgtctacacggtcgccgcgccggggagctactacatgg

SEQ ID NO: 66538 - DNA, 496 bp, Triticum aestivum
  Clone ID: PAT_TA_66538
gggttttttcactagggtaaaagaataaagtcatggtgcattatcaaacaatcatttcctcagcttacacaagagatgtaaatccaaagaaaaatctaagcaaggggggcggtcggccggcttctagtaaccttctaccactgctgactttaagcattgctttctccatcccgtcctccccctttcctcgctgcctagtgggcaagtggttgccacaagaattaataaaacccaaaggataatttttcactaattaacctgtcatcactacggggccccaccacaccgggctgtgcctaaccccccaaaattggagaagcaaaaaaagaaaaagaaaaggagaaatttcggccgctggtgccgtctttgacggaggcggcggcctagagatccggcaggttgctcatgagctccgcgaaggttcttggcgacggcacggtgggcgtggcaaggaggttgcgggggctcgggacgaaggggtcggagtagtaggatt

SEQ ID NO: 66539 - DNA, 135 bp, Triticum aestivum
  Clone ID: PAT_TA_66539
gaattcggcacgagtccccctcctcgagaaagagcacggccatcccccgcccgcctccagtcgagaagcccaccaccattggcggtagacggtagacagtatacatggaggtggagactgcgatgcctcctccgg

SEQ ID NO: 66540 - DNA, 287 bp, Triticum aestivum
  Clone ID: PAT_TA_66540
gaattcggcacgaggatccatccacccgccggggcccccgcccctttctcccccagaccaggcaatctcctctcctcagcaacggagagagaggcgccgccgcccagcgagaacagcatcgcggctggcttgctcgccggcgcgcgcatgcgtgcttcgatgcacggtgcttcgtcgagctggccggaccgcgcgcacgagagtagagcatggaatccatggggtcgtcatcgggagaagaggaggaggagtgcgtcctgccgagccgccacacgaagctggcgaac

SEQ ID NO: 66541 - DNA, 649 bp, Triticum aestivum
  Clone ID: PAT_TA_66541
caaaaatgctcagattttattcataagtggttcccacttgtcaagtttccatttcacatcttttcaacatgcataattattcaaacatacaatagtctttttcaatctgttacaatattacaatttacagtctactacagaaccaaaaatctctttgataagtagggattcactcctttgcacttggcttcacggcttcacacttcaaaaaaattaggcctagagctcatgtgcacttgcgaggccacatattctgggtcgtccaccacactagccaccatcacgtacccatcgccatcagcaacgttgctcctgccgcggtcgcaatggaagcagaggagcagacccctcccgcccctgccccacgagcaggacatggcttttggctgggcacgcccctactcctccgcctcctcgagcaagagacccccttcccctactgctgcttcgcgcgccgcatcactagtcacctcctcatgcaagaagtacacaatgaatagacagacggttagtgaggtacattttcacagcaacagaagcttaaaattaatagaaatacacacatcaaatgaagtcactaagatacttaagtccaccacgtgcccatcaagtcgtagccatatgctctgtagatgagatgttgacactg

SEQ ID NO: 66542 - DNA, 595 bp, Triticum aestivum
  Clone ID: PAT_TA_66542
gaattcggcacgaggctaactggtgctacgcggccgtcgcgccccgtgcccgctcctccaccatcgtcgccagcctcggcacccccgcgccctccaactcctcctccttccgccccaagctcatcaggaacacccccgtccaggccgcgcccgtcgcacccgcattgatggacgccgccgtggagcgcctcaagaccgggttcgagaagttcaagaccgaggtctacgacaagaagcccgatttcttcgagcccctcaaggccggccaggcgcccaagtacatggtgttcgcgtgcgccgactcccgtgtgtgcccctcggtcaccctgggcctggagcccggcgaggccttcaccatccgcaacatcgccaacatggtcccgtcctactgcaagaacaagtacgctggtgttggatcggccatcgaatacgccgtctgtgctctcaaggttgaggtcatcgtggtgattggccacagccgctgcggtggaatcaaggctctcctctcactcaaggatggcgcagacgactccttccacttcgtcgaggactgggtcaggatcggcttcccggccaagaagaaggtgcagactga

SEQ ID NO: 66543 - DNA, 650 bp, Triticum aestivum
  Clone ID: PAT_TA_66543
tgccggatctgatggcttctcgcagccgggccttaaagtttctacatgaaatagggtggcttctccaaaggagccacacacgagctacatcatccaaggctccgcaacaacatcatgcggtgggcttttctgctgcaagatttaggtggctcctgtcctttgcggttgatcaggaatggtgcggcgtggtaaagatgctgctggacaccttgttccagggcaatatcgatgtcgcctcaccagttgattttgtcctgggagagagcttagtattcgcagctgtcaacaagcggtcgaagcctttggttgcctgcctattgagatacacaacgaaatctgcaccggtgggcagtggagccgtggccacaccagctcggttcttgttcacgcctgacatgactggttcatcggatattacacctctccatgttgcagctaccatcactaatgctgctgccgttttggatgctctaactgatgatccccaacagctggggatcaaaacctggaagaatgcccgcgacgctaccgggtacactccagaggattacgctcggaggagaggacacacgtcctacatcaagatggtcgagaacaaaatcaacagcaggttacctgcagcccatgtgtccgttgccatgaccaccact

SEQ ID NO: 66544 - DNA, 418 bp, Triticum aestivum
  Clone ID: PAT_TA_66544
cgaccgaccatggcgcgcgccgccgtcgcaccgcgccgctctcccgcctccactcccccacgccctccattccgtgccactctgtgtcctcgcagctccgcattcaccagcagcgcaagcccctcaccgtcgcctcggcgctgccggaggtcgcggacctgccggggctctccctgcccgccgcggcggccgcggtcgcggccctggctgccgcggtgtccctctccgacccggagcgccggcgcatggcgcaggctgaggcgctgggcggcggggacaaggaggcggtgcgcgcctacttcaactccacgggcttcgagcggtggcgcaggatctaccacccggccacggacgacgtgaaccgcgtgcagctggacatccgcgagggccacgcgcacacggtggccggcacgctggc

SEQ ID NO: 66545 - DNA, 556 bp, Triticum aestivum
  Clone ID: PAT_TA_66545
gagagaacaccaatatttttatgaaactatgatcatagaagatcaatatatatatttggcagcctcttcttccctatgattcaaaatcctatactggaagaagaggggtacacatcaagccgaatttgccgttgaaaagaattacatacttctagcccatgatcttatatgacaaacatctcatttggagtttgaagaaagaacatgcatgcatggcaaccaggacaccactctttcctggccattctgcttaaccattcgtcgtcaagtcattgttcatgtctgctgaactcttgtgagtgcacagatcgacgggtgttaaatccttggcaattgtcatcgcctccagggtcgtcgatcacttccttctgtcagcgctgatcgacaggcgctcgaagctccggaatgccgagtggctgtcccgtcggcttgatctccctggtgcgttccgggcgacgggtatgggtgaagacgagccgttctccgcaccgctgcctccggattgggggagcctttgaacggtcgacgacgacgggcggctgctgctgccgccact

SEQ ID NO: 66546 - DNA, 272 bp, Triticum aestivum
  Clone ID: PAT_TA_66546
gtttttttttaaaactaacataaaatgttataaatcattgatcgctctacattcaatccaatcaaaaaactattccaattcatacaccatacttttcacttattcattgcatctacacctgtatctactttctacactaacagtacattccatacaatttgctcactgccacaacagttctaatcaaagtccatacttgaccctagaacaacctatcaacagatgcatcaaacttctacaagctacctttaaagttcaccttgcacccacca

SEQ ID NO: 66547 - DNA, 123 bp, Triticum aestivum
  Clone ID: PAT_TA_66547
atctctgtgcagctgagcatacatgctatctgatatccaatttttatcatgaatcaagctcaaacatatactaaatgcgttccattcacactttcatatataccacttatctatcatcaatag

SEQ ID NO: 66548 - DNA, 323 bp, Triticum aestivum
  Clone ID: PAT_TA_66548
ggcgggccagcgtcattccagacattgccataacaaatttgttggtggtgcataccaggctttgatttacatgacaaatttacactcgtcatggattcttgttcagactgctgaaaacactctagatctacaagctgaacgaaaccgccaagatcattgttggtacaatgttttctaatcgcatggcagataacaaggagcatgggttaacaagatgaaattattgtccttagccatctatctgcgctgccaatgacccaaaaacaaggcgtgctgattagactttctagcaactctcatgtcatcactatcaggagtagagg

SEQ ID NO: 66549 - DNA, 558 bp, Triticum aestivum
  Clone ID: PAT_TA_66549
gaattcggcacgaggttaatcaaaagtaagggaggtgctcgctgaaagttgggaactgcatcttttagacaacttattcttccagccctccagaaaaatcatgaaaaggaatgtggattttccttgataagtagatctactaaaacttccacccttttgaatttcctacttttttgttgaagggaatgttgaacttctctactagaaaggcatactagttttttttcctgaacaatgaatccaagagttattgaacacgacggattaatctttcattaccttagcatcccatcatgttactgtgttacattcttgtaaattttacttgtagatcactctggtatgtgattctatactgtatcagtatgtcactttgttgctatattagtaagcggtatgccactaatctgaaattatcgtgataacctgctttaatttggcaaaatttatagatagcaaaccaaatcgaatataccacctactccactgttcatattatccaaggcaatctcctctcttttttttgacaatcaacaagagcaatctcctcttaataca

SEQ ID NO: 66550 - DNA, 474 bp, Triticum aestivum
  Clone ID: PAT_TA_66550
ctcgtccgcttccttgctccacccttccacgcgcgctccagcctcctcgccgcgcttgccacgacgagtgcccgccccggcgctgctcggcctccgctccagcccccgccgtcctcacggcctctcgctgaccgtcgccgccgccgcgtcgccggacgtcgagaaggcgccctcctcgtcgccccctccgccgccggaagaatcctccgacctatcggccgtggcggagagcgtgaaggtgctcaaggacgccgccaagacgaggaaggtgccggccgcggaggtgctggcggcgctggccacgatcaagaaggccaagctcgacaccttctccttcttggagaccctcggcgggaccgagtcgccgagcaggacgtggatgctcatcttcaccgcccagggtagtaagctcgagaaaggcagctacttcccggagaccgtcgtccagcgcttcgacgccgagggacagaggat

SEQ ID NO: 66551 - DNA, 257 bp, Triticum aestivum
  Clone ID: PAT_TA_66551
gaattcggcacgagcccgagcaagaggagggagaagatggcctcgtccgcatccttgctccacgcttccacgctcgctccagcctactcgcggcccctgccgcgtcgcgggcttgccccgccgcagctcggcctccgctccagcccccgccgtccccgcggcgtctcgctgaccgtcgccgccgccgcgtcgccggacgtcgagaaggcgccctcctagtcaccccctgcgccttcggacgagccctccgacctatc

SEQ ID NO: 66552 - DNA, 517 bp, Triticum aestivum
  Clone ID: PAT_TA_66552
gaattcggcacgagccgccgccccccgcctgaccgtatctgcctctcagccacctccaccacccccacgcttctccccatcgccggatccgctattagatcgccaaggttaggcggcagagctccacgtccgcgacttgctcgtgctcgtcaaggaaggggctgccgatcgaatctgcgctcacgcggcttgtgtgccatggccgccatggcatccatggccgacaagaggggaccctcggcctcggccatggccgcctgctttggacacgggctggtactgcatctcttcggcggaaggcgaaaagaatggcggcggcgggcaatatgggagaagacggtgccctgcctgacaacggactcgaatttctactggatccggttgacagtgaggtggttgcggacgttgaggtgccagatccgttggcggcaagggacttagtggagacagacatggctggcgccgattcctcatgcgcggttgtggttgggcacctcggcggagctgctgagccccg

SEQ ID NO: 66553 - DNA, 218 bp, Triticum aestivum
  Clone ID: PAT_TA_66553
acaaaattaggtggctctataatctcttcaaatcaagaaccaatttaactatgatagaaacatatttgcctctccttcagttcaaggcccacactttccctctaaggatgaattggactgaaacaatgaatataaattcggttccgacatgattggcgcgacaatgaacataaattttccagcacgaacagaacctaaaaaagtctttacgccttaaa

SEQ ID NO: 66554 - DNA, 661 bp, Triticum aestivum
  Clone ID: PAT_TA_66554
gaatcggcacgaggaagaattctgttggggagaaaagcaagtgcaaagaggatgggggctctacaacaatcagttgcaaggtgtgtatggctgtatgcctagttgcttaatgcctaccaaattctacttaattctgttgcttacagtctctgaggcatcgcctcgccttatgcctcagcgcttaggcagtgaggcgcccccccagcgcctcgcctcgccttaccgccttaaaaacataggtacatacaaactctagctttgaaatgaatcatgaatcgaattttctctagattttgccatgaatcagaagtatatattgttgaacactgttttgccatggcaaaaaggattttatagcttttggcatgcctctaatatagctttttccatgtcaccactataactcttggcatgacatacacatattttttttaccatggcaaatttgctaatctgtttgccatgcctctaatatagttttcgccatgtcaccactacaactttggccatgttcacatggagtagtaaaaataaaaacaaatttgagttgattgtagaaatatgtgtttgtttccctttttttgactttgtaggattgatgatgaccacattaagcattgcaacttttaacagatttgattttgcttttgtacttactact

SEQ ID NO: 66555 - DNA, 323 bp, Triticum aestivum
  Clone ID: PAT_TA_66555
agaaaactatgtttaacagagacaaaatttaattacagctcaccatcaaatgatacagatagcaacagactgtttgcttgtcctcacccatgttgcggaatgctttgtttatgtgctcaacaacaaataagctcacattactcttcaacagaacatcaggttctaggacagcaccgtagcaatgtgggctcagagaaagacttgtggtaggagctaaaaaggtgttgaaaccaattgcaagccagccagtgaggaacttgttatcagttgttcccttcatagctctcatcgtcttgctgaattcggtgatcgtggggtgtttg

SEQ ID NO: 66556 - DNA, 333 bp, Triticum aestivum
  Clone ID: PAT_TA_66556
gaattcggcacgagacgagtgggatcgatcctaccgcgtgccaagccaccgaccaacatggcagagtatctccaagccgtggttacgctgatgccggccaagatcggcggacgggcctcctccgcgcggccgtggtgacacgtggcccggtcgttcggcgaccacgctggcgccaggatcacctgctccctgcagtccgacatcagggaggtcgcaagcaagtgcgccgacgccgccaagatggccggcttcgccctagtcaactgtgcccttctcgtctgcgtcgcgagcgcggagggggcgcccaagaggctgaccttcgacgagatccag

SEQ ID NO: 66557 - DNA, 642 bp, Triticum aestivum
  Clone ID: PAT_TA_66557
gaattcggcacgaggccctaaatttcttgattactgcatgccgctggagttgctgtgtataggtagtgaaccataatacatgtgtgttatgccttccacatgtttgacgtaatgcccaaccgaattgctcacacaaaattcgatgggaacagaaagtaggatggcttcaagctgtcaatcttcgagtttctataaattttaagcccaatgttcctctatgtccctgtttcttacctcctcactcaccgagcagatgaagaagcagcaccaaagtccccctgatgttccatcttttatattgcaatagtcaaacttaaatcttttttactgcatgtctcgtagtaggacatccatttacgaaaaggaaggtagcatacttgtgggttgtggctgcacaaataattatattgtttacatcgagctttcttttttactgtatgttttgtagtaggacatctgtttatgaaagggaaggtagcatacttgtggctgcacaaacaattatattttttacagaggtaaatacatcagaggtgcctaaacttgtcccgcacggtcactttagtgtctaaacttgcaaaatgtcgaaaactggtgctacaacttgtccatttggtgcatatacggtgcctcgctcatacg

SEQ ID NO: 66558 - DNA, 563 bp, Triticum aestivum
  Clone ID: PAT_TA_66558
gaactgtttagtaaactaaatagatggatgctgtctcctgaatcttttgtacataagtgaaatctgtgctgaatacatgtgcagcatagttgtctgaatatttgttctattctaataatgcagggctatttgatggtctgttcacagttgaaatccatcacaagggatttttttgtggatctggtagcaacatgaagtatatagatcatgaagttgattggtttgactactgtcagagtgatacttggtctaatttatggatagatgatttctttctccaactgggccatgacagagcaaactccaagatggatgtgtattggtgccaacctggtaaatctttttgtgatgggcttcacctgatgtcatgtgatgcagatatagtgctcatgattggtgcaaccggtaaaccacagaacctgggtactgctggtagaccatgatgcagatatagtgctcctgaatgcttctcagcctccttcttctcaacttcttcctgcaacagcttgttcttcatagcaagatcacaaatgattgcctttgcccggccatcccattttgga

SEQ ID NO: 66559 - DNA, 479 bp, Triticum aestivum
  Clone ID: PAT_TA_66559
accaactgtcacgaactcatcctcgctggattggatcgggaggggaaggggacgagattgagacttgtgggagaaggttctcgccaagggaggaggtacagattagttggggagaggttcagattacagcatacacatcacatgccctgcctactggctataaagccgtgttccacttgtctgcctggcctgactggcgggcccgtgccaactggccggggggtcccaccatcacgcgtccaccgcatcacctcctggcgatgcaggacacaaaagccatcagattcacgcagcccagtacggccatcatccagaagaagcgatccaggtgaccctcgttcaggtcgtcggggatccaccccggcgtgccgcccgtcgacgtcgcccactcaacgacggtcaggaggaatgagctcagataatcgccgaccgctatcgcgaggaacccgagcgccgtgcacacggtcttcatcgcggac

SEQ ID NO: 66560 - DNA, 294 bp, Triticum aestivum
  Clone ID: PAT_TA_66560
ttagaattcggcacgaggcgatctgatcatcaggggcggcggccacccacctctcactgcaaacaggcgcggaaaccttcgcctctctcccccctaacgcaatgcagcgcgtgcgccccctcgacagccgcgcgctgatgcgacgactcctctcatgctattaaagcgcatcctcaaggaactgaaggacctgcagaaggaccctgaccacataatgcagcgcacgtcctgctggcgaggacatgtttcattgacaagcaacaattatggcaccccctgacagtacctatgccg

SEQ ID NO: 66561 - DNA, 686 bp, Triticum aestivum
  Clone ID: PAT_TA_66561
gaattcggcacgagctccccctcctcctcctccccccgcctctccccacaccacgccgcccgccgctaccgcgcagccgccgccggcgaccgaacgaggacccgcggggagagttccggccgccgcagcggccctcccgaggcatttcccccctcgctctcttcgctctagacgatggtggagctcacgagatagtcaagcatggacgcaatggaggtcgaggagggtcctcttctggccattgatgccaagttacacgctggaatgtgcagagcatttcatcctgcggtttctaaacttttagcgattttcccgttcatcgaagcatcaaggcccagaagcaagtctggcatacaggcactgtgttcactacatgtagctctggataaatccaaaggtcttcttcaacattgtgcagattgtagccggctgtacttggccatcaccgcagaaactgtgcatttgaagtttgagaaatcaagaagccaacttcaggaaagtcttcggcgtgttgaaagcatagtaaccgaagatattggccataagattgtggagatcattggtgagctggaggaggttgtatttacattggatcaatcagagaaggaagctggtgatgaggtgatcaatttgctccagagaaacaataaaatgaacagttccagcgacagtggggagcttgaggt

SEQ ID NO: 66562 - DNA, 645 bp, Triticum aestivum
  Clone ID: PAT_TA_66562
tgccgccactcccaagtactcaaaggcgcgttacgaagaaattgtgaaggaggtctcttcctacctgaagaaggtcggctacaaccctgaaaaggttcccttcgtccccatctctgggttcgagggtgacaacatgattgagaggtccaccaaccttgactggtacaagggcccaaccctgcttgaggcgcttgaccagatcaatgagcccaagaggccctcagacaagcccctccgtcttcccctccaggacgtttacaagattggtggcattggaactgtgcctgttggccgtgttgagactggtgtcatcaagcctggtatggttgttacctttggtcccactggtctgacaactgaggtcaagtctgttgagatgcaccacgagtctctcctggaggcgcttcctggtgacaacgtcggcttcaacgtcaagaacgttgccgtgaaggatctgaagcgtggttttgttgcatccaactccaaggatgaccctgccaaggaggcagccaacttcacctcccaggtcatcatcatgaaccaccctggtcagattggcaacggctacgccccagtgctggactgccacacctcgcacattgctgtcaagtttgctgagctggtgaccaagattgacaggcgatc

SEQ ID NO: 66563 - DNA, 263 bp, Triticum aestivum
  Clone ID: PAT_TA_66563
aaaccatgcggttgcaacgtccgcacccaccgaatttaaaaaaaaaaaactttggaaagaggttcctacatggataaacactgccagcaggcatcaaatatccttttaagctgccaggctgttgatgctgtcatggccggccctttttccgcaaagaaaaaaaaaaacccctatggggatgacccacagaggggaacatgggcaaggaaatcccccaggaggtagttgttgcggaccagccgcggtttccacgagtgggccga

SEQ ID NO: 66564 - DNA, 492 bp, Triticum aestivum
  Clone ID: PAT_TA_66564
gaattcggcacgaggcagcctccactctccaccgcatccggcagcggcgcgcggcggagaagccggtccggggaagcaggcgagcgacaggaagcagcagcaccggcagcaagaagaagaaggagaagaagaatcggacgccataatggtcaaccaaccacgactcttctccccctcctctcctctcctctcccagctactaccttttctccctcgcctagtctcgctagtccggtcctcctcctcctcctaccccctcgccctgctgccgccctcctattggccggcccgatttcctcctcatcccgttgaatgacgcggcggttgctccttctctgaatcccatcatccagccatccaggaggccggcaggggcgagcgcgccgacgcccttctccggcggaaatggccgtaagtccccgccctcgctccattggttggttggttggttggccggctcgccgccgccgtctccgaggtgtggtgggggtg

SEQ ID NO: 66565 - DNA, 365 bp, Triticum aestivum
  Clone ID: PAT_TA_66565
gaattcggcacgagtagatctacaagggggggggggttttttattatttgggacaagggacctcacatcataaccaagcaaacgcaatggagcatgagcgaatctacctatgatcataacttcataggggtctgcacagctttgcttccgcgtggaacatatatgtacataagtatcttcgtaccggtatatatacgcatatttatcgcagtgtttctcatcccatggacaaatctgtactcaccagcggtagagggtactaagtatgatataccattgccgtatgccgtagctacaacagggtgacgtttttcctttttcacagaagaactggacgatgtaccgatcgagctgagcctgcctac

SEQ ID NO: 66566 - DNA, 423 bp, Triticum aestivum
  Clone ID: PAT_TA_66566
gaattcggcacgaggctcatctcactgagctcgcaggcagccccagccaccagcgaaatggccgcgtcggcgctggaccagacgaccagcttcctcggcaccgcaccgcggcgcgatgacctcgtccgcagcgtcggcgacttcggcggccgcatcaccatgcgccggaccgtcaagagtgcgccccagagcatctggtacggccctgaccgtaccaagtacctgggcccgttctccgagcagactccatcgtacctgaccggcgagttccccggcagactacggatgggacaccgcggggctgtcggctgacccagagaccttcgccaagaaccgcgagctggaggtgatccactcacggggggcgatgctcggcgccctggggggcgtgttcccggagatcctgtccaagaacggcatcaa

SEQ ID NO: 66567 - DNA, 424 bp, Triticum aestivum
  Clone ID: PAT_TA_66567
gattccgagcgagacgtgcaaagtagctcatgcatccatcggcgccagactactgactcagctcctccaccgaccaccagacccagaccgatggcttcttcttccgtgctgctcggaggaggcgcggactactgaagtcgtcacagaacggtagatccttccagcatgaaggatgcaccacatatttcctcctcatttgcaggcacagcggtgaccttgctcttgggattctagtacgacttgaggcctccacgagcgttccagcagaagcaaccttgcgggaaaggcaccagtgacttgccgcaagatcctttcagcaggtcgatgtcgtcggagaaggcgacgcagccgtcggccgtgattccccacaagagcggccccttgccctccgggtcggatgcgacgaggagggaggaggtggact

SEQ ID NO: 66568 - DNA, 539 bp, Triticum aestivum
  Clone ID: PAT_TA_66568
gaattcaactcttatgaaaattgaaggactggcaaattcttgtacaatctcgacgcagatacatttgacaggagagatgaaacaactctgaatctgaagagcaatggaagtagaaatcagcaactagctgtggcctgtagcttgttcaccaccatcagacaatctgaagccagaatcatcactcgtcgatagccttccgacacagcaaaatgcagacctttggtcaaagccgctattgcttcagccagttcttggatgatgaccccttgaagagtctggacaaactgagccaggacatcacactcccacacccatcatttgatcatcaatgaagtagtaaccatcttggcactagtgatgatggctcacacctagaggtagacaccggggaaacaagacgctgttggatcatatcaatataagcctcctgatcttatgcacaaccctttgcggtacaggaccgcctttgctgttccgagcctcgttgggtgcgtcccgtgggaattgatatgtaacagcagtagcagtggatgtttctt

SEQ ID NO: 66569 - DNA, 604 bp, Triticum aestivum
  Clone ID: PAT_TA_66569
gaattcggcacgagtagggcacagtatcacgtggaaaaaaattgggcacgtttggcggatgcgaagcggagaggtgcgaccgagggtcccctccggccataccgaaaccacccccttccatagcaagtacctgaccggtttgacggattgcacccaacttctgggagcgcgtgtggggccccacccgggcaccccacgcccgaaatgaacgaaatccgacaacgaacgcacgttgcgtcacgtccgggcagtattttcagggttttctgcccggaaaattgtagtaaatgcatacggactcgaaacgggaaaaaatttttgcgtgcgtgccctgctagggcacagtatcacgtggaaaaaaattgggcacgtttgacggatgcgaagcgcagaggtgcgaccgagggtcccctccggccataccaaaaccacccccttccacagcaagtacctgaccggtttgacggattgcacccaacttctgggaccgcgtgtggggccccacccgggcaccccacgcccgaaatgaacgaaatcccacaacgaacgcacgttgcgtcacgtccgggcagtattttcagggttaaaaaaatatgcctatttc

SEQ ID NO: 66570 - DNA, 275 bp, Triticum aestivum
  Clone ID: PAT_TA_66570
gaattcggcacgagatcatgctatataggtacatactacagccatgtcccatatcgggatggcctcgtggggcaccttccactctcttttcaagggcctgaagaacaccggcgtcctccccgtcagacggagctgcagcgtcgctagcctggtaagcgtccacagcgacgaaaggatcatgggcatgcaggtgtgccccatcatgagcatcaagaacatgaagaacatgtcttacctgcaaacggtcaacacgcagggcatgctcaagcacatca

SEQ ID NO: 66571 - DNA, 247 bp, Triticum aestivum
  Clone ID: PAT_TA_66571
agttaaaccagggagattttatttaggggggcctgtttacaacaagcatggcatggcacctgactgctgatgcaggtcaggtgcatagataaggccctcgatcaggtagcggttacatggtatggtagtagtagatcgatatgatcgatgctgcacgcgcggtgcatgcatgatcgatgatcaatgatctagcagctgcagcaggagcagccgcagctggtgccgcacttgcactgggtgcagccgc

SEQ ID NO: 66572 - DNA, 532 bp, Triticum aestivum
  Clone ID: PAT_TA_66572
gaattcggcacgaggtcgtgtgagagcgcggactctatctggctacatccagcacctgcctgcggatcatttacgagtttctaaccgagagggagggacgatggtgtcgcctgttgctcccatcgtcggcaatatactaacacttatcactttgctacaacatatgtcacatcaaaatcatagcctacaaggcaagatcgacggtaaattcggctcactaacggtcgaggtggagtcgctcgaatgcaacatggcgaactacaaggacgatgatgagtcgatgctggagatgcagtgagttgcttatagatattcaggactacctcggcgatcttacatattgcagagaaatgggacgcccttgtgatgcatgcgacggggactgagctccgtgctgaaaatatcgtccgcatcgatcttttcgtagccagcatcgataacgtcaacaagcgccgagatgagagagctaaagaagctgtattcaagcccacgattcttacatcaatggcatacagatctaaggcacctactc

SEQ ID NO: 66573 - DNA, 597 bp, Triticum aestivum
  Clone ID: PAT_TA_66573
ggagaaaaagccaaaatttgtgaaatcatagccaaatcatcatatggtgaggagaaggagagggacatggacctaggggaattcttaagaacgcatgagcacctccaaaatatgttggctacaatcatcaacagggaaattgtaaataaagataggaaattccactacaagacacatccaaaagaagaaggacttgcccgagtcgaaaaaatcttctcatctattgccgccgacaacccaactcggtagatatacttctcaaaacaacttattatgtgttgagacatgcttgttgccctgcacttcttatactatgtttacttcagtagtactcataattattgcatctgacattgtaatacgttgtatgcatgtggatgattgtttggatgctgagtcaacattctatatatgtaatataatgtgacgatgaagtgcaaaacgttgcaaccgcatcattaaaatgctgccacggcaacaaaaaacgcagccgcggtagcaattcttcagtatgcttaaataactatggcaggtgccaaaagtgcttgccactactgctacacatagcagtggcgggcagagagaacgttaacacat

SEQ ID NO: 66574 - DNA, 612 bp, Triticum aestivum
  Clone ID: PAT_TA_66574
gaattcggcacgaggaaacacagagcaagaggagaagagagaagcaaagcttgagatggcgcaaaccatggcgtccatgaccggcctgtcgcagggcgtgcgtctcccaggcccggccggcaggcgcgccagcaggttcatcgtgagggcgtcgtcggcggaggcggaggccgccggccgccgcgcggtccttggcctcatggccagcggagtcgtcggcagcgcgttcgctcaggtggtgcacgccggcaccgtcgcggccatcaaggttggcccgccgccgccgctctccggtggactccccggaacggacaactccgacgaggcaagggacttcgacctgcccctgaagaaccggttctacctgcagccgctgccaccggcggaggcggcggtccgggccaaggagtcggcccaggacatcctcaacctcaagccgctcatcgacaagaagcaatggccgtacgtcatgaacgacctccgcctgagggcctcctacctgcgctacgacctcaagaccgtcatctcctccaagaccaccaaggaggaaaagaaggacctcaaggacctcaccggcaagctcttcgccaccctcgacgggcttgaccatgc

SEQ ID NO: 66575 - DNA, 224 bp, Triticum aestivum
  Clone ID: PAT_TA_66575
atcatattttatttttttattatttatattttaacacctaacagcatcccagaggcatacacacaatcgtcacatggttatgcacagtcagcaacatcaatggcgaaaaatcaccaaaaacttcagagtcgcacaccactctctatccaatataaactctgcggaaacacccattgcctccgccccacccctgcaaaggatgcacacgacaagctccttctctt

SEQ ID NO: 66576 - DNA, 639 bp, Triticum aestivum
  Clone ID: PAT_TA_66576
gaattcggcacgaggaaacccagtactgtggggtacaacacatttatgaatggtctctgcaagaaaggtatggctaaagaagtacttgagcagttggatgttatgctaggcgaagggctggatcccacagatttcactttgagtattcttctgaattgcctttgccatgacaagaggattcatgatgccgtatgcttgctggagaggagcacatcattgaaatgctatgctggtgttgttgcatacaacactgtgatgagctgcttatgtgaaatgggacattggatgagtgctctaaagttgttgacagacatgatcaagagaggtgtcatgccaaacacgaggacattcaacattgtcattcgtagtctttgctttcgccgaaagttctccatagccaagagcctcgcaagtaaccaaggttttgctgcaaatgtcgtgacatacaatacactcatttattttgttttttactacagtcgaaagctcagtgaggtgaaggacctaatatttgacatgacagcagagaggattgctccagatgaagttacctacactataatcgttgatggattatgcagagatggattttttgatacagccactagttactttctagaatcgcttgagattggactg

SEQ ID NO: 66577 - DNA, 460 bp, Triticum aestivum
  Clone ID: PAT_TA_66577
gaaacaaacagaaggatccacgctgcttgattcagtataatatcaaattggcaccacaagttggttcaggatttagctaccagtaaacatcacgtggatggagccacatgggagatggggcacaaatctgactacatcacctcggggaaacctcacaactaacaacactgctcgtgccataatatattcattcccacgcaaattcatgcaagccatggcaatcatttaaaacagaaccgcgccgcaatacttgcatgtctggaagattgaccacacaagacaatgttgtggtccttcacagagaaaacgcagaagctttgcgacttgatgcattgatagaagtacccacaaccctctgagtaagcgcccccatgaacatgaatccttgttgtttgtgaactggataggtcaaggttggccacagctttactggtcaaggcccactgcctaaccgaaccct

SEQ ID NO: 66578 - DNA, 191 bp, Triticum aestivum
  Clone ID: PAT_TA_66578
agatgagttgttgaaggcattgcaaataaaagaaaaaattccccgtagaaaagctctttcagcattggaggagaaagtaataatgatactttcagagcagggttatgtgtccaaagatgagttatctggacccattggaaatttagctgatattgtcgaggaggaagatgaggacgaagttatagaggatg

SEQ ID NO: 66579 - DNA, 415 bp, Triticum aestivum
  Clone ID: PAT_TA_66579
taaaaattcggcacgaggttcgagtttttttggtgtttttttggaccagaggtaccgcattcactgttgtaatgagaatacattgtattattagatcaaacataagtgaatacatgatgtgtttgcttcacgcaagggaagaggaagaggtggcgtacaaccgttggccttgtaaaaaatgccggaggaggggcgacggctggggatgtaaaacaagatcaacaattgctcacatcggcaccattcctcacagaattgaagggagatcggcggcggcggcggtgacgaaatgagaccagcggcgttgctgctcacgacagcggtgagttgatatggcagtgctgctgctcatggcggcaggagatcaccgacgctgatgtttggttagttgtccttcatggcttgctttgctcga

SEQ ID NO: 66580 - DNA, 415 bp, Triticum aestivum
  Clone ID: PAT_TA_66580
gaattcggcacgagcaattacttgtcgcgggctggtgacgtctccggaggcatggcagcagctagcgctagagcccttgctgccgcggtttcagctctgctcgcggccgctgtattactcgcctccccgtcgccggtcgccgcggaggaggggtgcacgcagcggccggttgtgttcgcgttcggcgactccaacacagacacgggcggcaccgcggcggcgcttgggagctacctcccgctcccggagggccgcacccatttccgccgctccaccggacggctctgcgacggccgcctcgtcatcgactacctctgtgagagcctgaacatgagctacctcagcccgtacatggaggcgctgggctccgacttcggcgacggcgccaacttcaccatcgccggctcgggcaccc

SEQ ID NO: 66581 - DNA, 290 bp, Triticum aestivum
  Clone ID: PAT_TA_66581
gaattcggcacgaggcggcgcccatcgggggcttgtcacttctctcgccgagaacgggcggcggtgaggtcgggatccggggcgtccggccgccagtgctctccccgcctccaccgatcacggggctcgcaccgcctccggcgaggcagtcgtctgtggctgagatcatgagcggatcggcctgggacattgtgaactcgttcgctcccacggaggagaatacggaactgagaatggcctatggacatgttgaaacatctctcatgtcagacacagatgaggataatcct

SEQ ID NO: 66582 - DNA, 526 bp, Triticum aestivum
  Clone ID: PAT_TA_66582
cgagcaccggcgcgccaccacgccggcacggccccaagggagcgcgccaccactctgtccgtgccgcgcccgcgagcctgcacgccggcctcgcgcttgcgtcggcctggggtactaggatcttcgacaggcagggcatgcgccggccaccgttcaccacgccggctgatgtgccaccggaagcacccaggccaacatttatccaccggcctaactaaatggaaggtactagcgtccctattgagattgatggagacgcgatctgtctagagaatgttggagacgacgagcatgaagctcaagagagcggacaggtgcaaatcatctatgctactgaaaatggcgctcaagtagcttttgacagccaagaacagggaacggaggaacattctgtgagaagtgaagaagaccaggaaaataattctgttataccaagccgggaggagtttactgaagaattgcgcactaaagttgcgtatagtgaggaacaagcttacaggctgtactgtgagtatgggcaccgtat

SEQ ID NO: 66583 - DNA, 335 bp, Triticum aestivum
  Clone ID: PAT_TA_66583
agttggggcacatcgttacgtggtacggtacacgtacgcgttccaaacagtatagttgcgtgattgtagttagcagaattatcatcttggccatatgtattgatcttgattaagaacattcaaggcatgcacaacaaaggtcaaatactgaaaaacgtatccaataacatggaacacagaccggtaattgccgtttgtttgtgtccatagacactcaaaatcactctggagcgctgtcttgaccatggagtggattggccttcaatggcgcgtgcgcagcttctatttttcataccaagaagagtgcatgtccctatttggtattgttgtgccac

SEQ ID NO: 66584 - DNA, 648 bp, Triticum aestivum
  Clone ID: PAT_TA_66584
gtgctccgttccagctcaggcgagcagcggcggccttccggcgagggcagtgggcagcagcgatggagggcaaggaggaggacgtgcggctcggggcgaacaagtactcggagcgtcagcccatcggcacggcggcgcaggggtccgaggacaaggactacaaggagcccccgccggcgccgcttttcgagcccggcgagctcaagtcctggtccttctaccgcgccggcatcgccgagttcatggccaccttcctcttcctctacgtcaccatcctcaccgtgatggggtacagcggcgccgcctccaagtgcgccaccgtcggcatccagggcatcgcctggtccttcggcggcatgatcttcgccctcgtctactgcaccgccggcatctccggcgggcacatcaacccggcggtgaccttcgggctgttcctggcgaggaagctgtcgctgacccgggcggtgttctacatcatcatgcagtgcctgggcgccatctgcggcgccggcgtggtgaaggggttccagcagggcctgtacatgggcaacggcggcggcgccaacgtggtggcgcccggctacaccaagggctccggcctcggcgccgagatcatcggcaccttcgtcctcgtctacaccgtcttct

SEQ ID NO: 66585 - DNA, 344 bp, Triticum aestivum
  Clone ID: PAT_TA_66585
gaattcggcacgaggagaaattacgcgtcgggcaccaacgagccccacgcctacacccttctcctcccccccgcccgcattatgctactctcccctccccatccttggtacataatacatcctcactgcgcacggccccagcccaaataccctcccgaccctccacccctctccccgcaaaccctaaccctagccccccgccccctagccgacgacccaatccgcgccgcaccggcggccgctcccctacgagagtaaaccgcggccttgtgccggagataggcgccttccgtgatgcatgggctcgcaaactctgccctgaacgcctcacaagcgctgatgaa

SEQ ID NO: 66586 - DNA, 642 bp, Triticum aestivum
  Clone ID: PAT_TA_66586
gaattcggcacgagctccagcgggagtggggcgtggggcaccccctcagggtggtcccgctgttcgagaaactggccgacctggaggcggcccccgcggccgtcgcgcggctcttctcgatcgactggtacatggaccggatcggcggcaagcaggaggtcatgatcggctactccgactccggcaaggacgccggccgcctgtccgcggcgtggcaactgtacaaggcgcaggaggagctggtcaaggtggcgaagcagtacggggtgaagctgaccatgttccacgggcgaggcggcacggtcggcaggggcggcgggccgacccacctggccatactgtcccagccgccggagacggtgaacgggtcgctccgcgtgacggtgcagggcgaggtgatcgagcactcgttcggcgaggagcacctctgcttccggactctgcagcggttcaccgcggccaccctggagcacggcatgcacccgccggtctcccccaagcccgagtggcgcgccctcatggacgagatggccgtcgtggccaccgaggagtaccgcgccatggtcttcaaagaaccacgattcgtcgagtacttcagatcggcgacacctgagactgagtacggcaggatgaacatcggca

SEQ ID NO: 66587 - DNA, 612 bp, Triticum aestivum
  unsure (1)..(612): unsure at all n locations
  Clone ID: PAT_TA_66587
gaattcggcacgaggtcgcctggtccaaagggccgccgctcgccatcgcctcggccgtccccttcgcctccttccgcgccgagaggtggatcgtcgtctccgtctcctccccgcccaccgccgcgctcgccgcgctcacccgcgtcaagggctggcagctcctcgccgtcggcaactcccacaccccctccggctgggacctcaagggcgccatcttcctctccctcgacctgcaggcgcagctcggctaccgctcggttgacttcctgccctacgcctcccacgtccgcaagacggcgggctacctcttcgccatccagcacggggccaagctgatcttcgacgccgatgaccgcgccgagatgccggggaatgatctggggaagcatttcgatgttgatctcggatctggcatcgccaaccaccccgtgctgctccagtacagccacgcggatcccaaccgcacggtggtgaacccctatgtgcacttcggccagcgctcggtgtggccgcgggggctgccactggataaggtcggngaggtggcgcacgaggcgttctacactgagatcttcagtggccgccagttcattcagcagggcttgtctgacg

SEQ ID NO: 66588 - DNA, 417 bp, Triticum aestivum
  Clone ID: PAT_TA_66588
gaattcggcacgagctactgcaggagcccgaggacaccatcagaggaattcgctgcgtacatcaagcagagaggctatgacctccatgatgtgaagacctacggaaaggttagcttcttctcaagaaaaattcataccaaccgaacaaatctagttatcctgggagatttgtttcagagaagcaaaccgtcctaagttcctaacctctgttttgcacatgaactcagatgcttgaggatgccgcgtttccatgatgtcgtcgctgaggaccgcacctgaccaggtgatcatctccccctctgcattcagtcccctgccattgacacgcacttcctgaatcctgatcctttttgtgtacaccgatttgaattgagttatacaagaatggcttcatccactgacatgatcatcactgtg

SEQ ID NO: 66589 - DNA, 544 bp, Triticum aestivum
  Clone ID: PAT_TA_66589
aaggcagtgaaggatttgttcttgccgtgtttgcagaaagtcggcaaagtcttctggatagtactattaggcaagagattaacttgatggtctaaatcaaccatgctcccaataatgtggaaggtttactgcctcaagcaagagctgctgcaactagcaaagagcaatagcggctctcgaattctcaatcctgctcgtaagatgctcatcctcaagtgctccatcagcgcaacacaacctttggctcgcttgtcaccctctggttcgacaaggccatcgtttgatacaccacctacagcatgtgaatgccagttgaagcccagactgggtggctccttcagcacactccgagctttggaatccaaaatttatctgtgaatcctacgatagacaccagagactgtgcttaccagggcagttggttcgacaccttcaccaacccagccaataccaatctagtgcttaacaatgctcatgggataaaactctgcagcaggctcatggcgacggacaacaccagtggcaggtttctcctcaatgtgca

SEQ ID NO: 66590 - DNA, 387 bp, Triticum aestivum
  Clone ID: PAT_TA_66590
gaattcggcacgaggcggatgaatgcgaccagcgagaggctgagctacatgcgcgtgatcaagttccaggcgtgggaggagcactttaacgcccgcataggccgcttacggcgcctcgagttcgggtggctcacccgtttcatgtactccatctgacgcaacataggggtgctttggagcgcgcccaccgtggtgtcggagctcgtcttcggcacctgcgtcgccgccggcgtgccccatcgacgccggcctcgtgttcaccgcacacctgcctcttcaagatcctccaggagcccatgcgcagacgttcccccaggccatgatccaggcctggcaggccatgatctcgctccagcgcctcgactcgtacatgacgagcccggagct

SEQ ID NO: 66591 - DNA, 359 bp, Triticum aestivum
  Clone ID: PAT_TA_66591
aaactataacaaactatttatacatatgcccagctacagacatgataaagggtattacccattcgcacaagcccataaagggacagaaagactgttacatacacccggggccatatacacccttatctaaacagccggggggctttgaggggaccacatcagtatacatatgaccgccccccccataaaaaaaaaagaatccaaccgctaaattttttagcagggcccagtagcagtacaaaccacacatacatccgtatttagcatcgaaaacacactcactttaacgacaattttgtctagtaatcataaaagccagtctcgcctgccccaggggaatacccatcggcgccggactt

SEQ ID NO: 66592 - DNA, 648 bp, Triticum aestivum
  Clone ID: PAT_TA_66592
gaattcggcacgagacgacgtccacgtcccggaggagccgatggagtacgacgagcttgtcatcaaggcgcacatgttcttccacaccttccgccgccttttcgtcgacctcatcctcagcttccaggaccgcaccgacagcctcaccttcttccgccgcctgaagcgcgaccaggcctacaaggtcgtcgagatcgagctccagctcatgtacgagtcgctccactccaagtcgcccgtcatacactgcccctccggccgctacctccgcgttttcaccctggccgcgcccatcctgtcgctcctcgtcttctccaaggccggcaagggacgctacaaggaggccgacgttgccgtcacttacgtcctccttgttggtgccattttcttggagatttacggcatcatcctgatggccatctcctcctggagctacgccgacctgcggaagttgcgcaaatgcctcccggcggcgagcagagtggtcttccaggccgtcaagtatttcatgccggaggcgaggccacggtggtcgaaccagatggcccagtacaatctcctcagctactgcctcaaggacaagtccacatggttgacgagagtgctggagagtctcgagtgggattacaacatccgcgtcaagacagc

SEQ ID NO: 66593 - DNA, 647 bp, Triticum aestivum
  Clone ID: PAT_TA_66593
gaattcggcacgagatcactgatcaccagcgcggccgcgcatccaccgctgctagcaaggtcgagcaagcagcacagagatggctgctgccttctcctccaccgtcggtgccccggcttctacgccgaccaacttcctcgggaagaagctcaagaagcaggtgacctcggccgtgaactaccatggcaagagctccaaggccaacaggttcacggtcatggcagcggaaaacatcgacgagaagaggaacaccgacaagtggaagggtcttgcgtacgatatctccgacgaccagcaggacatcaccagagggaagggcatcgtggactccctcttccaggcgcccactggcgacggcacccacgaggccgtcctcagctcatacgagtacgtcagccagggactcaagaagtacgacttcgacaacaccatgggaggcttctacatcgctcctgctttcatggacaagcttgttgtccatctctccaagaacttcatgaccctgcccaacatcaagatcccactcatcttgggtatctggggaggcaagggtcaaggaaaatccttccagtgtgagcttgtcttcgccaagatgggcatcaacccaatcatgatgagtgccggagagctggagagtggcaacgccg

SEQ ID NO: 66594 - DNA, 299 bp, Triticum aestivum
  Clone ID: PAT_TA_66594
acataggggacggaccgaacttataatattatgagcatgggcctatacatagcctacgacagcattcacatacgagcatgctctctcgcgccatgacgcaaacatggacatacacatattcttatcttaggaacatacaatacagatatgcggaacaggaaaacccaaagcaatgtaagagctgacaaaaccgcaatggcactttatatgtggcccgcggggagcgagctgtttaggccttgccggactcctcgcagcccggtggcttgaaggcgatgaagctgacgcactgcacctgg

SEQ ID NO: 66595 - DNA, 205 bp, Triticum aestivum
  Clone ID: PAT_TA_66595
gaattcggcacgagtagcagtgaagatgctaaaggacttcaagactgatggcgaggatttcatcaatgagttggctagcattagtagaacttctcatgtcaacgtcgttactctcttaggattttgcttgcaaggatccaaaagggcactaatttatgattacatgcctaatggttcacttgaaaggtatgctttcaaagatggc

SEQ ID NO: 66596 - DNA, 341 bp, Triticum aestivum
  Clone ID: PAT_TA_66596
gaattcggcacgaggaccgtcgccgtcgtcgcacagccgcaggtagtgaaggcaaggaggaagggaagatgccggcggggcacgggctgcggtcgcggacgcgcgacctgttcgcgcggcccttccggacgaaggggtacatgccgctcaccacctacctgcgcacctacaaggtcggcgagcatgtcgacgtcaaggtgaacggagccgtccacaagggtatgcctcacacgttctaccacggccggaccggtcgcgtgtggaacgtcaccaagcgcgccatcggcgtcgatatcaacaagcaggttgccatcaggatcataaataagaggatccatgtg

SEQ ID NO: 66597 - DNA, 484 bp, Triticum aestivum
  Clone ID: PAT_TA_66597
gaattcggcacgaggcgcgcaccacctcgggggccgagagagaagtccatcacgcgatccgtcaatggcgtcctccgagctcacctaccgtgtgcagcaggcggtgacggcggccgacgtggccgcggccgagagcaagccgcgtaccatgcagcagctaccgcagccgatccggtacgtgctgggcgagcagcgcctcgtcttctacttggtcggcatggccctcgccaccctcctcttcgtcctcctctccccctccaccaccaccaccacccggtccaccagcgtggagcacctgacggcggtggggctggtgtcgcggcagtaccagtcgtcggccggcgcggggcggatggcgttcgaggaggccggcgccggcggcgtgcgccacggtcgcgtgccgctgaggctgaagcgcaagggcctgcgcgtggtggtgacgggcggcagccgggttcgtgggcagccacctggtggaccggct

SEQ ID NO: 66598 - DNA, 479 bp, Triticum aestivum
  Clone ID: PAT_TA_66598
tcaaaattgggtcggtcacctcctcgcacaacgcacgcccatgtgaccgcttacccagcgctatccacaggaaccttatccccaccccccgcaagacctatctagttcgtcccttgcctccaagtccttgaaatcccagcaccggcgggtggagcggcgccggagtcgatgcgagcggcggagctgcgtccatggatgatctccttccccttatctctctgtagtagccatggatagaccccttccccttctttcctcagcagccatggatgaactccatccccttctctctcaagtagccatggagggactccttccccttctctcctcagcagccatggatgaactccatcccatttcttttcccagaagccatatgaactccatcggtccatccccttcatcactcatccttaaccctcttttttttttcctacaactgttttagaagctacaactggccatgaaaaaagttgcgt

SEQ ID NO: 66599 - DNA, 662 bp, Triticum aestivum
  Clone ID: PAT_TA_66599
cagcggccccaaacaccctttgatacttgtatcagctttggaggggatatcagtagtgtgtggaacacattttatttttcttattcaatttatgaagctgtttacccgctggcctaaaatatgggcagcttgtaaaactcagcaactagtttgccgaaaaaggtgctaactttagctattgtacttgttcggcacctgacagcgaaaaggcgaccaaatgtgtccgatctgtattggcataaaatccgagacattgagcataaaaatatggggactgataggcgccggtgcgccggcctaacttttgggcaggtccaccacccaccgtcagattagcatgcgtgtgaccgttcgatcaaagtcaacgcatcccgtttcaccccaatcttctccccccgcttgtctctgccacatcgctgcaccgtccgcctcattacacgtgctcgtccacccatcctgtaggtcttcgtgccccaacccgccatcgcagctccctcgtcaccgccatggccgtcccctcactcgttgttgtaggcatgcatcaccgattccagcacctccgattaaggtggtcgtagctttttccctagccggttccagcaccttagagtatggacgcaacttttttcatggccagttgtagcttctaaaacagttgtagg

SEQ ID NO: 66600 - DNA, 595 bp, Triticum aestivum
  Clone ID: PAT_TA_66600
acaaattggttcaccactctgtaactggctaatcacatgtgccagcttccagtttagcatgatgcgctgctgaacagtgtattgcaagactggggacacgacagaatagatatatcactgaagcgaacaacgcaactggaacttaatgtctatgaaaatagctcgccgagatcacatatcatattcttcagtgcataccgcatccttcagttacagagtcagtttccaccatctcttgattacaacacatttggatggatgtccttatggcataaaacatccccaaatcctctgaacgaagcgcatctgagacttgctccagatcacctgcaccacctgccatcgccataccacagtcatgcttctctgatggcatagccccaacctccagaatttttctttctttcaggaaagcgttgtacgtgttgattttcaaaatttctggtggaggcctggaccatctttcctttggctgctgcttttgccttacccctttttgctcaacctctttgttgaagcttcatgcgcaggggtaaactctctgtagacgggcgccatcaaagttgaagaatcttgccggggaggggaagcgacc

SEQ ID NO: 66601 - DNA, 440 bp, Triticum aestivum
  Clone ID: PAT_TA_66601
ggagcggagcggagcgcagctcatatttccggagctgctattctgtcactccgagttccagcgctgagcggagcggagtagccagagcgatgcgttgccgaacaggcactaaatctctaagcttgctccgcaaccatcatcctgagcatgtgatcgtcgaaacgtctacacatggtagcctcaagcaaagattattcctgtcgaaccaatcgtccacggccacctgctacagttgcggcccaaaggatcgacccatcaatcgccggctgttccgcaagttaggtgactccagctaatcgtccatacatggcaggttccggtaagataattggtatgaactcaatcatcatccgatagcacgacaacatgctgcttcagttgtactaccgaagttgcaccggcgcctgtgtcaaaccatccgagtattctccgagatgagg

SEQ ID NO: 66602 - DNA, 553 bp, Triticum aestivum
  Clone ID: PAT_TA_66602
gaattcggcacgaggctcagggtgctaagcctggtgaaggtggtgagcttccaggtcacaaggttatcggtgacattgcagttaccagacattctacagctggtgttgggcttattagtccacctcctcaccatgatatatattctatcgaggatcttgcacagcttatccatgaccttaagaattcaaatcctcaagctcgaatcagcgtgaagctagtgtctgaggctggtgttggagttgtagctagcggtgttgtaaaaggacacgcagaccatgttcttatttctggccatgacggtggcaccggtgcatcaagatggacaggtatcaagaatgctggacttccatgggaactaggattggctgagacacatcaaactttagtggcaaatgggcttcgtggtcgagctgtcctacaaacagatggccaattaaaaactggtagagatgttgctgtggcgtgcttacttggtgcagaggaatttggtttcagcactgctccactgatcacacttggctgcattatgatgcggaagtgccataccaatac

SEQ ID NO: 66603 - DNA, 375 bp, Triticum aestivum
  Clone ID: PAT_TA_66603
gaaaaaaaaagaaggagggcaaagctatgataatatcacaataaacccattataaccttattacaattggcactccaaaattctattacggctataacggaggggatgggcgcccaatcccagataattaagagcctaaaaaggcctaaatatgaacctaggtatagcatcgatggaggccgcatgcatgcagtaaacaggagtaattctatctgcactcctttcgttgggccgaatccacaagaatcgttgttgtactacgtacataaagcattgctgggggctcgctggtttagaatgggaccctgaccccctggtaccggaggaccccgccgatgagctcccccttgccggagccgacgtagcggccgacga

SEQ ID NO: 66604 - DNA, 395 bp, Triticum aestivum
  Clone ID: PAT_TA_66604
gaattcggcacgaggctgaatctgcggatggggccagcacacccagcattcatgccgctgctgcgggggatgctgaaagtgcagaaaagagcgtcaaagaagagcaccatgaagccgaaaatacagatactgacaaaaatttggaatatttgaaggaagctgacggcaacgaggaactcagagaagtaaatggtgagccaggagatattaagggtgtcactagcaacttggaaaccccaaaagaggacagcagtagcagaggggcggattgtgatgatgaagaagaagaaggtgaagccgaagagaggaacatcaaaatagaatgcgtagatgaagttggtgagaatgatgaatccatagaagctaatggcatgccagaggatttcgatgatgtc

SEQ ID NO: 66605 - DNA, 442 bp, Triticum aestivum
  Clone ID: PAT_TA_66605
aagttcaaaatccaaggccttcatcactataaataaatcaaacccccagccggataaaaaaaaataggtcctccgggggcccacctaaaattcacccccttggcgaaatacctagaaaaaaagggaatttccaccaagggccctccggtccccaagtatcctgtccagaccggagcttcccaaagggtccagtttattaccacctgaccaacgggagtaggtaacccaaccattgtacctaagggggggccatgccccgatttgggcatgaaattcaaaacccacaacggggcaaacatttccctggcggaggcagctgaaaccatcaggtggggtttttactcgccccatcaccaaaaaaaggagctggctttttttttaaaacaaaagggaaaccccttggcgcaaggccctacttgtctaaagttacaaagctttaatc

SEQ ID NO: 66606 - DNA, 439 bp, Triticum aestivum
  Clone ID: PAT_TA_66606
gaattcggcacgaggacgcatcgaggtcggcgtcgcctccctccacacccatctggtgtgcgaggtggacatcgccgtcctcccttgctctccgccatcgagattggccaacgccgtcggagctcgatgcttgcctccgtccccagcaccagatccgacggctgccccaagcccttccatagtgccgtaggctacctcggcaaccccagcctggtgcacgcgcagagcatcctcgccatctgggcctgccaggtggtgctcatgggcgccgtggagggctaccgcgtcgccggcggcccgctcggcgagatcgtggacccgctctaccccggcggcagcttcgaccccctgggcctcgccgaggaccccgaggcgttcgcggagctcaaggtgaaggagatcaagaacgggcgcctcgccatgatctccatgttcgtct

SEQ ID NO: 66607 - DNA, 241 bp, Triticum aestivum
  Clone ID: PAT_TA_66607
agggaaaccagggagattttatttaggggggcctgtttacaacaagcatggcatggcacctgactgctgatgcaggtcaggtgcatagataaggccctcgatcaggtagcggttacatggtatggtagtagtagatcgatatgatcgatgctgcacgcgcggtgcatgcatgatcgatgatcaatgatctagcagctgcagcaggagcagccgcagctggtgccgcacttgcactgggtgc

SEQ ID NO: 66608 - DNA, 267 bp, Triticum aestivum
  Clone ID: PAT_TA_66608
gggagatcgtatatataataatgataacaaaatgtggaatagtacagaacacatcaacggatgaaaagaagtaggagtagcttacttgccccaatcgctatcgccatcgatttgttttgaatttaattctgcggcctcattgcttcctgcacagcatgcattccaccacaacacggcagaacacgtcacaacagcgatgactgaaacctacctctgctttcatgccaacagctatccaatcgcacgttgccacgccacacatcaggc

SEQ ID NO: 66609 - DNA, 497 bp, Triticum aestivum
  Clone ID: PAT_TA_66609
gaattcggcacgaggtctagagttttttgggtttttttttgcaacagaatatgtggcttattttagaggcgtacactgttagcctctgggtacaaaacttctggatctatttacattttgatcaggcctcgatggcaacagcgtacaacacaataaatgggcgaccccgtgtatcgctatcacacaggctcaggaaactcccgcgttcttcagcgtgcgtttttcaacaaaacaggtccgtcgtagtaccgcacaaatagggcctaggtgagttccgaaaggtggagaaaggatcatagtggacgccacaggcaaaaccggacaaggcgtacatcaaagtttcaaacgaaatagcgctatggcttatctgacttcctatggctaaatcggagcacattggtactacaagtgatacagaggggcaaaatggctaccgtaatcatgttagctgccgaacccaaatggcgatttactcctgctgccaccttcgacgtact

SEQ ID NO: 66610 - DNA, 561 bp, Triticum aestivum
  Clone ID: PAT_TA_66610
gaattcggcacgagaacacactgtccgggcgtccgaccgacggagagcgaaggcacacaccgcttcctcctcctttgctcggcgcggcgcttcccgcgaacaaggatatgtcgtcatcctcagcggctcccatggagcggcaccactccatcgacgcgcagctccgcctcctcgcccccggcaaggtctccgaggacgacaagctcgtcgagtacgacgccctcctcgtcgaccgcttcctcgacatcctccaggacctccacggcccgcacctccgcgagttcgtgcaggactgctacgaggtggcggcggagtacgagggcgaccgcgacgcggcccggctggacgagctcgggggcaggctcacggggctggcccccgccgactccatcgtcatggccagctccttctcccacatgctcaacctggccaacctcgccgaggaggtgcagatcgcgaaccgccgcaggaacaagctcaagcgcggcgacttcgccgacgaggcctccgccaccaccgagtccgacatcgaggagacgctcaagaggctggtgtctgacc

SEQ ID NO: 66611 - DNA, 276 bp, Triticum aestivum
  Clone ID: PAT_TA_66611
acttaggggcttgttgacatattatcaacagggaagttacattgccggcttccaaatatgaacaaacataaaaggcctgaaagcagcacggccattatgtggatccatctagcctagcttggcgaggacatcgccgagaacagtcttggtctcgccgtagtacttctcggcctcggtggggctcttgatcttggctgcatggtcaagcccgtcgagggtggcgaagagcttgccggtgaggtccttgaggtccttcttctcctccttggtggtctt

SEQ ID NO: 66612 - DNA, 361 bp, Triticum aestivum
  Clone ID: PAT_TA_66612
gaattcggcacgagccacaaccacaatcggctactacactcctactgtacacctacgatgtctcctagaacagctagcaatgacgaacaccgcgatggcgctctccaccttgtccttctcctccaaggcgatgaaggacctacctgcgaaggccttcttggcggaggcgttcgtcaacatgcgcatgaccatgcgcaagaccaagcccatgcccaacgtgacgccgtgcaacagctcctaccgcgtgttctacctcgtgctgttcttcggccagctctccagctacctgaccagctacctcaccggcgagtaccgcggggactacgggtggctcaccgccgacctgtagaccttccccaag

SEQ ID NO: 66613 - DNA, 615 bp, Triticum aestivum
  Clone ID: PAT_TA_66613
taagaattcggcacgagacaaattctcctgctgaagaattgttgggaagtgcacttcactacgcatttgatgtggtatgtttagaaggataaaccttacgattctatcatgactaataacatttgtttaccccttgttgttggatggatcaaagtaatgtacatggaagttctgatggagagtttgcacaatcaagactcgagttatagctaggtggtgatgttttagttgaagcttgaaagttcggtctgcgggtaaatgaccacatagtcctctaatttgattgttcgtctattcttcaaactttgaatgataaatggtacaaggatcgatcttgcctaagtgcatatgtaccactatagccatatcattctgaagtatggctgtcaacagagaatcatttattcattaaaaaaaaaaaaaaaaaactcgaggcattttctctaccccttcttaccctgaaaaagcagggtcaccttgtgtccttaaacctataaccatctttcggctaacctagcctcctccgtccctccgtaccaacaaggggtagtacaggaatattgacctgttgtccatcgactacgcctttcggcctgatcttaggccctgactcac

SEQ ID NO: 66614 - DNA, 605 bp, Triticum aestivum
  Clone ID: PAT_TA_66614
gaattcggcacgagaaatcatctactactagtgcaaataaacataatttatctcctgccattatctacaaaaaaacagcacaaaatccccctctcattccccttctccttcaccattatctcctgaccaaatcatctactactagtgcaaataaacacaactatctcctgaccattatgtacaaataaaacagcacataatcccccttctccttcaccattatctcctcaccaaatcaaagacttgccagcaagattgttcagctcactaaactacaacatctactctgtgacgtagattagaggaagataccaatcgggattggggcttgggagtatgaaaaacttaagaacagagatctcaggaggctaccttttcctcttcgtggcgctccgtgaggaaccagggaaggacggaccgacggcgtgctggccttgctgcctccccgacgtacacgtgctcctccagctcggactcggaccagatggcgccgtcggtgaagggagagccgcgggcaacggcgccgtcgcctgggttagggttagggatagaggaacagaggaggaggcctcgtgccgaattcggcacgagtattcttgggccat

SEQ ID NO: 66615 - DNA, 176 bp, Triticum aestivum
  Clone ID: PAT_TA_66615
gagggaatgcactaattttcatagcacgatataaatattacaagcatgcacgcagcacgcgtacaaatttacattttacacccaccctcgcatgtatacctctcgcacgctcacgtttcccacgacgacgggtaccatgcacaggacgacgatgctcggatcggatcggatcgatt

SEQ ID NO: 66616 - DNA, 312 bp, Triticum aestivum
  Clone ID: PAT_TA_66616
gaattcggcacgagaaaacgcgaagaaaaggtaaagcacaaataacgcgcagcggtgggagagccatggagatgggcggcgacgagatgatgatgacctcgggcgccacgggccgtatcgtgcccgtcttccgctccgagctctcccgccgcgcgctgctccgcctggccgtcgcgctccactcgctcttcctatgactgctcctcctcgtcggccgccgccgccgacccgacgccgcgagcccggcggagcccggccgtctgtggaaggccagtagcaggcgcagggccgctgaggaggaggacgtgcgcc

SEQ ID NO: 66617 - DNA, 647 bp, Triticum aestivum
  Clone ID: PAT_TA_66617
gaattcggcacgagaactgcttgtgctggtgtctggtcttctgcctaatcctaagctcgaaacctcggtattgccgatatgtcttaatacgggcgctcttatgttcacggtgccatccggtctctgcgcagccatcagcacacgcgtttccaacgaacttggtgctggtaggcctcaggtagcgaggctggcaactagagtggtcatatgcatggccatgtttgcaggctcagtgatctccatcacaatgattttgctacgcaaatcttggggttacatgtacagcaacgaggaggaagtcgtgacatacattgccaggatgatacctgtccttggcgtatctttcttcattgatggaatccacacttctctttcaggtgtgctatatggatgtggtgagcagaagattggtgcacgggtcaatctcgccgcattctacttggcaggcatccccttggccgtgttgcttgcattcgtcctgcatttgaatggaatggggctttggcttggcatcgtttgcggcagcctcactaagcttgtgttgcttgtgtggatccgagtttctataaactgggagaatgagtctattaaggcaaaagacatggtgttaggaacttctcttctggttgcatgaagaacatttcggc

SEQ ID NO: 66618 - DNA, 654 bp, Triticum aestivum
  Clone ID: PAT_TA_66618
gaattcggcacgagcgccgccagcagctgggcaaaggctccacaaaccctaaccctagctccaagcttagcttccatcttctcgatctagctagagccatggcgccgaccaagggcgaggggccggccatcggcatcgacctcggcaccacctactcgtgcgtcggcgtgtggcagcacgaccgggtcgagatcatcgccaacgaccagggcaaccgcaccacgccctcgtacgtcgccttcaccgactcggagcgcctcatcggcgatgccgccaagaaccaggtcgccatgaaccccatcaccaacgacaagggcaggctgagcaaggacgacattgagaagatggtccaggacgagaagatcgcctccaagctgcccgctgacgacaagaagaagatcgaggacgctgtcgacgctgcgatccagtggcttgacgccaaccagcttggtgaggttgacgagttcgaggacaagatgaaggagctggagggcctctgcaaccccatcatcgccaagatgtaccagggcgctggtgctgacatgccgggaggcatggacgaggacgcgccggctgccagcggcggtgctggccccaagatcgaggaggtcgactaagttagtcgctttcatatacgccatttgattcagtcct

SEQ ID NO: 66619 - DNA, 234 bp, Triticum aestivum
  Clone ID: PAT_TA_66619
gaattcggcacgaggccgaaccgccaggacggttgccacgcttggcgaaaaagcttttctgcttcgtcttcctctccgtcgaaccgaataagaataacgcgccatggaaacgaacgaacggctgacctacgcccgtcgctcacattgtgttgatattgattgatatgatgatgacactcatggatgttaggaaccaattacatctcttttttgaatgagcaacgctcactcact

SEQ ID NO: 66620 - DNA, 336 bp, Triticum aestivum
  Clone ID: PAT_TA_66620
gaattcggcacgagcccacactcctcgcccggtcgatcgctcgacaccggccggggctgacagcgagatcgccgccgcaaacggtcaccggttctagggtccctgactgatccttgctgatctcgccggctcggttcctgccagcgcccttcactctggacttctccccggcggcgccgcgcggcgcgatcaccggcgtgccggcgtggatggatgcggccgccctttatgtcccggcgctcctcatcttcaaggtatctacgatagacaacggctgattgagcacctgcaccttgcatcagaaacaagtaattcaagaagaattgcggcgtgaag

SEQ ID NO: 66621 - DNA, 621 bp, Triticum aestivum
  Clone ID: PAT_TA_66621
ctcaaatatgttatgaatgacttcccttgcaggaaaaaaaaagtatgattgacttgcatgcaaagacagacgaacattgacccaaggataacaagtttacttgtggtgcatgcgttcagtgcccgtatagcgtgcacgatcattcaccctgatgcacatatggtctttggtattcctgtgtttgtcctttatgccttagatttatggtttctgatccaaatggaaacacaaaccgaccttagctcagttggtagagcggaggactgtagtcgttgcagataaatccttaggtcactgtttcgaatccggtaggtcggatattatttttgcttctttttgccaagtctcccttcattattttcaaggggctgatattttccttttctcattagattctctaccctagaaaaaaaaaggattacccacggtctccacaattagattttgtacagcaaagtctgcattaggaaaaacagaaaaccagaacacagtgctttgacggacaggaacaactaaccttcttggacactcgagctctagcgccaacttgaaatgtacaccttcccggcctcacaacgtttgcagagtctatcttgactcgagtctcaactcaacgccctc

SEQ ID NO: 66622 - DNA, 618 bp, Triticum aestivum
  unsure (1)..(618): unsure at all n locations
  Clone ID: PAT_TA_66622
tagaattcggcacgagtgttcctcacaacacagtgagcacagagggacttccggagcaagcacaaattaattctcgagtgagcgcgagagagcagctcctccaagatacgtgcggcttctccaagatttatcagatcttcagccgaagaatatgcacgtcttgttgcagcttagccttcttggcctcatactgcttgggacacagcatgcctctggggccgcgggtcctagctcaaactgccgaaggcggtgcggcgatgtcaagataccgtacccatttggcatcgatcccaatatccccaactgctcgctcgcagaagtcttcgacctcagctgcgaggttagagatggctccctcaagcccaagccgttcaaggccatctttgaggtgctggacatctccctgacccacagcaccgccagggtgctcaactacatcgaggctttctgctacaacaactccaccaggagcatggagcatctcggctatcacgagagccaaaacggagggcctagctccgtctaccggctctccgacgtcgagaacaggttcacggtcatcgggtgcaacgccctgngcatcatgtccgacttcgccggcacgggctaccaggggat

SEQ ID NO: 66623 - DNA, 361 bp, Triticum aestivum
  Clone ID: PAT_TA_66623
actccctcttaactttttccaattttctcttctggattatcatttgtccccaaaatacagtgatcatggcggtaatgattgccccaaataatcctagtgcaactcctaggattaagccgatatcagggctgcatgtattgacttccattgttcttcctactcgacaagaacatcggcatcctgcaattgtattgtggtaagggcctcccgaaggacatgggtcgtatgtgactacatgtagggacattcgggcatccaccggggagataggcattgcctttgtatccctgcgagcagttgcacatatagccgtaatcattgacggaatccacgcacacgctgttgctgctgaggcatgcgt

SEQ ID NO: 66624 - DNA, 237 bp, Triticum aestivum
  Clone ID: PAT_TA_66624
ctttaaaccacaaaaacaaaaatcccttgattaacctgaaaaaatacccaaattttacacaaccaccattttgtagggcacacacaccaactcctcatttggactcgccctcacatgcaacatttatcagcccggactactcaatctaaaaacgggaaaaaccaaaaatcgacaacaacacacatgcagcaccatccatcacccatgaagttgccggcctaaaccttgagctgacgg

SEQ ID NO: 66625 - DNA, 563 bp, Triticum aestivum
  Clone ID: PAT_TA_66625
gaattcggcacgagttccctcctccaacaccatggcccccactgtgatggcttcctcggccacctccgtcgcacccttccagggtctcaagtccaccgcgggcctgcccgtcagccgccgctccagcagcgccggcctcggcagcgtcagcaacggcggaaggatcaggtgcatgcaggtgtggccgattgagggcatcaagaagttcgagaccctgtcttacttgccacccctctccacggaggccctcctgaagcaggtcgactacttgatccgctccaagtgggtgccctgcctcgagttcagcaaggttggcttcgttttccgtgagcacaacagctcccccgggtactacgatggtcgatactggacaatgtggaagctgcctatgttcgggtgcaccgacgccacacaggtgctcaacgaggtggaggaggtcaagaaggagtaccctgacgcctatgtccgcgtcatcggcttcgacaacctgcgccaggtgcagtgcgtcagcttcatcgccttcaggccaccgtgttgcgaggagtctggcaaggcctaaacta

SEQ ID NO: 66626 - DNA, 663 bp, Triticum aestivum
  Clone ID: PAT_TA_66626
gatctacggattatgtgatttcactttactgattgtgaattttacagcaataaaacttagtggtacatgtattttggacctcactttccccaaaagtttgcctaaaagatgcaaactctggataactttacaagtgaatacacacacccatcccatgtacactgcttgcaaaatagctaaaagtaagcttggagatgaactccataacggcgagagcagttcttcactggatagagcacgactcggctcgaagttgaggcttctggctgtcgatctttgacaagttacagttgccgcgagtgcaatatttacaggtccctgaactcttcttcgcggtggtccaatcatctgggaccgttaggaaatacttggccatgaacttcctgaaccttttcttgtactccctgggtgaaatcactgtcggcgactcattcttcggcactacgagagaagttttcgcccatgtctccagttgcttgtcccatgtgtattgcctcaggtaatcgatgatgccaagtacaaattcatggttttgttcatcgactcccactagtagagagtaatccataacattaactgacgtgagaaaagatgtatcgttccagatcgcccgctgcaagagatgttttgttcttccaccaatatagattggagaaacacgca

SEQ ID NO: 66627 - DNA, 499 bp, Triticum aestivum
  Clone ID: PAT_TA_66627
gaattcggcacgagctcgagcccctccccggtcctccgcatctcgccaccaacctccccccgatccccaacccccatgatccgcaggaggcgcgggcacgccgccgcctagggtttccactccccgccccccccgatggagtcgctgccgcggaagcgcaagggcgcgcgctccctcgccggctccctccacgacgcctccgcggaccgcaagcggacctgccgggagcggaagccgcgccccgacaagaagaaaaagaagccctccaccgccggcgatgacgccgccaccgcctccggccggggcggcgtggtcatgacggcgccgccggccagcggccgggccgccccggacagccccggaagggggctcaagcgcaaggtcggctgcatcgagtccgccacccggataggccgcatgaagcgcctcgaggccgagtacgagctcggcgacgagatcggccagggcaagttcggctccgtccggatctgccgcgcca

SEQ ID NO: 66628 - DNA, 532 bp, Triticum aestivum
  Clone ID: PAT_TA_66628
gaattcggcacgagagttcatctcactgaggtcgcaggcagccccagccaccagcgaaatggccgcgtcggcgctgcaccagacgaccagcttcctcggcaccgccccgcggcgtgatgacctcgtccgcagcgtcggcgacttcggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacgggtgggacaccgccggattgtcggctgacccagagaccttcgccaagaaccgggagctggaggtgatccactcacggtgggcgatgctcggcgccctggggtgcgtgttcccggagatcctgtccaagaacggcatcaagttcggcgaggccgtgtggttcaaggccggtgcccagatcttctccgagggcggcctcgactacctgggcaaccccaacctggtgcacgcgcagagcatcctcgccatc

SEQ ID NO: 66629 - DNA, 579 bp, Triticum aestivum
  Clone ID: PAT_TA_66629
gaattcggcacgagcaccagttcatctcactgagctcgcaggcagccccagccaccagcgaaatggccgcgtcggcgctgcaccagacgaccagcttcctcggcaccgccccgcggcgtgatgacctcgtccgcagcgtcggcgacttcggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacgggtgggacaccgccggattgtcggctgacccagagaccttcgccaagaaccgggagctggaggtgatccactcacggtgggcgatgctcggcgccctggggtgcgtgttcccggagatcctgtccaagaacggcatcaagttcggcgaggccgtgtggttcaaggccggtgcccagatcttctccgagggcggcctcgactacctgggcaaccccaacctggtgcacgcgcagagcatcctcgccatctgggcggttcaggtggtgctcatgggcttcatcgagggttacc

SEQ ID NO: 66630 - DNA, 378 bp, Triticum aestivum
  Clone ID: PAT_TA_66630
aaaaaaggaacctggaaattggaagggggagccccttacaaaacatccccaattcatggggggacaataaaaagcgggcctgacaagttcctacagcaaaccaggcaaattataaaaccatccctgggcccatacccccaaaaaaattaaaacccggaccaccacccccaaaatcccccccccatccaacccagtggaaaggtcctaccggaaccccaaaaggaaaaaccaaccatgggccccggtctagttttaaaacaaaaagggcaaaggccgcataattcagggaaacagggttccggaaaaaccaagccatcctaagtggattacccagtttgaggccaaaaaaacccccggaggggcctgccaaaagaggcc

SEQ ID NO: 66631 - DNA, 483 bp, Triticum aestivum
  Clone ID: PAT_TA_66631
aaaacaaaaaacccattggggaaaacaaacataataggaatccattacaatcactggtttttacaaataagggataaaactcaaggacaatccggaaggatcagagtttacatataggaaacaaatttgttttttggcacaaactttttttccttagcggggccaactaaatatcaccatgggtaaacaggccaaaatttttttggggcttgggcccccggccataataattggctacttctttttacatgggaactaggggggcgaataacacaaaaccataccctaaacaaaacgctgggacaaagcacatttaaaatgttttgggaaagggcataaggctcctgtcatgccgccttatgggttgggcttaaggggggttttcggccccagtccaagccagggggggttctaaaactcctttttgacgggggtggcataaaaaggaaaaccttgatatggggcctttgaatgcaaacaatc

SEQ ID NO: 66632 - DNA, 600 bp, Triticum aestivum
  Clone ID: PAT_TA_66632
gattcggcacgagaccagttcatctcacggagctcgcaggcagccccagccaccagcgaaatggccgcgtcggcgctgcaccagacgaccagcttcctcgtccgcagcgtcggcgactttggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacgggtgggacaccgccggattgtctgctgaccccgagacgttcgccaagaacagggagctggaggtgatccactcgcggtgggcgatgctcggcgccctcgggtgcgtgttcccggagatcctgtccaagaacggcatcaagttcggcgaggccgtgtggttcaaggccggcgcccagatcttctccgagggcggcctcgactacctgggcaaccccaacctggtgcacgcgcagagcatcctcgccatctgggcggtgcaggtggtgctcatgggcttcatcgagggctaccgtgttggtggcgggcccctcggcgagggcctcgacatcatctacccgggc

SEQ ID NO: 66633 - DNA, 644 bp, Triticum aestivum
  Clone ID: PAT_TA_66633
agaattcggcacgaggccacaacagccggggtctcggcctggaggcgaagaaggcgctgcagtaagcggccgagtcgaggagctgtctgcgggcgagggccgacggcggacgagggttagcacaatttccagagtatgcacatcactactaggagggatacaagtactacaggaactatcactgcgatgaccatggtagatttggtgctcttcttatttgaacagtacgtatctttgacttttgagcatacgggattgccttctaacctagtggcaccattacagaacatatagaaaaaaaatgaacacataagatgttagctacaacagctctacaaaattatgattagaagatgcctccattttctaacacgactaacatgctaaacatgtatgcactctgaacgaataaacttcatggtttctcatctatgcattctaaaagaagaaacttcatggtttgtaaatcatgtgcagttactaaatgtccttatctatttctcatattgaatgccgatagatgataaagccttatagttatactagtacacgtaactgatggaatgtttagatcaatgcaatgctctgcgcaagtgttgctgcacacacttcttgtggcacccgaattggccatcacaacttcg

SEQ ID NO: 66634 - DNA, 467 bp, Triticum aestivum
  Clone ID: PAT_TA_66634
agttcagtaaacaaaagtttgtcatttctctatttaaattttcagttgtacaaccaaattccttcttcataccatgtaaattaaattatacagagcaagtgatcttcttttgcactacatgtatgcttctgttcttcatccataatccagtggtgtggtgaacctacccactacagcacaatgtcatattctgcaatgtcttaactatgaacaaggccatatcattctactattatttaaaccgtctctttatttgccaatctgaaatgttataaattgacagcacactaaccattgatacttatgagttcttgatctgtaatccaatggtgtcgtgaagctgccaactccttcacaatgtcatttcctgccatgtcttgacctgaacaataccatattgtgttaatgcaattttaaactgtgtcactttattccattttgttgaaatcaatgatagcaccccaaac

SEQ ID NO: 66635 - DNA, 508 bp, Triticum aestivum
  Clone ID: PAT_TA_66635
aaaaattcggcacgagatgaatagatctggggtgtgactgatatatgattcaatgatataaatgctatatattttgtatccgatatgcaaggttacctgaatctcctcgcatattttttttgaaggaagagtgaacgcagtcctgaatgcagtcaataggcgcactccatttagaacaatggaagcatcattaaattaacttggttgacagatggttcaagctgctcgtcgtctaatggaaagcttggcctaataaaaatatctgggaggtagctatggtagtctcattgtaatttctactctaccatcaaggttctccatgatgattgagatgaccgtgactactttacaagcttttggaagctgtgacagaaggcatggaaaccatgataagtcaaagcatataaacctcaaaattatgcagctgatcatatcatattgccactggaatgaaattgtctattctaaagtgttctacactcaagctatcatctgcacttcatttatt

SEQ ID NO: 66636 - DNA, 378 bp, Triticum aestivum
  Clone ID: PAT_TA_66636
actggggggacattattacacattgataacatgcatcgagcaatttatttaaacctgacgaattcggtgtatctggcaatgaccatgcttacgtgaagtacaattctcagggtttacacaggtctcagtatccgtgatcctatttccattggataattttatttagcagcttatgcggtgagctcctcctccttgcgggtctagacgaccatgcacatcttgagacaacatgatcaccactggaatgtccttcaatgaagatgaccgtcgtccaggaatctctggacggactgctcgatttccacgcatacaaaattgtgtgatgatcaaattcacgcccacctgcggcaggagtagggcaggtcgatcccctcctcc

SEQ ID NO: 66637 - DNA, 606 bp, Triticum aestivum
  Clone ID: PAT_TA_66637
gaattcggcacgaggtcagaccggccgaggagccagccacgccacaccacagggaagacaagagaagcagaagcagaggtgtggggaggagagccacagggaagaagagaagccaggagcggcggccgccctcgccctgccccatgcgatgttggccaggtcgccggcgctgccctcccccttcctgacggccactgaaactgccgccgcttcctcggccttcttccaaccctgccatctctcgacatctccaagtgtcaccttttccaagaagacgcatggaacaagattaactgtccagccaaacgctcggcatggaaacactaaagctgcaagtaggattcaaggaaaatggcgaacactgtcatctgacccagctcaggccgccgctgtggtggatgccgccggtaacagcaagacatgggtagagtgcaagcagatactcacaacactgaatttctccaccgaagatgccgagaagatgctgaagaaggcgttcggatggctccattcgccatactggaccgaggagagaaagaaggaggttccgagcacggaggtggtaagcggagtgctggactacgtcaggggcctcgggctatctga

SEQ ID NO: 66638 - DNA, 612 bp, Triticum aestivum
  Clone ID: PAT_TA_66638
ccctcccgccaccgcctcagatgccaagccgccgcctcctgcttctcgtcgtccagctctagcggcggcgggcgcgcggggtcgtcgtgggcgacggactacgacctgtacgagctgctgggggtggagccctcgtcgccgcaggccgacatcaaggccgcctaccgggcgctgcagaagcgctgccacccggacgtcgccgccggcaacggagacgcctcggccggcccctcctcccacgacatggccgtggtgctcaacgaggtgtacgcgctgctctccgacccggcgcagcgccgggcctacgaccgggagcacgcgcgccggtccgagttccagggctacacgggccgcccgctctactcgtcgtggcgcggcggggacgccgagacgcgcgccgtgttcgtcgacgaggtggcctgcgtcggctgcctcaagtgcgcgctccacgccggccaaaccttcgccatcgagtccgtgcacggccgcgcccgcgtcgtcgcccagtgggccgaccccgaggaccgcatcgccgacgccgtccagacctgccccgtcgactgcatctcgtatgtggaacggtcggacctggcggcgctcgagttcctcatg

SEQ ID NO: 66639 - DNA, 468 bp, Triticum aestivum
  Clone ID: PAT_TA_66639
aaccatgaagagcaaatatgccttgtttaatctgaaaaaatggccaaatattacacaaacaccatattgtattgtacacacaccaactccttatctcgactcaccctcacatgcaacatttatcattccggactactcaatttcaaaacgggaagaagcaaagatcgacgacgacacacatgcagcagcatccatcaaccatgaagttgtcggcctatagcttgaactgacggcgctcacttgccggggactaagttggtggcgaaggcccaggcgttgttgttgacggggtcggctatgtggtcggcgaggttctcgagggggcccttgccggtgactatggcctgcacaaataagccgaacatggagaacatggcgaggcggccgttcttgatctccttcaccttgagctccgcgaaggcctcggggtcctcggcgaggcccagggggtcgaatctgccgccgggg

SEQ ID NO: 66640 - DNA, 651 bp, Triticum aestivum
  Clone ID: PAT_TA_66640
gaattcggcacgagaattctcttacttgggttgaaatactacgccaggttctggttgcttcaggttttggttcagatcatcatatgctgaatcggaatttctttaacaaggagaaaaatcaaatggttaagtatgggttacgtcctcgtacactgaaaggtgaattgtttgcactattgtctaagaaaggaagcggtgggttaaaggttgctgaacttgccaaatcaccacagattattggtcttaatctctctggcgcatcagaagtagagcagcttattttctccactctctctagtgacatcacattgtttgagaagattgcgccttctgcatatcgtctccgtgttgatcctcggattaaaggaaaagaagattctagatcagatactgaggattctggaactgttgatgatgatggggatgctagcagcagtggtgatgaatctgatggtccacaagagagttatcctgagcatgaaagtagaattatcaggtggagacagaaaaacgtacataaaaatatgaataaatgcagtgaaattgatgaaagttattccggagaacgatggctactggggttgatggaaggcgagtactcagacctaagcatcgatgagaagctggattgcttggttgctttgatagatg

SEQ ID NO: 66641 - DNA, 458 bp, Triticum aestivum
  Clone ID: PAT_TA_66641
ggggttttttttttttttttttttttttttttttttttttttggagcaatgcacacaaccatttttatgggattattaaaaaaaatcttataaaaaaaatacataaataaacccaaaatcaccttcctcgaaaaattgccgccctactacaaaattgatgatgggccctgaccgggcgtaacaaacaccaaaaaaatggggggcctaaccaagccgcccgccatttagccgaaagcaccaaccggtcaagcacaccttaaaggggcaccaaatgcacatgctgaaaaatttgccgccaccttttttcgaagccccatttttaggatcaaccaaggcactgatcttattaaacccttttgccgttgaacccaccgtaaggttaaacagggcctgcctcttgcacgcccccattaaagggtatcaagcatttagcccccgttgaaccctgccgccaaaac

SEQ ID NO: 66642 - DNA, 431 bp, Triticum aestivum
  Clone ID: PAT_TA_66642
ggaggagtaaaaacactaggcagggggggaactcagaaacaccccaacaagacgaaggcgggggctgcgatcattcagttgaccccgcacccaaagaggcaaacgagggagcctcgtaaaaggcccaaaaacctgaaacaagggcctgtaatacacaatagatggcaacgggagagtttccaccgggtattgttactgcatgcataaacagtcatgccagggtaatactccatcaaacatggcgttttttactttttaaaggaaaacagtttttgcgcaaaaggaaaaactcctgccccgtttaaagccttaaactgcttccctgcaacaccaaaataggcaatgggctttcatgctccgagacgtcttcagggacttcatagcttcccggaaggcagcctagatatcagggtccactggcaccagcttga

SEQ ID NO: 66643 - DNA, 606 bp, Triticum aestivum
  Clone ID: PAT_TA_66643
gaattcggcacgagatcctcctctcctccgataatacaataccatggcccccgccgtgatggcttcgtcggctaccaccgtcgcacccttccaggggctcaagtccacagccagtctgcccgtcagccgccgctccagcggcagcctcggccgcgtcagcaatggcggaaggatcaggtgcatgcaggtgtggccgattgagggtatcaagaagtttgagaccctgtcttacttgccacccctctccacagaggccctcctaaagcaggtagactacctgatccgctccaagtgggtgccctgcctcgagttcagcaaggttggcttcgtcttccgtgagcacaacagctctcccgggtactacgacggtcgatactggacaatgtggaagctgcctatgttcgggtgcaccgacgccacgcaggtgctcaacgaggtggaggaggtcaagaaggagtaccctgatgcctatgtccgtgtcatcggcttcgacaacctgcgccaggtgcagtgcgtcagcttcatcgccttcaggccaccaggttgcgaggagtccggcaaggcctaaactacaagttgaaacaatggcctatgtatgatggtcat

SEQ ID NO: 66644 - DNA, 381 bp, Triticum aestivum
  Clone ID: PAT_TA_66644
cagcgaaaggcttttaaaaaagcctgggcttccaactatcgttcatcacctgagagcagcttgatgaaccacataaaaatctcaaaagaatctatacggatttaaaaaaaatacatcaatctactactgattatggcatcacgcctgcacggtgcttccctccgatgccacctatagcatggacaaagggtcggaaaccacactgttatcagggacaacattcacaaagcgctcactggaaccattgactgacgtcttggacaggactgaaactgtagtacagactgagcatcctttacccaactaacgccatgtttttcattcctggttgagatcggattgtctcaagagattgagtactttatctaggtgagcgacatt

SEQ ID NO: 66645 - DNA, 597 bp, Triticum aestivum
  Clone ID: PAT_TA_66645
aaattcggcacgaggtggggcggaggctgggccggttcttccagtcacaggtcaggtcttctaagcaccctccccttccccatgttccatgtacgtatagggggctgtagagttgtggtgttccactttgtccacgcactactttttcgcccatctgatagcttcgtccaaatcgagatttccctggtgaagatggcgcagatggaggatgtagatgccgcgtcccctctgccagcgatggcgttggaccctgatctccacgcagcgattcgagctcctgttactgttatgctgggtccgtcggccctcctcctccgggaactcgattcttccggacagagtcttctcggtgcggaggagcttcgtcttcttagagatgctctcagggaagtatgcatccccctgaagagtatgtccgaagacgacggtgctagctttatggcccggtggtggatgaagatagttcgggagctttgttatgatacgcaggattacctcaacttcgtccaaagtgctcgagatcgtcctgaattttcagagttacctgatcgtgccaaggctgtttattcaggcttacttgctcgcgccattgatgcg

SEQ ID NO: 66646 - DNA, 572 bp, Triticum aestivum
  Clone ID: PAT_TA_66646
agggtggtatcatcatatcatgccgtcatataccgagactggaagtataataaaacaccgagaactacatgacatcaaatccatgacaacagacacgacaccgacaaagtagctgaggcaaaaaaagttttgttgttctaaaccagaatacaattgaggagacctagagacagataatttatgggtcggtgaaagaggctggggactaactgagacaccagaatacctacggatatcacaaagagatgagaaatggtaaacctgttaacattgtttagtactcaaacaatcccaaaatgcaaaatggtattgagaaaactatcatggcagatcttacacaatgctaatttatccactaagattctgccagaaataagcatgtcttacagattcagtagctgtgttgcatggaaaactatggagcattcatggttgtatataattttcacaagctgcgattattttgtcacacctccagtgacaaagctataaactatctaatggaccaaaatgaaacttttgacattctgcataccatttttccctactataatgtgatgaagctctgaact

SEQ ID NO: 66647 - DNA, 157 bp, Triticum aestivum
  Clone ID: PAT_TA_66647
aaaggggccaaactgacgtgcattaacggaactacatacaccatctcctgcttatcaaacacggccttggaccattcatgcacaatatgcacctattaaaagcacatttttctatacatatgtcacgccggcaaaacttatgcaacatcggcataaa

SEQ ID NO: 66648 - DNA, 669 bp, Triticum aestivum
  Clone ID: PAT_TA_66648
gaattcggcacgagcgcaaaggagggggaagcaaaagcagagccgtcgtcgcctccgaaccccacaccgccgcatctcagttccaatccatcccgccgccgccgcgccgcgacgcgcctccctcggccccgtggatcgcggctccggtcccgagtctcctctccgctccgccctccgggggctcggtctggtccgcccttgcgtgggcgggctctcctggggttttggcggtggctggcatgctctccggcgacctggtgcggtgaacccgatgctgcgcctactgtcggtcggcgagaggctgttgacaaccggaacaaataggcgggcagcccgtttgtcccagttgagtcacgccagtggttactacgcaacagtgagggacaatggcttgtcaacaaggcgaaatatcccgcccgtcttctctagaatgttctcacattacaaggacattgtcagaaagaaagttgaggatcacaactatagaaaaaggttttccagaggctatggttccctctctggggcagtgtcaaattcatctgcaagacagcaagcccaattgacgttgaagcggcccagtcatatatactcgtatagtggtccccgattcccgttgctgagtcgagcagcctgtgcgctaactctgtccttaacgagatcgcatatcat

SEQ ID NO: 66649 - DNA, 311 bp, Triticum aestivum
  Clone ID: PAT_TA_66649
cagaattcggcacgagctctcctcctccccaagctcgcacctaacacatccatgctacggtcgacgcggcgtccatcctccggggcgtcgaagactgtgcgaggacgacgagcggcggcgtgggaggaggcagctcatgccatggacaaggacgatctacaaaacagcgatccaacaatggatgaggaagaatcttctgatggatctttttcaacgcgcttttcagctccccgattgcgtgaggttgcagacaatgagctgaatgataaaaagagagcattgctagagaagtccagttttgggtcgttgat

SEQ ID NO: 66650 - DNA, 605 bp, Triticum aestivum
  Clone ID: PAT_TA_66650
gaattcggcacgagatctcgtgatcctccggggcctcttgcagcaccagcttcaaatcatctgtctctgcagagctcagcgttcttggattcaaccattcctagcatcaaaagttctagtacacgaaatggaggttctcgcgcattggatacaatgacaacacagttggccaccaaagagcggtcgaggtcaccatatttgagtaatctatcatccgagtccatgacaggcttatcactgccttatgtaagaagatcttcagagaggcttcaagatggaggccacatggatgagagtaatgatctgcggtcaaccaggcggtttcctcaaatgcacacagaaaaaaactatgttgatatgccttatagggatgctgctgctcatagagattcacataataacaatgtcccgaatttccagagacctcttctaagaaaacaagtaatgtcaaggccttctgcaagtagccgtgacaggtttgatgatagtcaagtaccttctaatgatgtatctagatatacagatactctggctactctacatgatgcactttctgagggtctcaatcctagttctgactgggtagcaagagtctctgcttttga

SEQ ID NO: 66651 - DNA, 240 bp, Triticum aestivum
  Clone ID: PAT_TA_66651
gagtaaacgctattatatttctttacggagggagtacaaaattaaccacatggtctccgcataagacgtacatggcaggagttatattatcttttcgtgctcaaaaacatacttaaatctagtatcttagcttgaatatggaagatcatgacatggaacactcaatatggcacgaatcatcactaaaatctctcaatgcacctctggctcgaaccaaagaaacttgttttcacaccttcc

SEQ ID NO: 66652 - DNA, 323 bp, Triticum aestivum
  Clone ID: PAT_TA_66652
ctggagggatgccttcgaacagacaccttttcttcccatctcttccagatgtatatatacttgagaatcaatggaaaccaggacggattgacctttcactttcaatctcgttttactctaacacgttatcacgcacgttgctctccaatagagcaggaacctgccggcgaactcgctggaactgaacaaaatcaacaggcaaaaggtgagacagaagaacaaatgcctgggaatcttctctccttgtttcttcgcctccttcgcgatgacggccgttgccgccgtttcgtcgtttgccgtagtcatcatggtgtgggcggact

SEQ ID NO: 66653 - DNA, 172 bp, Triticum aestivum
  Clone ID: PAT_TA_66653
tccaaaaaattcgccacgagctcagacccgatcgacgcgtccagctcgccggtcagattcttccacgcggtcttccgtgtgttcagtgttctgctccctcccgcgcctgccgatggcccctggacgcctacgatggtcggcgaccgcgctcgtctttctcttccttgccgcc

SEQ ID NO: 66654 - DNA, 231 bp, Triticum aestivum
  Clone ID: PAT_TA_66654
aacagaagaacttagataccttgattaatctgaaaaaatacccaaatattacacaaacaccatcttgtattgtacacacaccaactcctcatctcgaatctccctaacatgcaacatctatcagtccgaactactcaatctcaaaacgggaacaatcaaagatcgacaactactcacatgcagcagcatccatcaaccatgaagttttcggcctataggttgagctgactg

SEQ ID NO: 66655 - DNA, 694 bp, Triticum aestivum
  unsure (1)..(694): unsure at all n locations
  Clone ID: PAT_TA_66655
gaattcggcacgaggcggtgcagcgggggggcaggtgccgctggagaggatggcggcgggggtggtggagatattctcgcaggaccggagggcgcgcgcgcaggacgtcttcctccccttccgccgcctcttcggcagcaaaaccgtggagacggtggttctggagggggacagcgtcgcggaggcgctggccaggtacgcggccgagtccggcgtccgcaacctggtgctcggatccgcaaccttgagctggttccggaggatattatggctccaagatttgcccaatactgtcttaaaagccatgccatgttcttgcaatgtatttatcgtgtcccggcatggattaactataaaacttgcgaatcagacacaaacagacaactcaaatacttgctcaaagatccagtcagttagtcatagagcatttgccctacaactgaggagccagttgcaagacaaacaatcattgcacgaccttcctgatgtcaacacaccaaaatcttctggagtttctagttctgactcatgctctcaagcccgcagttctcttagcaattctacgagtgctgctcanagttcagaaagtcatagaagacgtctgtttggaagcttatgtcgaaagacaccagggcgaacaggggacacagattttgacgccattggccagttgaaggaatttcctcatgtcccc

SEQ ID NO: 66656 - DNA, 329 bp, Triticum aestivum
  Clone ID: PAT_TA_66656
gggaaggctttaagttgaactattgaaaccataccaccatattttcatttagtttctttaaaaatctaaaggtctaaaaggatggtccatgtgaaaagctgggaatccacaacaaaaaactaaactaactttcaaacaaatatttcagggttggaacccacaaaaaaccagcccaaatctcccattgtaggggaggtccatgtccttaatcatctccgaaaaggacttctgggcattcttatgtaggtgggacacaacaatccttgccgggagctgtaaaaaaaccacacaggcaccttccttcaccttgcccttggggaggggggggg

SEQ ID NO: 66657 - DNA, 512 bp, Triticum aestivum
  Clone ID: PAT_TA_66657
tatataaatccatcacgaacaaatgtggttccactgatagagtactcatcagttattggtctctggtgcacagaccgcacaacacataccttagacactgacatcatgtttgtcgtaagagtgccagttttgtcactgcaaatgaccgttgtgcatcctaatgtctccacagagggcaaagatcttacgatggcattcaagcgagccattctcttggtaccaagagctaagcacgttgttactacagctgggagaccttctgggatagctgcaacagcaagggcaactgctaccttaaaataatgaatggcacccctaagaaagccaccatgagaaggatctcggaaatggccaatatttacaacccaaacaagaagacagatccctgctataacctttgccagaaatgtgccaaattcgtccagttttttcttcagtggagtcgcttcatcctctgttctcagcattgcatcacgtatacttcctattgcagtattagaaccaacaccaat

SEQ ID NO: 66658 - DNA, 311 bp, Triticum aestivum
  Clone ID: PAT_TA_66658
ccgccaaggaaataactccttgccggtgacaaagggcccaacatagcaccagttcaccgagaaaaatcactaggacctatctcatttttcaattttaatacgaagggtttgcagcgacgttctaaacctgggcggaaaagttatctacggggttcagcccctaacgtaggatggggagagcaaaaccgacgggagttagtcaaacagatagacggcaaaacctatacaattgccagctggtacatacccgcaaaccatcttgggtggggtggcggccccggcggaattccttcacacctggggaggagggg

SEQ ID NO: 66659 - DNA, 706 bp, Triticum aestivum
  Clone ID: PAT_TA_66659
gaaatggagagagatatattccacagaccagagtgcctagccaaattgccggccaccaagtcacgtacaaaggtaggagctgtgccggttatacatacggcttggggttcaacctccatcaaacagcacatagacggtactgaagaaaacactgttttacaggagagggagctaaacagtctctcgggggtaaaaagaaacagcgttgaacaacagcctgagtgagctgagaagatgtcacggtaagctctcagtctcaggtatcaaagtcttcgcatcgtcgccctcgctgagattgtgagaagaaatgccagcatttgaactcgaagcacgcttctgaaacatgagtaatggttcaaatacagcacaatggtgctttcatcacaaggcaggtagaatagccgttcgagaaaaacatgacagcactgttttcttttcctcaaagaattaaaggtgcagagacagtttaatcaggtccttactcatattcaaagctcaattcagaaaatgggacatggaaaatttggtgtttaacaatcaatccatgattcctactctgactgttccttagttcttcttatgttaatttgtctgctatataaaggtgtatgatgtggaacatttttaagtacctatctgttacattacttgacagcaaacaaataacttttaattccatgcacagctagcacagctatgctcgatt

SEQ ID NO: 66660 - DNA, 695 bp, Triticum aestivum
  Clone ID: PAT_TA_66660
gaattcggcacgaggcgacgccgagtcgacgctagttccaatcccatgcgcggcgccgactgcgctcctctctccactcgccgttcccccaaaatgaaactctcgacccaaccactgccggggtcgttcaatttctcagagataaatctgacaaagcaaccactatgggatacatgagatgtgcagtgaggtgatgtatgtgtggtgtagagatgggtggtagaggagtcgtcagatgtacattcaattatattgcgttcatgtcagagctatgagacagattaaggcatgagtcgtgatattgaaattgcggatacttagtaaattgaagggcacttcaagctattcaggaattctgttgggtacaaatggtctccatcttctgaattcgacattgctttgcacactgtatctgaacttcgataggttacctcctcaccttctattctacccattatgtaagaatttacctcatcgaccatctcatttcttggacataagatggctctctcttctaagtatattcggttcatgtagttcgtccataggtttggataggtgctgttgatgattgtttctaattggttctctcctttttgcagtagtaagtcctccagtatatttacccatgcctcttcttctttatttccaactaatccatctccaatatttagaatccagtctgcaatatctgc

SEQ ID NO: 66661 - DNA, 386 bp, Triticum aestivum
  Clone ID: PAT_TA_66661
gaattcggcacgagcttgccctgccctaccgggccgaccagagcatccccgggcctcctcccacctcggtgccgccgccgcccatggccgtcgccaagagcaaggcgggcaagcacgccgccccgctgctcggcaagtacgagctctgccgcctcctcggccgctgcaccttctccaaggtctaccacgcgcgctccctcgtaggcggctaggccgtggccatcaaggtgctcgacaagcccgagctggccgccacggccggcatggacgcgcgcgtgctcggtgaggtctccgccatgcgccgcctgcgccaccctaacgtgctgcgcctccacgaggtgctcgccaagcgctcaatggtctacctcgtcatggatctagtcccc

SEQ ID NO: 66662 - DNA, 365 bp, Triticum aestivum
  Clone ID: PAT_TA_66662
gaattcggcacgagctcatccccttttcggggtcctatatggccttctcaccgaccaccacaaccacagcaccacgaccagaaggaacatacacctatgtccacgacagacactgaccagatgacttagttcaaaaactctacctcttgcgagtgaacatcaccatactccggaccatcaaaagcgcgccccagaccatatggtacggccctgaccgtcccaagtacctgagcccgttctccgagcagaccccgtcgtacctgaccggcgagttccccggcgactacgggtgggacaccgccggattgtcggctgacccagagaccttcgccaagaaccgggagctggaggtgatccactcacgg

SEQ ID NO: 66663 - DNA, 624 bp, Triticum aestivum
  Clone ID: PAT_TA_66663
gaattcggcgcgaggaccaccagcgcctccggcagtcctactgtcaacctcagctcgcccgaagcaaagctagcgagtacgcagcgcgcgatggcggccgcgaccatggcgctctcctccccggcgatggcgggcacacctgtgaaggcctccagggcggcgcccttcggggagggccgcatcaccatgcgcaagacggcgggcaagcccaaggtggcggcgtccagcagcccgtggtacggctccgaccgcgtgctctacctcggcccgctctccggcgacccgccgagctacctcaccggcgagttccccggcgactacggctgggacaccgcgggcctgtcggccgaccccgagaccttcgccaagaaccgggagctggaggtgatccactgccgttgggccatgctcggcgcgctcggctgcgtcttcccggagctgctcgcccgcaacggcgtcaagttcggcgaggccgtgtggttcaaggccggctcccagatcttcagcgagggcggcctcgactacctcggcaaccccagcctggtgcatgcgcagagcatccttgccatctgggcctgccaggtggtgctgatgggcgccgtggagggctaccgcgtggccggc

SEQ ID NO: 66664 - DNA, 561 bp, Triticum aestivum
  Clone ID: PAT_TA_66664
gaattcggcacgagtctcactgagctcgcagggagccccagccaccagcgaaatggccgcgtcggcgctgcaccagacgaccagcttcctcggcaccgccccgcggcgtgatgacctcgtccgcagcgtcggcgacttcggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacgggtgggacaccgccggattgtcggctgacccagagaccttcgccaagaaccgggagctggaggtgatccactcacggtgggcgatgctcggcgccctggggtgcgtgttcccggagatcctgtccaagaacggcatcaagttcggcgaggccgtgtggttcaaggccggtgcccagatcttctccgagggcggcctcgactacctgggcaaccccaacctggtgcacgcgcagagcatcctcgccatctgggcggttcaggtggtgctcatgggcttcatcga

SEQ ID NO: 66665 - DNA, 316 bp, Triticum aestivum
  Clone ID: PAT_TA_66665
ccccacctaacgggttaacccttaattaatccgggagggaaacgggaccggcagttacaaggttggagggacctaacccggggtaaccccttatggggcttataaaaacctttccccggcaaaaagggacctccccggggccgggcttttaagggttccaggggggaaattcctaccaaaaggccggaaaaaaccaccaccttcggttaatcacagcccctctttggattttatccccccgtaaagaatttcccacttttggctccttttttagggttaagggcaatcccccaatcggccgggggggggaagggaa

SEQ ID NO: 66666 - DNA, 585 bp, Triticum aestivum
  Clone ID: PAT_TA_66666
gaattcggcacgagaattgagccgaggaaccggcaatggaagctgctgccgggctcctcgcccctctcccccgaagcaccgccggcggcggcaccaccttccccgtgctctcctccagcaacccgtaccaccattatccccagccccaccaccaccccattttctccggcctcctcagcctcagtctcaggggatgcggcactcgcctcccagccccaccctgccgcgccgccgtgaaggaggacgacgccacgccgcagtggcagctcgacttcctggggcccgaccctcacccgcggtccggcgacgacgaggacgacgacccgctccccgccgcgagcaccgactggtgcgtccgcgcgcgccgctccgcgctgcgctccatcgaggccaggggcctcacgccggcgctccagcgcatggtcaccccgcccaagaagaagaagaagaagaagcagaagaagagggtcctcggcaggaagccccgcaagcacgacgccgacgaggagccgctggatggggacgagttcgacagcgacgaggaggcgagcctggacgacctcgacctccgggtggcgcagttcg

SEQ ID NO: 66667 - DNA, 591 bp, Triticum aestivum
  Clone ID: PAT_TA_66667
gaattcggcacgagcaggagcacaagctagctagctggatattggcatgttattccacgagctaattagttacacacttacttcttggatccttctcaacaattaagctcagtcatctagccggctggtagctaggatcgatggctgagcagcaacagaagggtggtgatgatgaggtgctggaggtggagtgcgcgctggacatgccggaggtggtgcagcggcaggactcgctgtaccgggacgcctcccgggccggcggcgccagccaccacggccacgagcggtggggcaagacgctgcgcctcgcgttccagtgcgtcggcgtgctctacggcgacatcggcacgtcgcccctctacgtctactccagcaccttcaccgccggcgtccggcacaccgacgacctgctcggcgtcctctccctcatcatctacagcttcatactcttcaccatggtcaagtacgtctacatcgccctccgcgccaacgacgacggagacggcggtacgttcgcgctctactctctcatctcgcggcacgccaaggtgagcctggtgccgaaccagcaggcggaggacgagctgcaca

SEQ ID NO: 66668 - DNA, 119 bp, Triticum aestivum
  Clone ID: PAT_TA_66668
ggcgggggtaaatattgtcttatataagcacatacagctataacatttcccaggccattaatttacaggcagttgctaatcatttgctggtcgaacgcatgagatcttcaaaaaatgct

SEQ ID NO: 66669 - DNA, 362 bp, Triticum aestivum
  Clone ID: PAT_TA_66669
ccggaaaaaagggggggggttgcattctttgccggggggtccgttggccttttaattaactaaaaccacccaatttgtagtaaatgggcaaaagctaaagcatttaaaattcgtcccgaaaacctgagggggatcctgaaccatttattacaaaaaccggggccaaaacttgaagtcgtgggacccccaccaaggcatgaaaaacggccacatcaccaaaccctccatggaccctggaagggaggcacatatttctttgtgggggggaggagggaaaaggatcccacacctttctgtaccaagggccccataaatccccactgcttgctgaaagggggggcttttaacgagtaaaaaaaacc

SEQ ID NO: 66670 - DNA, 141 bp, Triticum aestivum
  Clone ID: PAT_TA_66670
gcaaaaagctggttaagttttcaacaagtttggggaacacgtgaatttacagagggaccgtaaccgatctgacgctgcactgaggactgttagatctacctactctacgtgtcgagctccaggggatcgggggaagaggag

SEQ ID NO: 66671 - DNA, 371 bp, Triticum aestivum
  Clone ID: PAT_TA_66671
aaagaaaaggtttatccaaaaagggggggggctcatatagcatatcagcaaaacattttacagtagggccccgcaaaaaaaaactatcgacaaagtccccatattcggaaaaaggatgggatccctttaacaaaggggggcgcccaatcggggatctatggttaacaggactggccccaaaacggggcttttgggtggctcccttgcgggaaaaacaaaaaagttcttaattctggcacttaagggcccccttctcaaacccaatggggggaaatggtttcgaatattcccccacatggggggaaacctttgaaatttcaacttggatgttgctgccgaattgaaatggggaaacaaagcccttcagttgg

SEQ ID NO: 66672 - DNA, 610 bp, Triticum aestivum
  Clone ID: PAT_TA_66672
gaattcggcacgagctgcctcactctttttccccactcttcccctatcctcccccggccgcctctaatccggtgaggcccgcggatcccggcgactcccggcgagaagcccgcgctagatgcgcggtaggagagccccggatggtggtagatggctggatccccacacaagcacaccagggcacggagacgaaccgcgcggccgtctccatgagtggtggctcgccggaggccgggcggccgcatgggtatgaccgggtcgaggcgctcaccgccgatcgcgcgcgcctggaagcggagaacgagaggccctccatgcgcggccgtctccatgagccgcggctcgctggagaccgggcggtggcgtgggtatgacctggtcgagctgctcgtcgccgaccatgcgcgcctggaagcggagaacgaggccctccacgcgcgaccgtctccacgagcggcggctcgccagaggccggtcggcggcgtggttacgtccgggtcgaggcgctcgctgccgaccgctcgctgccgaccgctcgccgtgttttctacaaattgtgcagctcgtgtctgtggaaaaaggcctgcaggcccactttctctactggatc

SEQ ID NO: 66673 - DNA, 418 bp, Triticum aestivum
  Clone ID: PAT_TA_66673
ggacaaataaatcaggggaaacctgcctgacctattttatgatatatttttaggaccccgataactggcaaacgttcggcctcgggagggaccagaccgaacgactcgttcgtgctggagtagggaaggacccaacgaactcgttcgggggaaaagaacctccagcccgaacgcctaacctcccctaacgatcaacttgtcgttacacaaaaacccccgatccagtaaaaaaggggggcctgcaggcctttttccacagacacgagctgcacaatttgaaaaaaacacggcgagcggtcggcagcaagcggtcggcaacgagcgcctcaacccggacgtaaccaccccgccgaccggcctttggcgagccgccgctcggggagacggccgcccgtggagggcctcgttctccgtttcc

SEQ ID NO: 66674 - DNA, 520 bp, Triticum aestivum
  Clone ID: PAT_TA_66674
gaattcggcacgaggttcatctcactgagctcgcaggcagccccagccaccagcgaaatggccgcgtcggcgctgcaccagacgaccagcttcctcggcaccgcaccgcggcgcgatgacctcgtccgcagcgtcggcgacttcggcggccgcatcaccatgcgccggaccgtcaagagtgcgccccagagcatctggtacggccctgaccgtcccaagtacctgggcccgttctccgagcagactccatcgtacctgaccggcgagttccccggcgactacgggtgggacaccgcggggctgtcggctgacccagagaccttcgccaagaaccgggagctggaggtgatccactcacggtgggcgatgctcggcgccctggggtgcgtgttcccggagatcctgtccaagaacggcatcaagttcggcgaggccgtgtggttcaaggccggcgcccagatcttctccgagggcggcctcgactacctgggcaaccccaacctggtgcacgcgcagagca

SEQ ID NO: 66675 - DNA, 679 bp, Triticum aestivum
  Clone ID: PAT_TA_66675
cgaactaaggcatagcataagggagttcatcatcctatatgacatccgaccgcacaaattaggcatgttctactagttaaaatagggatctcacagcactcgaagatgacatagggatcgagacggatttgctcggcgccgtagctgtaggtgttggatgcggcatcagtctcctcctgttcatttgggggcaggttgtgcgagggcacggaccacccatgtctgctccaccacgtgtgggtttgtggatgccggatagcccggacgtttgggctgtccgcccggtcgtttagagcatctacaacggatttagcaaatccggtccctcaaacgcctgtggacgcgctggggctcgtccgccgacactgaccggtcacgcatcaaatttctcttctcacggccgggcacctcaattagcacacctcaaatccatacaaactcatgcaactacatattaggacatgccatcagactacaaaaaaaaaatggcatgtttgacctacatactagctattgagaagatcatccacgactacccttgcccttcccggcgcccttgctgtccttctcacggaagtagcggtcgaagacgcagtatggatcgagccggatctgcctgtcaccggagcggtccgacccatcgtggtcctccttctcctccttgggggcagtctggcta

SEQ ID NO: 66676 - DNA, 406 bp, Triticum aestivum
  Clone ID: PAT_TA_66676
ctaattccttctataaccaaaaagagctaccatatattccttggctgtgtaatttacaggaggcaactaagaagatcacatttttgcatcttgctggccggacgctcaacaaatttttaaaaacgccttttgccgtgtacagagctccctcgtctgcgtaacccaatctgaacgtacgttgcaagacagtcggaaagaccatttaagcgccgtgcctgagcaaaccgggcggccgccggttggggccccggagggcatccgcgtttgccaggccgtacgtcctaccaacactggtcggtttcccacgtcctccgccggaacgacggcccggccggggccgtccgccgaattattacgcccggggcacggcaggccacgtccttgtcttagcgagcgcgctcgttgg

SEQ ID NO: 66677 - DNA, 311 bp, Triticum aestivum
  Clone ID: PAT_TA_66677
aaaaaccaaagctttccaaagaccatttttaagggcacttttcgaaaatttaactagggcccccacgggcggatttgttacagtatttctcgcaaggggatacagtttcaggcaaaacgggggacaacacatccaacaaccaactttggttttaaccccctcgaaaaatcgggggggggaagctgccttgccaaaaaatatttccccctcccctaccggggggggggtagcaacactggggctaaaagctcgtccttaaaaggctccggggaagccggttccgccgccttttggggcgccgcctgcccgga

SEQ ID NO: 66678 - DNA, 683 bp, Triticum aestivum
  Clone ID: PAT_TA_66678
ctcgcacacgcacagacacagcagatcgaaagcagtatccattagcaaaacagagaaacgaggatctcgccggcggattcaggcgacggagctgccgggggttcatcgcgcagcgaggttttcgcacagatcgatggaagaaggagaacagcaagtcagacggcagatccagaccacgcccacaatggaaagagatggagagcagccggtagacaaaggagaagcagcagctccgtcgggatcgacaagcaggtccactaaacacacatctaggatagctattcagaaagtaacagaggtcgttgctgcattatcggattacaaaagattcctggttgaggagattggctttgagggtgtattgcatatccccatgattcagaaaatcaatctcaagttcagcaagttcctcatgaccaaggtggatgtgaaagagcattgcatcatcctgagacacggcggaacgccaattactttttatccagaggatttccacaaagtgtttggcatcccatgtggtcaatgagacatccatgggaaagatgcagacatcacatctgaagcaatcgagttcatcaggaactctatagggtggacagagaaatctgatcgcagcttaagttcgctcgaagtgttcatcggcatggaaataaatgaactatccagccgattagaaaaggatt

SEQ ID NO: 66679 - DNA, 441 bp, Triticum aestivum
  Clone ID: PAT_TA_66679
ggaacaaaacactacaaaaggctaaggttccccgaacgggggacccaccaggggggaaggcacccggggaatccacttttatttaaaaaccgagctaaaacccttaaaccgccgggggacccactagttgggcagaatcaaccccgcctccttgtaagggaaccaggggaattccccatcatcaagtatggccatctaaacggggagcaaataaaaagtttttttgcccaaaatcgcctttggaacgggcccggttttcccagccccagttaccaccaggggaacataggcggacaagtggacccccggaaacgggaacgggattctttggggggggggtttgggaaagcccaaaaggggggggacccacttggggttctttttaacaaaaggatggcctggaaaaaaaaaggcaatggggccgtccggccccatgccaaa

SEQ ID NO: 66680 - DNA, 198 bp, Triticum aestivum
  Clone ID: PAT_TA_66680
aaacggcaggaaatttaatatctgaacatgtttttccgggttacaggctctacatatgttcaaagtcccaaacagcaaaaaaaaagcggccaactaggaaccctgcaaaaaaaaccataacatgccataaaattttaaagagtccacctttaggggaacaatagctaaacctcaacatcccccccgggggggaccggg

SEQ ID NO: 66681 - DNA, 123 bp, Triticum aestivum
  Clone ID: PAT_TA_66681
gaattcggcacgaggaaactcattggtgctttgcacgaagctggatctaacgacattgtagtgctatgccatggccttatgtcatcacatgaacctataaccatactgggccttactgatgca

SEQ ID NO: 66682 - DNA, 563 bp, Triticum aestivum
  Clone ID: PAT_TA_66682
gaattcggcacgagggccagggcggctcgcgcaggtacggcctcacctggcgctggctacgctacttcaagaacgaccgcgaccgccgcgacctcgtcaccatcggcgccggcgccggtgtctccgccgcgttccgcgcacccgtcggcggcgtcctcttcgctctcgagtccctctcctcgtggtggcggagcgcgctgatctggcgctccttcttcacgacggcggtggtggccgtggtgctgaggctgttcgtggagctgtgcgggtcggggcggtgcgggctgttcggcaagggcgggctcatcatgtacgacgtgagcacgctgttcgaggacctcatgacgtaccacctcaaggacatccccatcgtcgttctcatcggcgtcatcggcgccgtcctcggcgccttctacaacttcctcatgatgcaggtcctccgcgtctacagcgtcgtcaacgagcgcgggcgcgcgcacaagctgctgctggcggcggccgtgtccgtgctcacgtcgtgctgcgtgttcggcatgccatggttcgcgccgtgccggccctgc

SEQ ID NO: 66683 - DNA, 573 bp, Triticum aestivum
  Clone ID: PAT_TA_66683
gaattcggcacgagatctcactgagctcggaggcagccccagccaccagcgaaatggccgcgtcggcgctgcaccagacgaccagcttcctcggcaccgccccgcggcgcgatgacctcgtccgcagcgtcggcgactttggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacgggtgggacaccgccggattgtctgctgaccccgagacgttcgccaagaacagggagctggaggtgatccactcgcggtgggcgatgctcggcgccctcgggtgcgtgttcccggagatcctgtccaagaacggcatcaagttcggcgaggccgtgtggttcaaggccggcgcccagatcttctccgagggcggcctcgactacctgggcaaccccaacctggtgcacgcgcagagcatcctcgccatctgggcggtgcaggtggtgctcatgggcttcatcgagggctaccgtg

SEQ ID NO: 66684 - DNA, 432 bp, Triticum aestivum
  Clone ID: PAT_TA_66684
gaattcggcacgagcacagagcaagaagatgagagagaagcaaagcttgagatggcgcaaaccatggcgtccatgaccggcctgtcgcagggcgtgcgtctcccaggcccggccggcaggcgcgccagcaggttcaccgtgagggcgtcgtctgcggaggccgaggccgccggccgccgtgcggaccttggcctaatggccagcggagtcggccggagcgcgttccctcatgtggtgcacgccggcaccgtcccggccatcaaggttggccccccgccgccgctctccgggggacttcccggaacggacaacttggacgaggctggggacttagacctgcccctgaacaaccggctctacctgcatccgctgccaccgccggaggcggcggtgcggcccaaggattcggcccaggacatcctcaacctcaag

SEQ ID NO: 66685 - DNA, 394 bp, Triticum aestivum
  Clone ID: PAT_TA_66685
caaaaaacagcctttggcattcaaccttggtactttacatcaggcggggggggagaacaaacaaaacccagttgcttgcccccttgcttgcccacacttgatcgcgtccgtacgtccggccccggggggtttccaaacttaacacaacccctagcagtttacttgccgggcacaaagtggggggcaaaggcccaggctttgttgttgacggggtcggcaggggggtcggcaaggttttaaaaagggcccttgccggggacaatggcctgcccaaaaaacccgaacatggaaaacatggggggggggccgtttttgatctccttcacctggagctccgaaaacccctgggggtcgtaagcgaggcccagggggtcaaacctgcccccggggtaaa

SEQ ID NO: 66686 - DNA, 611 bp, Triticum aestivum
  Clone ID: PAT_TA_66686
gaattcggcacgaggcagcacggtcgacctaccgcgcaggaccaccgagcccctccctcccttcccccgtggccgctgcggatcccctttcctctgccttctctccccccgtcagctcctcttccgcgcgtgtggcgggcgatggcggcggcggcggcggcggcggacacttccgcggcttccacgaccgggctcgcgctctcggaggcgagcatcaactgggagaggttggacaagacaaagtttcatgtcattggagcaatcctatttacggcccagcaaggtgttctgcacccaacagctgttgtgaagactagaatgcaggttgccgaaggaggactttcacatatgtctggctttgtcgtttttcgaaagatattgaggagtgatggcatccctggtgttttcagaggatttggcaccagtgcagttggagctctgcctggacgaatcttggctctaacttcactagagatctccaaagaaatggcatttaaatactctgagcacttcgatatgtccgaggcatcaaggattgctgttgctaatggtgtagcaggcttagtgtcaagtaccttttcaagttcatattctgtacccctagatgtggt

SEQ ID NO: 66687 - DNA, 302 bp, Triticum aestivum
  Clone ID: PAT_TA_66687
gggctaacaacagccttttgcattcaaccttcggactttacatcaggcagggggggagtacaaacaaaacccagctgcatgcccccctgcctgcccccacttgatcgcgtacgtacgtacgggcccgggcggtttccaaacataacacaacccctagcagcttacttgccgggcccaaagttgggggcaaaggcccaggcgttgttgttgacggggtcggcaagggggtcggcaaggttctcaaaagggcccttgccggggacaatggcctgcccaaaaaaccccaacatggaaaacatggg

SEQ ID NO: 66688 - DNA, 608 bp, Triticum aestivum
  Clone ID: PAT_TA_66688
gaattggcacgagcagcaaagagctcctgcggatcactcgccactcaccagccagcctcacctctgtccaggagaccaaaaggccgaaccaacaagcaccaatcccacggagagagagagaaagctgggctttgtaagctaacgagtcaaatgtacttgtagctggtaccgcccaccaatcaccactggacagcagccagcggctaatatctcctccaacagtggaaagatcgatacagatagaggagggatcgagggagacgcgcgccgcgcgccgccggccggggagcactttccagccggccttgagccatcatgtgcaacaccggcgccagccctaccccctcgccgccgcaccttacgccgcccctcgcctgcttcaagaattcctcccacctgctccaccccgtgggtgaccaccacgacgacgacgacagccaccaccgcgcccgcgcactggcgctctccaaggtggccggcgaggcgcgggcgatcgggcggctgtcggtgcccatggcagtgacggggctcgtcatgtactcgcgcagcttcatctccatgctcttcctcggccagctgggggagctggcgctcgccggcggctcact

SEQ ID NO: 66689 - DNA, 653 bp, Triticum aestivum
  Clone ID: PAT_TA_66689
gaattcggcacgagaccagttcatctcactgagctcgcaggcagccccagccaccagcgaaatggccgcgtcggcgctgcaccagacgaccagcttcctcggcaccgcaccgcggcgcgatgacctcgtccgcagcgtcggcgacttcggcggccgcatcaccatgcgccggaccgtcaagagtgcgccccagagcatctggtacggccctgaccgtcccaagtacctgggcccgttctccgagcagactccatcgtacctgaccggcgagttccccggcgactacgggtgggacaccgcggggctgtcggctgacccagagaccttcgccaagaaccgggagctggaggtgatccactcacggtgggcgatgctcggcgccctggggtgcgtgttcccggagatcctgtccaagaacggcatcaagttcggcgaggccgtgtggttcaaggccggcgcccagatcttctccgagggcggcctcgactacctgggcaaccccaacctggtgcacgcgcagagcatcctggccatctgggcggttcaggtggtgctcatgggcttcatcgagggctaccgcgttggtggcggccccctcggcgagggcctcgacatcatctaccccggcggcgccttcgacccacttggcctcg

SEQ ID NO: 66690 - DNA, 625 bp, Triticum aestivum
  Clone ID: PAT_TA_66690
gaattcggcacgagccgagtccgagccggcactctgctccggagccagagccctctccccatggcggcggcggcggggtcagagcacgcggccgaggaggggacgctgagcatctacaaggcggcgaggcgcatcaagcggcgggagagcaccctgtacaacgcgctgcggagcgtggcggacgacgcggccttcgtggccgagatcgcggcgctctggccggcgctgccgctggtcgccaacctccgctgcggcctctggtacgcgcagccgcgctccctcgccgccacctgctacttcaagtccaccgacggccacgccggcaactggggcttctccaccgcccgcctcaatctccacctcgccctcctcgccggggaaagaggagggtgcataatagttgattcaacaaggaaagggaaacgatttcctgatagcatggcaaagaccatacccatctggtgctgcgttctcaatcgagccattcagaggcatcgactgcgggctatcaaccaagtcagctgttgtaccaaacggggatgctgaagagtactctggttcatcaaactgggatagctcagttcatcttcctgtatgggttctggaaactgagaaaaatgcaata

SEQ ID NO: 66691 - DNA, 693 bp, Triticum aestivum
  Clone ID: PAT_TA_66691
agaggtgcccaactatatactgtaaaaacagcagtacaggctcaaagaacaaataaaatgaatgtctgtgggattaggagttggtacaaataatgttacatcgtcaagataaaccgacccaaaactgtgtctccatcattacaagctctctcacaagtataaaagtcagtgctctcgcaacacaaaaatactatagaagtcagttcaaaaaagctactacttgggtatttggctgttgccagtacataataactggttttcattcaaatgaagaaatgttgatcagtttggggtccatctggacggtgttgcttgagctattccaaggacaactagtgatcattaattcttcagacactagaagatcattggagaatgaagaacacacaagaatcaactgcaagcccaaacctgactattctgtggcaactgatgagagcgaatgcctcatcggatgcattttttcacagaactaacagggcagctgttccttttcgttgcatagaaaaccatagacctgcctcaagtttcccctagatggccgcgcattaacggcgtatttgcaaatgaacaccagcctcttcctcatctccaacttggtgacgtctcttctcataaaagattcgccgcagtcgaagcacccagtgtcactgaataaccgtgtgattattgccaaggctacacaaatgctta

SEQ ID NO: 66692 - DNA, 478 bp, Triticum aestivum
  Clone ID: PAT_TA_66692
gacttagatacattcagattggatgaggtagattcagatcctgacgcgctggagcgcagagacgccgtccaggcccttggcgccgtagtgccggagcatctccggcaccgtcgtgctcctgtacctcgcgcggccgtcgccatcaccgccggcgacgatcggagcgagcaccctcgtcgaggcgtcggcgcggaagaagcatgcgacggagacccggggaccggcggtgttggccaccacgcggtgctccacgctcctgaaccggtcgttggacaggatctgcaggtagtcaccgacgttcaccaccagcgcacacgcctccgccggcacgtccacccacgccggccgccgctcgtcgacgtccaccagcacctggagtccgccgacggcgtcctggaggagcacggtgaggaagctggggtcggagtgcctcgcgttgcccagcgtccggtgcggttccgggcacgccgggtagtag

SEQ ID NO: 66693 - DNA, 466 bp, Triticum aestivum
  Clone ID: PAT_TA_66693
gggcaaaatctcttgtttcaactattgagtaaaagccgaggcattgaccaaaacacaaccacaccaatttcacgattaccattacaaagcaaataccacaattatcaaaaagttttcgagacacttaacatctgatagttactgacaccaacattggagagtcgactgacaaccatacatagagcagagcaaaaatactgacgaccccaaagattttagcatactgtgccattagcacttgacctctttcagcccatgtgcaaagtacaggaaagttggatcagcagctccctccttgtagtacgcgaacaccacgccgccatcatcatgcatgctctcgccaacaaagaactgaaggtccttgagcttgctaagaagatacttcgtggcagactcaacattcttcttgaaaacatctaggtcatccctcgtgccgaattcggcacgaggctctctctctctctct

SEQ ID NO: 66694 - DNA, 578 bp, Triticum aestivum
  Clone ID: PAT_TA_66694
gaattcggcacgagctcaggttctccgacgggatccgcgtgtgacgcgccgcgtgatggagacgtctacatcaggggtctctccctcccgtccgcgtcaaggccggaggggactgccgtcggcggacagcaagcgagcgagcgtacgatggccgccctcgccgtcgggatggctcgctgcagggcatcctcctcatcctgattctctccgtcgggatggcctcagagtccgcgctggtgggcgacaggtgagccacgggctcgctgtcgtcgtgcggcgctgggatgcattgcgcctcctgctccccactcgccgggagcccctgctacgccaccctgtgcaccccgttcgccgcggcggcctccaacactgccggtgcggtcagaaacagtctagatgctttattatttatttactaaaacagggagtgcgggttgatatcatttaaaccgaggggcctttttgaaaaactgccacgacgacggacgacagaaacccaattctctttattatatatatatatatatatatatatatatattatatatatatatatattatatatatatatatattat

SEQ ID NO: 66695 - DNA, 503 bp, Triticum aestivum
  Clone ID: PAT_TA_66695
gctcagagagaaacaagacccaactaaattactgatgcctcatatgtatggtaatatggaacgatataatgtattttaggctatctagatgacgatgatgatctaccgcgactcggcggacggcggcgtgctgctgctggagtcacccttggatccgccgaagaagggctcgccgagcacggagctgaccttgttcttcatgctcgcccagtgctccttcgccggcgcctcgagctgccggtactggtctttggccagctccaccgtcctcttgaagtacgacgacgctggcgcctgcgccgcctccttctccggcaccgtcgctgccgctcccttgttctccatcaggtcccgaaaactgagatcggttgatcgaaaacttgcgtgcgtgaagaagttgtcgctgcctgtgttgctatggtggccaggaggtcgtggggtcgtgcctacttatatggggtcggtcatgagccgccgtctgtcttgagaaggaagccggggcc

SEQ ID NO: 66696 - DNA, 629 bp, Triticum aestivum
  Clone ID: PAT_TA_66696
gaattcggcacgagctcaacctcaaagcgggctggcgcgcccgagcttcgtcctctccaacaccttacatagcaggtggccggccattttttaggcgctcctgtgatgcaacgttcatcaggcagcccaatggcttcgatgcagcttgcacacacgctggctgtacaagccattggtggagcgatagcacgcaccggcgctgcgcaacactcgccggcgctacccgtgtgaagctcagatggctgttgccgcggtgctactatgcaacgctttttgttggtgcagcggagctatgatgcaacgctcgctggcgctgcaatccgggttggggagcgacgccgcagggcgcacccgtgctaaggtgctgcgctctccggtgctatcgtccagaagccagaatggtttttgccgcggtgctgctatgcaacgctcgcgccgcgctgagctgcagttgagcgtcgccggagtcgttgaagctgcgatggggatggaatggactccgtcggagctgcaatggagcgccgccggagtcgttgaagctgcgatggcgatggaatggactccgtcggagctgcaatggagcgccgccggagctgcaatgaagctcccgccggagttgcaatgaagct

SEQ ID NO: 66697 - DNA, 412 bp, Triticum aestivum
  Clone ID: PAT_TA_66697
tgcttaaaaataattatatgatagcgacactaacataccgaaaatgttctttccattccaagcacaaatactccttcgggaacaataaaataaaaggggacagctacggatcacccggatgaaaatcatccgactggccggccgttcaattaggtgcatgtggcccgtctgattaaagcaacccagcccaccatcgtccttctcctctcttgtattgcatccaccagctgcgacacccacctccgcaacaacgatgatgcaaagagaaaaccggcgactacagcgccgtcacacccacgccgacgagtgcacgcagctcctagagccgccggcgaccgctgcatcgcagcaccgggagccaccggaactgctccatcacaacaccgagctcgccgccgcgccaagctttatt

SEQ ID NO: 66698 - DNA, 286 bp, Triticum aestivum
  Clone ID: PAT_TA_66698
ggtgggttttttttttttttttttttttttttttaaggcccacaaaatcctcagtttcgcttttgatctcgggtacaaaggctataaccccataggccccggggtctgctgtttctggcactacaggttcagttcagtctggcgagacataaaagccagtactttttattggggagcacgacaaccccttgatgccccgcagaacaaccggttttggaggcaacaaaagcggccgaacaaaaattgcttgagttcaagggtgaaccgttcgatataggctgagcag

SEQ ID NO: 66699 - DNA, 198 bp, Triticum aestivum
  Clone ID: PAT_TA_66699
gaattcggcacgaggccagcccaagaagaagagacgccgctacgcacccacgcagtacgcacgccatggccgccaccgcgtccctgtctgccgtcgcggcgcccctgtccgtcgccgggctcaagaaggccacgtcgttccggcccctgccggtggtcagggccggcaggcccgcggcgaggatgacggtcgtccggg

SEQ ID NO: 66700 - DNA, 664 bp, Triticum aestivum
  Clone ID: PAT_TA_66700
gaattcggcacgaggtcattcatcactgatgcaccagcacagccgcgcatccaccgctgctagcaaggtcgagcaagcagcacagagatggctgctgccttctcctccaccgtcggtgccccggcttctacgccgaccaacttcctcgggaagaagctcaagaagcaggtgacctcggccgtgaactaccatggcaagagctccaaggccaacaggttcacggtcatggcagcggaaaacatcgacgagaagaggaacaccgacaagtggaagggtcttgcgtacgatatctccgacgaccagcaggacatcaccagagggaagggcatcgtggactccctcttccaggcgcccactggcgacggcacccacgaggccgtcctcagctcatacgagtacgtcagccagggactcaagaagtacgacttcgacaacaccatgggaggcttctacatcgctcctgctttcatggacaagcttgttgtccatctctccaagaacttcatgaccctgcccaacatcaagatcccactcatcttgggtatctggggaggcaagggtcaaggaaaatccttccagtgtgagcttgtcttcgccaagatgggcatcaacccaatcatgatgagtgccggagagctggagagtggcaacgccggagagccag

SEQ ID NO: 66701 - DNA, 653 bp, Triticum aestivum
  Clone ID: PAT_TA_66701
gaattcggcacgagctcccgcgtaccaagccaccgaccaacatggcagcgtctctccaagccgcggccacgctgatgccggccaagatcggcggccgggcctcctccgcgcgaccgtcgtcgcacgtcgcccgggcgttcggcgtcgacgctggcgccaggatcacctgctccctgcagtccgacatcagggaggtcgcaagcaagtgcgccgacgccgccaagatggccggcttcgccctcgccacctctgccctcctcgtctccggcgcgagcgcggagggggcgcccaagaggctgaccttcgacgagatccagagcaagacctacatggaggtgaagggtaccggcaccgcgaaccagtgcccgaccatcgacggcggcgtcgactccttccccttcaaggccggcaagtacgagatgaagaagttctgcctggagcccacctccttcaccgtcaaggccgagggcatccagaagaacgagccgccggccttccagaagaccaagctcatgacccgtctcacctacacccttgacgagatggaaggcccgctcgaggtcggcgccgacggcaccctcaagttcgaggagaaggacggcatcgactacgcggccgtcaccgtgcagctccccggaggcgagcgcgtgccc

SEQ ID NO: 66702 - DNA, 388 bp, Triticum aestivum
  Clone ID: PAT_TA_66702
acaacaggttcacggtcatggcagcggaaaacatggacgagaagaggaacaccgacaagtggaagggtcttgcgtacgatatctccgacgaccagcatgacatcaccagagggaagggcatcgtggactccctcttgcaggcgcccactggcgacggcacccacgaggccgttctcagctgatacgagtacgtcagccagggactcaagaagtacgacttcgacaacaccatgggaggcttctacatcgatcctgctttcatggacaagcttgttgtccatctctccaagaacttcatgaccctgcccaacatcaagatcacactcatcttgggtatctggtgaggcaagggtcaaggaaaatccttacagtgtgagcttgacttcgc

SEQ ID NO: 66703 - DNA, 394 bp, Triticum aestivum
  Clone ID: PAT_TA_66703
acaaaaaaagaaaaaaagggttaaaacctactcgacccctatttttaatctttatttttaaacacaaataatattctaacataaaaaactcacaaaaaaaaaaaatacccccttcaggaaaggaccacccctcgaggggggggttgaaaacatcggcagggcctaccctataggcagaagtttttttttttttcggccggaaagtatatgtagaagtgggagttaagaaataaaacggagggatttattttggccttccttccaaaaaaggaccccttaattcccgggagctggctagcggaatcttaaagggccgctttttccccggggatggagggggtgcagaaaactgttatttgcagaaaaaacacgaggccctgaggaaccgaatttt

SEQ ID NO: 66704 - DNA, 728 bp, Triticum aestivum
  Clone ID: PAT_TA_66704
tgccgctccaatgttggattgtcaacaatctgtccaatgtttaaaaagataattttgcaggatgcagtatcatgttatagacacacctttgggcactatggccactatcacatggcaaccctgtcacaaacggccaggtcacaaaggattagcaacaaaaaaaatctccgtggctgaatctatcaaaaagtcctccaatcttatcttttaggctttatatatatagtaatttccttcatagattcatgttgctgtggtttaattatttatcatggacttggagctctatatataatctagtgcatgctcttatcaaaaggtaaaaagagattcctagtattacatggcagctagaaaaggatacacattttgatgaacatttaattatttgatgccagcacagcaaatagtcttggcatggtgcaactataagtcgaccaccctcagaccaaccagccatcttagtggaatccttgctgtcccactaaggcttcacatcacacgatgcttgatatcagcctaacacaagttctcatggaccatgaaaccatgaaacgatgcttgctccctgaaccaatcctcgccaggtccaagattaatgcagccttgtacaaattaatagtttagaactctttcagtcgagtcaatagtaaactaataaacataaatgaaccaatggaaaagaataatatgtaacttgaattgaactgttagttaattagtatagc

SEQ ID NO: 66705 - DNA, 659 bp, Triticum aestivum
  Clone ID: PAT_TA_66705
gaaaattttgtgtgtcaggccttaagaggggattgccttttctgtacttttgtgttgcttcatccattcattatttattaacatgtttacacttcattgttaatgtatggttgtttaccttttggtgtcgactttcgacttactgatttgtgcaatcaaatatagaaaaggatcttgttttggacacgacagccttgctgatggcatgcttgagttacctcgcaccatcatttggcctttcaagcacttgatttgcatttttttgatgtaatcaaatagtgtccctgcatcttaacaagccacccatttatcatgtgtaatgtgtcattctttccttttcttttcctggagttttttcgctaaacatcaatgcacttatggatagtacattgacgctgatgattctatcttctttatttgagaatatgatattgtacatgtattgtagattggattacaaaatagtggttgtagttcttatgatttgcagtagcttaggtatggtgttgtggctttagcacataacatggatcggttttaatatcctgttcgtgctcgtcttcgcattttataggcaggttgtctgggataatttatacttttgctaaattactgctaaagtggttttgttgagagttgaaactacaccaatgttttgc

SEQ ID NO: 66706 - DNA, 220 bp, Triticum aestivum
  Clone ID: PAT_TA_66706
gaattcggcacgagacgcgacgaggcacgggctccatttcaaaaatcacgcagagcttcgcgtctccctcctcacccccccaccgaccgctcccgtccgacggtccgcccccgaaaccctagggcccagatctctcctcccccgcgccgcgctccccggcgcccccatggaccacgccggcccgcgctccgacccgacggatcccgccggatcgggcgcg

SEQ ID NO: 66707 - DNA, 634 bp, Triticum aestivum
  Clone ID: PAT_TA_66707
caggcgaacaagcttgttatttcacgcgcctgtgaaaaaaaaactgtaagttggcaacagacagacactcactcactctcactcagacaccacaggtgcttgtttcatcacgttacaaaggagcagcacaaaccacaacaatgactgtctaggctatatgtgtaagaaacagaacctaaccaatcagtaaaaaaatgaagagagaaaactgtgtaaggaacaagatacaagatccacatgtgcgagaagatcagaagcacgggacgttctcggtcttcatgaccaggttgcacgtcgagtagatggacgccgcggcagcttgcactgcccactcgctctcggaaatctccgggttcttcagcttccataattcagccattgggcctagcagtggagcctcacaggtcacttgttgcaggcctttatcacaattctgcaacattccttgcacttccttcaaccgaatttccaagtgccttccctcctcctgcagtgttctttccatctgaaggaatagagacctccaccgtgcagcatgttcttctgaaactgtttttccagtgggcccagcttcagaagaatgtgcaatggatggttcattctcttgactagatgagaattctgttgatatcag

SEQ ID NO: 66708 - DNA, 211 bp, Triticum aestivum
  Clone ID: PAT_TA_66708
gtggggggaacattaagaattatagataaacacccgacgaacatgcagaaacatacaaaatccaatctccagatattacgttgttacaaaacattttaaattctctacaccgaacttgaaaaatcatagaaagaaagattcctgtccatgaacgtaaggaaaaaaaagaagctgttggaagctcgatacttataattctgattacaaacaa

SEQ ID NO: 66709 - DNA, 435 bp, Triticum aestivum
  Clone ID: PAT_TA_66709
ggggaaaacaataactattcattaatggccggaacaaggggggcgggcccataaaacagccccatgggctaggacgggggtacacaaggggggggacaggtaactcacccaaacgggcgcgggcatacatgggggaaaaaaatatatgcccccccagggggggggcaggggccaaacataaaccccctacggaaataacccccccgggcaacttcattttattttttaggaccccaacacgggaggggccccccatcaacggaaaaattaagccccacccaagggcgtccatgcttgcccgtaggaaggattatttatggaactagtggacattgttgcaatggggggacatgctgagggggaagggccccctgaccccgaatttgccgggcccgccggaaaccttgcccatgtggagggacttgaggcgggggg

SEQ ID NO: 66710 - DNA, 274 bp, Triticum aestivum
  Clone ID: PAT_TA_66710
acaattgaaacatataggtattcgttgcatacgatgatatgcaaaaacgatctggggtttgggctcgagatgcaatctataaatatgcaggggaaaaacaatcacattgggaaataacaaccgagggattgccacaaagaatgggcaaaacagtttatactttaacacgaatcccagggatgggtcctgcaaaaatgataatccataggtgaattggacgggctttgaaaccttgaaccaagaaggactaaatttgggctaaaaggatattcaa

SEQ ID NO: 66711 - DNA, 469 bp, Triticum aestivum
  Clone ID: PAT_TA_66711
ggaatggcaacgcgagaataattcatatcttttacataagtaagattgtaaacacaatattgcgtgtgtcatgctaccttgtcagctacctacagctacctacgtaagtgattcttgccatgcaaattcaaaacatcaccactacttctagacgtcggagactgagatacgtcgttatggcccgacccaaaattggctcactcgataatgtgaggcgccttttccggcctgatctcgcgtcctgcagctgcgacgaaacacagcgagcagccccgacgagccacacttgatcgatggcagtcgccgccttgagttgcgacgccgtcatgtccttcgccctagccctcagctcaagcaggccccggtcaatgtcggcctacgcccttgaggtgtgacacttctgcttatcatacttatccttcagtgaccgacctccttctttaacttactatgtttgtgaaccacattc

SEQ ID NO: 66712 - DNA, 680 bp, Triticum aestivum
  Clone ID: PAT_TA_66712
agtgaagaccaaacaggaccctagtccgtctttatttatgaatttccttttaggagttgatgcaaatttgtccagaaataatagatgactcaccgagcaagaggtaggcccatccttcgattcatgctccaccactgtatgcacacaggcagcccatttccccaccattattgtaggggcagcgttaggcgccggtgtgccggcccggtttttccgccggtccagcctcaaccgtttgatctaacttaaaaaagccgtccgatctggcatctcctcccttcctgagtcgtcttcaacctctgccccacgcgccttcgcccatctgccccacgcacctccgcctctctgcccatgcgccttcacctctgtgcgcagctccgcgagggcgccgctcgccggccgccgaccactcgccgctcgcacccgacgccccacgacccctctacggctcgcacccggcgcctcacaacccccctcgtgcagctccccctcaacctgattgcaactccgtcgtagatcggttgcaactcctgccattgacgctccatggatgtagcaccgccgccgccgcccgtcgtcaacgctcgctgccggaattgcgcggtcaacgaccaccagtaaaaaaacgacattaaacggatgtagcaaaaaatattgcctatagtcgcaaaacacatcac

SEQ ID NO: 66713 - DNA, 645 bp, Triticum aestivum
  Clone ID: PAT_TA_66713
gaattcggcacgagtctggatcgaatgtctcgagtcgcgctggttttatcatttgttgggccgctggtgttgtccaagtttctgctcgaatctttctcggacaaccctaccttcttcgatcggctcgttgtcttctgtttgtcatggccaatcgcaagagaggtacgcctgagactggagcagagggacttgcgagcccgggccagctcacgaggagcggtcttggccccactcgtttcctctcgtctccccttcggcctttcggtgctcttaacccgtctgcggatgattcactcgggctcccctggtgacgtattggacttgttcaaaaccggcgtcgctcaaccactcaacccagatcggccaaccaaggtctttcgcagccgtgtcatgggggttgaaacgatctggaccatggaccatgatgatgccaagtatttcctctcaaccggcttcggcaacttcggcaaatccccgttattcaaggccggcttccgcagacttctcggcgacggcgtctttgcaagcgaccaacgcgggctatgggcctggcatcgtagcctcactaggcctcattttgtcagagagcggatagccgatgtcgtggcaatggaagaacattctcagcgggttgctacttggcta

SEQ ID NO: 66714 - DNA, 591 bp, Triticum aestivum
  Clone ID: PAT_TA_66714
acagagaaaaagtcaagacaatcagatgtatgtttatcaacattttacgtcgcaaagggctgttacatatcatatagtaacgatgaaaaaggcttgtgtgtgtacaacaaaaaaaagatgaaacttgaaacaggttctttttccccagcaattgcctccacaaataattcgggcttacacacacactgaagtccttcacctttgtgcttacatacaaaattttctttactagtttaacagccattaatccagttgattgatctatttatttgggctcttgagagactttcgacttttttttttctttcggcggaagtgctctcatttcatcttttgaatcggactttcagacctcctctgaaggtaagtataaccgcaggggcttctgcgccaacagggccttcacttaagtctaaatctaccccatcaaattgttccaaaattcgaatcatcaaaatcgacgcctcggtgagggcaaattgctgccctaggcatatccttggccctgcgctgaagggttgaaagctgaagggatctttaacctgtaaggctttgcgactatcgatccagcggtcaggatcaaactcctcc

SEQ ID NO: 66715 - DNA, 449 bp, Triticum aestivum
  Clone ID: PAT_TA_66715
ggggttttttttttttttttttttttttttttttttttttttttttttggtcaaacaaggggggccaccggggggaccccccccaattgttccccgggcaaaaattttaaaaaaacaacctcaactaaaaaccggacccatggtaattttttttttttttttgggggggccccggttaatttcgaaaagggaaccccaaagacccccttggggggggaggaaaccccaaagggggggcatacccccaaatgccggaaatgcccgggggaacccccccccggcaaccccggaagggggtcccccgcgtaggggaacccgaagggcccctttttgggcccggcaaggttcccctccccaaacatggggagcatggggtcccccacctgggggtgcccaaacgggtaccccccggccaggcgggccattaagggcttttccctgggggaccc

SEQ ID NO: 66716 - DNA, 423 bp, Triticum aestivum
  Clone ID: PAT_TA_66716
aaaaaaaccgggagggagttacattacatcccgcccctcgagtagaaattagggcacacccaaaaaatataaccattttacaacaacagcaaattctccaaccctataaacccgggcaaacctaaaccggaacgggggcctggggcgtgggggccccccggttttcgacgggaatctggggaaactcgaacaggatggcccgaaactcgtaaccgttcagggtttcctttcccaaaaacacctccacaattttgcccatggccacgcggttgcccctcacctgttggagggcaatctaataggccttgtccaaaagttgtttcaccgccgaatcaatgtccacccccagtttctccaacatggagttcctggccattatccgaatgatcacgtccccgttttggcccgggtccataaaaaacc

SEQ ID NO: 66717 - DNA, 715 bp, Triticum aestivum
  Clone ID: PAT_TA_66717
gaattcggcacgaggggaaatggctttgtgcggtaattcatgggccatctggctacctagatggatacacaacgcaaagcacaggagaaggtctcagagtaaaagaaaatatgtctgataagaaaggatctagaggaatatacatagaaaggtctgagttgcttccatgggacggtggctacatgtacgctgcgaaatgccgtgttggacatttgggtttgataaactcattttcaagcatctataagactgttcaaggcattggtcccgagcttaaggatcagacagtgatatcccatggagaaacactcatcctccatatctcagaggcaggaaggtctgacattttattttcttttatcgatagcaatttcatctccggatgcctcctgggcaacgaccttctttattccgccagacactggaggtcgaaatctgaaaaaccactgcgcaaaatggaggaagtatattcacctgagcttgcggataagagtaaaggaaggatgataaatcaaggagcccccaggtctgagggtaggaggatagctaagtttgctgataagaagaaaggaaatatggcagatgaaggagcaaagctggtagataagaagggaaggatagcagatgaagaaaaagaatatggagttgagcttgaggaagaattgtctgttctcgaagacatcagactgctccataggccgaattacacacgtga

SEQ ID NO: 66718 - DNA, 649 bp, Triticum aestivum
  Clone ID: PAT_TA_66718
gtttttttagtccaaaggaaaatagaattgttgccagccaagttggcagtatcattacatatgagttggccaagtctcacaggtcacaaggctctgatacgaagtagaattgtggaactctcctgaatggtacgtattacatccgatgcacacattgtatgtatagagagtacaggtgtgtaggagcaaggggcgacacattcagtggcactcagtcagcagctactccactggtcgacttcaacaccaactaggcacgagctgactccagacaaccttgaacaacgcgagctctgtataggcacagatacgcaatctgacctcctccacacaagttcaacactttaaaagagacaagttctcctccacacaagttcaacacttcatgactaatatgcatggttgccatggcatcgtcatactgaatccacaactcaccctcttgcttgacccaagcaatgtagtgtcccgaatctggggtatccccattgtgtctcaccacagctatcagatcgtacatgccagtcagtgaaggtccatctttgtacatatctgatgaagatgattccacatgagtactcagtgagttgcacccagcattttctgcacctatcaactgtcgacaagcttggattttagttttgagctc

SEQ ID NO: 66719 - DNA, 290 bp, Triticum aestivum
  Clone ID: PAT_TA_66719
ttagaattcggcacgagagaagatccggcaggtggaggtggtccaggcgcagctcaagcaggagatgtccaagttcgcgctgccaccgaccggcggcggaggggagcgccggcgctcgcagtccgtctcgcccagccgcggcgcgccgcctcatcctgcgccggcgccggcgccctcgaggcggctctccgggggacttgatggaggcccgcgggggtggggccgtggctccgcgtccttctcgcactcgtcgccgctgcagcgggaaggccgtgccgcggccgaaggcg

SEQ ID NO: 66720 - DNA, 663 bp, Triticum aestivum
  Clone ID: PAT_TA_66720
tttgaattcggcacgagcttaattcaagagttagggggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagggttccgttactaacatgtttacttccattgtaggtaacgtatttggtttcaaagccctacgtgctctacgtttggaggatctacgaattccccctacttattcaaaaactttccaaggcccgcctcatggtatccaagttgaaagagataagttgaacaagtatggtcgtcctttattgggatgtactattaaaccaaaattgggattatccgcaaaaaattatggtagagcgtgttatgagtgtctacgtggtggacttgattttaccaaagatgatgaaaacgt

SEQ ID NO: 66721 - DNA, 655 bp, Triticum aestivum
  Clone ID: PAT_TA_66721
gaattcggcacgagccgttccgtagataggggccctaagcctaaggcgggggagaggcggcggcggcggcggcgatctcaacagccaacatccccatccccatccccaagatctgcgatggcggatggcggcggcggcggcggagagtatagcaatctcaacaaccctatcacctcccccacaagaactgcggcggcggatggcggcggggaagacatcgaggaggggaggccttggctggtgagccctccgccgttcaaaatccgccgcaagctgagtgatccaggtgcgtttgcggcggcggcgaatggcggcggggaaggcgtcgtggaggcgaggcctccgccggtcaaaatcagaaccgcggtggccgatggcggcggggaagacgtcatggaggcgaggcctccgctggtcaaaatccacaagctgggtgctccaggtacgagttcaattcggcctgaggatcagattgaggtcatgcctgccagcgactacgagatgaattcgatgcgtccggagcacttggggaatgacgacatggacttcattaatctgatgcatccggtgatcccatgcggtgaggttcagaaggaccagatgggcttaggcaaacactccatcatctctgagcagcagattgagaacaagacga

SEQ ID NO: 66722 - DNA, 352 bp, Triticum aestivum
  Clone ID: PAT_TA_66722
ccccaccaaaccacatccattggattctagtggaaaaaaaaggaaagcatcaattactctaaagagagcaacaggcatgggttaaaaaaaactcaaacactatgcataagggggctttttaccggacaaaccaaaaaaactccctacagcatgactggcaagtaataccaccacggaaagtaaaaatacaccatctaaactgggctaataaaacagagtcgatacacacagccaaacacattacatagcaaaccgatacagcaataagtccacatcttacatagctgagcaaaaactggaccaccatcaaacatatccctctcacaaaaaacccttttgggggaaagcactg

SEQ ID NO: 66723 - DNA, 713 bp, Triticum aestivum
  Clone ID: PAT_TA_66723
aggttggggcctatcagcgacttgttcagcacgaagccgccgccggaaaaggtatgaacagcctcacgcttttcagtagcaatttagcagttcttcctaaatctcactagtttgcctgccattaggttctgtagttcatggtgtttgtcggaatggataatcattttgctgcggagggatcagcaagagttattaatcaagatacaatgagcattgcagaccatccatcctcgaactcttgctccgtgaccatgtgatgaaccagcttatgaaattcacttgtgaaatcagttttcttgctccacaaaacccccattgactcctttgctttcttcagcacatgccatttacaccacctatgcgttgtattgggcatctctgtttctatagccaattccattgaccgcgcctgttaatattgtttacaggtgtttacccccgaccatcctgatgaattcacggaaaacccacttgaatgtgtcctccttctcatccctcagcatgacacctccgaaaattatgctctggaagtgattgttcactcctacaaacagaccgaatggcatgtcatataggtttgtcctgtatgtggtatcaaatgttacaacatctccgaaacacctatactggtccacactacgcccgttaacccacataagtgtcttaatcctgctctcgtcatcaacctggacagtatagttgaattctggatc

SEQ ID NO: 66724 - DNA, 497 bp, Triticum aestivum
  Clone ID: PAT_TA_66724
acatgggcaccgattgcattcacatacgagcacgctttctcgagccatgttgttacatgaacatggacatacacatattcttaggaacaagtaagaaagacaaatggagaaggaaaacccaaagcaatgtcagagttgacaaaactgcaatggcactttatatgtggcccgtggtgagtgagctgtttaggccttgccggactcctcgcagcccggtggcttgaaggcaatgaagctgacgcactgcacctggcgcatgttgtcgaatccgatgatgcggacgtacgcgtcagggtactccttcttgacctcctccacctcgttgatcacctgtgtggcgtcggtgcacccgaacataggcagcttccacattgtccagtagcggccgtcgtagtacccgggagacgcattgtgctcacggaagatgaacccgaccttgctgaactcaaggcaaggcacccacttggagcggatcaggtagtccacctgcttgagga

SEQ ID NO: 66725 - DNA, 684 bp, Triticum aestivum
  unsure (1)..(684): unsure at all n locations
  Clone ID: PAT_TA_66725
gaattcggcacgagtaacgatggggtcgttcgcgaacgccggctccgcgccagccccatccgcggcgaggccgcacgtcgtgctgctggccagtcccggcgccggccacctcataccgctggccgagcttgtgcggcggctcgtggagcaccacggcttcgcagccacgatcgtcaccttcagcggcctctccgactcagaagccctccccagcggcatccttgactccgcctccaccgttgcgctccctgccgtcaagatcgacgacctccccgccgacgccctccgcggcagcctgctcgtggagcttattcagcgctccctcccaagcctcggcaccctgctccgctccatgggctccaccaccccgctcgccgcgctggtgccggattttttctgctccgcggcgctgcccctcgccgtcgagctcggcgtcccgtgctacgtcttcgtccccagcagcctcaccatgatctacctgatgcgccgcatcgtggagctccacgacgacgcggcccctggcgaataccgcaacctcccggagcctctcgagatccccggnggcttgtcgctgcgccgcgcagagcttccggtcccgtatcgcgactgcaacggtctggcttacgcgcaactgctccggggaggccggcgataccgccgtgccgacggtttgttgatgaacac

SEQ ID NO: 66726 - DNA, 598 bp, Triticum aestivum
  unsure (1)..(598): unsure at all n locations
  Clone ID: PAT_TA_66726
agacaagatggaacagcaagacaaagacatgatcaggtaccaccgacacgtgcttacagatggtaggcgcccaaggcgcgacccggacatacaaaggttcagtatcaggcgccaccggcacgtgaatacaagaggtaggcgcaacccgcgcgacactagaagtgaatacagatccttggttcgacaccatcgccgaccaagaccagacataggactcaactcgcaacaaacagacacagtcaggcgccaccagcgcgtaacttaagttcgggacaactaaggaaacaggccaaatacactgggatacaaccggggctggcacagtctgcgcggcccaacctgcagtggggtacctagatgaagaagatgttgtactatccatgggggatgagtaacaaccatgcggggcaagagcttcagttggcagtggcgttcagctcgtctaggatgagctgcagatcctcatctggcaacttcagcaagcttggcgaggagaggctgtggcacggngtttttgaagaagcttaggtacagcttcagggtgtcatcgttgaactccttaacgttcttgatcaggcccaggcgaacacagaactga

SEQ ID NO: 66727 - DNA, 688 bp, Triticum aestivum
  Clone ID: PAT_TA_66727
ggttttgtaacgaacaaaactttaaaaccattctaaatgtaatatttagcactttacgatattcgtaaatcacttctgtgctcatgttcgacaagacacagttcgaaacaacaaagtgttaacaattcatcaaacaatttatctcgaagggtagtacagacatgtcagcacacaactctttccagaatttcaaactacaatctcagaaaagaactcaacatcagattctgggggaagcagattccacgagaatttttccaaaatcatgattctacagaatcctgcgcgaaaagaactgggcctcatctcctgcccatggtgatgacatgtcattcttcatggtcaaatctccatagtagctaatccatagctgtgcccgatcacaacccttcttgagcctttcatacatccgagtgcatgaacttttctgaggccaaagttaagtatgcgctcaagcctgaaagtacttgtgttccaaagacgaacagtcccgtcacgtgaacctgtcatcagtattggaagctggggatgggcatagacggtactgactctatttgcatgccctacgagtgttttaacacatatctttttctgcacgtcccaaatcttggcagtcccatcatcggatcctgtaaacaagtattgcttaccaccatgggtaaaataatccaaacatcttacattggat

SEQ ID NO: 66728 - DNA, 329 bp, Triticum aestivum
  Clone ID: PAT_TA_66728
aaaagaaagggcaaagcacctcccccccgtgggggaactggggctacattccaactaaacagggggaacaacatagctaacattttcaggcgggggcagggaaacacaaggtataaaaaggggggggataggaactacatgggccccttaacatcctacgggctacagaaaaccatatgggggaaaagccccaactacccatttttacaggggggggaagaaaatatatatctaaaacttggggggttaactactcggactttaggggggggcgaaaccaaaccaaaacgcgggatcataggagggacatgggcaactaaaaaacctgg

SEQ ID NO: 66729 - DNA, 375 bp, Triticum aestivum
  Clone ID: PAT_TA_66729
gaattcggcacgagccacacaccacgcctgcgtcatctctcggagcagcagcaggaggagcttgcaggaacaatggcggcccagggtcttctctctgggaggcagctgcttgggaggcctctgcagtcttccatctccaggtcgtcttcctcccggaagtccgccttcgtcgtcagggcatcgtccagcccccctgccaagcaaaatgacaacaggcagctgcggttcgcgtccaagcagtccctcacctacctggacggcacgctgcccggtgactttggcttcgaccccttggggctggccgacccggagggcaccggcgggttcatcgagcccaggcggctggcctacggcgagaccttcaacggccggacg

SEQ ID NO: 66730 - DNA, 312 bp, Triticum aestivum
  Clone ID: PAT_TA_66730
ggaaccgatgggaagtcccatatcctagaagcacatactacaaataaactaacaaaacacaaacaggggggggggactaacttagttaacaccccccctcctccctccaaataatccaacaccagggggcccatgaaaagctaccaaaacccaaaaactggggaaagagccaaaatagtctcgaagggacacacactcacgggggaaaactaacccagggaaagatccgcaagggaaactaaagacagcccgccaaaaaattccaaagccgatctcgccttttttttcctccggccctccgggggcccctgg

SEQ ID NO: 66731 - DNA, 361 bp, Triticum aestivum
  Clone ID: PAT_TA_66731
caggaatcacacatacttatgtagtcaaaattatgaaaacctaatagtaaaggcaggttgctgatataaacctggaagcataagaatgcaatcagtcgctggagaaattctccgaccaggcgaaaagcgtgaaaaagaccaggttaccccctcaatttgaattccgcctccttcctctacctccagccctcttcctcccggatccagaagctccgcctccctcctcctccaccctctgcccagatcttccacctccctcctcctcctaagccctctgtggctgttgcgaggaaggaggagaggggggagggagatcggacggcggagctcgagagggggatggaggggtttggggttagga

SEQ ID NO: 66732 - DNA, 507 bp, Triticum aestivum
  Clone ID: PAT_TA_66732
gaattcggcacgaggccaaataaatttctcagcttttcttctcctcgccgccgccgccgccgcccgcaaaccgccgacgccgacgacgaggacgagggagatggcgaagaaggggaaggacgccgccgagcccgacgccaaggcggcggccgtccgctccctcttctccgccgacaacccgttccgccgcaaggagtccgctcccccaccgacccccgcgtccgcacccgccgtccccgcgccggcgcgcaagccccggaggcggcccgaggctgaggcggaggcggagcccgccgtgccgtcccggaggaagcggagcgaggaggatggggaggggccggcgcggcgcaagcggaagcgggacgaggtggaggccgggtacgagcggcggacgctggggcgggcgcccgcggacgacgaggagcggccgcggccggtggtcggggccaagaggaaggcgccccacgacgtagaggcggccgcctccggcggggaggaggaggacga

SEQ ID NO: 66733 - DNA, 388 bp, Triticum aestivum
  Clone ID: PAT_TA_66733
ggaagcaggcggccaaatcaaaccatttccccaaagatccttgaaattaacaccaggaggttacaattggaaccacccattatgggggcagttcaccgaagtggcctggatatagggctacaactcgaagttagggagcgccaacgcctaacttgccggggacaaagttgggggcaaacccccatgcgttgttgttgacagggccggaaagggggccagcgaggttctcgaggggccccttgccggggacaatggcctgcacgaaaaacccaaacatagagaacatggcgaggcgaccgttcttgacttccttaaccttgagctccgggaaggcctcgggatcgtaagccaagcccagggggtcgaagctgcccccggggtaaagggg

SEQ ID NO: 66734 - DNA, 500 bp, Triticum aestivum
  Clone ID: PAT_TA_66734
accatcccctgccgccgcctcggccgcggccaaagccaaagcctcccaagcccaagcccaagccggggaggatgaagccggagccggtgcgcgaccagacggactccgttttcccgttccctgccgaccccttggcctgcgccgcgcactgctcggagccgtgcgcccactacggcctctgccggccgccgccgccctcgcgcaccgccaccgtgcacctccgctcctcctctcgcctacccaccccgctcatcgccctatcggcgtccgtcctcgccgtgtccgtagtcctcctcctcgtcctgctcgtctgccacgtcgtgcgccggcgccggcgccatgccgccaacgccgcgccgctgccgctgcaccaccagctcgcccaaggcgggcctccggccgacatggcggtcccggtgccggcggacagcgactccgacgacggggtgcaccacgtgtggtacatacgcaccgtgggactcgacgagcgcgccatcgcg

SEQ ID NO: 66735 - DNA, 628 bp, Triticum aestivum
  Clone ID: PAT_TA_66735
ttcttgcgagagcctgtgaggtatactctgctaatgtgatttggtaaagggcccgggattgtctcttgtcttggatggttggattggattgctacctgcaacgcatctttttttgacctcgttgctttcctcctcttcgtctaccttgctatagatgtgtactagcagtatttgtgctcagtcctagctaagatagccttgttgattggctagcttgatagatcagtggcgataggagtgactaatcaattcgcgtgcccttctgttattgttctctggaaagatttggtcgtccgagctacatgtatctctagctactagttgctttgcgcaaagtgagctcatctctttcgattggtgttcctgcccttttgtctcgtttgctcttgctctgctgattgggttggtggtgtaatttgcttcagtcgttccatcgagctgggtggaccttttggtggcgtgtaactcgggaggatggcgcacgatccgagcctgggcttcgccgactacttctcggtggccgacgcggcggcggcgtcgctcatgcccgcgatggacgagggtgcgccggagctgtacggcttgcagtccgggatggagctgctcggcatgcgcggactgcacgctg

SEQ ID NO: 66736 - DNA, 522 bp, Triticum aestivum
  Clone ID: PAT_TA_66736
gtttgatcgaccaccaaaagcaatgtcgcgcatgcataagcgtgcgtgcaggtaaactggtacaggtccaccccaccaccccctgccggcgccgttgcggcaccgcagtctgcctcctcgccggggatggcattcgtgcaaccagcaattgccaccgggccaaccgtcgcgcgcagacgaccggcagatcagccggccaggtcacggagcaggtgaaacccggcgctcatcccccggtagtgctggtcctgcacgccgtgggacgacccctcggcggcgccatccatgccgaactggatgttctggccatggccgccggacggatgcaaacccacgccgtccatttgctcgcccgggaacaggaacccgcccgcgccgtgctgcgcggacgacggcgcgccaaacgcgatgttcacgccgtcgccgccgtgcgtgtcgtgctgctgcagccccagcgtgagcgacacgccgcccccgaagccctggccctgcccgccgtacgcatcgaagtcaagggggtgg

SEQ ID NO: 66737 - DNA, 212 bp, Triticum aestivum
  Clone ID: PAT_TA_66737
agggcaattggagagaaattttgaaaacacccaaacgcgttttagaaaatgccgacgcgggcacaatacatcacccgaacagtgttacactgatatatttactggccgggcttccgatcatccatactggagtcggccgatctagttcctgccgaaggaggcaaactagccgagcttggtggcgctggcccttaggacatactggtggtagg

SEQ ID NO: 66738 - DNA, 114 bp, Triticum aestivum
  Clone ID: PAT_TA_66738
ccgctcgtctcgttcgtgtgctggaacgtctttctgctagcgctgaaggggaaggctgtggcagagtaagtaagttagctgtggcgatggctcaggcggtgatgccggcgatgc

SEQ ID NO: 66739 - DNA, 348 bp, Triticum aestivum
  Clone ID: PAT_TA_66739
cgggtcacccccaaactttattttgcgtttataaccctcacatgaaagggaggggctataccctccaaaaacaaacacccgggggggcgcggccaccgaaatatgcactaaataagcgggaaaacattacccacccaaattataattaaacaccccttgcccccaaaaaaacacggcctatttcgcaataatcaccctggtcgttattgtaaagttcactcaaagggaccccctgaaaaacggttgggtcctattacccaccctggatgtaggcgttaagccgcttcaactcctccttgggctcgctaaccaccacgcgaaccacgtcgccgatggaaaccatcccca

SEQ ID NO: 66740 - DNA, 667 bp, Triticum aestivum
  Clone ID: PAT_TA_66740
gaattcggcacgaggtccaccggacgaggccgtctccatcggccctatccagcggacggccccctctccggcgaccagacgggcgcttccctttactcccatcaatttggcatcgccccgcccatggagctttcgccatgcccgccagcggccatggtcgggaccgacaccatacttggatggagaggtctgacaacggaccaatgcgaccgtggtggtctgaccacggcggtggatgcggcgacggaggtctaggaggagagatacgtgcgctacaactctgaaggcggcgacggagaccagggaggaggagaaggaaaggtaagccagctacacagtgggggaggtcgaggagacgagggagaggcacgctctcaggtctcggcagtgtgtgtagggtgctcgctagaattccccactcatggaagcaggcgaagtagcgcaccctgccaccgaacatgacagctctgagtattggttaagaagatttccaacgccaaatctgaacgaagctacaaaggtgaaccagctagcgatggttgcagggaacaagacaatggatcctcgtgatgagagcagatgcgtactgcttggtttggatggcagaggcaaaccgaataagtggggtaaggttctctcaaaaaaaaagtggggtaaggaacacaca

SEQ ID NO: 66741 - DNA, 620 bp, Triticum aestivum
  Clone ID: PAT_TA_66741
ggaagttgggcatgaaaaaatgaacttcggtagtagcaatacaactgcaaggatacataatcttgataatttccataaaacaacctatctttaaatgggttctttcgtttctcttccactatttctttaccgttatacctccttggcatccgatataggttttacttggtgtcaatgcgtgaggtgtcgtcgcgtgccccagcatgatcttttgcatatttttccgaaatgccagtcgcccaaatttgactggaggcagtgatgcatgtgtagctggtaacctcaacgcaacatcttgcctatgcctgcattccccgcactccacctcacccttgctgctgcgaccctgaaattcagtagtacagcctcataaccaaaaggcagaaatgttgtgcaaatgtaactgctgtgaccctttacattccagcattctttttgttgctacacctgatggtgcacgttcaaagattaagcagactgggtactacattacccttcacctctggatcatcacccatgacaacatgatacataagggagaacactttctggtggttctgtgtcttaagtgcaaaatgacgatcatggggtcttaagtctcggctaagttgtcacttgcc

SEQ ID NO: 66742 - DNA, 448 bp, Triticum aestivum
  Clone ID: PAT_TA_66742
gaattcggcacgagacaccatccaccagttgggctcactgaactcgcaggcagccccagccaccagcgaaatggccgcgtcggcgctggaccacacgaccagcttcctcggcaccgccccgtggcgcgatgacctcgtccgcatcgtctgctactttggcggccgcatcaccatgcgccggaccgtcaagagcgcgccccagagcatctggtacggccctgaccgtaccaagtacctgggcccgttctccgagcacaccgcgtcgtacctgaccggcgagttccccggcgactacaggtgggacaccgtcggattgtctgctgaccccgagacgttcgccaagaacagggagctggaggtgatccactcgcggtgggcgatgctcagcaccctctggtgcgtgttcacggagatcctgtgcaagaacggcatcaagttctgcgaggcc

SEQ ID NO: 66743 - DNA, 494 bp, Triticum aestivum
  Clone ID: PAT_TA_66743
gaattcggcacgagggaagctcctagccaagaccaatcaaagcctccatccaatcccaagcaacctcgaggatgtcttgctgcggaggaaactgcggctgcggcagcgcctgcaagtgcggcaacggctgcggcggctgcaacatgtacccggaggttgaggccgccggcgccaccctcctcgtctccgccaccgccacccacaaggcgagctcgggcgggatggagatggcggcggagaacggcggctgcggctgcacccagtgcaagtgcggcaccagctgcggctgctcctgctgcagctgctagatctatcatcggtcatgcatgcaccgcgcgcatcatatctatgatctatctacaatctacttaccatgtaacgccacctgatcgagggtctttgtatgtatgtaagcacctgccagcatgagcagagcaggtgcactgccatgcatgtaaaccgacccctaaataaaatctcccgtggtttaacct

SEQ ID NO: 66744 - DNA, 224 bp, Triticum aestivum
  Clone ID: PAT_TA_66744
gcggaatcaatttacattgcacgcagctagcgataggacctcttgctcgctcgatcgtggtactaataaacacacgaagtaccttccattacacgacgatccacgacgtacaagtacacatgcatatctcggccgatggacggacggacggacggacgggtaacctcatttaccttccgggggccaagttggtggcgaaggcccagccgttgttgttgaccggc

SEQ ID NO: 66745 - DNA, 397 bp, Triticum aestivum
  Clone ID: PAT_TA_66745
aaacaaaacttcccccaaaaaccctttgaaagccccaaaaaaaagtctgacctctgaatttttgaccccaatccccctcacataaaaaggggcaatttattctgccccaatcctgtctgatttttaaagccccaacccccaagctcggggagcaatctcgaaacgaatgaaaccccatcccgctgggccattttataaactttaaatttagaggataataatggagttgcttcgttgcgttttctgatcaaccccgaccggtcaagccagcggcaacctccgagcttttggttcactcgtaaaacaccttgccctccacggggttggggtcggtcttgcaataatcccccaacgggtccccgttgcccccggtcccggcccccggccacttggcccc

SEQ ID NO: 66746 - DNA, 650 bp, Triticum aestivum
  Clone ID: PAT_TA_66746
gaattcggcacgagctcacccactcccccagagtctagccccccggcgattacagcggcgagtccttccggcgattggagcggcagcgagtggcgcgggagtgcggcggagaggatgcgggagggctgcgtccgtgcgatagggcgacgcatgccgggcaccacgccgcgcctgcaggaggaggtggcggtgaggatgcgtccggcgggagggagctcctcctgcacgtccagggcgccgtccggcaccacgagtgcgcgcaggccgcatccgggagtgcgagcagcgtggcgctgccggtcgcgcccgccaccgacatcctgccgcggcggcgtggtcggcggggacccgttcacggcgtcgctttgtcgggtcgcacgagtacggcggcgaggatgtggatggctgcatcgggcggctacgtagccggtagatatggaggcggccgcggcactcgagaagagggagcggctagtgattgggccaaggtctgggtcctcccgtcgtcgcacacggtcgctgaggagagtcgacggctatggaggacatcgagtggcggtggcagccgctcccgcttctgctccgagtgtatcaatggcgtcgtcagccgtcgacccctccatttggggcttgctcgaggaataaggcct

SEQ ID NO: 66747 - DNA, 134 bp, Triticum aestivum
  Clone ID: PAT_TA_66747
aaagcagcaaacttagataaatcatattagagtagacatacgatcatttactggtggatgataatgtctctttttaccaacaaactaacttccttactttttgccatacatccaatgtcacagtcactgaaatg

SEQ ID NO: 66748 - DNA, 186 bp, Triticum aestivum
  Clone ID: PAT_TA_66748
gaattcggcacgaggaccctccaagccgtatcccgggactcacgacgaactgccccatcgagtgagcgtctaccctgttatggcacagtcgatgctcatgaggaagatggcctcgttggactgcacacgagcctgctgcaggctgcccggccgtccctgaacaaggcggaggctcgggacaagatc

SEQ ID NO: 66749 - DNA, 594 bp, Triticum aestivum
  Clone ID: PAT_TA_66749
gtttaaaagggcagaaaaacatacattagcttggtgctaaaactcatacatgcacactagtttaggcgtacaatactcttgttcggccaacccaaattattattttggttgccatgcatcagacctgcatgtctcaagaacacttgtactgacagaactacatcagttctacatgacaaattcagcaaccatgactcaagaacacctgtgaaattctacatctctcatttcttcaggttgcagccactgctcacatgccagccaacctgagatcacctactttgtggcagttgtttcgcctgtgaccttcaattccacagtatttgcacctagacggtttgcgaacaggttccggggcatcacctcggtcagggcaggtcgttctcttgtccccttgcccgcgacatatggtgcaaaaccggggtcgtttgctcaacccctcgtatgatgccttctccctgctagttgatggccgccccatttctttgcgcttctttggtgccaactgaccgctcagtctgttcccactctcatttgcagaagtagcatcatcgttgacagtgcccatgcctgccccaccacttgcagcaacca

SEQ ID NO: 66750 - DNA, 552 bp, Triticum aestivum
  Clone ID: PAT_TA_66750
atgtataggaaacattttttcgtggggcgtgacattgtgttggttttgacaacagtggaagaaggctggacaagagagacaagagagatgcaagggtgtgtgtgttgtgtgggtcggatgtgtgtggtagaaacataatcgtaaagagagagatacgaagcaaagagaatgattggacaagacaacaaaaaaatggaaaagaacaggtagacagcatgaagaagagaaaagcaaggaatgattggtgatctgggcggggaaaggaaagcgcctgcgtttaaggttttggtaagcaggatgaatattctaccacgcggcacgccacaaagatccggggtcgatgaagctcgcggcattgccgccgccggcggcggcggcctggtggtcgtcctgttggtaactagctttcgaggagctcccggcaccggaaagatcgttctggatctgcttatggacgaagcagagataatcgacataagacatggcgtcgttattctggtcctcgaccaacagattagcgaactcgaactcggtcgagtcgagcgattggcg

SEQ ID NO: 66751 - DNA, 641 bp, Triticum aestivum
  Clone ID: PAT_TA_66751
gaattcggcacgagcgttgatgtaacgtctcgtggaaacacacctttttactgcacacctgagtactgggatagtttcaagggtgatatggatgatcctgtccaagtaccagaagtatctgatgaaaaagctgccacatctttggagacggacgaaatcgcatcgcatgcgtcggttggttctcaaggagtacaagaggaagtggaggaggttactggcaggcgcaagcgcagaggatcacaacatgtcaagtcttcttatgtggtccctaaaccaaacaaacatgcaaaacgttctgccaaaggaaaattgttccaaaatggtgatgttaacaaatctggtgatgagtatgatgtggtgaaagcgtccatcaagtacgtgcgtgcgcatgagcattcacaaaaacatgccaaaacagaaattttcaatgatggcatggaagaaggtctcactgtgcggagagcttgtcagattattaaccatgagtggctaagtggcgacataagttaatttcatatattgttttacaattgattcgaaaatgccattgttaaatctaacacattatttataggtaattgatgcatactcatcatttttggtggacaaagttaatgatgatcatttcatgttaacaactt

SEQ ID NO: 66752 - DNA, 412 bp, Triticum aestivum
  Clone ID: PAT_TA_66752
ttcaacccccaacgcgattgcttcaaggtccattccaagctgcataaggtgctgaccacggacacagcggcgagtgtgacaatgcggatccggtgctccaacgggctgcgaatctccgagcatttcggctcgttcctgcaacgcaatgtcaccgacctggagtttgggaacctcaatgcggacaaggcgatcgcggcgttgctgaagatcgagggcaaattgaaggacaacggctcggtggaggcccagctccaatgcgcccttctctacacctccgccgccggagaacgcagggtcaggtgccataacttgaccctgcccgtcaccagggtcatcgggaacatcttccggtccgccgatatggacgcgacgatggccctgttgacaaaacaatatattgcgcatatcgtgc

SEQ ID NO: 66753 - DNA, 562 bp, Triticum aestivum
  Clone ID: PAT_TA_66753
gaattcggcacgagcgtcgccgtccggtggtagtcagcggccgccaccgcgtgggagcatcggagggctgctcgccggagccacccactgtgtcagagcgggacgcaccaccaggccatatgtggaagcggaatcatccgtgaccatccctctgccggagttcgtggcggctgccatctctgattccggtgcgtttgttccaaccagtaacggcgcacgacggtgtccatggttccgcacaccatgctgcgcccgtttggcgtaaacccgtgcgccgcgggtggccatctcagacggcaccatgcccggctgtgcctccgccgtgcgagctcggtggatgcgacgaccgggactttgccgggcggtagcagcaacaccaggaggaggaagaagcaggccgcggaggagtcgcggttggaggtcctttacgacgacgggttcgggagcgccaccatgaaggactactgggaggcggtgagggccatgcccaaggacgacggcgggccgccgcggtggttctgcccaatggagtgcggccggccggaggtggacagggcgccgc

SEQ ID NO: 66754 - DNA, 598 bp, Triticum aestivum
  Clone ID: PAT_TA_66754
gaattcggcacgagggcggatgcagagcacaccggccgtgcatgcacgcatgaaggccggcgtgtgatcgagagccagctgcatgcatgcgctcgtcgtgaggttatcaaagctacgtcgtcgcgatcatggaaaaacagggaagcagccaccagctggacaccttcgctcaactggacggcggggcggcgccggaggagccgatcggcggtggcgcgggagctgagatggtggactacatgctgggccagacaacgccgctgcctccgggtgggccgcacggccaggtgtccttggacaagctcagcttctccgacgtgctacagtttgccgacttcggccccaggctcgcgctcaaccagccgtctgccgaccaggacgacgcccgtgacgacgatgaggaggacagttacttcttcaggttccagtcccagctctccggctcggacgaccccgatccccgcggaggcgcaggtatccaccacgcggcggagcacgagggcagcaagacgggggacggatcaggaggcccgcacgatcacggcggcggcgtctccgagagcaccacgctggtgcagcagtccgacggcggcgccag

SEQ ID NO: 66755 - DNA, 379 bp, Triticum aestivum
  Clone ID: PAT_TA_66755
gtttttgggattttttttttattttttttttttttcttttttttttagaccaaaaaacatattttgtttataacaaaactttcaaaaaattaaaaaagttgcatcaaaattaccttgatcatgataaacaatctaaaaagtttaaaatgcaaaaaaaaactaaaatttaatggcccaagctttatgcataacctaaattgaccaaaaccccatgatttcactttgttaaacgttttaaaaaaaaataactaaactcgtcacccttaataaccatttggatcataatgcctccccccaaataaatcataacaatcttcgccataaaaattatcacccttgccataaatcacaattcttaaatactgtctcccattccttt

SEQ ID NO: 66756 - DNA, 367 bp, Triticum aestivum
  Clone ID: PAT_TA_66756
cacgccctaccgtcaggcccgccaccacgttcaccgtgagggcgtcgtctgctgaggcggaggccgccggccgccgcgcggtccttggtctcatggccagcggagtcgtcggcatcgcgttcgctcatgtggtgcacgccggcaccgtcgcggccatcaaggttggcccaccgccgccgctctccggtggactccccgtcacggacaactccgacgaggcaagggacttcgacctgcccctgaagaaccggttctacctgcagccgctgccaccggcggaggcggcggtccgggccaaggagttcgcccatgacatcctcaacctcaaaccgttcatctacaagaagcaatggccgtactttatgaa

SEQ ID NO: 66757 - DNA, 662 bp, Triticum aestivum
  Clone ID: PAT_TA_66757
gaattcggcacgaggccactccaggggggggtgctggagttctccgggctgaggagctcgtcgtcgctgccgctccggcggaatgccacctccgacgacttcatgtccgcggtctccttcaggacatacgcggtgagcaccagcggcgggtcgcggaaggcgccgacggaggccaagctcaaggtggcgatcaacgggttcgggcgcatcgggcgcaacttcctgcggtgctggcacgggcgcggcgacagctcgccgctggaggtcatcgccatcaacgacaccggaggcgtgaagcaggcgtcccacctcctcaagtacgactccacgctcggcatcttcgacgcggacgtcaagcccgtgggcgacaacgccatctccgtcgacggcaaggtgatcaaggtggtgtccgaccgcaacccctccaacctgccgtggggtgagatgggcatcgacctcgtcatcgagggcaccggcgtcttcgtcgaccgcgccggcgcgggcaagcatctcgaggccggcgccaagaaggtgctcatcaccgcacccggcaagggcgacatccccacctacgtctgcggcgtcaacgccgacctctacacccacgccgacaccatcatcagcaacgcctcctgcaccaccaactgcctcgcccccttcgt

SEQ ID NO: 66758 - DNA, 608 bp, Triticum aestivum
  Clone ID: PAT_TA_66758
gaattcggcacgagcacacgccgcgtcacgggccttttgatcgctccacgtgggcatctgggtccatcccaccgcttccccttatccttttatatccttccctcggtttagcacatccactcgttccccaaatcttccttccccaatctctctgattctaatcccctctcaccgcaaccactccttgccggccatggtcagccagaccacggcaatcttccccagcgagctgtcctgctttggtgctcgcgcagctcctccctcacccacgcatgcaggagggttgtgtggtggactggtggtgcggtgttgcaaatggagagcgcaggcggctatgggacgggtggtgtggcaagacgctgctggaacagccatggtggcggagttgcggtggtcaccactggcagtgtaggaacttcccatcaaggatgctggaaacgcccggcgaaaaagctgcaaccactcgacggcgacgggagcgcggcggcgcgggcagccgacgaggacgagcgcggcgccgcgggcgccggcgagcatgggcggcgcaggggcaagcgcggaatcgtggctggtcagcgaggggaggaagcaggagacctggcggagct

SEQ ID NO: 66759 - DNA, 262 bp, Triticum aestivum
  Clone ID: PAT_TA_66759
aatgtggaatcaaaacgcgcatacgaaatatgggatgaatcacaatataaccatggggtggctatggataattaggcctaaatttatgtcgataaataattggcattcagcaatgtttttatccgaactccctccttcctgcattggctttttggccatttccatccacttagtctcatttctgcggtactcatcctttccctccccatgcatcaccttccggatgcatctctccacctactacctactcaccaagcctttc

SEQ ID NO: 66760 - DNA, 618 bp, Triticum aestivum
  Clone ID: PAT_TA_66760
gaattcggcacgagcccttcctctcccaacgccacgttcgcggaggtgctgcagatccccgccgaccaggccgcgctggcgctcggggcgctcgccgccgtgctccccggtgacgacgacacccccgcagcggacgacgcgtcggaggccgacctccacgcaaaccctagcgcagctcaaggcgaagctcgtggcgttggggccgggcacgtgggtggcgcggtgctcgcggaggcgctacagatccccgccgagcaggtcgcgctggcgctcggggtgctcgccgccgtgctccccggcgacgacgacgaccccgcaacggacggagctggcgcctccccgcccccatctatccactccgtccagaagcattctagaatcagcaactgaaataggcaaagttagcaactagaatctggggtgggaaataggcaaatacaggaagcataatggggagtttgtcttcgcgacaattatggagcgggtgctctgcttcgaatatatgcatggcggaagccttgataaacacattgaagatgaagcttgcgggcttgagtggcccacatgttacaagattattaaagggacttgtgagggaataaattaccttcacaactc

SEQ ID NO: 66761 - DNA, 642 bp, Triticum aestivum
  Clone ID: PAT_TA_66761
aatggagggcatttattagacgagaaaattctgggggatttaggaatgtatcaccgcatatcctaatatttccctgagggaacgacaagatcgacccgaatttttcgacccagttttagcggggtcgcataccgcgatccaaaataccgtcccgaagatgagtagccctcttcgaccctcgatttcagacgtcgcgatccccgtcccgcgaccccgttcctcgacccgatcgacccaaatttctggcaactatggtctgacagtcgtttgattttggatatccaactgttattgctgatagcttcccatactgagcatcttttcctaacttttaacaacgcttgccatagcttctccaaaattgtcgtcttcggcgttgagtgtgcatgtcggctgttgattatgatatatgttgatctgagtggccagttccaccttttttttccttcttctacctgctgtgtttagctgctggaccagatatggtgtcagtgtcactaaccaccttgataatgaccggaattacctggagcattattgatgtacatataggcatatagccaatgcctctctttgggcccaatcatcacaagttgcataacaagtggataaacgagaggcgagagcgattgatgtccccct

SEQ ID NO: 66762 - DNA, 579 bp, Triticum aestivum
  Clone ID: PAT_TA_66762
aaaagggtgtactacatgaaacgggtgcaaattccatgacactctacttctgtaatgcattgcacaacaaacactcgacgcaaaaaatcctggtccacttgcaaaccaaccagcaccagtccaccaccatatatgcacacatgcttattgtacggtcaacgagcctcatcactatttacaacctacatcatgcacaaccttcgatcagctccaactccagccgatcaaatcacaaggatcaaagtgagattagcagcggtgatgatcactggatcgatcggaggtgtagttcatataaaaagttcagatgaacttccagcagattgatcacgaagcattttcagtgcgaaggttgaagaattggtcacctctgtgtgtgtatgctgcatgagcatgaccccggccgctgaaactttcagctagccatggtatcttctccaagcgtcttccggagctctctgaggctgcgagcgatgtcgtggatcaccgcctcgccgtccctcccgttcctaaccgagttcacgctgtgctccaggaagctccgatccgcttccagcgcctgcagccgccggctgagct

SEQ ID NO: 66763 - DNA, 388 bp, Triticum aestivum
  Clone ID: PAT_TA_66763
aaaagggaatcgggcccttccacccaactccgaaaatttttaccttgaaacttgtttacccatacaaggacggcacacaaaaccgggatgctaaaaaaaaaaaaacccttacattgcagggaacgcggaaaacaccccaaaaaaaaaaaaaataaacaaacttgggggctcataaccatttccccctataaaccctcctagtcaattttaaaaaacccgggggattagaaactccggaggggcccgggggggtgctcatgcccgcggtttgaaggaacttgggaaactcgaacaggcttatccccccatttttggggagggcggccccccccaaaaaggggtcaagggatcccttcaggcccgggggctttttaagttcatggggggg

SEQ ID NO: 66764 - DNA, 343 bp, Triticum aestivum
  Clone ID: PAT_TA_66764
ggggcccaaaaggaccaccccgaaaaaaaacccggtgccaaaaaaaaaagccccccctttaaaaaaaaaataccaaaggtcaaaaccttaaacgggaaagggccaaaaacttgcccggggaaaaccattaaataccccttttaaccgggggaaaaaaaccccactaaacccctttgaaaaaaaaaacaacggggggaaaaaactttgcccaggggaaaccccctagaatcccttgggccaacggggggggggcattccctttaaaaacccttgtgtcccccccttacccccttcaagtccaaaccccagggaaaaaacccttccccccgggggcccctaaaaa

SEQ ID NO: 66765 - DNA, 650 bp, Triticum aestivum
  Clone ID: PAT_TA_66765
gaattcggcacgagcatcagtcctgcttggggcatgcaacgttcttaagaaaatcattgttccaaaagaaggcacaacacattctgcttacagatcaagcttggcagttgcctttctgtttacttttctttacccgatgaccaaacgcaatgtgaagcctgcaagatcagctcgtctaaatggccatgctgcttctgataccaatggaaatccaaattgtccacccagtgcagatattgacttgtcacttaaggagaccaatagtgtggaatctggtctgcatagcaatgaccacatacttgaatcttgcaagcagatagttgaaatcagtaaagattatctcccagttggcataccagccaagaaagttggagcagaactccaagcctctggtgaggctgtatatgtggatgacatcccttctccagagggctgcctttatggagcatttgtatatagtacaaagcctttagctcatgtgaatagcatagagctcgacccttctctcgagcaggtgaaaactgtggcagttatcactgttaaggatattccagaggggggtggcaattttggggccaacactatatttggacctgaacctctgtttggcgatccacttactcagtgtgctggggaacctcttggtatcg

SEQ ID NO: 66766 - DNA, 392 bp, Triticum aestivum
  Clone ID: PAT_TA_66766
aagggactgccttaacatacccctaaaaaaaaggtcctggcttaacatccaggctaaaggggaaattttttcaacttcaagggcttttttgggttgaaaatcataacattccccacaatttttgtacaaactgttccacacaaacttatttttaccataaaataccccgtttccccctttcaggtcaaatgccaaccccaacagggctcgcaaactaaaacaaccttttacgtgtacacagttcccttccccacaccggtttaattttggcccaaaacattgcacggattttgcttacaagttcgttttcggtttgaatggcggcctcacccccctggtaaaggccccaattttaacaaactcctccggggaaaaagggtggatcccaacgg

SEQ ID NO: 66767 - DNA, 644 bp, Triticum aestivum
  Clone ID: PAT_TA_66767
gaattcggcacgagctgatcaccagcacaggcgcgcatccaccgctgctagcaaggtcgagcaagcagcacagagatggctgctgccttctcctccaccgtcggtgccccggcttctacgccgaccaacttcctcgggaagaagctcaagaagcaggtgacctcggccgtgaactaccatggcaagagctccaaggccaacaggttcacggtcatggcagcggaaaacatcgacgagaagaggaacaccgacaagtggaagggtcttgcgtacgatatctccgacgaccagcaggacatcaccagagggaagggcatcgtggactccctcttccaggcgcccactggcgacggcacccacgaggccgtcctcagctcatacgagtacgtcagccagggactcaagaagtacgacttcgacaacaccatgggaggcttctacatcgctcctgctttcatggacaagcttgttgtccatctctccaagaacttcatgaccctgcccaacatcaagatcccactcatcttgggtatctggggaggcaagggtcaaggaaaatccttccagtgtgagcttgtcttcgccaagatgggcatcaacccaatcatgatgagtgccggagagctggagagtggcaacgccgg

SEQ ID NO: 66768 - DNA, 353 bp, Triticum aestivum
  Clone ID: PAT_TA_66768
ggggtttttttttttttttttttttttttttttttaacccaaaaacgagttgaattctacatcaaaacctggcaaacaatagtatattttacaaatccccagtgttaaaacttcctttgcaggaagtctattataatccgggtctggaccctgaaaaatcaaaaaaagaaaaaagaaaaacaagaaaagaagggaaaaaaaaaaagccggggggagttcgataccttgaattcccattacaaaaaatcgatcatccgggacaagggggggggaaaattttgagaggagtaacttaacagggcaatgcccccgtccggggttaacttccattggtgggcaacaatgccggcgag

SEQ ID NO: 66769 - DNA, 365 bp, Triticum aestivum
  Clone ID: PAT_TA_66769
gaattcggcacgaggccaggggatctactgggcgtaaactcattggagccgacgacccgtgcgcgtgtggttagccgccgctgttgatagcggagaatggcgaatgccgccgagcaccgcgtacagatgcaggcagctcctcccgccggcaaggtcgtccccgccgcgccggagaagagactgaatcgcttagcgcactcgatcgcgtcgatggagagggtcggcaacgctctgggcacgctggacttcacatgggcgaccgtagtcgtgctcagcggctacccgacagtgctccacgtgctggatttctggtttgccacggccataattttcctggaaggattgaggtacgtatgcaattttat

SEQ ID NO: 66770 - DNA, 438 bp, Triticum aestivum
  Clone ID: PAT_TA_66770
gaattcggcacgagccagtggatctcactgagctcgcaggcagccccagccaccagcgaaatggccgcgtcggcgctgcaccagacgaccagcttcctcggcaccgccccgcggcgtgatgacctcgtccgcagcgtcggcgacttcggcggccgcatcaccatgcgccggaccgtcaagagcgcgccccagagcatctggtacggacctgaccgtcccaagtacctgggcccgttctccgagcagaccccgtcgtacctgaccggcgagttccccggcgactacgggtgggacaccgccggattgtcggctgacccagagaccttcgccaagaaccgggagctggaggtgatccactcacggtgggcgatgctcggcgccctggggtgcgtgttcccggagatcctgtccaagaacggcatcaagttcggcgaggcc

SEQ ID NO: 66771 - DNA, 563 bp, Triticum aestivum
  Clone ID: PAT_TA_66771
gaattcggcacgaggcaaggtgtatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtaaacaacatcgtctctgtctttctactcattttctagctgacggacggaagtcaataacatcaattgtgtagaactagaattctagcctgttaatgtatcaaaaatgtcaatcttatttgcaggtgtggcccatcgagggcattaagaagttcgagaccctgtcctacctgccaccgctcagcacggaggccctcctcaagcaggtcgactacctgatccgctccaagtgggtgccttgcctcgagttcagcaaggttgggtttatcttccgtgagcacaacgcatcccctgggtactacgatggccggtactggacaatgtggaagctgcctatgttcgggtgcaccgacgccacgcaggtgatcaacgag

SEQ ID NO: 66772 - DNA, 605 bp, Triticum aestivum
  Clone ID: PAT_TA_66772
ttatgaattcggcacgagctacagtcctactgtcagcctcagctcgcccgaagcaaagctagcgagtacgcagcgcgcgatggcggccgcgaccatggcgctctcctccccggcgatggcgggcacacctgtgaaggcctccagggcggcgcccttcggggagggccgcatcaccatgcgcaagacggcgggcaagcccaaggtggcggcgtccagcagcccgtggtacggctccgaccgcgtgctctacctcggcccgctctccggcgacccgccgagctacctcaccggcgagttccccggcgactacggctgggacaccgcgggcctgtcggccgaccccgagaccttcgccaagaaccgggagctggagcgatccactgccgttgggccatgctcggcgcgctcggctgcgtcttcccggagctgctcgcccgcaacggcgtcaagttcggcgaggccgtgtggttcaaggccggctcccagatcttcagcgagggcggcctcgactacctcggcaaccccagcctggtgcatgcgcagagcatccttgccatctgggcctgccaggtggtgctgatgggcgccgtggagggctaccgcgt

SEQ ID NO: 66773 - DNA, 469 bp, Triticum aestivum
  Clone ID: PAT_TA_66773
gaattcggcacgaggaagcttctcctcctcctcctcccgccccgaaatccgcacccaaaatccgaattctagcgggaaaaaatcgccgccgggaaccaaattccccgattgttcgcctcgcacgcgcctcggattccgggcctggagcctcgctggggagatcgagtccggagccggaggggatgtcagggcccctcgaccgattagccaggccatcttttgaaggatttacacataatgatggaaagaaagagagcagatcggatgcagacaactcacaaggagagaagaagactaaaatagcctccttcaagaaaaaggcaattaacgcacggaacaaattcagacatttcctatggaggagaagctaaaagaagaatgaatatcagatttccatcgatgacataacagatgttcaagatctacaggccgttgaagcatttcgacaatgcttgcatgatgaggactt

SEQ ID NO: 66774 - DNA, 606 bp, Triticum aestivum
  Clone ID: PAT_TA_66774
gaattcggcacgaggtcaagagtgcgccccagagcatctggtacggccctgaccgtcccaagtacctgggcccgttctccgagcagactccatcgtacctgaccggcgagttccccggcgactacgggtgggacaccgcggggctgtcggctgacccagagaccttcgccaagaaccgggagctggaggtgatccactcacggtgggcgatgctcggcgccctggggtgcgtgttcccggagatcctgtccaagaacggcatcaagttcggcgaggccgtgtggttcaaggccggcgcccagatcttctccgagggcggcctcgactacctgggcaaccccaacctggtgcacgcgcagagcatcctggccatctgggcggttcaggtggtgctcatgggcttcatcgagggctaccgcgttggtggcggccccctcggcgagggcctcgacatcatctaccccggcggcgccttcgacccacttggcctcgccggcgaccccgacaccgccgccgagctcaaggtgaaggagctcaagaacggccgcctcgccatgttctccatgttcggcttcttcgtgcaggccatcgtcaccggaaagggac

SEQ ID NO: 66775 - DNA, 414 bp, Triticum aestivum
  Clone ID: PAT_TA_66775
gaattcggcacgagctggcccgactgctcagaagtcggtctgaatctcgggggctacacccagcgggagcgctgacacgcccctgcgaagaagaagaaaaagtagttttcgggagatctggcccgacttctcagcagtcggcccgaatctcgggggctacacacagtgggtgcgctggcgcgccccacggaagattgcagacaagagaaaagttttgtccgactgccagcagccggcagaagagaaaaagaagaaaaaaggcactgcaagatgcctcgccgcctggccgatcgagcctaacgggccgggaggctcgaaggctacacccagcgggtgcgccggcgcgctccgcgagcgccgagtcgcgccagctgtcttcgacgaccgcgactacacaaaaatcaatgtgagctc

SEQ ID NO: 66776 - DNA, 263 bp, Triticum aestivum
  Clone ID: PAT_TA_66776
gaattcggcacgagctaccacgagcgcctagtacagtgctagtgtctgcctaccctcacccgatgcaaaggtagccagtacacaacgcgcgatgacagccgggagcatggcgctctcctgcccagctatggcagacacacctgtgaatgtctggagggagacacctttcggggaggggcgcgtcaccatgcacaagactgtggacaagcccagggtggccgagtgcagcgagccggggcacggctccgaccgcgtgctatacc

SEQ ID NO: 66777 - DNA, 122 bp, Triticum aestivum
  Clone ID: PAT_TA_66777
gaattcggcacgagcttacttgtcctcatgccgccgaccctgatgcacggacgaacccccgccaaggtgggctagatacgatagaaggagatcatctagccaatggtgcgcacagtacagct

SEQ ID NO: 66778 - DNA, 571 bp, Triticum aestivum
  Clone ID: PAT_TA_66778
gaattcggcacgagtctcaaagattaagccatgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagccgcggtaattccagc

SEQ ID NO: 66779 - DNA, 115 bp, Triticum aestivum
  Clone ID: PAT_TA_66779
gaattcggcacgagctgactctagccgcggcgctcatcccgaccaacccgcgtctgcacagcaaggtcgccttcatgcagaaggttgacttctccgacttctccgggctgaggcc

SEQ ID NO: 66780 - DNA, 166 bp, Triticum aestivum
  Clone ID: PAT_TA_66780
gaattcggcacgagctgaaaccaggaagggcgtaacaagcgacgaagtgcttctaggagttaacaataaccatatatccggagattcccaaataagtcatgccttttaaactgtctgttgaattcatgagcaggcaagagacatcctggcgaactgtaacatctta

SEQ ID NO: 66781 - DNA, 286 bp, Triticum aestivum
  Clone ID: PAT_TA_66781
gaattcggcacgagcagaactaaattgttaggggtattaagagcctcagtttgcaatcgcagttgccccttttttaggatctgacctgacttgttgttgtatcagtgtggacagtggggattgacaatggcacctcaagatgttcgttccctctgcatatgctgcctctgaaactggagttgttttgacgtgaggagatttcctccagtgcatgaactgattgttggattagctgttattggtaacagaagatgtgtgtatcaggctgcaagcggggtgggtggcg

SEQ ID NO: 66782 - DNA, 406 bp, Triticum aestivum
  Clone ID: PAT_TA_66782
gaattcggcacgagtctcactgaggtcgcaggcaggcccagccaccagcgaaatggccgcgtcggcgctgcaccagacgaccagcttcctcggcaccgcaccgcggcgcgatgacctcgtccgcagcgtcggcgacttcggcggccgcatcaccatgcgccggaccgtcaagagtgcgccccagagcatctggtacggccctgaccgtcccaagtacctgggcccgttctccgagcagactccatcgtacctgaccggcgagttccccggcgactacgggtgggacaccgcggggctgtcggctgacccagagaccttcgccaagaaccgggagctggaggtgatccactcacggtgggcgatgctcggcgccctggggtgcgtgttcccggagatcctgtccaag

SEQ ID NO: 66783 - DNA, 361 bp, Triticum aestivum
  Clone ID: PAT_TA_66783
gaattcggcacgagaagaagctggagaggccaactgctcaagttatatggaggaaatggcttgggtaaaagaagtgtatggtgtaagcaccgcagaagcaatggaactcttggagcactttttggctatgaatccagacagcgatggacgtgttaaagcacaagatttttgggctccttttggcctagattgcagtcctctatgcaagaagatatttcactacttcgattttgaaaataaggaatccatcacattccgacagttcctggtcgggtgtgcgcacctaaggaagcagccgatgtttgagggagtgtgcgaaaccgccttcgagaaatgcaaggcccctgggacctctgacata

SEQ ID NO: 66784 - DNA, 500 bp, Triticum aestivum
  Clone ID: PAT_TA_66784
gaattcggcacgaggcaagtttgaggcactagacttgagtggcaaccagattgaaggacagttgcctagatctctagcttcttgcaagtacctggaggtcctcgatattggacacaaccaaattagtgactcttttccatgttggatgactgcacttcccagacttgaagtcctcgtcctaaagtctaataagttatttggacaagtgtcaccttctattgatgatgagaaaagcacttttgagtttccaaggctgcggatcctggatctggcctccaacaacttatcagggacattgacagaaggatggtttattagattgaagtccatgatggttgaagttgtgaatgaaatgtcagtcatggagtataacagctatcaaaaccaagtataccaggtcaacaccgtgctcacatacaaagggtatgccggctcctttaccaaaatactaagaacccttgtattcattgatgtctcaaacaatgcaatccatggtagca

SEQ ID NO: 66785 - DNA, 531 bp, Triticum aestivum
  Clone ID: PAT_TA_66785
gaattcggcacgagtctcactgagctcgcaggcagccccagccaccagcgaaatggccgcgtcggcgctgcaccagacgaccagcttcctcggcaccgccccgcggcgtgatgacctcgtccgcagcgtcggcgacttcggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacgggtgggacaccgccggattgtcggctgacccagagaccttcgccaagaaccgggagctggaggtgatccactcacggtgggcgatgctcggcgccctggggtgcgtgttcccggagatcctgtccaagaacggcatcaagttcggcgaggccgtgtggttcaaggccggtgcccagatcttctccgagggcggcctcgactacctgggcaaccccaacctggtgcacgcgcagagcatcctcgccatctgggc

SEQ ID NO: 66786 - DNA, 181 bp, Triticum aestivum
  Clone ID: PAT_TA_66786
gaattcggcacgagctgggccgagttactagagcgctgctgacccgacgagatgttcgaattactactctacggagagctcgcccgaagactcaagaaaaccatccctatgctgaccaaccagattatgaatctggagtgcaggactttcttgaacgtttgacacattatgaaaaggttta

SEQ ID NO: 66787 - DNA, 524 bp, Triticum aestivum
  Clone ID: PAT_TA_66787
gaattcggcacgagcaccaggtcatctcactgagctcgcaggcagccccagccaccagcgaaatggccgcgtcggcgctgcaccagacgaccagcttcctcggcaccgcaccgcggcgcgatgacctcgtccgcagcgtcggcgacttcggcggccgcatcaccatgcgccggaccgtcaagagtgcgccccagagcatctggtacggccctgaccgtcccaagtacctgggcccgttctccgagcagactccatcgtacctgaccggcgagttccccggcgactacgggtgggacaccgcggggctgtcggctgacccagagaccttcgccaagaaccgggagctggaggtgatccactcacggtgggcgatgctcggcgccctggggtgcgtgttcccggagatcctgtccaagaacggcatcaagttcggcgaggccgtgtggttcaaggccggcgcccagatcttctccgagggcggcctcgactacctgggcaaccccaacctggtgcacgcgcagagc

SEQ ID NO: 66788 - DNA, 583 bp, Triticum aestivum
  unsure (1)..(583): unsure at all n locations
  Clone ID: PAT_TA_66788
gattcggcacgaggatacggcgcccgtgagcgggcgtcggcggcaaccggagagagggagcaagcgacggaggcggcaacgttccccggttaacctgtagctttgaggccgcctcgcacgagagagcgaccgctgtagccggagcgagggagtgcatggcggcagcggcgactattccccgcttatctgtagcttcggggccgcctcgtgcgagcgagcaatggcaataacccgagcgagggagtgcacgtaggcagcagcagcgattccccccggttttcctatttcttctgaggcctcctcgcgctagccagcggcggatttcgagcgatggaatcgagggacaagactgcagcagctgctgggcgcacgacggggatgaagccagcgacatcaacaactgacttgggtacgattcctttaacatcccgacttgggaacgaactccgctgcacctacatcaatcctagccggcttcaagatgccacgcggacgcgaagtggaggaccgcgaccccagatggccatgacgtcgtccttcggccctgcttcactgnggcgtggtctttcagtgtcgagcagcc

SEQ ID NO: 66789 - DNA, 464 bp, Triticum aestivum
  Clone ID: PAT_TA_66789
gaattcggcacgagggatgaacaccgtgtccacgatgaagtacccatacgagggtctcctgatgaacgagttcggcggagagcgggacttctcctcgaacccgccgctcaccggcaacgccatcctcgagagcctcaccatcagcgtggccaaggaccgcaagtggaggatggtgctctacctgctcggctgggccgtcttctaccgcgtgctcttctacctcgtcctccgcttcgcctccaagaacaagaggaagtagctcaaccggaagggccgggctccctgtatcgacatatcatgctggtttgctagcttaattaatccgaagctctctggtaatcattcatttgaattgacgggaccacgtacggatcatgtcaagatctctttccaagatttgtagtactcctactgaactgtaattttcagataagacattgtgttgatagagcgtgccgtgattt

SEQ ID NO: 66790 - DNA, 496 bp, Triticum aestivum
  Clone ID: PAT_TA_66790
gcctgaatttcccctcttgattccttgttgtgaccttgctcgtactcacctgcacgcaactctgcaggtcacctgaccgacgcggacactggatgaggcttgtttggctccctgtatgcctcctcgatccctcaggtcggtcaatgacgacggagggttagtatggctcgatgagaagctgcgcgatgcgagcttgtcgaccttgacagtgcctttgttgtcggcgaggcgatgtgagcgtggatctcgtctcccgcagcaagcttggatccacctcgattgtgaggaactgattgtccccgagcaaggcagcctggcttgtcgtcttcatcctgccgcctgacttcagtggctcattattctacctaattaaagaagatcaacttctaagaccagcagatgttaagttccaatcttcatgtgaaaacacatattatccaattttgcgccgctgaagatcgccaccgcctcggtcaatggcgcccccgtgcaggtc

SEQ ID NO: 66791 - DNA, 516 bp, Triticum aestivum
  Clone ID: PAT_TA_66791
gaattcggcacgagcatcggggccggatcccctttcccctctcctcccccgcatcgcccccgtggatgaccgggggcaatcactagcgcccggccacctcccttcctttcacggccctcctccctcgctgccgccacgaggcgccgccgggcaaagcccggccagcgtaggtggcagcggggcccttgtgctctccgctctgcgcatgctggcataggacagctgctcgagtaggcgcttggggctggcgcggggcccttcgtcgtagaaacgggcgagtgggtcactggctcgtgcggctacggcggcacggtggctggctgctaccggtctttggcgctgcggctgcaacgaggttgacttcggcgacggcgtgcaggtggttccctggcaagatccggccagatatggccccaggtggcgtgctcgcggcgtgggaggtggctggagctccagcaagggctctggaaggtggtggcggcgagagtggtctgctcccggcacggatctagtggg

SEQ ID NO: 66792 - DNA, 670 bp, Triticum aestivum
  Clone ID: PAT_TA_66792
gaattcggcacgagagaattcttaattcaagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagggttccgttactaacatgtttacttccattgtaggtaacgtatttggtttcaaagccctacgtgctctacgtttggaggatctacgaattccccctacttattcaaaaactttccaaggcccgcctcatggtatccaagttgaaagagataagttgaacaagtatggtcgtcctttattgggatgtactattaaaccaaaattgggattatccgcaaaaaattatggtagagcgtgttatgagtgtctacgtggtggacttgattttaccaaagatgatgaaaacgtaaac

SEQ ID NO: 66793 - DNA, 446 bp, Triticum aestivum
  Clone ID: PAT_TA_66793
gaattcggcacgaggtccaaggcactgatggtgaaatgccgtatggaacactgtcttatcatcctcgcaaagcaccaccacggcatcacggccaatacggcctcccacctgccgcttcttcccgcgcgccggagcgccgtccgtttccccgtgagggccggcgccgcggagccgcccgcacccgccgcgaagcccggctcgcccaagaagcggtgcaagactgaggtcaacgagtcgctgctcacgccgcgcttttacaccacggacttacacgagatggagcagctgttcaacgcccatgattaacaagcagctcaatcaggacgagttctacgcgctgctgcaggatttcaagacggactacaaccagacccacttcatccgcaacccctagctcaaggaggccgccgacaagatgcacggcccgctccgccagatcttcatcg

SEQ ID NO: 66794 - DNA, 604 bp, Triticum aestivum
  Clone ID: PAT_TA_66794
gaattcggcacgagctcctctcctccgatgatacaataccatggcccccgccgtgatggcttcgtcggctaccaccgtcgcacccttccaggggctcaagtccacagccagtctgcccgtcagccgccgctccagcggcagcctcggccgcgtcagcaatggcggaaggatcaggtgcatgcaggtgtggccgattgagggtatcaagaagtttgagaccctgtcttacttgccacccctctccacagaggccctcctaaagcaggtagactacctgatccgctccaagtgggtgccctgcctcgagttcagcaaggttggcttcgtcttccgtgagcacaacagctctcccgggtactacgacggtcgatactggacaatgtggaagctgcctatgttcgggtgcaccgacgccacgcaggtgctcaacgaggtggaggaggtcaagaaggagtaccctgatgcctatgtccgtgtcatcggcttcgacaacctgcgccaggtgcagtgcgtcagcttcatcgccttcaggccaccaggttgcgaggagtccggcaaggcctaaactacaagttgaaacaatggcctatgtatgatggtcatt

SEQ ID NO: 66795 - DNA, 295 bp, Triticum aestivum
  Clone ID: PAT_TA_66795
gaattcggcacgagggcacatctactgcgccacgtttgaaagaaaagatgcctggtttgaaggagaacacgtcaagtcatgaaatagatcttccaggtgctaaagttggggaggtttgtgttcgctttgccccagagcctatcgggtatttccacattggtcatgcaaaggctgcactgttgaacaagtattttgtagagagatttatagggcgtctaattctttgatttgatgacacaaatccttctaaggcaagcactgagttcgtggagattgttactgaaagatattgaga

SEQ ID NO: 66796 - DNA, 617 bp, Triticum aestivum
  Clone ID: PAT_TA_66796
gaattcggcacgagcttaattcaagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagggttccgttactaacatgtttacttccattgtaggtaacgtatttggtttcaaagccctacgtgctctacgtttggaggatctacgaattccccctacttattcaaaaactttccaaggcccgcctcatggtatccaagttgaaagagataagttgaacaagtatggtcgtcctttattgggatgtactattaaaccaaaattgggattatccgcaaaaaattatggtagagcgtgttatgagt

SEQ ID NO: 66797 - DNA, 507 bp, Triticum aestivum
  Clone ID: PAT_TA_66797
gaattcggcacgagccagcgcctcctacagtcctactgtcagcctcagctcgcccgaagcaaagctagcgagtacgcagcgcgcgatggcggacgagaccatggcgctctcctccccggcgatggcgggcacacctgtgaaggcctccagggcggcgcccttcggggagggccgcatcaccatgcgcaagacggcgggcaagcccaaggtggcggcgtccagcagcccgtggtacggctccgaccgcgtgctctacctcggcccgctctccggcgacccgccgagctacctcaccggcgagttccccggcgactacggctgggacaccgcgggcctgtcggccgaccccgagaccttcgccaagaaccgggagctggaggtgatccactgccgttgggccatgctcggcgcgctcggctgcgtcttcccggagctgctcgcccgcaacggcgtcaagttcggcgaggccgtgtggttcaaggccggctcccagatcttcagcgaggg

SEQ ID NO: 66798 - DNA, 430 bp, Triticum aestivum
  Clone ID: PAT_TA_66798
gaattcggcacgagctcgctgggctttaggggaaaaaatagcacggcagcctctccttcctgggacgacacggcaccgccgccatgaatcccgccgccacgcgcggccggtctacctctccagctaccctcaagcagcgccgctgttgcccagttcttcccctcctcacccgccccaactcctcacccctagcctccttcgcctcaaggcggacgtctctgatttggatatgattccatggcgtgttcacgccgccacgcgcagtcggtcttcctctccagctaccctccagcagtgtcatcgttgccctgttcttcccctcctcccccgccccaactcctaacccccagcctcctccgcctcagaggcggacgactccgatttggagctcaagtactccctcccccgcacctccatccccatatttgga

SEQ ID NO: 66799 - DNA, 308 bp, Triticum aestivum
  Clone ID: PAT_TA_66799
gaattcggcacgagtgatcctccgcggaaggtgggggaacggaacgggaaagaaccggtcttgggcgcgtgctgatctttccggcggcggagatggtggcggcggcggcgatcctgccggagctggccacacagctggtggtgccggtggcggcggcggtcggcatcgcgttcgcggtgctgcagtgggtgctggtctccaaggtgaaggtcgcccccgagccgcgcggcgagggcgggtcggcggccggaggaggcgccggcgcgggcggcaaggacggcgccagcgagtacctcatcgaggatgag

SEQ ID NO: 66800 - DNA, 406 bp, Triticum aestivum
  Clone ID: PAT_TA_66800
gaattcggcacgagggagaaccaaaaaaagagtgtgactaaaacaaatctataacatacacttcctatctttcttttcctgtatacagattttccttagcccccccaacaataatgcctaccgaaaggaattaatctagctaaattaagaatcatctgaggatgaagaaaatgaagatgatgatttgtctcgtattaatatattcccatcccatgcaccacctccagaggcaccatgcaagtttatctctctagatctctctctcttctccggtgctttctttcttctctctttgaatctcctcagtgctccgaataatgcaatgcatgcatgagccatgaatgaataatcaatatatatgtgtaggtaggcatcaacaaccactgtagtctctcaaggagaaccg

SEQ ID NO: 66801 - DNA, 435 bp, Triticum aestivum
  Clone ID: PAT_TA_66801
tgccgtggaatttgtgtgttagttttactttggaattagatgactcttcattgttctttttaccttcatgttaataagtactccctccgattctaaatataagcccttttggagatttcaatacggactacatacggatgcatatagacatattttagagtgtagattcactcattttgctccatatataatccacgttggaatctctaaaaaggcttatatttgggaacggagggagcaatatcttatttctttgcttaatagtcattactacatacacttgtcacaagttgaatactaaatactgttgagctgacaaaaaaaatcaatatattttttgcttatgttacattgggaaatcgagaatgtggcgggctaaatttttcgaagccaattacatgtttggaagtataaattaaggaactataaacatgt

SEQ ID NO: 66802 - DNA, 436 bp, Triticum aestivum
  Clone ID: PAT_TA_66802
acaaaaagcacaacaaagatatttaaggatcaacactgctatacacatgacacctccatggccgatgcttgcatgattctgccatgacagcgccaacagcgaggatgcacacaaaggcgttgttgggagggaacatcgttcataggccgtgcaactactgtcatgtgtgaggcaacatccttcaaggataggaacatcaggacaaagaagggtgcatagttgttagtgctagctaattattttgtactacagaattagtttcgattgacctttcggtattgtatcctttgttcttcacaaggctctattttataaacaccttttatgtcatcaacaacaccctcgacttcagctatctcctccaccttcacagcgagtggtctggcgaggtcacctgtggcgatgtggataaggccgaggagtgcagaagaaaaca

SEQ ID NO: 66803 - DNA, 205 bp, Triticum aestivum
  Clone ID: PAT_TA_66803
gaattcggcacgagcttgtgagcctttcctctgatacataatgcctttggtaaattgtatcctttgctttctcaaccatgctctgcctttgagcttgagttaattacttctgaagatttggtatatgattctaagatgccccgatgggttgaacctatgccttccttagtatgtgtgaacccgaaagttttcacgagtcatactt

SEQ ID NO: 66804 - DNA, 551 bp, Triticum aestivum
  Clone ID: PAT_TA_66804
gaattcggcacgagatcacagagcaagaagagaagagagaagcaaagcttgagatggcgcaaaccatggcgtccatgaccggcctgtcgcagggcgtgcgtctcccaggcccggccggcaggcgcgccagcaggttcatcgtgagggcgtcgtcggcggaggcggaggccgccggccgccgcgcggtccttggcctcatggccagcggagtcgtcggcagcgcgttcgctcaggtggtgcacgccggcaccgtcgcggccatcaaggttggcccgccgccgccgctctccggtggactccccggaacggacaactccgacgaggcaagggacttcgacctgcccctgaagaaccggttctacctgcagccgctgccaccggcggaggcggcggtccgggccaaggagtcggcccaggacatcctcaacctcaagccgctcatcgacaagaagcaatggccgtacgtcatgaacgacctccgcctgagggcctcctacctgcgctacgacctcaagaccgtcatctcctccaagaccaccaaggaggaaaag

SEQ ID NO: 66805 - DNA, 352 bp, Triticum aestivum
  Clone ID: PAT_TA_66805
gaattcggcacgagccacactacaccacacccccttggaatctagcagggccatcagttttggagcgagcatgtgacagcgcaccacggatcctccctaaacaaatgaattaatagcacaagtacaaagtggctggttgtcgcacacgagacgagcgggagagagagggttggatccgggctcgcccgccccattcaataattcccatatgcggccctgcccctccgccaggcccgcggctggcccacccgtcaacgggcgctccacgcgcgcgcccacccgcaccgtcggctgacgcgtgggcccgtccgcaccggggccccacgaggcagcgtcgcggcggactttcccg

SEQ ID NO: 66806 - DNA, 197 bp, Triticum aestivum
  Clone ID: PAT_TA_66806
gacgtcggcgcgagcttcttctttcgccgcgctctccttccttcgagggtagtatcccgacttcccgagccatctccagtgcgcttagatcttcatcgttggagcgaagctcccgtgttctgcgctcatctttggtagccttcaatccgagagctggtcgaggtttaggcactttttcgcggatgcatcgtttgttc

SEQ ID NO: 66807 - DNA, 148 bp, Triticum aestivum
  Clone ID: PAT_TA_66807
gaattcggcacgagctagttgcctattgacccctcactggcacaccgcgccttcctcaactccgactcccacaatagcagacgccgcgcgcttgccgagctccgtccagctgcacatcatatccatgctagacgtgcgtattatgctc

SEQ ID NO: 66808 - DNA, 240 bp, Triticum aestivum
  Clone ID: PAT_TA_66808
gaattcggcacgaggggcattctgctaggcgcgtatatacctacatagcacaaccatggacgcaacagcgatggccatggcgctcacctccatctctgctttcgagtggctgaaggtgatcaacaacctgctcgtcagccggaggtgcaccctcgctagtgtcggctgcgtcggcgccggcgaaacgatcacgcgcatgcaggtggggcccatcgagggcatcaagaagatggagaccat

SEQ ID NO: 66809 - DNA, 392 bp, Triticum aestivum
  Clone ID: PAT_TA_66809
gaattcggcacgagtttatcctctcgccgggcaaccgacgccgtccactccggcttcgccagttcgcctcctccgccgtcgccatggccgacgctaaatcccaaggccgagcagcgactaccgctctcagttccactcccactcccacatgggcggaacggaccgaggccctaacgcacatcctgacccacccctcccactcgccgtcgctccactcgcagctcttcctcgcgtcccgcgtcccgtgcccacctcggggctcctcctacccgaccttcctctgccccggcgcgtcgctcctgcggtgggcactcacctccgtcttcctgccccgcgcggaccgccttggcctgccgacttcgacctggcgctcccggtgcccctttcagctc

SEQ ID NO: 66810 - DNA, 235 bp, Triticum aestivum
  Clone ID: PAT_TA_66810
atctcaagcactgaaagatgcattaaagtctaaaccacagaacaagatgcacctatatcccttgtatgctacttgcataaaacttcctttttttccatcgaatatatcacaagcatcgaaagatgcattaaattttagatcacacaagaaagacctatatcctttttgctactcgaaaaagtttcttttttcttccagataactgctacatggaaatataccgcaagcaattccc

SEQ ID NO: 66811 - DNA, 476 bp, Triticum aestivum
  Clone ID: PAT_TA_66811
gaattcggcacgagattcatcgctgatcaccagcacagccgcgcatccaccgttgctagcaaggtcgaccaagcagcaccgagatggctgctgccttctcctccaccgtcggtgccccggcttctacgccgaccaacttcctcgggaagaagctcaagaagcaggtgacctcggccgtgaactaccatggcaagagctccaaggccaacaggttcacagtcatggcagcggaaaacatcgacgagaagaggaacacagacaagtggatgggtcttgcctacgatatctccgacgaccagcaggacatcaccagagggaagggcatcgtggactccctgttccaggcgcccacgggcgacggcacccacgaggccgtcctcagctcctacgagtacgtcagccagggactcaagaagtacgacttcgacaacaccatgctaggcttgtacatcgctcctgctttcatggacaagctt

SEQ ID NO: 66812 - DNA, 466 bp, Triticum aestivum
  Clone ID: PAT_TA_66812
gaattcggcacgaggaagaactcgtcgggagggctcgagatctgtgttgggagaggggaattcttgaggtcggaatcggaacaagcgggcgcgctcgggatcggggttaccatacaatttttcccaggaacctttagtgaatgtgctaatggagtcaaagggtggcaaaaagtctagcagtagtagttccctgatgtacgaagctcccctcggctacagcattgaagacgttcgacctgctggaggcgccaagaagttctctgctgcatactcgaactgcgcgaagaagccatcctgatatcgtttttggcatccccttcccgtagtttaagatttttatgcaattttattctgactcttttctcccaccaatctctctggcttgctgcttcacgataatcgaccagctctctagtctttctccctctgttcctctctgctctgctttctgactcaaaactgcaac

SEQ ID NO: 66813 - DNA, 423 bp, Triticum aestivum
  Clone ID: PAT_TA_66813
gaattcggcacgagaccacgcctgcctcatctctcggagcagcagcaggaggagcttgcaggaacaatggcggcccagggtcttctctctgggaggcagctgcttgggaggcctctgcagtcttccatctccaggtcgtcttcctcccggaagtccgccttcgtcgtcagggcatcgtccagcccccctgccaagcaaaatgacaacaggcagctgtggttcgcgtccaagcagtccctcacctacctggacggcacgctgcccggtgactttggcttcgaccccttggggctgtccgacccggagggcaccggggggttcatcgagcccaggtggctggcctacggcgagatcttcaacggccggacggcgatgatgggcgtggggggcatgatcgccccggaggccctgggcaaggggggc

SEQ ID NO: 66814 - DNA, 516 bp, Triticum aestivum
  Clone ID: PAT_TA_66814
ttttaattcggcacgaggaaatacacgagtacgtttagaggaaaaacatcaatagtagcagcactagcaatcacaaaggctacctacggatgcacaccaagccgttatatgcacgcacaccacatgcatacacaacacacacggagcacacaacacgccagcacacatgcacaccatacgtacgcaagcacacggcgatgttccgcatgcaacatcacacacgcacaccttcaggcaggcggctgtgtactagagaagggaaagtcttccttccaggcgttgagtcatggaactcttgtcagttattttgctgaactgatacagaagaactgtcgcaaatcctttcggaaatatagtgaataaacgctgcagttttttgctgcaagatgtgccgatgtcctttactgacaacgccttcctgatggatcgttggaggatacaacgagagggaggaggcagcagcacctctcacaccctctcacacgctagcatccgctagatccgtgacctccaatt

SEQ ID NO: 66815 - DNA, 357 bp, Triticum aestivum
  Clone ID: PAT_TA_66815
gaattcggcacgaggcccaacccagtaaacgactgccacccatccgccggtgaaatggcccaagggcgcattctccccctggtactctccgtcctggccacggtcgccgaggccgtcgcctcctgctccttcaccgactccaacccgatccggcccgtcaccgagcgcgccgactcaacgctcgagtccaccgtcctcgccgcgctcggccgcacccgccacgctctccgatttgcgcgcttcgccgtcaggtacggcaagagctaccagagcgcggcggaggtgcggaggcgccaccagatcttctacgagagcctcaaggaggtgcgctccaccaaccggaagggcctgtcctac

SEQ ID NO: 66816 - DNA, 117 bp, Triticum aestivum
  Clone ID: PAT_TA_66816
gaattcggcacgagcactaatccacctaacgcgacacacacactgagcaactaccgctcgacgatggactatgtcgtccaatataatgggctgcgatatgggcgtgatgctgccgct

SEQ ID NO: 66817 - DNA, 531 bp, Triticum aestivum
  Clone ID: PAT_TA_66817
acataaataaagcatgaagtttaaactgtaattatggggaaaattacactgtaattacataaatgaagcatggagtttacactgtaattctaggaaaattacactgtaattaaaaaaatgaagcattgagattacactaaaatctgggctaaattacactgcaattctagggtatattacactgcaattacaaaaaggaagcatggggattgcaatgaaattcttgaaaaatagctttatcaaaccctctatcatcactagaaagatcctgaaaaataattcagtcaacaaacaaaaaaaaataataaactgaaagaaagaataaaaacgaaaatgaaagtagagaacaagacagaaataactaccaaagacatagcattagaaccatcttccgcaaagtcattaggcacaaaaggatcattccaagaatcagcactcatgatagaagaaactaccgaaacatccttgtgagagactttccgtagtctccccattgacctaaacctaacaaaacagaatacatgacacacg

SEQ ID NO: 66818 - DNA, 152 bp, Triticum aestivum
  Clone ID: PAT_TA_66818
gaattcggcacgaggtttttttttgttttacttttcaatattacacattctttctttcttgtgtgggaatccagtacatattacctagtcaaattgttttcttgggtggtaattattcacggacaacctcacacagctgggcaaattaatca

SEQ ID NO: 66819 - DNA, 518 bp, Triticum aestivum
  Clone ID: PAT_TA_66819
gaattcggcacgaggatgcagtgaatattttgcttcgtggtgattgggcagatgactatcaacaccaactgcagcatcgtccatcttgcgagcataccaccaagctgcgcagggttaaggaggatttcaccaagaaataaaaacggagaagaggccataagtgctactaccaatagcctcaaacaagaaaatggatactttccgcgatatctgtgcaatatttcaaaagttttagcaagtgtctaatcatataacgtgaataacaaattactattagtatgagcagtgtgcatggttcagaaaagagtaaacaatgtgagttactattctatacagtggatatcttctttttacaggcctaagcttaaagaacaagtgaggtattgtgaccaacaccctgaggagattgacacacttgtagaagtgaaggctcagttttcagaggcgaagaaatgccacaaaacttcaagaaggtcagcggcgtcaggtctggagatgcggatgcccctacatagcgt

SEQ ID NO: 66820 - DNA, 311 bp, Triticum aestivum
  Clone ID: PAT_TA_66820
gaattcggcacgagagcacacacaacacaatcttggcgccccactccctgtgctgtaggacctaacaagatgcaacctgattctccgatcctacttcgcagacgagggcggcgtcgggaggtttccgggctgcgcgttggtgcatgcaacagaggggcctctccaacaaccgccgctcccgcggcttctcccgatcccgcctcgccgtcgagggcgcctaaacagaaaccccaccgccacctccgggctcacaccttcttaacaacaaacacacaccagagctgacactcacacctttgaaacgaccacac

SEQ ID NO: 66821 - DNA, 391 bp, Triticum aestivum
  Clone ID: PAT_TA_66821
gaattcggcacgagcctgactcagctccatcgttccgtactactctactactccgacgctgcggggctctcggctaaccacctcacctcactagctccccccacctacagtaaacaacagagcatcaaagatccggaccgccggagccggagctggttattcgcatggccgcctcgtgcagggagctggccggggccggcctagcgcggccggcgacctcgagttcgcagcccggccggagccggaaccagctctgcttcgcgccgatgcggcaagaagagcggcaagggaggagcagcaggaggggcgtgaaggtggtggtggcggccgtgagcgaggagctgccgaggctggcgtcggccgggaagggcgcgggggcggcggtgaggcc

SEQ ID NO: 66822 - DNA, 284 bp, Triticum aestivum
  Clone ID: PAT_TA_66822
gaattcggcacgagatgcaacttgcttgctagcagcagccatggccgtcttctcctctgcagcggtgaccgaaccttccttcggcgctaagtgccgacacctacatgcgcgccagtaggacggaggagaccgcctgccagtctaggaaggtccccatccttagcgtcaataattgtggcttcttcaaaagcgtggtgaccatgaacatgtgctccaagtgccacaaggagatggcgatgaagcaggagcaggcaaagctggccgcctactctttcgacagcatc

SEQ ID NO: 66823 - DNA, 685 bp, Triticum aestivum
  unsure (1)..(685): unsure at all n locations
  Clone ID: PAT_TA_66823
tttgaattcggcacgagaccagttcatctcactganctcgcaggcagccccagccaccagcgaaatggccgcgtcggcgctgcaccagacgaccagcttcctcggcaccgccccgcggcgtgatgacctcgtccgcagcgtcggcgacttcggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacgggtgggacaccgccggattgtcggctgacccagagaccttcgccaagaaccgggagctggaggtgatccactcacggtgggcgatgctcggcgccctggggtgcgtgttcccggagatcctgtccaagaacggcatcaagttcggcgaggccgtgtggttcaaggccggtgcccagatcttctccgagggcggcctcgactacctgggcaaccccaacctggtgcacgcgcagagcatcctcgccatctgggcggttcaggtggtgctcatgggcttcatcgagggttaccgcgttggtggcggccccctcggcgagggcctcgacatcatctacccaggcggcgccttcgacccacttggcctcgccgacgaccccgacaccgcagctgagctc

SEQ ID NO: 66824 - DNA, 696 bp, Triticum aestivum
  Clone ID: PAT_TA_66824
gaattcggcacgagggcggctgccgccgggacgtctccgaggggcgcggcggagaggtggagccccggcacccccgccggcttcgcgggctccgggagccacttcaccccgcccctgagcgccggcttctgctcctaccgcgtcaccccgccggcgagcggcggcgggtgctcccggccgccgagggcgccgccggcgctggattccccgtacgtgagggcgaagcaggcgcagttagttgaaaaagatccaaacaaggcagtttcattgttctgggcagctattaatagtggtgaacgaactgagagtgcactgaaggatatggctactgtactgaaacaagcaaataggactgaagaagccattgaagcgataagatccttccgcgaccgttgtcccaatgaagcccaggagtctcttgacaatattcttcttgacttgtacaagaaatgcggtaggacaaaagagcagattgaaatgctgacagtgaagctgagaatgattgatgaggatctagcttctggccggtggaaaactaagctttctaaatctcatggaagagtattctatctctctctcagggatgaaaaggcaaggttgctgggtaacctcgcctgggcctatatgcaatctgaaaactatgaggaagctgaaatgctctacaggcaagctcttgctatagaaactgattataac

SEQ ID NO: 66825 - DNA, 305 bp, Triticum aestivum
  Clone ID: PAT_TA_66825
tttataattcggcacgagctggaaagtattggcagttgtctttagacagtgccaaatctagatgattaaggggatgaggacatcaataaaatgatttcagagctgaggagaaggctacatgatcagttgaaggaaaagaaatatggattgcataagttagacaaagcaattcaagatacaaaaagtatcgaggagaggagcttagagcaacatgcattgaacaaactggttgaaagcgcgtacagtaaacttcagggtgtggaggctgtggaggggactcgagctggttcttgccagaaggctgt

SEQ ID NO: 66826 - DNA, 668 bp, Triticum aestivum
  Clone ID: PAT_TA_66826
tttgaattcggcacgaggtcaactgctgctgtggaaaggagaaacttttagccctgggttcatccggaattttagcagagcaccaactccaggcgcagcttcaagagcagcacttgaagggccagagcaagctaactatctcagatgttgcaaggaaggctttccttcacagtcatttcatggagggacatgctaaaagtggtccaatctctcgtttaccccttgttactatttcagatcctagcaaccttttgcgagatattcctgtttgtcagccattccatctggagttgaacttcttcaaccaggagaaccgtgtggttcagtatccagttagagctttctacttggatggatttaacctgatggcccataacctatcatctggagccgataatctctataagaagctttactctacgattccctcaaatatggaatgccaccccaagtatatttcatatagcccaaagcagcatatgtttctagttgtgtttgaattaagtggtccaagtggagtggtgcatgaagttgttctttactgggagcagactgatttgcagacagtaaacagcaaaggaagttcaataaaaggtcgagatgctacttttttggggccggatgataatcaatatgctattctggaggaagacagaactagcctgaat

SEQ ID NO: 66827 - DNA, 252 bp, Triticum aestivum
  Clone ID: PAT_TA_66827
ttgaattcggcacgagcgtaattcgatcgattgctgctgtggagtttgggaaatagattgagatcctttttagttttgtttgaagttcttttaattctgtggttttggattcttaatctttttctttgttgggttctttttttcctttttctgatgccctgcgcggttgttgccgatgaacttgtctcaggttgctgcgggagatcgaaggggatttttcttggcgccgacgacgacgatgatgacagtggc

SEQ ID NO: 66828 - DNA, 424 bp, Triticum aestivum
  Clone ID: PAT_TA_66828
aaatcccgaagcaacgcgcgggaaaaccatctagtttatttcatgactgttacaaaaagaaatctactccatccctgtaataattttctaaaaaacgcagggcgcaagaataatcaacatgcgtctagctactactccctccgggccaaattattaaaaccacgacgggtaatttgaaacgaagagagtagtagccacaagcgcgccgtctcgtatcattcagaagaggtacttggatagcacgtatttgggcccagcccgggggcccccttgccagggctgcatgggcaccccaagggcatccaagggctgcccgctccggccggggaacccgaccaccttcccctcggccgtcgccggcgacgagaagtaggtgccgacctcgtccccgaacgggccgtacctgccggggttgctgactaag

SEQ ID NO: 66829 - DNA, 512 bp, Triticum aestivum
  Clone ID: PAT_TA_66829
accaccccatcttcctcgcctccgcttccgaaggtcagagatggcggaccgtgctaaccacccgtctgtcatgcagaagtttggtggacagttccaccttgcctccagcttctctgagggtgttcgtgctcgcaacatctgcccttctgtgccatcctatgagaggcgcttcaccacaagctgctacatgactcagaaccttggcatcagtgtccccatgatgtcatcttctccattgtttgccaatgcaccacctgagaagaaaggtgtcaagaactttgcaattgacttcctcatgggaggagtgtccgctgcagtttccaagactgctgcagctcctattgagcgtgttaagctgcttatccagaaccaggatgagatgatcaaggctggcaggctctctgagccatacaagggtattggtgactgctttggccgcaccatcaaggatgaaggctttggctcattgtggagaggaaacactgctaacgtcatccgttacttcccaactc

SEQ ID NO: 66830 - DNA, 584 bp, Triticum aestivum
  Clone ID: PAT_TA_66830
ttgtgacctttccccttgtagaattgctagttggtccatgtgtttcttggttagttctctgaaactatgaccttaatataatttgcttctgtcagtaaacttaatctaaaaatcacatatggaagggactagtcagcctgtattagccttgtcctaattttaacttagaatcttcaagataacctgaagtatgcttatctttcctataatacttgttggaatttaattccattgataaaggtagcattagtatcaagctaactattcagtttaactctaaccattgacaacgttgaacattaatcattcaagttcttccgttttgtaccaagctaaagaactgtgggttgagcatatgtaatcttgataattgctttggatttaaactctatgaaccgaagtgtttttttcagttcatcatctctgtccattttgactttattcatacaccattgaattgatctgttgttgtcttagcttcaagtttgatttgaaaaacgtgtattagtgacaaagcaatgaaaacatgaatcaatgtattgttaaggtttcgagttttccagtagaaaaaaaaaaaaaaaaaa

SEQ ID NO: 66831 - DNA, 476 bp, Triticum aestivum
  Clone ID: PAT_TA_66831
cgcttaacaacaagtttgcggtgcagtcagtgggaaattggcagatacttccctcacaacgttggcactgatatgtctgtggccatgttcagccggctccaggtatctagctatggttgtcgctgctacggaggccagaggaggaagctacgctcttccatggcggccagaggaggaggaggcacttctctggtcagatcagtggctaccatgtcgccgtcaacgtccaccctcctcgacagatcaacttactcccaaggcaactgctcctgatcttgaacacgagcttggaaatctggcaccgacatatgcagctgccggtcaaatttctccatattttggtttggagatttttggaaggaacagttgtttaattgctcagaaccatctctcaaatggaaacatacagcgaagtttttcagtatatgagttatattggaaacagcagcgcatctggaactctcagtaggggtgat

SEQ ID NO: 66832 - DNA, 452 bp, Triticum aestivum
  Clone ID: PAT_TA_66832
aaaccttcctgatggtggataagagaagaggagggttatctgcaataccagatttgagttgttgactatgatcccacctgtgatctcagtcattatgttccttaccgaactggtggggactttccaagtttccattggttgttggttttcacgagatacttcacctggaatcaatgtactagctggtatgtgggtccatatatattgtgcatgtgggtccatatatattactcatccgtcttctcccgacaagaatcggggtctgttgggcaacacacacgattgtagctatcatatcaattggtcattgatgggaaaggccaacggtagtagtataaatctggatgagacgggacgaagagagtatgcaatagattagtagtggggaataggagacaccgggaataagagcatgggtcttgtttcacttcataggtctctgatgtatccct

SEQ ID NO: 66833 - DNA, 185 bp, Triticum aestivum
  Clone ID: PAT_TA_66833
cttcttccctttccaattcttcaacttgcatgccccaacatctcttctcgactttcgaccatctcaataccccactacgactacttgtcccgcttatggaaaccggtgcacgcggctcggttcctgggcttgcctgcgtgttatggggttgtcttgatgtcggttgttgatggtgttgtggcttg

SEQ ID NO: 66834 - DNA, 373 bp, Triticum aestivum
  Clone ID: PAT_TA_66834
gactataagtgatgactatatatgacacgacaacatcatatagccagcagttggctatactactaaccatgctctaatatgccttataaaatgaaatggaggggttagttacttattatatgaagtgaacttagtttgtaacttcatattggtgtagcttcggaatgtgatgcttataatgaaagcaacaagacatgtttttgcgaaagaaaaatcaacaaatagtttgataatacttgctgtttcttgcattaaagtccaccagatgaagtgttttacttgactattactccattttgggtatcccttgtttgataaagctggtgcagcttcatgaactacctgagcatggagggaggaggatggtgcggct

SEQ ID NO: 66835 - DNA, 598 bp, Triticum aestivum
  Clone ID: PAT_TA_66835
cgccccacctacgtaattcctcctccctcgatcccccattctccagcgccctggacgaggaccgccctcgtcatggctcaatggagcagcggctgcttgtcttggagttcctgtttgactcgtcgtctagccgtagcgggccgccgatcccctatagttcttgttcatctcttcctgttcttcaggctctaagcaccaaacttgcaggaggcactacatttgcgaacgatgacaccagaggaatgaacaacttcatcatcttataagagcattggagcaagagagagcaatgcacaagaaagagcaagatagatcaatgttgcagttgcattggagattgtcagctgtatatgaagatatgaaagtgaagaaaaaaaagggacatgtgcctttatcatgatattgtgggttgtttctttagttttagattttgttgctggtatggtcgtctcagtctagttgagaagagagaattcagataatgcaattttttaagggaatgtacttgtagctctgcaatctattgcatacgcaaagatatatgtaatctgaaagcaagcttttcttgctgtcatgaatgaaagcttttattaactga

SEQ ID NO: 66836 - DNA, 267 bp, Triticum aestivum
  Clone ID: PAT_TA_66836
gaatgtagcgctttcattgagcgagtcactagaacgtgtgtagaacttgttggggaacttggcgggtcatcactttgcgacattgctgctgcggttccagattcaacaactattgcagctgaacaggggtccgagggccagagggacacagaggatgagttaaataactccatggtgcctgatcaggagaatgagtcgggccctgttcgtgagaagcggactcgattccaggttgatcatacacaagtgaacagcagggtccattca

SEQ ID NO: 66837 - DNA, 391 bp, Triticum aestivum
  Clone ID: PAT_TA_66837
cccatgggttctccgtgatcctgcacaacgccggccaccgtgggaacagaagcttggaggaagaagcgaaagtatgagctcggccgccagccagccaacactaagctttcaagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccccttcaagcagtggtacctgactcattatggagtcgaaatcggtaggaagaagaaagctgctgcagctgcca

SEQ ID NO: 66838 - DNA, 564 bp, Triticum aestivum
  Clone ID: PAT_TA_66838
gcatatcaccgggcaaatggtcttcttgctactgtagcagatgatatggtgcttgtattgtttgatacagtatcaatgaaaatggtccgtagatttgaaggacatacagatcgtatcactgatctgtgtttcagtgaggatgggaaatggctcatttcgtctagtatggatgggacgctcagaatatgggatatcagtttagcaagacagatagatgcgatgcgcgttgatgtatctataacatccgtctctatgtctcctaatatggatgtgctggcaacaacccatgttgatcaaaatggcgtgtatctttgggttaatcaagctttgttctcaccttcgacaaatgttgatagctatgcaagtggtaaacatgtccggaacgtgcttttgccaactgtttcgtcagccgaaagatctgaggaggaagaacccattaaaaaatcacaagattcaaatcaatctaatattaaaccttttgtcataatggatcatcaaataccagatatgatcacactctcattactcccaaagagtcaatggcaaagcttgacaaatcttgac

SEQ ID NO: 66839 - DNA, 474 bp, Triticum aestivum
  Clone ID: PAT_TA_66839
tctttcaacgtcctccgtgggaaatattgcaacaatctaccaagttttaccgagtcacacataatgcagaatttgcagtccatagcaagtgcgatgcgccgcaggctgcttggtgaagctggcaatctgcctgctctttcagggaataataacgctggaaaattcaacaggaatccagagacctgctgatgttctatctctagggactggttcatttcctgcgttcccaaagtcggatggccaaatcctgatgccttcggttccagaatccatagagaatgttgatgctgcaacaccgaagcaggtgcctgccgaagtgacccaatcacccgataaagagtcatccggtgcgaagtatgacatttggacttacgtcctcatatttctagctgcactactgctcattagcctgattattgcgccaatcttggtctgtcggaagcgaggggatggatcaatagccccctggaaagc

SEQ ID NO: 66840 - DNA, 544 bp, Triticum aestivum
  Clone ID: PAT_TA_66840
aatggtgcagagtggcatacaaggttaggatgctagatgggggtgatgaattcgactgagtatggacaatttgcacatatgggcttgctttgcagccatgtgatgaagctcgtgaaacgaaggtcaccaccttggcagtgcatactaggcaagggatcagcgggagcacctggccggcctgggaggaagaagatgagcttgccatttgccatcttctctgatctgattcttacaaagcgaggaagaagaggataaggcaatgggggagcagcccgtggagtcttgtagtggaaggagctaggtgtggctacggctggacaacagccgtttagcagcaaacgtctgagccgtggaccaagattcggtatcaaacgtctgagccggccttgaaggcgtgatggccattgcattgacagcgacaactgggtgggccacgacatgggaaaaaacagcggatacatgtccatatacggactgacatacctgcagcggttggaatctcagcaaaagctgacggctatgatatcgagtccatttgagctcg

SEQ ID NO: 66841 - DNA, 551 bp, Triticum aestivum
  Clone ID: PAT_TA_66841
tttttttctttttttttttttaacaaaaccaacgacacgggtagggtctctacattagcatgttatactaacatctgtgctctacgtgtactctcttcgtcccataatatataacgtttttttacactacgttcttagtgacgtgagtcatacggcacacgagatcgcaacccacgagcttaattagactcgcttgtcctcttcgccggctttggcatacacgccggagtccgtcctgaggatgatcttggcgtcctgagtcacgtagcacgcccagttctccacgtacgagagcggcccagtcctgagcatcagcgggcgcgcgccgtcctccacgtcgtcgccgtcgtcgccgtcgccgccgtcgccgccctcgtccgagcaagcgagcctcgctgaatcgtgggatggcgcccacacgaggcacacggcgcaaaggagcgcgaaggagatgagctgccacaccgccgggatcacccacgccacgcgccaccggttgctctggtacccgtccgtcgacttgaagtggacctcgaacgcgatccagccca

SEQ ID NO: 66842 - DNA, 362 bp, Triticum aestivum
  Clone ID: PAT_TA_66842
ctgggggcggcgctctgcgccaaccaccgcagtgttgagccttcttcttcttctttgtggtttgctttgtttgtagtacgtacctagctggatttcattcagcactccctggccaagtagattatttcatctgtttagtgtttctgaagcgtcaaatgcgaccagtagcattcttggttcagtaaaattcaggaatctgtcattgtgcagcagaagtaaatgacagttcagaggaaaagtgcctcctgcaaaagaatttttacaagattctgggagaattcagatgaaacaacttatttgctttataatttctaaatgacaattgccatgttataatactgtgagtctgtgttgtgtgtctc

SEQ ID NO: 66843 - DNA, 537 bp, Triticum aestivum
  unsure (1)..(537): unsure at all n locations
  Clone ID: PAT_TA_66843
ccaagttttgagattagctactcagcctagcatcctggtggcggcgacgacgacgacgacgacgacgacgatccagtcggtgaaggcgcggcagatcttcgacagccgcggcaaccccaccgtcgaggtggacattggcctcagcgacggaagcttcgccggggcgccgtgcccagcggcgcttccaccggaatctacgaggccttggagctgagggatggaggctctgattacctcggcaaaggcgtcctcnaagcggtgaacaatgtaaacgccatcatcgggccggcgctgatcgggaaggatccgaccgagcagactgacatcgacaacttcatggtccagcagctcgacgggacctccaacgagtggggctggtgcaaacagaagctcggggcaaacgcgatccttgcggtgtcgctcgccgtgtgcaaggccggcgccatggtcaagaagatccctctttaccagcacattgcgaatcttgcagggaacaagaccctcgtgctgcccgtgcctgctttcaatgtgatcaat

SEQ ID NO: 66844 - DNA, 423 bp, Triticum aestivum
  Clone ID: PAT_TA_66844
cctccggcaagaacaagacggccaccggcggcgtcgccaagccgaagcgcgcccccacccccttcttcgccttcctggctgagttcaggccacagtacatggagaagcaccccgaggcaaagggcgtcgcggccgtcaccaaggcggctggggagaagtggcgcagcatgtcggatgaggagaaggcaaagtatggcggcaagaaggcagatgccccagcaagcaaggcggtgaacaagaaggagagcactagctccaagaaggccaagactgacgctgacgaagaaggttctgacgttgaggatgatggcgaggaggacgaggagtaaatagtagatgagggaacagcagtggtgcaaatcagcgtttgctgcttagggtttagcttgccatgtcgatgtcctcattatgtaatgttatgta

SEQ ID NO: 66845 - DNA, 254 bp, Triticum aestivum
  Clone ID: PAT_TA_66845
ccggttcgagcagctcaaccgagggaatctccgggggcgggactgggaggacgtcgccgctgccgtgaccgacgggcaaggcaagagcagcgggggcaagagcgtggagcagtgtaagaataagatcgacaacctcaagaagcggtacaaggtagagtgccaacgcatcgccggctccgcctcggccagcctctggccctggtacaagcaaatggagcagattatgggcaactccccatcccccggcaccccca

SEQ ID NO: 66846 - DNA, 176 bp, Triticum aestivum
  Clone ID: PAT_TA_66846
aatcaagcgagcggcgcagcgtccgtcgttaggtagtcctgggagcacgcagacggcgacggacgcgcacctccccgacgcctccacttccctggacccgtcgtcctgtctaagtcgccggcggcgtggacgcagcgatgctgcggacggttctgcgccggggaggggcggccatg

SEQ ID NO: 66847 - DNA, 487 bp, Triticum aestivum
  Clone ID: PAT_TA_66847
gccgccgtggctgctgcttgctccgtcgacccaaacgcaagtcccagccgcctccatcttcttccagcagcccgagcgctgctcttcccccgctgcgccggcgagtccacatgccggagccgtcgaccgccgctgcctcaggtcttcagcgccgcaccgaagtctcgccgttgactgcgctaccccgaggcgttctgcctccttctggcgggagaagacagaggaagccgcgccgccgcgttgacgtcctccccacctacctcgcgcgcctcaatatcctccaagaccggcgggatccatcttcccgtgcccgggtccgcccgtccgctccttccgccgctcgccggagtcccacgcgtccccggcgtcgtcaaccactgctccatcctctgcttcaggcgacagaggacgccgctcgtccctgctgcattgactgtagccagcgcccctggcccagcttcagcggccgcgtgggccaccagcaagc

SEQ ID NO: 66848 - DNA, 382 bp, Triticum aestivum
  Clone ID: PAT_TA_66848
aatggccaggccctccctacttctcctgctgctcgtctcggcctgcgccgctctcgctgttgccgacgatgatccgatggtcaggaggttcgagcagtggatgggcaagcacggccgcgcctacaccgacgccggcgagaagcagaggaggctcgaggtgtacatgaagaacgttgagctcatcgaggagttcaactccggtggccacagctacacgctgaccgacaacaagttcgccgacctgacgaacgaggagttcagggccaaggtgctcggcctatgcgctccggggcgaaccggccggcgcgctccgagaacagagaactttgcccccgtgacaatgcctgaaaaagaggctgacaatgataatagtactctgccc

SEQ ID NO: 66849 - DNA, 560 bp, Triticum aestivum
  Clone ID: PAT_TA_66849
gggttatttcatccgtatataaagccccaattagccttgttgcttgagatggtggttaaggcgacatgacagctgttaaggaggagaggagagaatattagtttgtctctatatgaatgcaaaccatatgtcaacatgatcgacatacatttctgaatttaaacgattgtttaatcactattttccgttagtccattggcaacacacaaacattcaactaaccattgttgctgtgcttcttgttgacagttcggggttagaagggagaagttagattgattttctgcgtgcgtgtgcaagctcggtttaacctatgaggctcactggtatagttattttttgaatatgcaatctgaataaacataggtaaaacagtatggtggaatcttgcgacaggggcagaagttagaatcttgagacaatgctataactccttgtccttggtagtttggactttgtaataattatcctagatagatgctagaatggtagtaatacccagtaaacccatatttagcaatggccatgcatgtcttttagaaacaatcatccttttaata

SEQ ID NO: 66850 - DNA, 509 bp, Triticum aestivum
  Clone ID: PAT_TA_66850
cttctctcgctacagtcagtgcgagggcgcggccggcaccgggatggagcggtacagcgctctgggcatgcggctggacggcgggggcggcgatctgccgccggggttccgcttccacccgacggacgaggagctcatcacctactacctcctccgcaaggtggtggactgcggcttctccggcgcccgcgccatcgccgagatcgacctcaacaagtgcgagccgtgggagctgccggacaaggcctgcaagaccaccacggagaaggagtggtacttctacagcctccgcgaccgcaagtaccccacgggcctgcgcaccaaccgcgccaccggcgccggctactggaaggccaccggcaaggaccgcgagatccgcagcgcccgcaacggcgcgctcgtcggcatgaagaagacgctcgtcttctaccgcggccgcgcccccaagggccagaagacccagtgggtcatgcacgagttccgcctcgagggcgtctacgcctaccact

SEQ ID NO: 66851 - DNA, 426 bp, Triticum aestivum
  Clone ID: PAT_TA_66851
aatccactcgaatcctccctcgctagcagcacaaatccagtccaatccaatgcaccacggcccaaccaaccaccaaatcgaagctaaccacgccggccggaggggaatcgaggaggagaaggaggaggaggaagagtcggatccggcgatcgacgggccacacgccggaggtgcggggcggagccggagcgcccgcatagccgcggcctcggagcatctcggcgattggttctagctagggtttcgatccatcaaccgggcccccaatcccggccatggagctgccgccgctcaagctcaacgtcgcccgaggcgaggaggacaggatcagcgcacttcccgacgagctcctcctccggatcctcgagcggctcggcctgcgccgggcggtccgcgccgggacggtctccaagcggtggcggcacc

SEQ ID NO: 66852 - DNA, 651 bp, Triticum aestivum
  Clone ID: PAT_TA_66852
tcgtcctcacgtgtgtggattcgcctcttgctggactcaacacttgcaatgtggacatggtgatcttctttgccctcccccctctaccccaaaatctagatgacatttacatctgtacatacatacatatgttttaattttgactgaaacaatctggatggttcctgcatctatagataaacatgaataaccatgctttggttcagtttgtatgtatcaatttggtttaactttgactgaatatatatatgaatacattttggtttctaggcccttgtaatgatgggcttactgtctgacagggttcattcttcagttatccttgttagtcgtgacccctttagctaatctgtttggaactggtgggtggtacatctgcatgttgtttgatcgaaaggcggaaccgttagtattatcatgtttgctttccttggaaatgattcagctctaggagcaaattattagtttactgtttataatctgtatcatttatcaaattgtgttgtaaattatcattccctagctcattttaattgttttgcattccctggctcattttaattttgttccagtggtggagtataactctgggcagcttatcatccatattcttgcagctttatgttccatctaatatgtatagaaatcaat

SEQ ID NO: 66853 - DNA, 466 bp, Triticum aestivum
  Clone ID: PAT_TA_66853
gttcgttaaccccgcctgcgcatccacccacgtaacgcacgcgcgcaccggcgcagtcatggctcgcacggcgctggtcctcgccgcgctcctccttgccgccgtggccgtggcgccgctggccaaggccgagagcgccgccgacgcccccgcccccgccgacgcgccggctgcagacggcccggcggccgagtccatcgacgagtccgccctcgcgccggccgtggaggttaacagcctagccgacacgctctcgccggcgcctgcccccgacgcctgaatggatgatggcgtacacagttgcaaggatatgtgttccttttcctaagtaaatcgttcatggttggatttttggttttcctaggaaagctagatggattatagcatcacgagtttttgcagggttgtgggttttgtggaaatctagaaataaagcatgttttgagaatacttatccctatgatcc

SEQ ID NO: 66854 - DNA, 594 bp, Triticum aestivum
  unsure (1)..(594): unsure at all n locations
  Clone ID: PAT_TA_66854
cagccacgggggtgcggtggtgctcctcgccggtgtagcaacgcacctcttccgtacaggcagttacctctggcttacgagcctgcgaggtactgctcgtgcactccggccgccaaggcgccactctggatctcttggagtgatcttaaccctggcagacggtacctagcttgcgccaaagggaggggtgctgggtgcggtttcttcgagtgggccgacccggagcctaacgccttcatgaaccagctgctactggatctccgcaacgcagtgtgggctctggaggcacagaatcgtctcttgaatcggagcgtgcatggggcgaggacgcaagtgctcgaaggaatggtagtccaggaggcgacgagcgctcaggtgcaacagaggggtggagaaaatatgatgattcatagccaagattctgagatgcttcgcaaagctgtggcagatctcgaagctcagaggaagttcatggtggggtgcgctctgtcattagtgatgctctttgcattcnggcttgtgattccacgctagatcagttcatgtggagttctgatacttttgcttagactctgctaatttcgggatgatctg

SEQ ID NO: 66855 - DNA, 499 bp, Triticum aestivum
  Clone ID: PAT_TA_66855
tttacttaatacacgatgaacatttcttagaaatagtggtcaattacatcatataatttggttctgtacaaaagaaatttcctcttttgtgtatatatatcctaaataccaccccttgcgatgaactatctgtctttgtccacaaatttggttattcaccatccagcatgtcagttgcagtctcctgttctctataaagaattaacctgagaagggcattcttcaagctgactcctaggtcctagcagaagatgatgcatctaagcgaagctgcctggagatttcttatatgtcccttgctctctactataggtaattaatctctgcatagatggcgcagagtagtaactgccttgatttctttgctgtcccagccccctttccagtagcacagctccctttttttggtcatctacccctggtcatccttatcattctttccatcaatagaagatgaaagagcttcagccttatcatcagacttctcctggtgcacctt

SEQ ID NO: 66856 - DNA, 550 bp, Triticum aestivum
  Clone ID: PAT_TA_66856
tccccccaccctcacagccttccaccgccagcgacactcgacgctgcggccattgccggctcccccaacccctgctaccacggcgccgttgggaatcctccccgccacctgttggaaccgcccgcctggctcccgctgcgaacatcaccgccacctctctgtcgattcccaccccagcggatggtcccctcacctgcgctcgcatcctcagactttgaccaaaaacaagccgggatccgatagtgccccacagttcgccggagtttcatcggccggttctacgcttcaggtatgtggacaaggaggcttgaaatcatggtctttgttctctggcaacctgcagttcgttggtgacaaattgatttttgttgcaatggttgctaaatcctacgagggcctacagtaaaagtgacgtcatctatttgtctgcatatatacaatggaagaaaaatccggaggaaaaatctttaaggccggcagggaaattaattaatcagcggcatccatgcttggatttaattttgggtcaacattggattgcttatctctg

SEQ ID NO: 66857 - DNA, 489 bp, Triticum aestivum
  Clone ID: PAT_TA_66857
ttgggcatactcgtatcttgccattggatggggccagcaaaaatggaatcgagtccgacacaataagagatcgtaagtggctctcccttcagcccagtctctctgcttggagtcatgcacacctatccagcccttcgatcaactgcattgtcaacaccaacagttcaacacctccgtcagcttgtaccggtgtggccaacattggagtagttcgctgcctgtgcttgcagcttactccagaatttgcggtactgtgatatccccctcctgcctcctgtggctgccatggacatctgcaccaatctgaaataaatagcctccagatcctcttggtgagagttgttgtcacctccgtgctccatctccatcttaccgatgctaccactttaaggcacactgctgtcaccgctggcaaatcaagcgatggttgtggcgaatcgggtggctttggcatctgaggagacgaggatttgtaagaagagatgtaag

SEQ ID NO: 66858 - DNA, 513 bp, Triticum aestivum
  unsure (1)..(513): unsure at all n locations
  Clone ID: PAT_TA_66858
cacactcatctgatcacccactatctagccagctagcagcttaaagactagcttgcagctagcgatccatggctcgtctcaacagcaaggctgtggcggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgctgctccggcgtgcaggggctgaacggcctggcccgcagcagcccggaccgcaagatagcgtgcaggtgcctcaagagcctcgccaccagcatcaagtccatcaacatgggcaaggtctccggcgtgcccggcaagtgcggcgtcagcgtgcccttncccatcagcatgtccaccaactgcaacaatgtcaactagttcaatatataatccttcctacgtgcatgcatggacgcgcttgcgtggagcttaatttctacgttgatggagtgct

SEQ ID NO: 66859 - DNA, 237 bp, Triticum aestivum
  Clone ID: PAT_TA_66859
gctggctgcacccctagcaccgccaaggccaaaatggttgaaaaggccggcgggttcggcatgatcgtcttcacccctgaggtgttcggcccggtgatcatcccaaggccccacgtcatcccgacggtgcaagtgcccaacaaagtcgggcagaagctcaaggcctacctgcagtccgagaaagaagccacggcgaacttcatcttgaaaggaacgtcgttcgacaccccgcggtcg

SEQ ID NO: 66860 - DNA, 580 bp, Triticum aestivum
  Clone ID: PAT_TA_66860
tcccaaatccgatccgcgcccacgccttgcgccgcctggttggtatggccccctccgccggcgattccgccgccgccgccacagttccgcggtaccctgcttgggttctcctcgaaaagaaggggtacgacgacgaccgcgaggacgccaccagcgcttcgtgcaagacaaccaccggtcgcgacgtccgggtggccttctacctcgtgcctctgccggagatctcctacttccacgtccacctctccaagctcgagggcgaggacgacttcgacttcatgcccctgtttctcttctcggccaagggcctcttcctcttccgtatcctcttcgtcacccgaagcgacggaagcaatctcgtcgagtacttcatctacaaggccgggcgcggcggcggcccgtcgctcgaacccatcccgccaactcctctgggcagcagcagggattcggtatccgtgggcatcgtcccctgccccgacgacgccgagggcagctacgtcctcgccgatctctccgttgggagtgaaattgggcactacgacctccacctttactcttccaagacttgcaaatggagcac

SEQ ID NO: 66861 - DNA, 549 bp, Triticum aestivum
  Clone ID: PAT_TA_66861
tcggtgaccatcaagcacatgatcgaggacggctgcgccgacgacgggatccccctccccaacgtccccgccaagatcctctccatggtcatcgagtactgcaacaagcacgccgccgacgccgccgccgacgacaccaacaagcacgtcgccgaccccgccgacgccgacgaggacgacgacaataacaacaacaatgccagcgccggcgagaaggaggacctgaagagcttcgacgccagcttggtcgccgtcgaccaggccatgctgttcgacatcatcctcgccgccaactttctgagcatcaaggggctcctggacctcgcctgccagaaggtggccgacgacatcaaggacaagtcggttgaggaggtgcgcgagattttcaagatcgaaaacgacttcacaaaggaggaggaggaggccgtcagaaaggaaaatgcctgggccttcaacgagtagaaacgtttacgagttttagctagtgtactcacttggggtttcatctttgcagctgcttaattaatttgttaattcgtcgcctttctt

SEQ ID NO: 66862 - DNA, 522 bp, Triticum aestivum
  Clone ID: PAT_TA_66862
atggcctgcaacgccctcctcgcctccgcctgggagacggcctccctcacaccggaagagcgcgccgccgaggtggacggcgtgcccatctacaactacatctcgtccaccgacaaccccttgacatgggaccttttcatgcagcacacctcgtactacggagaccggatgcccgtcaatcaggccgtgtggatctactgcctgtccttggtccccgggaggtgggcctatttgtttctaaccggtcttcttcacttcctccctgccctcctcgtcgacatcgtgtgcattgctattggcaacaaattcagagcgatacctgtttacaaaaagatctacaaattttctgaagtgattgcgtactttggcttgcgtgagtggtactttaaaaaccaccacacgaaaaacctctggcgacgactgagccccaaggatcaggagctcttcgccttcgacatcacgcagatcgattggttcaagtacctcggcgactacaccaagggcatgcgcatgttcatgttc

SEQ ID NO: 66863 - DNA, 521 bp, Triticum aestivum
  unsure (1)..(521): unsure at all n locations
  Clone ID: PAT_TA_66863
aaaaaataaaaagtcgttcgccaggagagcagttgcagtgaactcttttagggagctgacgtggtgtcaaatttgcgccaagatccgtgtggccaaatcagatggcaggaagggtgttcgccagcatcagcctccaggtgaacgttcgccaaatagcatttccgttaatacaaactcanttgaaaaaataaatagatttcagtgtaaacttgtctccagaaagtaaattgaagtttttcataaccatgcattactttttgaagacgatgcactagaaccctacctagatgtaggatgtgcaatatacttgataaatacaccctgaagcacctaaatttatcattttgtactccatatagaccgccggagaggcccaatacaaacacactacgcaatacattgattcttatcctttatcagtgtgcacatgttataatccaatttgcttctggctaagattagtgaaacagtttcatattagccagtggttggtcttatgctggacgcacatgcaggttcct

SEQ ID NO: 66864 - DNA, 362 bp, Triticum aestivum
  Clone ID: PAT_TA_66864
gcatcggcctcggcggcatcttccacaccgccatccaggtctatggaaacgaggaatggtcattcggctactgcgagaacggcagcggggttttcagctgccccccggccaagaaccccatgtacacattccgcgagtccattgtgctggggaagacaagctgctcgccacgcacggtaaatcagatagcgcgggagctcagccgggaatggcctggagcctcatacgagctcctctcgaggaactgcaaccacttctgcaacgagttttgcgacaagctcggcgtgccaaaacttccaggttgggtcaatcgctttgctaatgctggagacgcagctctggaggctgctgaaactacagcg

SEQ ID NO: 66865 - DNA, 403 bp, Triticum aestivum
  Clone ID: PAT_TA_66865
ccaccttgctccgcataacagcatttgtgcagaagcggggacaggcgaccacgaacagatggcgtcggcggcaacggcaacacgcacggtgcatgaggtccggtaagatgggctcggcctccccacatgcgtttaggatggcgtgccagatggctcggaacgcgcgcgcccggctcacaagaggtatgcttcagagcacggcggcggcaacgtgcaccgcgaggtcccggagcagcccagccagagcccctctgtactggaggaaccctgcgtctccatcctcacctccactcacaggtaatcccattcccctccgtgccctctctttcctctattttgatttcactggttttgtgccagcagatgagagggagagagaaggaaggaaatgagggagaaagag

SEQ ID NO: 66866 - DNA, 499 bp, Triticum aestivum
  Clone ID: PAT_TA_66866
acagcatgttcggcttcggtcaccacggccaccatggccagaacccccctgccaacgctccggccgccggcggcggcaaccagcccaccttcaagatcttctgcaaggccgacgagggctactgcctctccgtccgcgacggcaacgtcgtcctcgccccctccaacccccgcgacgagcaccagcactggttcaaggacatgcgcttcagcacccagatcaaggacgaggaaggtaaccccgccttcgccatcgtcaacaaggccactggtctcgccgtcaagcactccctcggccagtcccacccggtgaagctcgtgccattcaacccggagtacctcgacgagtccgtgatgtggacggagagcggcgacgtcggcaagggcttccgctgcattcgcatggtgaacaacatccgcctcaactttgacgccctcaacggcgacaaggaccacggcggcgtgcacgacggcaccaccgtcgtcctctgggagtgggc

SEQ ID NO: 66867 - DNA, 532 bp, Triticum aestivum
  Clone ID: PAT_TA_66867
cttcttccttgtcatcatcagggagcatctcctcccgaaattcttcgacacgcgccacctgtgggagctggatgcgtccgagtacgaagaatgcgagggggtgcaccgtgacccatcgataccagaggtatgggcttctgtcactcccggttgcatttactgcatcttttagtctcatgtgcggtttagcatgtcgctgctgctaggatttcatttggttcccttgcccagggtgatggcgaatccatcacacgaggcatagaagatccctctgaatatactgccgaggtgatggaggaattcacgactcaccgtggagaactgaagcacagggctccaagcttccgtgacgagcggctgatacggctgaactctgtccagatgacgagacagttctcccggatctcttcttttgctcctacacggccctgactacgaaaggagattgttcaacaaagaccttttactggcatgaatctcctgacggagggtgcaaaaaatgcggcagctcgtaagtgaacgtacggatgat

SEQ ID NO: 66868 - DNA, 638 bp, Triticum aestivum
  Clone ID: PAT_TA_66868
ccgccgcatcacgcgctgcgccgtcgcggacgactccaagtcgtcgtcgccgccgccgggcgcgtggccttcgagcgcgctatggtgggcaggaccatcgtggccgcgcgccggaggggcaagaacctctggctccgcctcgacgccccgcccttcccctccttccagttcggaatggcaggtgcgatctacataaagggcgttgccgtcacaaagtacaagagatcagctgtcaactctgaggacgagtggccctccaagtactccaaattcttcgtcgagcttgatgatggcttggagttttccttcactgataagaggcgctttgcaagagttcggttatttgatgatcctgaaactgtacctccaatttctgagttaggtccagatgcgctctttgagccgatgtctgttgataattttgtggactcactgagcaggaagaagattggaataaaagctcttttacttgatcagagcttcatatcaggcattggtaattggattgcagatgaggtgctttaccagtcgaaaatccatccattgcagattgcttctagcctaacaagggagagttgtgaagcgctacatcaaagcatccaagaagttgtgaaatatgctgtcgatgttgatgctga

SEQ ID NO: 66869 - DNA, 270 bp, Triticum aestivum
  unsure (1)..(270): unsure at all n locations
  Clone ID: PAT_TA_66869
ggcctcgctcctctcgcgcgccgcctcggccgccttcgccctccgcggcggcgcccggctcctccccagggnagggtcggatgggcgcgcgcggcggaggtcggctgcggggcgtcgctgtcgccgtcgatgacgcggttcgggatcgccgcgcgcttcaacgccatcctttcggccgtgtcggaggccggcggcgccgcgtcgggcgccgtccacgcggtgccgcggacggagcctgtcgtgtccgccgagtggctccacgccaacctc

SEQ ID NO: 66870 - DNA, 548 bp, Triticum aestivum
  Clone ID: PAT_TA_66870
ggccggctgtggccagtttgagttgactgcgtccgtgggttctgccatgactgggaagctctgttctccggtgtggggtgcccgtgcagtggtggtggatgccagatgttggatctggctcatctgttttggcagacagacgacgagggaggaggtggctctggcgtggcggtggcgtgttcgctgcgtcggaggtgtgcgggccaccggagtgctttgcgtgggagtgttgttcgtgctgctccaggcgaaagcctagccgatgcttgatcgaaactgctgtgtggacgacaacgtgcttgcacgacagtgagacgacgggcaatccagccgtcaactacggtttgatgctatgcatggacgatctgataagtgctgtcgtccacaaatcgtccgtcaacatcgtgtgcatagcagcactgatgcttgatggccggcggcggcagcgcccgtgggtgtcgctttcctccttggaggcgccgtcgaggagtttttgcacttcctcaactctcgggtcaagatctacgggcgaaagtcatgatcctgtt

SEQ ID NO: 66871 - DNA, 450 bp, Triticum aestivum
  Clone ID: PAT_TA_66871
taggagataataactttattgcttgccctcaaaggtgctgattatacgatatataaaggccccatgggctgctaacaaactagaaacctatacgtaacaaactagtcttttattctaggaactaatgtatcaggaccaggactcctgcccagcctacgcctcgcctgatgcggccgacggctgctgctcctggccgcgtggcccacgcctgtaggacgtgccccacatgacagagaccaatacaaaaaacaattatttgtttgcccctcttccttgatttccttgtggcatttctttcttcagtttgcagatggccaccatgagaagttcctacttgaaaccatttagatataggtgcagtaattattttacaagctagccaggatcatgcggttttcttaatggagtgttccagcagcagcagcagcagcagcaacaacaacaacaaag

SEQ ID NO: 66872 - DNA, 631 bp, Triticum aestivum
  Clone ID: PAT_TA_66872
cggttaatgatcatcgcatgcgtactaggggccaaataaggatttcatcaaccccaaaaccgcctaaaccttcatacctcactatctctcacttctcttccaaagaattacaaaactgctctacttgatcccaattgggccgctgccatgcaagaagaatataatgctttacttcaaaacaacaccaggcaacttgttcctcgtcctcccaataccaatattgtttctggcaaatggatttttcgccaaaagttccactccgatgggagcctctcacgatataaagccaggtgggtttttcgtggcttttctcagcaacaaggaattgattacgaagaaaccttctctcctgttgttaaacctagcaccattcgcaccgttcttagtgttgctgtctcctcttcatggcccattcaccaacttgatgttaaaaatgctttcctccatggttcccttcaagaaactgtctactgccagcaacctctgggttttgaaaatccatcctttccaactcatgtatgtcttcttcagaaatctctctacggtcttaaacaggccccacgagcttggtttcaacgcttctcctccttcattcaaacaataggcttcactccatctctctccgacacct

SEQ ID NO: 66873 - DNA, 430 bp, Triticum aestivum
  unsure (1)..(430): unsure at all n locations
  Clone ID: PAT_TA_66873
tgggcaacgaggtcgccggcagcgacacgcagtacctcgtcccggccatggnagaacgtgcacggcgcgctggccgcggccgggctgggcgacgccgtaaaggtcacgacggcgatatcgcaggccaccatcgccgtccacgtgccgccgtcggctggcgagttcgccgacgagtccaagccgttcctgctccccgtgctgcagttcctggagcgcaccggcgcgccgctcctggccaacctgtacccgtacttcgtgtacacgtacaaggccgcgggcgacatggacgtcggcttcatgctgttcacggcgccggggacggtggtgcaggacggcgagtacgggtaccagaacatgttcgacgcgagcgtggacgcggtgcacgcggcggtggagcggctcggggtgagcggcgtggacgtcgtggtgt

SEQ ID NO: 66874 - DNA, 638 bp, Triticum aestivum
  Clone ID: PAT_TA_66874
cgtgggcaccccccgccgccactccccgcacccagacgttcccgcccggcgccgaggtacgggtgctcgccggggcgcgtaccgcagccagcccgcctcccccgcgtccgagcagccgcctccgtcccggcggccggagggcgtggccgagctccgccgcctcggcaagtcctactccgaggccgtcgactccgcgcagctcctcgcccccgccaggtacaaccttggtccgccatgtccgccgcctcatatacagattctcccagatgacctccttgtggagattctcatgcgccttccgcctgagcctatctatcttttccgtgcttctcatgtctgcaagcactggcgcagcctcatccacgacgcccgcttcctttgccgcttccacgagttccaccgggggactcctcccgtgctcggcttcttcagcaaccagccatcgtttcccttcttcgtttccatcaccaacaccttcgcgggctccgctgttggcaagattgaccacgactatttgtcggtcttggactgtcgccacggtcgtgccctcctgaaatgctgcgtgtactcgtccgagactggcgtctggggtgagatcacttcgattcatatgcctgattcatttgtcgtcccattgc

SEQ ID NO: 66875 - DNA, 484 bp, Triticum aestivum
  unsure (1)..(484): unsure at all n locations
  Clone ID: PAT_TA_66875
ctcgtctccaccgccgcggcctccgctcccttatcctcggcccgcgtccaccgccggccgctccccgcctccgcggccttccgcgccccggcccgacgaggctggcgctgccgctccgccgcgccgaccaggcccgacccggtgccgtccgaggagcccgcgtcggcgtcggggtccgcgaccaccgccaccgtcgtcacggacaagcccgacgcgccggccggggaggagaagagcggggaggtctccggcggatttgtggaggtgacggtggaagatgcgccggtgtcgtcgcccgaggaggacggcggcgtggacgccttactgggcaagggttacccctcgtttgctgctttgcttttatctgtttattttanagaaaaaatagaggataagccaagcttcagggaccatgatagttggcccaaattgggtggagatcctgagatcctccccactcctacgtttacaaagatgggcgctt

SEQ ID NO: 66876 - DNA, 429 bp, Triticum aestivum
  Clone ID: PAT_TA_66876
agctggcgaccaagcggcccgcaagtccgccccggccaccggcggcgtcaagaagccgcaccgcttccgcccgggaaccgtcgccctccgggagatccgcaagtaccagaagagcacggagctgctcatccgcaagctccccttccagcgcctcgtccgggagatcgcccaggacttcaagacggacctccgcttccagtcctccgccgtctccgcgctccaaggaaggccgccgaggcgtacctcgtcggcctcttcgaggacaccaacctctgcgccatccacgccaagcgcgtcaccatcatgcccaaggacatccagctcgcacgccgcatccgcggggagcgcgcctaggctgttcgtccggccgccaccgccacggttccatcctggttgatcctgattggattcgatccgtcctgttattct

SEQ ID NO: 66877 - DNA, 225 bp, Triticum aestivum
  Clone ID: PAT_TA_66877
ccccgaccaaccatggcggcagcggctggagaggcccctcgggcgctgtcccagaaggagcaggacatacagatgatgctcgccgccgacgtccacctcggcaccaagaactgcgacttccagatggagcgctacgcctacaagcgccgctccgacggcatctacatcatcaatctgggcaagacatgggagaagctccagctcgcggcgagggtcatcgtcgcc

SEQ ID NO: 66878 - DNA, 290 bp, Triticum aestivum
  Clone ID: PAT_TA_66878
cccggtcggtgctggagcactgccgatgtgtataccgagcttgtgccgaggaaagagctagctgatgtgccatcggtttcaccagggtttgtagattgccagatctgatctgacctgattcagcaaagaattccgagctatcaaagctgcttcaacccgaagctctagcactgcgctatcttccactttaagaagactcgatcgatcgtcacggaaagagcagagagaagtatcaaaaattccatggtagcacctcatgttcttgagcgcaagaaatgagtcttcggagt

SEQ ID NO: 66879 - DNA, 232 bp, Triticum aestivum
  Clone ID: PAT_TA_66879
gcgcggcaaagtgggtcaatgcgtgtgttcgagttctttgccgctttggttgatactgttgctcgtctcatggacaagtgttgttgttgatttttcatgatatgcacgagcgggggtttgatttccgtcgccgcggcctgagacgagggtagagcggatgtgtgtttccgtgcaaggtgagatcaacctgtcaacattagccagggcgtacgtgcatgcgcttgtgcgtccc

SEQ ID NO: 66880 - DNA, 383 bp, Triticum aestivum
  Clone ID: PAT_TA_66880
tgctgggcttcacctcccgcgcgtccacgctcgcgctctccgccgcgggcgccatcacctactccgtggccgtcggcgtcgccaccgtcgtctgcaacctcgcggtcgtggtggccgccatggaggagcgctgcgcggggcacgccgcggtgctgcgcgcgtgcatcctcatcaggggccgcgtgcccaccgcgctggcgctggcgctgcccaccaacctgggcatggcggcggcggaggcgctgttccagctgcgggtggtgtcgcagcgccggaaagccgggaggctggcgccgggcgtcgccggcgaggccttctcgatcgcatacatccacgcgctctgcgtggtgctggagatcatcgtcagctgcatgttctaccgg

SEQ ID NO: 66881 - DNA, 210 bp, Triticum aestivum
  Clone ID: PAT_TA_66881
agctcgtccttctcttctctatccactaacaccagccaagcgatgctctcctcttctcgcccgcggtggctagccagccggctggccgcgccggcgtgtttgctgcaacagctggggtggtggcggcgtgctcgtcggtgcacagggcccgaggcggcgtgctcgtcggtgcacgggggccggggcggagtccccgtgccgtggtggtgt

SEQ ID NO: 66882 - DNA, 129 bp, Triticum aestivum
  Clone ID: PAT_TA_66882
gcactcgatgctgccgccgacgacaccgcgggcgcgatccagagcatggcagggaacatcatgtcggcgtgcgcgatggcgctggggcctcctcgccctcctcgcctaggcgagcaaagccggcgaacg

SEQ ID NO: 66883 - DNA, 198 bp, Triticum aestivum
  Clone ID: PAT_TA_66883
aaatcagtttcaaacagcagaatcctgtagctagccgatcggcaatggcgaccaagatctacatcgtgtaatgctccgcgcctccgccgctgctctgctccgctcactcgtcttgcggctggttagctcgatgatttgattgttattgtctgcatcgattcaggtactactcgacatggggcacgtcgccacgctcgc

SEQ ID NO: 66884 - DNA, 365 bp, Triticum aestivum
  Clone ID: PAT_TA_66884
ttcactgttgcatctctggaacagtgcaccaacaacttcagcgatgagaactttctgcgagaaactcggtttggcaaaatctatctaccagagcgcccagaatgcaagtttgtggtgctgaagctttgccacacggctacgaaaatggctactgacgagtttctggagaatgttcggaccatcgccgaccttcgacaccccaacatagaagagcttgtgggttgctgcgtggagcacggacagaggctgctcgtgtacaaacatttcagcgaacacacattggacgacatgatccatcgcggcagcagcgacgctgccgatcccggcaacaagttcctgtgggaagctcggatcgccgtggccct

SEQ ID NO: 66885 - DNA, 360 bp, Triticum aestivum
  Clone ID: PAT_TA_66885
accaaccacccttctcccgccgccgcaccgcgaagcaaagcaggagcagcaggatgccggcgggccacggtctgcggtcgcggacgcgcgacctgttcgcgcgcccgttccggaagaaaggttacatcccgctcaccacctacctgcgcacctacaaggtcggcgagtacgtcgacgtcaaggtgaacggcgccgtgcacaagggtatgccgcacaagttctaccacggccgcaccggacgcgtgtggaacgtcaccaagcgcgccatcggcgttgagatcaacaagcaggttggaaaccgcattatcaggaaaaggatccatgtccgtgttgagcatgtgcagccatccaggtgtgctg

SEQ ID NO: 66886 - DNA, 162 bp, Triticum aestivum
  Clone ID: PAT_TA_66886
gcggccgcgcaatgaatacggcgacgacggcaacacgtcgctggcattggtgcccgtgcccatgcccgaagagcccactgctgtggcgcccggtggttccggggctttcccgcagcctgccgtcaaaccggcggcgggcggcgtgctggcggtgccgccggt

SEQ ID NO: 66887 - DNA, 369 bp, Triticum aestivum
  unsure (1)..(369): unsure at all n locations
  Clone ID: PAT_TA_66887
ttggtcatcgaggcacaagccgtcagcatgtggactttcttggtgtggggtcagatcttcctactaccagngtggaaaacccgcgaaacagagcaaaaaatagcacctctaatgggctgaaggaagtagtaggttctgatgttttttcagcatcgggtcccagggaggaaagaagagaagcgatcaatatccagggtacagcangactctcaagtacaccatgcgatgttcctcaaagacaagtggttcggagaaagttggtgcgaaatggttgtatttctccctctaatgtagtcaaaagaagtgtaattgctgatgaaaagcgggaaatgtgctctacaagtggagtattacgttatcgaaatcctc

SEQ ID NO: 66888 - DNA, 353 bp, Triticum aestivum
  Clone ID: PAT_TA_66888
aatagcattcctcctctcacatactccagcagcaacgagaacaatttcatatcatacatacggttcacgacggcaccagctcttccctcaaatatacactaacacgtcgcggcaatggggctctgcatgtctagcggcggggcgacggtggcggcggtgcgctcggaggggctggccacctcgacggcgatggtgctgctgccaacgggggagctgcgcgagtacccgcgccctgcgacggcggcgcaagccctccaggactccgtggaggcaggagacggctccgccgggtggttcctgtgcgacgccgacgcgatggggttcgagggtcccgtggcggccgtgggcggggg

SEQ ID NO: 66889 - DNA, 451 bp, Triticum aestivum
  Clone ID: PAT_TA_66889
cttacaaatcccagttcatcatcataattcttgacgacattgaaaggtatttagaacctcaatgccacaaaagtatgctgtcatttgtcctttcattttgattgaagtatttggtgctcctttatgaccatttaggttactggagtttgttgccatcggaccacgtttttcatatctgatatcgcaaactcttatggtcctcctcaagagggttcctcctaagggcaaaaacttgcttgttattggaacaacaagtgagacaacatttctagactccattggtatgtctggtgtgttctcggtgacctacgaggttcccaaactgacaaaggaggatgctgcaaaggtgttgcgacatttgaatgtgttcgatgaagcagatgttgagacagcagcagaagcgctggacgatatgccgatcaagaagctgtacacgcttgtcgagatggct

SEQ ID NO: 66890 - DNA, 321 bp, Triticum aestivum
  Clone ID: PAT_TA_66890
tgcggcggtagctcgctgacggcggcccggacggcgacctgcaggtggccaagcggcggcgttaaggagctcctcccccgcaggagctctggcgtggaggcaggcacctgcggctccacccaatctcctcgctgcgggacatgggcgagaagcgaccaagcgtcggcgacgaggcgggctcctctggcctcgctggagtcgcggcgcggcggagatgaggcgggcggcggcggggaggatctcctccgggacccagtattgggacgtggcgcgtcggcgacgaggcgggctgctctgtcctcgccggagtcgcggcgcggc

SEQ ID NO: 66891 - DNA, 291 bp, Triticum aestivum
  Clone ID: PAT_TA_66891
acatttttctactttaccatttgccttttacttaaatgccaggagcattttgtccgtaggatttcattctataactgaagtcactagttctaagttgtcactgaattaggaagcccgttaaaatattttttgttatgaaaactatcaaactttactggtcatatgatagatggctgctgtgtcttatttgtaaccagtattctgtcagttgtgttgcttgaaaaatgcttacctatccatttgaaaccttctagtaagattgttgtgtggaaatgtgtgtgtgtgtgtgtg

SEQ ID NO: 66892 - DNA, 486 bp, Triticum aestivum
  Clone ID: PAT_TA_66892
cccccaccgaaaccatggccgccgccgccgcgaagtcggggccgccgtcctctccgccggggcggccttcgccgcgtcctcccagagggtgaacgcggagggcggctcggggttccgcttccccggcttctcctcccccgcgcccgcccccgcccccgcccccgcctcatgctcgccgccgcccgccgcgccggctgcggaggaggcgccgcccaagccccggaacgacaacccgcggaccaccgccgcggggttcgaccccgacgcgctggagcgcgcggtcgagctgctgcgcgaattcgaaaagagagatgacgctgatgtcaaaaagtcgttcgcccatgctaacaagcgggaggagacgcggcaagcggagttcgctgcaaggaaggccgattacctgaaggaggccgcgcagatcgagctcgagaggacacgtgtagagtatgaagagaagaaaaaacttgcgcaaagtcaagctgaaat

SEQ ID NO: 66893 - DNA, 252 bp, Triticum aestivum
  unsure (1)..(252): unsure at all n locations
  Clone ID: PAT_TA_66893
cagtgctaacacgctggtggatggctccgtttactgccctttctatgaggaagaatgtgattaagataaacacagccaccatggatttctcctctctggatctaccctcgcgggtaattgattacggacaggccgatttcatcgttggggacactnaagatggagagctctgcatgctatatgcatctgatgatttttacctccatgcttggatccgtggtgtggacggtgatggaattgggatttgggtgc

SEQ ID NO: 66894 - DNA, 504 bp, Triticum aestivum
  Clone ID: PAT_TA_66894
cggcggttggctcggcacaacacatctcaatcccaatctcagccttagattacagatcagacggttcatatggctcaaagatagacacatcatcgccatcaactcatatttttataggagtagagatggctcccgtaaagatcagtatctagacctagacgcgtgtgaaatggtgtgcttcttaaaaagtaaaaaaaaaaaaaaaacaggctatgcttctgcgaagcatagtctgtcctacccgaaaagggaaaggcaagatgtgcttttcgaaaaagagaaaagcacaaccgatgctttcatgagtagtatagttgtgctttccgaaaatggaaaaacatagtctatatttccataagaagcacagtctgtgctccccccctcccagaaaaagtgaaaagcacaactctgcttctggattctaggttttttccttaggttttcatttgttttttcaggtttttaatttttatttcttttttggaaaaaaaaaaaaaaaaaaaa

SEQ ID NO: 66895 - DNA, 311 bp, Triticum aestivum
  unsure (1)..(311): unsure at all n locations
  Clone ID: PAT_TA_66895
gctgggctgccacatctatagtgcatgtttgttggataaaactggggatcactctaggaagcgatgcaagttgcggtgaatgcataataatcagtcccggccgttccccagtttcaacccgaaccatgtgaaggtacttgttgccatagctttcgtgctgtagnttttttcacaagttgttcctgcgatgaggcttgtgtgctttgagaggcctggaatgggctgtattgcgaatatatccagcggattggtacgattggaaggcaggttcctgtgcttgatttatgggctatcggaattgtattccagcc

SEQ ID NO: 66896 - DNA, 434 bp, Triticum aestivum
  Clone ID: PAT_TA_66896
cctggtgatgtgggcgacgtcgcggctccgggacagcaggttggtggtggcggagctgccggacccggcgctgaaggcgcgttcccgcccgaggaaatgcagatcatggcgcacctggccagagagtgcctgcagtgggaccccgaggccaggcccaccatgaccgaggtcgttcagatcctctccaccatcgcgccccttgccgacaagcgccgtcgccaccacctgcccgccgccgccgccgccttcgccccgggcttccgtgccgagaagccgcaggaatgctcagtgtggcaagacggcgacgacggccgtcgccgtgatcacctgcacggggggaacggtagcaatgcaaagggcaccgtcttgtcgggcgaggtcgcggttaacgtcggcacgccggcggcgatgggccggagctggcggtcggcgga

SEQ ID NO: 66897 - DNA, 405 bp, Triticum aestivum
  Clone ID: PAT_TA_66897
cccaccaccacccacggcagccggcggtagcgctacgccgccaacacaagctcgcgcgccgtgcggggaaatggcttccctctgggtcgtcgtcgcggcggcgctgctggtcctcgggtgcgcgagcagcggcgcgacggcgcggccgctggtcggcgcggcggcggcgaatcatccgctgcagacgtcgcggccgtacaacatcgcgcacaggggctccaacggcgagctccctgaggagacggcggcggcgtacatgcgcgccgtcgacgagggcgccgacttcatcgaggcggacatcgtggccaccaaggacggccacctcgtctgcttccacgacgtgaccctggacgacaccaccgacgtcgccgaccacaaagagttcgccgcccgccgccgcacgct

SEQ ID NO: 66898 - DNA, 350 bp, Triticum aestivum
  Clone ID: PAT_TA_66898
gtctcgacccaccgccgccgccagcccgcccagcgccgccgcgggcagttcctccatgggaagcaccggctagccgcctcccgttcccccgccagctgctccgcctgcgcctgcccctgctctgctccgccgcccgctcctccctacccccagcctgtgccgcctgctcctccctacctcccgacgccgcattcgaccgtcccccacgccccgacgcccccagtccccggcgccggcaggcagacgcggtcgccaacgccaaccggttgcagttttaacatggatcccaacatgaagcaccttcgaaggactctgattgacatagaaacagacgcagagcaacttcttct

SEQ ID NO: 66899 - DNA, 604 bp, Triticum aestivum
  Clone ID: PAT_TA_66899
tccagctaattttgaggaagtttcaaatgaaattctgaagaagtgtggcggattgccacttgcaatcattactatagctagcctattggcttcccgtcgagaaagatcaaggaatgattgggagaacatacagaattctctaggtgcccagtttgccataaaccccacactgaaagggatgaggagtatattaaacctcagctatatgaatcttcctcttcatctccgcacttgcttcctttaccttgctatgtatccagaggactatgtgattgagagggatgatctagtccgaaaatggatagccgaaggctttatcagtaatttgcatggaccaaatttggaggatgttgggataagttatttcaatgagctagtcaatagaagcatgattcagcgtgtaatgacctacaagggagtttactgcaaagtacatgatatgatgctagatttgatcctaagcaagtgtgcagaagacaattttaatagtgtggcatatacttctgaagacatgacaagactgcgtgactgcacgtacaagatccatcggttatccctgatctcacgtgttgatagaacaacaaatgaaacaatatcatggaca

SEQ ID NO: 66900 - DNA, 494 bp, Triticum aestivum
  Clone ID: PAT_TA_66900
tctcccactcgcgtttctcctctgaacctcgtgcccgagatgtcatcaccgcgccttcgtcgatcccgcggccactagccagcccgcaccgtcccgacatgtccggagctccgcctcgctcctctgcttcgactacaccaaatggctcgagctgggagcctctacatcgccgggatcgagtgcttcttcctcttcggtcgccggtgcgccaccgcccaactactctgctccgatcactccggccttccctcgccgcgccaagccatccaggagctcccccatcgtcgtctcctttgccctcgcataagggcccgagctgggaggcccagtacggtcaccatcgccgtcgtcttcgcccacggccgccgcatctcgtcgtcgcgttcttcgtgtccggccacccccgcgctccctgaccacatccacaagctgcgcgacctcgagaccgatgctgcccctgtgattgactacgtcgacgacgaccccttcttgcc

SEQ ID NO: 66901 - DNA, 550 bp, Triticum aestivum
  Clone ID: PAT_TA_66901
gtttcttactcttgggctcttccctaaatacttgaccggatgccactgatagttaattaatacattaatagcttggatggttctgtattttttctctttagatttataactcttcaagaattataatggagtattttctaggttatcttgatctagagcttttatcgcctcttcagtaatctactggagaaaaactttgacgtgaagcatcccgtcggatatctattcctaccaatacatatacctgctatttgctgtcatgtgtaatgcatactatatggtatggtatccacttattcaggattcctctgaagtaaggaatttgtattaccagaagtattatctaagtgatatttttcgggattggtgtacttctgctcttggtaggagatccttgaccaggacactattctacaaaaggtaataactgagaattcatgggcaatgtaaaatttgcagcacgatattttgaggcagtagctactcaagcgttaaaatgattaactgaatggatctcttacacgccagcagcaaatggttgagaaagatc

SEQ ID NO: 66902 - DNA, 422 bp, Triticum aestivum
  Clone ID: PAT_TA_66902
cgccgacgacgacaacccaccatacgacaaccatggtcaagttcgccccgacggtgaagctcaacaacgggcaggcgttccccgtcatcggcctgggcacctggaagtccaagcccggcgaagtcgagcaggccgtcaaggacgccatcgacgccggctacaggcacatcgacggcgccttcatctacggcaacgaggtcgaggtcgggaacggcatccgagccaagatcgccgagggcgtcatcaagagggaggacatcttcgtgacgagcaagctgtggaacaccttccaccgccccgacctcgtggtcggcgccgtcaagaagtcgctccagaacttcgggctcgactacctgggcctgtacctgatccactggcccgtcggctaccatgatgagggcgagctcttccccaggggcgcc

SEQ ID NO: 66903 - DNA, 555 bp, Triticum aestivum
  unsure (1)..(555): unsure at all n locations
  Clone ID: PAT_TA_66903
gccatctcgccgccgacgcatgcgcgcgggcatgatgcattccgccgcggcgctgtgagctcctccgtggaggggaggggagatggcctancggccggatgggagcggctggatctccattgggttgcagctgcgctcgccgacagaggaaaatcggggtaactcgctggtgttagattgtggttggttcttgttgctgtcatccttctctacctgtgggatcacagaacatcctctgctgtttagtttgttgccgtaatggcaacgacatcgccgaccgatgctaaacgcaagtactcatggtggtgggacagtcatatctgcccaaagaactccaaatggcttcaggagaacctcgaagacatggacagcaaaattaagctgatgatcaaaatcattgaagaagatgcggagtcttctgcaaaaaaggcggaaatgtactaccgaagaaggcctgagttgatggccttgcttgaggagttgtaccgtgcataccgagctctagctgaaagatatgatcatgcagccggggacctccgacaggcccataaaaaa

SEQ ID NO: 66904 - DNA, 183 bp, Triticum aestivum
  Clone ID: PAT_TA_66904
tgagcatcatcagccaggcgctcatcttcgtgacgcggtcgcggcactggtcgttcgtggagcggccgggggcgctgctggtgatcgccttcttcgtggcgcagctgctggcgacgtgcatcgccgtgtacgccaactgggagttctgcaagatgcaggggatcgggtggggggtgggggctc

SEQ ID NO: 66905 - DNA, 602 bp, Triticum aestivum
  Clone ID: PAT_TA_66905
tacacgttggacggccatgtcgtcggcgacagggccggtggtggacgcggagtacgtggccgagatcgagagggcgcgccgggacctccgcgcgctcatcgccagcaagagctgcgcccccatcatgctccgcctcgcatggcatgacgccggcaccttcgacaagaacaccatcaccggaggccccgacggctccatcaggttcccggaggagctccgccacgccgccaatgcagggctcaagatcgccgtcgaccttcttgagccaattaagcagaagcaccccaagatcacgtacgccgacctgtaccagctcgccggagtcgtggccgtcgaggtcaccggtggaccaaccatagatttcgtccccggcaggagggattcttcagttgccattgaggaaggacgcttgccagatgctaagcaaggtgcttcacacctcaggggaagttttctaccgaatgggcttgaccgacaaggacatagtggcactctcgggtggccatactctggggaaagctcgtcccgacagatcgggattcgacggtgcttggacaaaagatccactgaagttcgacaactcctacttcgttgagcttctg

SEQ ID NO: 66906 - DNA, 522 bp, Triticum aestivum
  Clone ID: PAT_TA_66906
gtacgttgcttcatatgttggatggttttggcggccttctgtgtgaggtagacttgactgatgagggcttgaaaagggccttggttttctgtcaactgaaaactctgtttatgcacaacctatatcctctatgagaaggaactggatggagcaagttctacatgcctcaaattgcttaaatatatgctaagctcacttgatttacccagcggagtaaacaaaaactgggtccagaactactgcatgcgtaatgcaacacttcttttatgtactacctcaatgcgggagtgttaattgttgatcccactaagtctgcatttgttaaaacatggtgttttggtaggagatgactgtcaactcagtgcaatggttagagcaaagtaaggtattgcctcaccctctttatactgtctgatttcacttactcattggtgcatttactaaaagataaacttctgatactaaaatgctatttttttcttgagaaaaattgtaatggccatatctttcctttatgttcca

SEQ ID NO: 66907 - DNA, 488 bp, Triticum aestivum
  Clone ID: PAT_TA_66907
atcaggtcacaagcattcgactttgcagggcactcctttttcctcattgtacagcgcactgttaatgctcaactggggattcactgtttcggactgtatttggcagtcgaaaaaggagtatcagtgccaataaccatagagttcgaatttgcagcgagaacaaaagctgttggtgactttgtgtctaacttcagacatatcaagacattcaccagcgaaagtaatcaactaggatcccgagatctctttaacatgtcctggggtcaggtcttttctgaagcaagtcaatttttacttgatgacatgttatatcttcgagctgagctgactgtaaggcaaccttagtcccagaccccactcaatgacaattcttgattttatctgttctctgacctgctccgtagagaggacctcatcaacatcgtgattttccgagttgggtacaccagggcatgggtgaccgaggcttccatatcttgatgctgaat

SEQ ID NO: 66908 - DNA, 559 bp, Triticum aestivum
  Clone ID: PAT_TA_66908
ctctcgttgccgcatcgctgacccgtcgtcccggcgggcgccgcgtcagttccccagcgccacggtgccgccggccaccgccattccattggcttggattcggttgtggcgcgggcagggaaccgtagggtgattgtctgatgtgtcgtccgtgcggggggtttggtcggtcgaggcctggtataatacatatgccaccattgtacatgccctgagcaggatggatggatgcatgcatactcccgtctagatacatcctcttttatccatttcgatgacaagtattttcggacggagggagtacatgatatcatgttgcttggtgtgcagcaggcgatgatgatgatgatgttgacgactgtggctaaaataagttgtcttgagcaatcaagacggcctatagccagcagccagctatactattaaccatgctctaaatagaatcaatggccgcgttggagttggccttagagcccacccttacctctcttgtagcctgttcaattcatggctgatgttggatggctgtccctcggatggtcactctgatgagtgataa

SEQ ID NO: 66909 - DNA, 407 bp, Triticum aestivum
  Clone ID: PAT_TA_66909
tcatggtaccccgatgatggatgaagagacctctgccaccccgtctctctcatgggctggcgtggaaccagggaaagatttggtcataccctcctcttcttcaatccaggttcaaccggcatgcctccccaatgacgactagcataggattctttttttactgacaacatatgcttctccgcccgtagcttgatctatgctcgcaggttacgccgacacctccaacatcctggtatcttccttatgtacacccatgtctccgtgcagcagcagcctcctcctatttccacgcgcgtccccttcatcatgccttcaactttcatccaattgccacctctggactctcctccctcgagccctataattcatggttggttgctgcctcaatttcaccaccactcaaggga

SEQ ID NO: 66910 - DNA, 569 bp, Triticum aestivum
  Clone ID: PAT_TA_66910
cagcagcagcagccatggcccccaaggcaggcaagaagccggccgccggagagcaaggtcgagaaggcggcggagaagaccccggcgggcaagaagcccaagaccgagaagcggtttccggcgggcaagacggcggccaaggagggcgccggcggcgagggcaagacgaggggccggaagaagggcggcaaggcgaagaagggcgtggagacgtacaagatctacatcttcaaggtgctgaagcaggtgcacccggacatcggcatctcctccaaggccatgtccatcatgaactccttcatcaacgacatcttcgagaagctcgccggggagtcggccaagctagcgaggtacaacaagaagcccaccgtcacctcccgggagatccagacctccgtccgcctcgtcctccccggcgagctcgccaagcacgccgtctccgagggcaccaaggccgtcaccaagttcacctcctcctagactgaatctgaatgcgtcgccttgttgttccaaatgtagtactagttggctgctgttgactctgcctgtctctctgcgagtagtggtag

SEQ ID NO: 66911 - DNA, 345 bp, Triticum aestivum
  Clone ID: PAT_TA_66911
ttggcagaagtgaggcctttggatcttctggttcggtgaggatggccaccatggatagggctgcagcatcagggccaaagccgaaggtgcccttccacatccccaccatcccacgcccgcaggacgtgcaccgtattgtggtggacaacacgagcaagccgttcgaccatgccttccttgagcgcagcgatgatggtgcccgtgccatacacccactggaaaaactccccatggagcaactatttgacaggcgtgttcctgaaagtgagccattaaagccacctgctttaaatgacaccccttttacatttgttgaagacccgaaaaccttggaagtgttggtgg

SEQ ID NO: 66912 - DNA, 382 bp, Triticum aestivum
  Clone ID: PAT_TA_66912
ccggctcaccgggtcgctgagtgctgcaatcttgcaaagtgcttgctgtgtgggttctctgggcacggtggtgcacggctgggactcctcctgcgtcctgtggcggctgttgaaccgtcggtcgggctctcgtccacctcgtcgtcgggagacaggtctcgccgcctgctccaccccgcctctccaccgctctcccggtgcttgaaaggaagatggaggccccgggcagctctccggaggcgcgcccggcattggcactgcgcgccgcggccatggcgatggaagagcgggagctggttcgccgtggggcggtggcggtcatcgtcggcttccaatcggagccagagccgtcggaggtggcgcgcgccttcgccgggcgctt

SEQ ID NO: 66913 - DNA, 521 bp, Triticum aestivum
  Clone ID: PAT_TA_66913
ttgttagtgctcggtgtcactatcgtcatcacttgcatgagcatcgtcatatggctgctcttccggcatcggaaggacacacaagtggtgaaagaaggtgtgacgaattagaaaatgacaccattcacacctctagacttcacggaatccgacgtgctgaacaacatatccgaggagaacattatcggcagcggcgggtctgagaaggagtaccatgtccatctccctggtcgtcatggtctcttgaggatcacaactgcagaatagtggctgttaagaaggtatgcaacatgagaaatttagaccataagcagtctgactcgaaggtgaagacattggggagcatcaatcacaagaacatgatcaagctgctttgcagcatctccagccaagatgccaagcttcttgtttacgaacacatggagaaggggagcttcgatgaccggctgcactgccgtgacagcaagggcgcccctgcaccattggactagccgacaaggctgaccatcactattgatgta

SEQ ID NO: 66914 - DNA, 601 bp, Triticum aestivum
  Clone ID: PAT_TA_66914
cccttcctctcctccttccccgcctccggatccagacgacatggacgatgcagcgccatggaggctggcgggtgggtcgatccactcctagatcgggcgctgcgaggaggcccgggctcgggtgctatggacgggaggctgcgctccgcctcttcctcccccctattcgctagccccatgtgcggtcaagagcggcagggccacgtcggcgccgctcgtggtgttgaaggcgttcacgctggcggcgcacttctacggcctctactccttccccgggccggggaggactggaaatggggcgaggggggcgcctcgtcgttcctgctgccgctgcacccgaagcccaaggccaccgccgtcaaggcggattcgaccacggccgcgctgccggtgaggtagtactacacttctgtagatattggcaatcctgcaaggccctattttcttgacatcgacaccgggagcgccttgagatggatccagtgtgatgctccctgcacgaactgcacaaagggacctcattccttatataagcccacgaaagagaacatagttcccccagggattcacattgttaggaattgcaaggcaaccaaaatta

SEQ ID NO: 66915 - DNA, 556 bp, Triticum aestivum
  Clone ID: PAT_TA_66915
attaataatgctcagaatggagagcgtggattcgccctctccgaggtgctatgctcagcatcaacagaatgatggggaaccgaaggaccataagagcaccagtaaaaggcagtcacacagcactgagattccatgctctttggtacaagaggtccagcaccttgagaagcgactaaatgatcaatttgccatgcggcgcgctctagagaaagcattaggtcacaagccctgtgctatcaatttatcgagagactgctacattccaaagccagccgagaagctcataaaggagattgcggtactggagctagaagtcatatgcttggagcagcatctcctgacgctctaccggcaggcctttgaccaacaattgtgcagcacggtttctgcttgtgacatggagagaagaaacaggcaatcgacaaggtcgttttccggcacactctctgaaacttcggcgcacgatttctcaaccccaaagaagcaacagttggtgcagtccagccgcatggttcaagcacgcaagtcgacaacggcagcgcttaatactgaaccc

SEQ ID NO: 66916 - DNA, 403 bp, Triticum aestivum
  Clone ID: PAT_TA_66916
tctcgttcggcttccagtggccgtccctgatgcagtccctttccgacgccgccaccacaagctcctctctatcctcccaggacgacagcggcgactgctgcgacgagccggtgtccctgcgcatcaccggttcggcgcgagcgccgacaagctgcgggacacggaggcccgcctcgcccgcttcgcggacggctgccccaacctacggttcgagttcgagggcgtcgtcaacaacgggccggaggagggccgccatgagcgcataacgaccgaccccgccgcgacggtggtcgtcaacctggtgttcccggccgcacagaacgtgaggcagagctcatgggatccgcgcagcgcatcggctcacatccggtctctgaacccgtccttggtcttcctgatcgac

SEQ ID NO: 66917 - DNA, 209 bp, Triticum aestivum
  Clone ID: PAT_TA_66917
ccatccacagcgccaacgagctcacggccaagcacagccgcttcctcctcgtcggggccaagctctccgccgaccccttggacaaggagatcccctccccggacgggagctccgacgagcacgaggactgctcggcctcggccgccgaggaagcccctgcagttcatgacgccagccacgccggatcaggaggaggaggaggtggagga

SEQ ID NO: 66918 - DNA, 251 bp, Triticum aestivum
  Clone ID: PAT_TA_66918
cctggcgtcgcgcaagatgacggtgatcggcacggtggacccggtggacgtggtgagcaagctgcgcaagggttgggcggcctacatcgagtccgtcggcccggccaaggagcccgagaagaaagagcagaagaaggaggaggccaagaaggagggcggcgacgccaagaaggaaggcggcgacggcggcgacggcaagaaggacggcgatgggaagaaggacggcgacgggaagaaggacggcgagaaga

SEQ ID NO: 66919 - DNA, 392 bp, Triticum aestivum
  unsure (1)..(392): unsure at all n locations
  Clone ID: PAT_TA_66919
cgaccaccgtagtaccaccctacctccccacccaaccctagcgatggcgacaacggcagccggcggcgggagggggtaagccgaaggcagcaagtcggtgtcgcggtcggtgaaagcgggcctgcagttccccgtcggccgcgtcgcccggcacctcaaggtcngccgctacgcgaagcgcgtgggcgcgggcgcccccgtctacctctgcgccgtcctcgagtacctcgccgccgaggccctggagctggccggcaacgcggcgcgcgacaacaagaagacccggatctcgccgcgccacatccagctcgccgtccgcaacgacgaggagctcagccggctgctcggcggcgtcaccatcgccgccggcggcgtcctgcccaacatccact

SEQ ID NO: 66920 - DNA, 348 bp, Triticum aestivum
  Clone ID: PAT_TA_66920
caacggcagctgcatcgcgccgccgcgttgaggagcaagcatggggcgatgggagccacaccgcttcgtccgtctgtgcagccttgagcaacccgggcagagcagccgccaccgcggggtactgcatcgagccgctgcctccaccggagtgtatgcgccatggaggcgtggcgtgcgccagcggcggccacgaggcatgcaccagcagcggccatgggggcgttcgccagcagcggtgccgctccaccctgctggctcgcgacgaccacggggagcctggcagatctgaaccggctgtgcccgacggcggcggcatctcctgcaagagcgtgtgcggcgcgtttgggc

SEQ ID NO: 66921 - DNA, 277 bp, Triticum aestivum
  Clone ID: PAT_TA_66921
cgcagccgacgacgcggcgcggcgacgaggacccgcgtgcggcggccgacggcaaggcctccaactccaagaagcggctgccgaccgccgcggcggccgcgaggggcgcgctcccgtccatgctgctgcgccggtccgagctgctgcgccgcggcgggaagaacgggaacatgcagtcgctcaacgtgtcgtgcgcctcggaggcctccgacgactccttctgcagccgggcgtccaccggcaggatcggccggccggcgggggcggctgcccggcg

SEQ ID NO: 66922 - DNA, 123 bp, Triticum aestivum
  Clone ID: PAT_TA_66922
cagcggccgcctccccaaggagagcttcggcaagtgcatcggcatgggggacctccaagagttcgccggcgagctgttcgtgacgctgtcgcggcggaggagcatcgagccggagcagggcat

SEQ ID NO: 66923 - DNA, 534 bp, Triticum aestivum
  Clone ID: PAT_TA_66923
aaccgaccgattgagctccactcggcatggtttcctccaagaacgcccgctgcaccgcgcttcttctcttggccgtgctgctgctctcgtgcgccgccatgggccgcgcggcacggggcctggaggagacggcgcctgaggataattacccggccgaggcgccggagtcgtcgcctgaggacaattacccggccgaggcgtcggagtcgtcgccgttcccggacttccggtcgttcccgaaagtcgagctgccgcccatgcccgagatgcctacaattcccgggttcagctctcccgagccggagccggaggccgatgagccatgatcaaggacgagggccgtgacatgaactcagagagaatgtgagccgtccatgctccttgcgtacgtacgttgtggtgtgctgttgtgttcgtatgatcgtatgaccttccactggacggcaagtgtgtatgtctacatgttcgataaaaatcctgtgatagagtctgtgttgttcacttttggattcacacccattgaaaaaaaaaaaa

SEQ ID NO: 66924 - DNA, 453 bp, Triticum aestivum
  Clone ID: PAT_TA_66924
cctctctccggcgacgcctccctggtggtcagccccgccccgctgccggccacggccaccgtggcctgagcgcccacaccggtcgactgagcgcggcccggacgctagcttgtcacgccatttgcaccttcgtctcgccgcgcagaactcgtgaactgtactagcaccatctactagcgtgtatgttggaatttctgcggtactacgtcttgctgcaatttgcaaaatggtctacctacgtgattgctcaagtgagggcatgtacaatggttgataagatagtcttatcttaagtcttgcatgtgatttagagataacaaatttttttgtctacaatgggtcatttcttagtcttatcttcaatagctagtaattcctaaaaatgtggtgagacatattgtaataagagatcacctcttgtcttctttaaataagagaagacaagctttttct

SEQ ID NO: 66925 - DNA, 360 bp, Triticum aestivum
  Clone ID: PAT_TA_66925
cgctccgcgtgcgcgacctcatccgcatcgacggcagcgacgtggacgcgctgtgcggcttcatctcccgcgtcgccgacgccgcgcgggcctccgcgtcaggggtcgtgctcaactcgttcgacgccatcgaggcgccggagctggccaggatagagaaggagctgtcctgtccggcgttgcggtcggcccgctgcacaggatgtgccccgggccggcaccggcggagcacggcctgcacgcgccagaccgcggctgcctggcgtggctggacgcgcacccggcgcgctccgtgctgtacgtgagcctggggagcgtcgctcgcgtcgaccgcggcgtgttcgaggagatggcgtgggg

SEQ ID NO: 66926 - DNA, 354 bp, Triticum aestivum
  Clone ID: PAT_TA_66926
aaactcccggcatcctctcctcctacaagttgaagagctagccgcactcatctccgctgccactccattcttgccaccacagagtcgtcaggcaagcgcgccgcccatacgtccatggagaggtcaaggtcctactcagagaagagcagcagcaccaccaccaccccggccggcgccgtcaccgagctgaggtgctacagtgcctcctacgccacacccaagaaggcagcgggcaccaccagctggcctccttgtactacagcttcttcctcgacgtcggcagcggcggccggctcgaaggcgaggtcgtggagcggcagcttccgtagcgccccggcggagctgcggaggaag

SEQ ID NO: 66927 - DNA, 422 bp, Triticum aestivum
  Clone ID: PAT_TA_66927
tcttccctgttaacagtatagtggagcttcttcatttgtatttattcaacctctattcccattcaggttgttttcttaagctacctaaaggagctctctattgacatcaatttaggagggccagcagtatccttgattgagtacaggtgtgtgcctcggcctccagtctgaatgaacaacccttgtattgtctggtagtgacctatatgtgtttatggttcataagggaataagaaaggccggtaagatcgtcttctgttggtgaaggtctgtgttatagattgttacaaccattctttagctcgagtttttttaattggagaagccaaaagatggatttcacaggtcgacaaaaaaggttgatgtacatttataaaccgcctagcatggataattacacccaataaacattgcaatgcatc

SEQ ID NO: 66928 - DNA, 461 bp, Triticum aestivum
  Clone ID: PAT_TA_66928
actawacatatwcwtygtyycaagcaaaatagcwcgaacgttaggtactctagatatyattgcagagcgctgttgtsgcaggccacaymcgacardkactatggtwaacagagcggtaggggggaggaactgaagccgcttagtscgaacagastgaracccatgkcttcatcagaatcttccttctcttsaaccttctcctcsctckttgastcagcagcwggagcggsggcacaccagaggcagcagcaggagcacccacagcaatggsaccaccgacctgaaggcrcagcgggcaaasktstccctgscagaggcaatcacktctgtgaagtbctygccktaagagttcagccagaaggaacdcaagcgtttcttcatyagcctcggcascaacggagtgcaggatgtkctwgacgtsagccgcactyggggaagagtacccacccagacaggcgagg

SEQ ID NO: 66929 - DNA, 367 bp, Triticum aestivum
  Clone ID: PAT_TA_66929
acacrwwacaatsgccaaytaaacaraattccgtyggtttcagaaaggatkaytcgkttgtctyggccgccgcacttagaatcacttatggacccctaskcttcgcwctctctcacttacctcgtcgccgcgccactctctagcaaccacaccgccgckcgttgaccgacaccacaaawaataggagtcccccccggkwggttctwaaatcacaccggcatgaggaaccggagcagcyccggcrarcgttcaggkcaccagcagsgacyywrgggaggccaacktygcmgaacasgcctycatacaccgacgagakccatggcggcgcaggtyaccyccaccagcagggcggcgcgtaccttccctg

SEQ ID NO: 66930 - DNA, 335 bp, Triticum aestivum
  Clone ID: PAT_TA_66930
acagcagcagsagcagcaggkcgagtgagamggcaattactgaccaccacggaggcggacaccaggkgaagggtggactccttctggatgttgtagtcggcgagggtkcgaccatcctccagctgctttccaacaaagatcaggcgcygctggtccgggggaatkccckccttgtcttggatcttggccttgacattktcgagggtgtyagaactctcaacctcaagggtgagagtytttccagtkagggtcttcacgragatctgcatkccaccacgcagacgcaggacaaggtggagggtggactccttctkgatkttgtagtcagccagggt

SEQ ID NO: 66931 - DNA, 484 bp, Triticum aestivum
  unsure (1)..(484): unsure at all n locations
  Clone ID: PAT_TA_66931
gcgcgagtggcgagtcgcgagacgcgcgcgtgtggggcgcaggcgcgcgcgcgcgcgaktgagtgcgcgcgcgcgacgcgtgygcgakgggcwgcgggcgcgggcgcagagagttygcgacgctgarggtgmgagtgtgagagcgggtkhgngctcgggcgcagggcgcggganmgdgtkacgsckaaagttcgctcagarggacagagcgctctstgtgcyctctccctgttggasaccaatgsgggckggggtttgaarcgctgtgcgykcgggckytctgagcgsgcggscckgggggamaccaaytctctctctytggggcagttagrgaghgggktkgggrgggttctgwgccctaaagtywgacanggggtgwgggactsgccctaattggggagagagaggcyctggcgggttgggyttgggggagtgtgktcgactactactcgcsttttgacwgttttgacgggttttgttcttg

SEQ ID NO: 66932 - DNA, 520 bp, Triticum aestivum
  Clone ID: PAT_TA_66932
yaaacgagagcktgggacgtctggggtgattcttcgcggctttttcccactccttttttgtttcgttgcycagtccatcatggagagyaacctcattaagacgtdgcagggaccagatcgtcgtcgcatggcgaaagtcactcagatccttacatagcagcyggagccaatcgaggcgtggcagarctttctcttcgattttcagctccatcatggcttccaccacaacgcataggcatcgcaagcktccaagtkctcctggtcggatgatgagattaaccagtcgagcygcaatkatcttcaggsactccaggccacacactctgctcagggcagcaagaatctccccsctcagctgawgawtaggggatgaaaggsacagcttagtgagaccacgcagcatagtaacaaatggaggsaggstacatatgtdgtccccytgtagcttgagccagcyaaggtagcaggggggagcttctttttctagagacaagtccacgagcaagccttggaaccattc

SEQ ID NO: 66933 - DNA, 422 bp, Triticum aestivum
  Clone ID: PAT_TA_66933
ccaccaaaagcaaaggaccaatttacatctatctcaccaaccaccaggaggacggatctgcagaacaacgatgcacgaacgacggatcacttccgccaagggggcgccgtcctcgccagagagctgctgctcctccgggagaatgcacaactcagagtagatccacgctttgatgttgtcaacggcctgcctgcgcttcatcgcacgttcaatgactttcttcctggtcaccgtcctgacagagatgcgcatctgaccgctccgacgcgtgatgccgcgaaacgcaacatgaagggtagattcattttgcacgtcgtagtcagccaaggtgcggccatcctccagctgcttcccggcaaagaagagacgctgtctgcctggggggatgccggtttcatcgaaaaactttgccttgacactgt

SEQ ID NO: 66934 - DNA, 176 bp, Triticum aestivum
  Clone ID: PAT_TA_66934
acacbgsrcttctkgacagcygggacaactccaccgtkggggtkkgcgcgaaarggatgaacctccgtccaggsygtckcggtgggcsawcasggtaggaggtttttytttgggccggggagccgtggtygaagccgaagctgcgggggtcacctcccgctgtgggttctgctgcg

SEQ ID NO: 66935 - DNA, 196 bp, Triticum aestivum
  Clone ID: PAT_TA_66935
ccatggtgttagtagacgtttgtatggtggcggcgccagcmggggtttttgccccattgattcgtcttgattkcaggcggtaggkggktggtttcctggkggwtdyctttadctctacttctctctcctgccccyygtttctttkgtttccatgtygataaatttagccttttcatcataaaataatgaaaaawaa

SEQ ID NO: 66936 - DNA, 347 bp, Triticum aestivum
  Clone ID: PAT_TA_66936
caagtacaccaaksccggggaccgctykgtgggacaaawcsccaagaggcaggcggkggtcaacccsgagaacacctycttctccctyaagaggktcatcggccggghkatgaackakgkcsccgargagtccaagcagggktcctacctccytttcccgkacgataacbgcaactcaagctcsatttcycabcaatttgcaarcagttcgccgccgaggagawctcttcacaggtccycakaaaactgggtkatgatgcctyaaaatttttaaattayaaaatyaccaaggcagttatcactgttcccgcctatktcaattactcccagaggacagcbacaaaaga

SEQ ID NO: 66937 - DNA, 409 bp, Triticum aestivum
  Clone ID: PAT_TA_66937
acgacaccgttcacggccacyggaagcacagtkacatcaagctcaaggacgacaagacgctgctctttggcgagaagccagttaccgtcttgggsgtsdgggassstggggrgatcccgttgggtgaggctggtgccgattacsttgttgagtycacccgtgttttcactkacaaggacaaggctgcagcycacattaagggtggtgccaagaaggtcatcatttctgcycccagcaaggatgcccccatgtttktytkttgkgtcaatkagaaggaatacaagtctkacawcgacattgtctccaacgcyagcbgcaccactaactgccttgcyccccttgcyaaggttatcaatgacagggttggcattgttgagggtttgatgaccacagttcatgccawgacttc

SEQ ID NO: 66938 - DNA, 662 bp, Triticum aestivum
  Clone ID: PAT_TA_66938
ggtggttgaattcccggcgacctgagcaccawggtttcggccgacgcagckcgcaacgtcgtcggcatcatgggcaattgcatctcctkttkcctytkyctctcccctgcgcagacatttgaccggatttgcaagaacaaggacgtkgagcagttcacgccggacscctacctggcgacgctcatgaactgccttctctggttcttctacggcctcccaatcgtccacccgaacagcctcctcgtcatcaccatcaacagcatcggcatcatcatcgagacaatctacstctccatcttcttcctctactcgcccccaaagaagcggctaaagawacttctcgttgttggctttgagggggcgttcgtkgcgtccgttgtggtcggagttctcctcagcgcccacacctacgaggaccgctccaggatcgtcggcatcatctgcatcgtcttcggcacgattatttattcygccccgctcacagtcatggggaaagttatyaggacaaagagcgttgagtatattccamtcaccgtgtctyttgtgaacactatcaacggctgcbgckggctagcctattggctgatagggaacgacccctatkttacgatccctaatgccatcggtacctcggcccgcgaccacgctaatcgaattcccgc

SEQ ID NO: 66939 - DNA, 829 bp, Triticum aestivum
  unsure (1)..(829): unsure at all n locations
  Clone ID: PAT_TA_66939
tsaaaacwctcccatatamtccaccttcagamwhccccmaattcactaatwattaacmtwgtcccmgcccaartaccawcmcccaatttagtctaatttaaatccggcttctcaagataaatwcarccaracttctggattawaacmttttchccctacaacccgcctttacmcatcctcyatwctcttccctttaaccaacttaaabaanaarcctccaacaaacccatcaccaacaccattwgtkthaacaaacttctcctttgtcaataagatcacaaggaatwttttcaccttcccatcctcarccacaactactbgatcaacaccctyaataatcacaacaatcctcttttttttcccataawccawaacaattbttagaacytcaaaaccatcycctccacattctcaatctcccacccaccgactttaaaaaaratcctttcctcaatttcatttccaaaaatgtagtccccatacmgaaaaaccttctcttttwcatcaccgaaaaactcacagataaaagtagccgagawgttcatcaagaaaacctttttactttcagcaacattctcarcaacaaactcaatawattcaagwgacaccctaaaaaaaaaaccaacactttagatctatttttctttctcaacyahttcccacttctctttcttctttawattctcayatttttaacaattcccttcanantaarttttcaatcaattacctttcaccaccaacaacacamacarcacarctycctttatgagcacctcatcctcataatawttawcacttactcctcagctttaccgcactcttcacc

SEQ ID NO: 66940 - DNA, 376 bp, Triticum aestivum
  unsure (1)..(376): unsure at all n locations
  Clone ID: PAT_TA_66940
cacyggttccaagcycacctcggagatgaggaactcagacytgckctgcagctactccttggacckcgccagcacagttggagccttagaaacagskwtgcytacytcagcatccgtccagctgaaggkgttcttcaagtagttcaccctggctgckatcttgtbctcgctgagaaatgcaacagcgtgcagccgtggcctgaacatcccagaggcacggggcacacctatgtkttcagcgcatkccaccatcgcctggacacgctccaggttggcggtgacaatycatggttgayggctgcatagcttgngcaatatcacaagcacctagcccgcactccctcaggaaggcaacattkggctttaccaacttatc

SEQ ID NO: 66941 - DNA, 494 bp, Triticum aestivum
  Clone ID: PAT_TA_66941
gccaggtacctdggcaacaaggggcagaacgccactsattgcccggtaagacccaacyagttggcackgtccagkttctagccagdcatcactsawtkcctcbttggasggtkggttgcctccbttttgtttcatggrattctgatcyygctttctgggcttcttgttttgsttggctagrkkgtgaggcttcttgttctgsttkttgcccccbccacgarrgaagtgaaacccsaatgggccaaattcygrgagactgatgggagcbgctctagcagccaagggattaaagggaggagcaggtkcgggckttacahcagttckcycactkcagttctyawcaggcacagakgagsgtccttaaaggggaactatcccatccygtccagggaaaagckttaatwccgactcaaagcctgggccawccycaaagattggacccybgcctccbcgggtagsgacaggcaaagcagaagaaaattaaaaggtggtag

SEQ ID NO: 66942 - DNA, 351 bp, Triticum aestivum
  Clone ID: PAT_TA_66942
cwcaagctcctggtggtcgtcccgggtgctcttgaagaactccagttgggatatcaatgtkggctcgtatccccagcagaaaactagcccggctttcttctkccaggtgccaagaactgckccaaggkcttctcccattaccctcctgtggtcctcgtatgtyagctcccatgccagttggtcgccctcgccgctgctcctggcattctgataaagcgcastccccgtccctcgaaccatatcatcagcttkgtgggatgtkacctccatgccccgaagacccttccctggcagggagcagcaacgacagatatcttctcccatccttgatcaagcytcagctgccacagt

SEQ ID NO: 66943 - DNA, 230 bp, Triticum aestivum
  Clone ID: PAT_TA_66943
acggccadtcctcgagctgcttgccggcaaagatgaggcgctgctggtccggggggatgccctccttgtcctggatcttggccttkacgttgtcgakggtgtccgaggactccacctccagcgttatggtcttgcccgtyaggtcttcacgaagatytkcatacyaccgcgaaggcgagcaccaggkggagggtggactccttctggatgttgtagtcagcaagggtacc

SEQ ID NO: 66944 - DNA, 218 bp, Triticum aestivum
  Clone ID: PAT_TA_66944
gatttgggcgtgcgtktcaccccattcgacaaaastgtgagggacacggtggattkcctaaggagcaaaggagaaatctagsctgtdaccbtgaacaaatatacattttgtgtatgccacgtrttgaaaactgttgcaggaaaaaatttctgccgtatgaachgcscgccgtgcatgtaacatgatcaataatgcatgtgtccmgttcatgtgtccac

SEQ ID NO: 66945 - DNA, 483 bp, Triticum aestivum
  Clone ID: PAT_TA_66945
ctttacggttgcsgtcactcgctccctgatggtcttatgarggccactyatgttattatcgcyggcaaggttgcygttgtctgckgttattgtgatgttkgcaagggctgtkcggccgcactcaagcaggctggtgcbcgtgtkaacgtkacacacaatsaccccatctgttckcctcaggccctcatggagggcatcagatcctcaccttggaggatgttgtctcttawgctgatatctttgttamcaccaccggaaacaaggacatcatcatggttkascacatgatgaagatgaagaacaacgccattctctkcaacatttgtyactkcgacaattagatckatatgaacggcctttagagcyackctggtgtcagcgcatsaacatcaagcgccagactgaacgcygggtcttccccgagacccaagactbgcatcaatkttctctgcgaaggtcgtctgatgamcttggatgtccact

SEQ ID NO: 66946 - DNA, 455 bp, Triticum aestivum
  unsure (1)..(455): unsure at all n locations
  Clone ID: PAT_TA_66946
catggatataatcaccacaactcrcacccactggartcaaacactgggttgacaatcataataactggaacraatggagraggmagggrgrarcaacaaacttytttttcargttgcaggcacggtcaggggrgttcaakatctcataatataacacasaaaaattgagtgcarcccaagcctgrgggggkgtvtgggagccaaatctactagggcgatatcctgagsagctttgtasctgccsgggcggscgctsgaaatcaattccggagcccatgggcbggaacatncacgtcwggccaatcmcctataataatctatamawtcactgccgtcttttacacgtcttactcgaaaacctgctaccactatcccttcacacacccttccackctatacaagcgacatccctccacatscactgatggatgaccccstacacmgtagcgcggggg

SEQ ID NO: 66947 - DNA, 459 bp, Triticum aestivum
  unsure (1)..(459): unsure at all n locations
  Clone ID: PAT_TA_66947
cgaatagctgtcccgatcctcgatctgttctcaaccctccctccgtccgtcgcagctccagawttccttccccatggctccgatcaagadcggcatcaatggtttyggcyggatcggcaggcttktkgccagggttgcgctccagagccccgatgtcgagctcgtcgccgttaacgaccccttcatcaccaccgactacatgacctacatgttcaagtatgacactktycacggacagtgaagcaccatgaagttaaggtgaaggactccaagacycttctcttcggkgagaaggaggttgcggtgtttggctgcaggaaccagaggagatcncatgggctgctgctggtgctgagtactyggccgcgaccacgctaatcgaattcycgcggscgccatggsgsggggagcatgcgacgtcgggcccaaattcgcccttatagtgagttgtattacaat

SEQ ID NO: 66948 - DNA, 579 bp, Triticum aestivum
  Clone ID: PAT_TA_66948
agaatactcaagctatgcatccaacgcgttgggagcgctcccatatggkcgacctgcaggcggccgcgaattcackagtgattagcgtggtcgcggccgaggtcggctggtatatayaggacatcacgaactatacagacaaacattwwccaggaacacgataatttgtcytttkgctgtattkygatttyaaagccacgggtcttctgwtggatgkgtctctcwagaaggtgcgtcagaccagggcgtataagattttcttyyctccacyatdcacaccytaytywtttwtktakagaaaccgggtcagcscggaagggtgksggcggcgckygtaaagcgcacgggccggccctccygttttctytttttratkagtgayvktcckgcggcgcrcgaaacgwatacccgcsgcgcatggcgsgggagcacgtacgacgggccmaadckcccatagtgattcgtattataatcwyaggtcgtygttwtatacgmcgtgayacgtaaaccccggtggkaccaactratcgyctgtagcacatcccctttygcagcggggrattagtgagaggcscgcac

SEQ ID NO: 66949 - DNA, 419 bp, Triticum aestivum
  Clone ID: PAT_TA_66949
acccatcaccccaggtctccacctctgttgttgagccatacaacagtgtcctgtccacccactccctccttgagcacactgrtgtgtctatgcttcttgacaatgaggscatctatgacatctgccgccgctcccttgacattgagcgcccaacatacaccaacctcaacaggcttgtktctcaggtcatttcatcgctgacagcbtccctgaggtttgatggtgctctgaatgttgatgtcatgaattccagaccaacttggtgckctackcgaggatccacttcatgctttcctcctatgcccagtgatctcagctgagaaggcctaccatgagcagctgtctgttgctgagatcaccaacagcgcctttgagccttcatctatgatggccagagtgttaccyccgccacggcaagt

SEQ ID NO: 66950 - DNA, 393 bp, Triticum aestivum
  Clone ID: PAT_TA_66950
gcacaagtbgcgccttcatcgcgcccgcctgctggtatgcacgggttgtctttctcaagttcagcaaacacaggctacaatcagacatctatagctgctttcagacctccacgtccagccacaggtgaktttacctttaggcctcacgcgccaccttcagcagaccatccagcttcagcgggccaaatgggagctcaagctaactctccgtttggtttacyccaagcaccgccgtkccgtcctgctaatcatagccccatctccccagtkcaaggtttccaaaggcctccggatggaagtyatatgggtccggctcggatgcatgtgccactwccacacttccatgggamcttccctggggatcacctgckcatgatactatggttcgacatc

SEQ ID NO: 66951 - DNA, 395 bp, Triticum aestivum
  Clone ID: PAT_TA_66951
acggcgactcttggttcgttgccacacaactkgctgcyggcattagttgccacctgatcaacaacatcttctctcttcatatcagwgatggcaagcatttcaccaagcgtttctcaagckccttcgcatcggcaccktttcccggataawctcattggaagadgcacttggccacctatyagaggkattckttttaccytccctagctacatgtkccttargagaacaagaagcatggcttaaagatgagccaaaataaggattkckaaaccggtagacgtaatcscaagaattgcatgatgttgggctttcaagckccgagccactaaagckactgttcbcttcttcagcgcgatcataatacgatctatcttgcgcgagcatatttgactttt

SEQ ID NO: 66952 - DNA, 435 bp, Triticum aestivum
  Clone ID: PAT_TA_66952
gtgcattayttgkctggacaagaagaaggcctctbtcttcttcaagactcaagcygatagccacgtttccygcgccaaggagaagaccaagctctctggkakbtbcgacatcattyccgagawggagggctgttacttcgacttcgagcscygcgctackccatgaacgccawcaacggatctkccgtctccaccatccatgttaycbccgaggacggcttcagctattcyawcyacgaaggcatgggcatkgacgcctcccccctsgcctacggcgacaacstyaagagggttctccggtgckttggcccyacagagttctcttcygcggtcaccatctcttgtggcgctgcaccgccacctggggcaaraagctcgacgccacgcatacyacttcwacaacgttgttgagcaggagctcccctcttgaggcgt

SEQ ID NO: 66953 - DNA, 179 bp, Triticum aestivum
  Clone ID: PAT_TA_66953
acycttcttccacatgtcccaccacacactaccttggccatcgatggkgccattctcacctgtaatgaaaacatcctgaagtccattgccatggatcaaactgatgtatctcttgccgggcaactcgcgccctctcccgtatgagggcagcgggtcgatcagcggccaactagatgtgt

SEQ ID NO: 66954 - DNA, 433 bp, Triticum aestivum
  Clone ID: PAT_TA_66954
gcagccgyccccaggtctagggttccccctttcctcttctccacgcbaatgakctagrtactagcascagcatcgatgggggggggrgcgcsgggcggrcggkaaggcggrggsygccaagatggayctcctcgaggacgacgagcgagtgsgaggagtgcsaratcyaccaacaatgggrtgrgcaaggrggadgggcaacgaagctgtcgcaggyrakgggaggatgagskggggtggkggrgggsgtgaggcsatgattgctsaggkcacctcaggaaaggdcgggaggtasggaasrgtcagragrgskgaactacttccatggggsgckgtgtdgccatgggctctctgaacctgttagactggcctagcrggrtcaakctctgatacttakcttggkgtcaggackgtstatsagactgtttasctt

SEQ ID NO: 66955 - DNA, 204 bp, Triticum aestivum
  Clone ID: PAT_TA_66955
actactkttgactggagcctccccgacggaattaagccggatgagcttgakatggacatgatcgtcggctttacaacaaggagaagkaaccaactttcacctagtagcgaygccgtataatgttccaacggaaaattgaggttgatcaatgtgtaattggtgcttgtkatggtgattgtkcycgtgtgttawtaaggccttgkt

SEQ ID NO: 66956 - DNA, 259 bp, Triticum aestivum
  unsure (1)..(259): unsure at all n locations
  Clone ID: PAT_TA_66956
accattaggccggacggtgttgctttttttctggtgggggavaaggttgamtcttgagtytyaaggaaggaagggaaggcaacgacatgatttggtggagtkgcgctgtcaggtgargagaggaacgggaccgggctcgtkcatttctttttttcttcgtcaagtkttgatttcycaccacgggggccgtgcgtbtcgccggckgccaaawncacggcgtcggcatttctttggtaaaccgggtgcattctttatcttt

SEQ ID NO: 66957 - DNA, 569 bp, Triticum aestivum
  Clone ID: PAT_TA_66957
ctaatacgactcactatagggctcgagwcsyggcgccccgggcaggtactacatctcarccaacacaacacaktcacctcgactcggcacgcacgcaacttgcacactaaaattacgagaaaagtatcaacaaggtgcacaaatcacaktttgtttcggcggtggccgtggrtcaaccacaccaggtcgcacgcgcgcactactcgcrggawccgggtacackgcactkcacagccaggcgcacagcaaaaatctaaacacaaaaggtcaaaactactaacgaaaagtgagcattttttcatacacaaataactaaagaaagaaacayagcsaactgctttgcaaggatgcaatrgttcawgaaagaagrggcaagcagactactgcagtgacgacctttaatttctcatachggagaagaggaatkgkgagcacaccgttcakcggcgatgttcactacaccamacccggacgccacaattgataggcatccagcacaasacaktcygagacagargscacacgataggggagcatygkggccggggctcgtccccaccgttcyctgg

SEQ ID NO: 66958 - DNA, 510 bp, Triticum aestivum
  Clone ID: PAT_TA_66958
gccartygctgtcgctgcycatgaagatgaacccgctcgtctcccttctccacctctacgacgtcgtcaacacgccgggggtcaccgccgacgtcagccacakggacaccagckccgtkgtgcgccgcttcatttgccaacaacagcyttaggcagcacttacaggaattgatcttgtcatcatccctgccggcctcccaagaaaaccaggaattacaagggatgatctgttcaacaaaaatkctgggatckttcgctcgakttgtgaaggcgttccaagagctgtcctaatgcaattkcgaatttkatcagcaaccctgttaacgcaaccgtccccattgckgcsgaggttttcaagaraactggaacttactgtyccaagcgtytyctttgagttacaacacttgawgtagcaagggctaacacctttgttgcggaagttctttgagttgatccaagaraagtyaattttccagttkgttggcgggcattcaggggtcactatattac

SEQ ID NO: 66959 - DNA, 330 bp, Triticum aestivum
  Clone ID: PAT_TA_66959
aggtgaatatagaatatgaagtatgatggaaagggttgggaggktggatatggtggaagtggaggkgggggggaattgagtagtgattttgagggggtgckwggggaggtawktgtktttaggtttgaatttgagckaatagaatgaatamataaatatatgaratgataatkaakgtgtgtktttataggkgattagttagaggtaggagttgagakgakakgggakgkacacaagadgagagcactggkgttgggttgggagaagaaggawgabctygggtatgttggtggagttttgggttgggcttggttggagttgagggbagga

SEQ ID NO: 66960 - DNA, 266 bp, Triticum aestivum
  Clone ID: PAT_TA_66960
agtggcgttttttggttcttgaagmcctgaacgttcctggtggagtrgagcaaaataatttggaggctttaavgctactgaacttaatgtagttrggatcaattttytgtttcagtttgaaatwttccccattycctcctatttgattgattcytttgatggacattttgtaaggaaawtaaaccmmaggchtttgtattgttccgagtgaagccatccatactcccttgtggrattcaagaaatagrgrawtgtttttgttctcc

SEQ ID NO: 66961 - DNA, 271 bp, Triticum aestivum
  Clone ID: PAT_TA_66961
ccgctgacaagcaaagcggcgtgcaagtgcatcaagagcgctgccggtgggctcaacgctggcaaggccgccggcatcccctccaagtgcggcgtcasgtcccatatgcaatcagcgctaacgtcgactgctctaagattcgctgatcaaccactgcccaccatggctgccgtccatagcgccatccatcaccgctgagtatgctgaggtctctaatacatatgaataaatgctctgatctgatctccatgtgagggagaaaggagtgcgt

SEQ ID NO: 66962 - DNA, 276 bp, Triticum aestivum
  Clone ID: PAT_TA_66962
tcagcttctgcagcctccgccttctctcactgcgmgcctcagcttccgccatgatagcgctctgcctcagcmaccgccacgarcgyctgcagctgcasctcttctgcactcatgtttctcatacgtgcaagttcagcatctacctgagatttagtgtgggctgtaaascatccctctctaccttctctaccttggttggctccttttttatatcatcaagcagcagcattttggagcttcgcccttctaaaaaagacgagctaggggctatcctgt

SEQ ID NO: 66963 - DNA, 624 bp, Triticum aestivum
  Clone ID: PAT_TA_66963
actcccaccttcctccagattacgcttcctcgaactggggccacgagattcaaatgaggctgcatagccaccaatctcactcccggtaggctgaccgatcatcagatctattcccattcccccgttcttgaaattttcaggcattgagagcatcccagaatgggttggtggcaatcctcctgccattgtcagatttaggtcaacctgagcatttgacaatgattttccctcaacagtgcatgcctcatcacgtccttcagcattgtttctgtctgttccttcagcaacccatccattgatcccactcgtagcactaattccacgtgccaacataggtttcgtccctgcatcaggtgcatcaatgttgccgagattaagatgagaaggacgtggaacggatctgaagtcccagattctcactgtagctccacataagctgcaatccagcaaaggtgatctcatgctgcatccagaatcttttacacgtagtttgcctttccccttatctttcttgactgatgtagagtatgaattttgctgatgctcaggaaagcgggaacatttatctggttcagctgaggctgcattttttgcagagtgggttgaatttcttcccagtcttgt

SEQ ID NO: 66964 - DNA, 580 bp, Triticum aestivum
  Clone ID: PAT_TA_66964
acgagcagcttcctgctacatgtgcacataatgcttgcttactgctacattagatggattcacccggctggtggctgcctgctacatatgttggcattaggtcgattcgccccctgcttgctgctgcgcctacatggaccatctcgtgctatgcgcgcaatcgccaagacgatgagctgacgaccgttgatgggccaagctgccaaaggatggaaggagcaagatatgttcgattacagtgtaattttacttctaggctattttgaatttaaaatttgctttcagttgaaaatttgcccctccccccttgattgcttgccacgctccgccactgccatccagcgctgctcctcctcttctacatccatctcccacaaagtggcttgcgtcacccctcccccagctccctcctatcaacggatggccctgctccacccgcaccctcgtcgcaacgcccgtgctccagccacacttatgaagccgcatagagagctcaggcttccttcctcttccctgaccgtggcaagggtgaagttgccgccctgtgctccctagacctccatccgcccgtgatccatcc

SEQ ID NO: 66965 - DNA, 495 bp, Triticum aestivum
  Clone ID: PAT_TA_66965
acatcccgttgcccgcgtccagggttcccctcgccgacgaggacggtgtcgcggacatcgccgcggaacatctatgcgatgtctcatcctgcggcgatctcatcaagtttgtccagatagatttcgatgaacctgactacggaagcagtggcatcgcttggaaagccaccacatggaacaggaagctctcttgggatgattggcgcaaccgccgcacggttgatgttgctgaaatctcggtcgacacgagttattctgctttgttgcctgagctgctggatgatgakaacaaacaactggagctgaagaatcttattttcattaaccccaccctgagcatccaagatgaccatcttctctacataagggccatggtaaaggctcaagatgacacgacatggattgtcgcacttgacatgaaacatgcctctctcagtgcgctagtcccagtgtccacccaacccttctgtggtgttaccatgcgcytccccaagt

SEQ ID NO: 66966 - DNA, 286 bp, Triticum aestivum
  Clone ID: PAT_TA_66966
cggctggtatatacaggacatcacgaactaaacagacaaacattaaccaggaacacgataatttgtcctttggccgtattgcgatttcaaagccacgtgtcatctgatggatgggtctctcaagatggtgcgttagaccaggtcgtataagattttcttccctccactactcacaccttacttaattatgttgagaaaccgggtcagcccggaaggggtggcgggcggccgcgctgcaaagcgcacgggccggcccctcccgtttatcctcttttgttaagtgggt

SEQ ID NO: 66967 - DNA, 233 bp, Triticum aestivum
  unsure (1)..(233): unsure at all n locations
  Clone ID: PAT_TA_66967
cacagactcactcgcgctctcgcaccctctngcbcacgcgcdcgggccctggccgnamaytctcbacgctaaagctcggactctctctngcacgctcgagccctcgccccctcgsgcgcscaagggctcacacgmacgmgctaacgcksgcgctcaaacccckcgccckctcwcacwctctctctctctctcgagcyckmgcscdmaaaggcactcgcgctaactcccacacg

SEQ ID NO: 66968 - DNA, 348 bp, Triticum aestivum
  unsure (1)..(348): unsure at all n locations
  Clone ID: PAT_TA_66968
actttgaktgcsycaacattcatcccgggttgtcgttttattkttccaatwaagggttcagatttttktattttaaagctkaaagatagttgttaggttkttgaagttggggttctkcgcgacgaggttccacttcgagtagttcatcaggdagttkaagttttkcaccgtkattttyaccctccagtagtccttktagttagctttacgttcacttmactyttwttkggcacawwttaraagagcatttcamgagaagcgccggggtgttttgykcsawccccgggcacgacaaaaramaaaaaaagtgwgattkggccttaaaanacdcaatgtggtttttgtcgt

SEQ ID NO: 66969 - DNA, 261 bp, Triticum aestivum
  Clone ID: PAT_TA_66969
cgttaaaccagggagattttatttaggggggcctgtttacaacaagcatggcatggcacctgactgctgatgcaggtcaggtgcatagataaggccctcgatcaggtagcggttacatggtatggtagtagtagatcgatatgatcgatgctgcacgcgcggtgcatgcatgatcgatgatcaatgatctagcagctgcagcaggagcagccgcagctggtgccgcacttgcactgggtgcagccgcagccgccgttctcc

SEQ ID NO: 66970 - DNA, 388 bp, Triticum aestivum
  Clone ID: PAT_TA_66970
actgtcatggctgtgtaggcgcatcaaaatcttccgggaagagaggctgtttccaggacttgaacccgtgacctcatggtcacaarggcagcagctttaccactgcgccaaggctccccttcggaagttgagattattaccatttaataattcagaatcttgcacctgcagtttctgcaccgagggggtaagcctgaactgtagagtgcccaaatggatcaatctgccaaccaatcctcggaatctgactaaattcctcattgatgaacctgtgccccagtgtagtttgatcgatcatgtcaatgtagcacacagtcgcctcgtcgtgcatgcacatgcccctatttatgaattccaaccgtccggggctgacaagccctttcaccgt

SEQ ID NO: 66971 - DNA, 396 bp, Triticum aestivum
  Clone ID: PAT_TA_66971
ctcatgtataagtggccatgtttgtggaggaattcatggccgacatcaccaacaatgaacggacacgtcctctcaagttttgctagaaaccacttttggacgccgataggacagtgattgaggcgctgcgctctaacttgacaccgtggggtcgtcttcgacttaaaatctgatgaagcatgagcgtttggtgtcgttgtggcggctgctagcaagtgcgcaacaggataagtcagccacgactcttccgttgatcagtcgaatctggtgtgattgatgaactctaaatccagcctgtgtttttgcttgatgaaacaacgcatatatattgtatgatctgatgctattgttaactgctactgtgatgagctagatttgacagtttagttagctgcc

SEQ ID NO: 66972 - DNA, 339 bp, Triticum aestivum
  Clone ID: PAT_TA_66972
ggccgctgcaggcaggggaaaagctccggttggtgcttcgggccggcgggggcaaagcggatagtatctcctccgttcagctcayattggtgcttcgtgccggcgtgggcagggcaaggcggtggcagtggaatccctgcgatttttgtccctggccagaagaaggacggccggcggtgaagtccatgttgctgtagtggaggacttgattgcttttatttcttactttgtagggtcctttgtgtaaatttttaggtcaactttgtttattccgtgtaactccacctacgatgaatgaaaggcagcaccccatgtagaatccaaaatctacttgagctg

SEQ ID NO: 66973 - DNA, 597 bp, Triticum aestivum
  Clone ID: PAT_TA_66973
gtgataagatatcagtagrwsaagcgtgggrcycaaaggygckakagcggcggawyatatgatcgrggcgcagggmagtacagtwgtcwtgtgaaagaaggcgtggamccgtaagraccggttcgggtagctcgaggacgcacggataygagmaggcrtggcayaayamatcattcagmtccdgtgtcyacagmaagagtacagtagcgcacttcttccbagmaacggccatgggcaaagacgbacgascgaacwacagccagcaawgcacaatcccsaactcaagygtydtgcgctctggygggcagygattgagagcatactygtaykgygakacggakaaggcgaggaggagagagatcacgagcgaasaaagacrctsrggcgakmyygcggacastaacgatccgcgcgcatggggcgasakcgagcggccatcsctaaatratgtatacatcatgcgcgttmaagcgkgatggaaactkgggtacaattatgctktdsmacccktygcaskggkawagaaagcsgmgwkcttcbaaatggcrkgatgggawgaggcrkaggggwtargggggkgggkagggacgtaattta

SEQ ID NO: 66974 - DNA, 413 bp, Triticum aestivum
  Clone ID: PAT_TA_66974
accggycwcbkctctkttcattctctgyctcctttacactcgcccytgwtactttctagatwctcgcttrccgatcgmgcaytgtgcrstckycatcaaacywtggtgmacacsctgcccwtacttctatccatccwcttgtcttgaggcatcrtgtsgcytgkwttcaggcksrgggccctcgacatgcagcmssaacwtgtcgatratatcctctattatstatcmaaggtctcttacctcgttggcycacagcctccacttkttcgtcgagctggtcccgcggcacgtccccraycttgctgarggcagcgtgcatrcwctccagctctctctcgagawgwttgatatcatccttgacgcytctctgcagtytgtayctcggccgcgaccacgctaatcgaattcccgcc

SEQ ID NO: 66975 - DNA, 696 bp, Triticum aestivum
  Clone ID: PAT_TA_66975
accttccctcgtcttcctcccaaccttggccttcttccttggccggtaattgacctcttcctccacgtcgtccttgacaacaaaatcatcatcatcctyttcctcctcatcgtcttcatagtcgtcagccacccgccgcttgctcctacgccgacgtgctgacgtgccattccttgtctttcccttggaactactcttcctcttacggtgttggcgcccagccgctggcttccgcttggccaagtggttcctaggtctaacatttgtggcacgagttggggcataatcccccaaatcatcatcttcttcttcaacatcttcctcctcatcctcctcatcttcgtccacctccggatcaaagtcttcatcctcatcctcgatctcttcctcgtaatcatcatcatcctcatgtctctgccggctagagcccgttggcttcaccttcctgcccttgccacgggcctcggacaggttcctgggctgtagcgtctccgtctccaactcctcatcatcttcctgatcctcaacttcctcctccgccccattgaaatctgcatcaaactcgtcctcctgcttcagattcctgccattggggcgatacttgactgactctggcgtctcgatctccagctctttcatcctcttcctgatcctcaacttcctcctcagccacattgaaatctgcatcaagtcatc

SEQ ID NO: 66976 - DNA, 663 bp, Triticum aestivum
  Clone ID: PAT_TA_66976
cacaatctcgcaatagttcacatgtattctaaatcccatctacaattaatacaacaaaaacaagacgtaggattttgcatctttkagagggcctgaacctaggacaccgatgtcscctcgtatcctttttccatccaacaagactatcagactgggaccccctacccatagtctgccagatttagctccgtcactaactattacbtatcttgacgtcstcatgttttgaatttttgatttgtaagtkccaaggggacctcaaacataactttttcttcaattttttctctaaagaaaacttttcttcaatgagacgggtcgtcaatgggctgaactctgcttgtgaacatacgctcaaacggtaagctgacgcaccacctttcaccctctcttaacactttgtgagaatctctgcgccgttgacggtaaccagcaccgtatgckcgaactgcgcgttgaggctgccatccactgttatggcggtccagccgtcgtcccacacctcgcaccgtgtcckccccatggacagggtaggctcgattgttaatatctggcctgcgaccatgaatcctggctcataatcataggtgtgccacawgatgggttctgaatggaagabcgtcccaactccgtkcccsatgaagggatcgacgctgtagccgt

SEQ ID NO: 66977 - DNA, 522 bp, Triticum aestivum
  unsure (1)..(522): unsure at all n locations
  Clone ID: PAT_TA_66977
cayccctctctccctgcctccctccctcgctctcccggccccagcggggtykyyattagcccgtbaccatggaccagcggtgggctggggastccgtccgcggkgaacagggagcactggtgcwctkctggcgaacgctttttgcggggacatggagawctcctacgatggggaatkgagaaagccttggtagaaagacctkttctctcttgatgcgaacaaaatttatcactcttggatttttttgtttttttrtaaawagtagagaggaacgctgcbggkgagaggattcttatcactaccagcagatcaagccttcccatgagttttttgccaaggatttgcatkgcgttaagtggaggttccgccattataagaraaaagawgggaggatkgcacangctgtwcyttcccsgahhnccgcycgawgarssswtgcccgttccnaacyttcggargccygggcgtttgaawttaaaatrgcacttgcgaagccgccggcagacgctggagggcgacccg

SEQ ID NO: 66978 - DNA, 558 bp, Triticum aestivum
  unsure (1)..(558): unsure at all n locations
  Clone ID: PAT_TA_66978
aggtgacactatagaatactcaagccgatcatccaacgcgtcgggagctctcccatatggtcgacctgcaggctbggccgcyaattgcactagttattagckgtggtcgccggccsaggtgacaggaaagtygggrbtcagcagcbccctcctttgtagtaggccgaaccacccacmgccngcctatctatckatgctattcycycygcctaactaaagaacttaaggtcytttatstttctttkwwgataytttgtktgcagastcaacaktcttcttgaaaacatctaggtcatccccytcaagcyttgctagawaggttcttkatgtagctcttyatgttatadataaactgctttttgttaaaagcaggktgctccttaagacggaaggkgttaacaatrttaaccaccttcacggcctggtcatcgacaccytcatcatcaccaccaccctyagcagagggatttgctcyaattttcacatcaactkctccttgaaccacccaattgccgttgacttcccaaaacacgcygttctccagctccctgtaccttc

SEQ ID NO: 66979 - DNA, 412 bp, Triticum aestivum
  Clone ID: PAT_TA_66979
acccsctgtttsgccgcgacgggcgtcgccwtcggcatytgcgccttcagcctcctcsgcaacatmaccggcaacccagaagtaagggtcaacaagatggggagggcagcgggagtgcttgagaaccatgaggagggaaggcgtacgccgagcatggcctcagagcctttgtgcaggacaagacccccgrgatcatgccaggaatcaacaagttcttcaccagcccgaaatgaagcactttagcctgtmagtggctcgctattagtaactgttgtggtcaagtgcaaacctwtttcaagcattcagtaatgttgtcgcgtccataattcagaggatatcawmaarwscctvttattgaaavaaccatgtgatgtttgatggcttgctatwtwtgkggkggttgatggcttct

SEQ ID NO: 66980 - DNA, 293 bp, Triticum aestivum
  Clone ID: PAT_TA_66980
catgccggtgccgaagaggacgcagaggatgccgacgaccatggacctgcggtcgtgggtdtwggcgagggagaggacgagcgccgaccaccctaacgccttgtcgacattgcyggccttgccccagaggtccaccagaagaccatacacgggctcgtcaggagcccagtcgcgcctcatctcgaggaacacagcctcagcctcgtccagatgaccacagtkaccaagaacctccatgacgatgctgtaggtkatcttgtccgggcggactccggcgatctgcatgtctttgt

SEQ ID NO: 66981 - DNA, 273 bp, Triticum aestivum
  Clone ID: PAT_TA_66981
cttcagtttatgatctggtttctccgattggttgtccacggtcttggacgcdtctccagcctctctgcggtgcggcctggtctcctaktgccaccskcattgcbtggtcactctggcaataccgcaatgctgcgagtcttcgacaagatcatgccctctacctcggaccttgttcgcgcgawcatggaggaagctcgctcctgggcagctgscggagccacaggagtgaatgcattaatgcgcygtaacttgaactgatgtgtttgggggyga

SEQ ID NO: 66982 - DNA, 346 bp, Triticum aestivum
  Clone ID: PAT_TA_66982
ccacaatgttgtccccttgctctcagatgtgcagcccaatccccccgcgacatcctccacagcttccacacattggtccaggagarcgcacagtccccatatcctcckcctgatggaagcctcgtcaggccatggaaactggctgcccgttgccacaagcacgccaccaagctgacctgccagcattcgtggtcgctgaggcgagttctcctcgacacgatccatggattctacctgcaggctctcgccagattgccgcgtggttaccaccgcagcctgctcgatgctggacattgctacggcccattcgaccccgtctcgaacatcatcatcaacaccatctggt

SEQ ID NO: 66983 - DNA, 437 bp, Triticum aestivum
  Clone ID: PAT_TA_66983
acccaaccgwactgcactaggcaaagactatacaaaatgaccatccattcttactactctttcctctctccatttctcdkwaacaacaaaatggacttcaaatgaatattgdtgttctattctctttcttactgagttcactgcaaatgatttccagaagaaaaattgagttagcygccaaacatcgcacgtcagcsacggtggactgcattatggtcaccggcaaaacgcaggacatgcatkadtagctggcgaaccccaagttcacactagaggagcygcatgttctgcttttcctgagcyacatgttctgcttkcgcgaagcgcacgggctacgcacacaggatttgccaacggtggccgccgcgggaactggacttcaagccggcacgctgccatacttctccsgcgaggagagaaccgccaggggtgctctc

SEQ ID NO: 66984 - DNA, 268 bp, Triticum aestivum
  Clone ID: PAT_TA_66984
tctggattttgttggcgaggtttggctagattaaacgctatactgaatctgsrggggatacctctttagggccsccycctaccccattatggttaacagmatttgaaatgtacatggtggsgggtcaatttatgccaatggcrgttttttttgattgtcttctggcgaacattaggccggtcvgcmcctvgmactcttagtggctggacatggvgtytbycccsccmccagaatgattggtgcattgcctgtgcytttggcgtgcttc

SEQ ID NO: 66985 - DNA, 436 bp, Triticum aestivum
  Clone ID: PAT_TA_66985
gacaagagcagccaaagacggatatacchggrgggccccgactcmctrcgccaactcggcgtttagcttagcgttgccaaggttgggaaatgtgttgaygtggggaaggtgayaytyytgatgtagyaaaayattgaatgatgggtgyaaatwyaatgyaytgttggtaagaatattttttytttttatgatggatggaygaygggtgtwtatwttgyyytygagyygaggtytygaggggtttygyygttygttgayagttgaggaggggatagagtagagtaagatagtwagggaagaagagtkyktggtgtagagatgtatttayagaggtattttggttgygattatgttgttttatagtgagttgtattagaattgaattttygtkgtygtyatggtgkggggaagtatgttatgttgggtttaatttgtt

SEQ ID NO: 66986 - DNA, 463 bp, Triticum aestivum
  Clone ID: PAT_TA_66986
cccttcaccagctccttccccaatgaaacagttagakgcatccycttcacaagggtagaagcktccgtaatcaaatctgttcactgaaaagwacaatacacgagagtkabtataaaacatctkctgtgtkccagtkccatgaggaacatcccaatcgacgattaakatcttgttgatacytaggtcaggcytctcatttaagagataatttgctgcaatagccacgttgttgaagagacaaaatcccattggctcattatgttcagcatggtggcctggaggcttacaagagckakacagaactcaactcaccttccgcaaccktctcagcaacctcgatgacagaaccagcygcaaggaaagcagactcttaggagccctcattgaagtaaattgaattgaatttcctagcagtyttgtktygacggtaatyatactccttcgagctgatatcccttatcag

SEQ ID NO: 66987 - DNA, 213 bp, Triticum aestivum
  unsure (1)..(213): unsure at all n locations
  Clone ID: PAT_TA_66987
tacaccacaraacacgttaccagtagcacgaacgcatgcagctagcttattgcaganacacccatgttatarkaatgcgtgggyacacacggcrtgcstgcatgcatnaggcgctatcgakctkattggagtstatacgacgatcgggggacgtkggatgcattncatgcatnaatacycagttgcagtagcygttgttgacgggcatcctgt

SEQ ID NO: 66988 - DNA, 226 bp, Triticum aestivum
  unsure (1)..(226): unsure at all n locations
  Clone ID: PAT_TA_66988
accawacgcaagttacaccacagagcacgttaccagtagcacgaacgcatgcagcbagcttattgcaganacacccatgtkataagrgtccgtracgaccacacgcatgcstgcatgcatnaggcgctatcgatctkattggagtstatacgacgatcggkggacgttggatgcattncatgcatnadtacycagttgcagtagcbgtygtkgacgggcatcctgt

SEQ ID NO: 66989 - DNA, 249 bp, Triticum aestivum
  Clone ID: PAT_TA_66989
ccaagaaggcagcsccagccaagaaggcccccgccgccaagaaggccaagaagtagactcctgcgttaagatcctagggcttggcggtagtgttccaggkagcagtktttcctgttctgtkchgtyagtcgagawgtccgtyctgtgtcgagggtkctaggctgtaaatttgaaawctgggttcgggtgcacctgtkatccggtgcacccttgtktgtkcgtwagaaactgttgcgacgatcgcgttgt

SEQ ID NO: 66990 - DNA, 457 bp, Triticum aestivum
  unsure (1)..(457): unsure at all n locations
  Clone ID: PAT_TA_66990
actgcttkcytytctttgggtcctctgagaatctcctccgcggccctcaagaggaacttctaccttctctcggctgarndngacgacgttgtcaagcccaatgtcgcktatytkcaggagttckggctaggtgctttttatattgccaagctatgcttccgtcaaccatggcttctcactgccaacctggagcgtkttcaggcgatggtggaatgcgccgaaaacataggtgtkccccgtgcctytcggatgttcaggcatgcbcygcacgcbgttgcatttctcagttaggacaagatcgcagacagggtkaacyactttaagaacaccttcaggtggacggatgcbgaggkaggcatggctgtttctaargctccatttgtgctggcgagggccaaggagttgctgcagcccaggtcttacttcctcatctcccagcygggcttkgaaccggtgt

SEQ ID NO: 66991 - DNA, 375 bp, Triticum aestivum
  Clone ID: PAT_TA_66991
gcagcmctcatggcacaacgtgggcggccacactttgcggtggcacgcacctacctcgtgtcggatgtdaccrrgggtggaatccacgacytttacttcggctggrgcaagccggtgtatwcyggtccgcgcggaatggcggagtcgtcgaattaccaggcgtcggcagcttcttcatttctgtaaggaacgccatktacgaggagggtatdgcaatccccgtstgcatrccccgccccassrgggrsrrgttcgttaacragaagggcaagctcatrcbccccgcatttgctgacacgtgtcccaagakgtgatctgccaccttwkttgaatcgtcatctgcyagcacggtttcaatttaccatcaaagcktgt

SEQ ID NO: 66992 - DNA, 202 bp, Triticum aestivum
  Clone ID: PAT_TA_66992
gtccgtccccacacccacacctcctcctcctcatccggmgyctcctcctcctcttacaaatactacatacccactgtkccctctccttaaccagatcgttcgttcgakgwkayggacagagagcsagagakataggaggagggagaaagcaggtkatcaaagggccaagaagcgtcgcgagtagtatgggtattgaggttgt

SEQ ID NO: 66993 - DNA, 313 bp, Triticum aestivum
  unsure (1)..(313): unsure at all n locations
  Clone ID: PAT_TA_66993
ggtcggtagctgggccgaagatgtyctttkacctccttcttggctggcctcygtcygacatacttcttggtaktwkkgcgcaccgagcnccttnggcgacwggcctcggcgghttkgbtgtakatctttggaaggtcttccccgcctgcctgcsgaccgcsgaatyctcattgtctgattgtccytttkaagckggactgccggcgagcattawgggctccaaggcctttaggcggacattttytttktykgattarctcsawgggggcsccgttcacctygawgarccccccccccggcttkgtgtacctcg

SEQ ID NO: 66994 - DNA, 249 bp, Triticum aestivum
  unsure (1)..(249): unsure at all n locations
  Clone ID: PAT_TA_66994
gccaagaaggyagcsccaccaagaaggcccccsccgccaagaaggccaagaagtagactcctgcktdaadatyctagggtttkgcggtagtdttccagtagsngtktttbctgtwctgtdcygttagtygagaagtccgttctgtktcgagggttctaggctgtaaatttgaaaactgggttcgggtgcacctbttawcyggtgcacccttttttktttttttwwaaactrtwgcgacgatcgcsttgt

SEQ ID NO: 66995 - DNA, 655 bp, Triticum aestivum
  unsure (1)..(655): unsure at all n locations
  Clone ID: PAT_TA_66995
ctctctctctctctttctctctcgcaccgcaccgcaccgcaccgcgtcccctccctctcctgtcgbgkgsgcscggccagcaaaagcttccacataaaggchaywwgataaaccttaatctgttgggtgccagttaaacctcaacaacaaagtttcatgtcttatctcgacgttactctgccawckgccttcgatccttttgctgangcaaatgskgrgggrkgctggtgcaggccccggcgcaaaaaaatatatwcatatwcscatccagcagckcaacggcaggaagagtcttaccactgtccagggccttaagaaggagtgcagcbacaacaagatcctcaaggatctcaagaaggaattctgcygcaatggcacagtagtccaggatccggagcyaggccaggkcattcagcytcagggtgatcagcgtaagaatdttgcyactttcctagtccaggctgggattgcbaagaaggagcycatcaagatccacggcttctaarccgaagccgcctcccakaaatgctcgwaccgccascyggctcttctctatattgaaggcataaggcatakatatattgcygcccgcytttygaactgtttcttgctttawgcaagttgttttgtcgcctsaatattatacygccgccgt

SEQ ID NO: 66996 - DNA, 223 bp, Triticum aestivum
  Clone ID: PAT_TA_66996
actgcggbagcctttgcaataccagcttcccgtcgacgtggatcgtatcggaggatcaatgcatgacatgtkacacactaacttgddrgrbattacatatgayggtkctgacacctcttgtctccttgccacattggtcacaggcactgcccttttgaacatcagaaacatttgttcggkctggatagtccaatggttggcatccctgtkaggtggagggtac

SEQ ID NO: 66997 - DNA, 752 bp, Triticum aestivum
  Clone ID: PAT_TA_66997
ttcccgatggctttctctgttcaattgcttaatttggktgtcttgtcttacctkaactgbdargggaaccaacatacatggttttgtttgtkccgtccgcgcsgaatgccttctgttgccgcgcctccgccaccgacaccgccacgcagccaatkatgttggcatgttgkgaaaaaagggcccaagttaaaagtcgaccaagcygtaaaaattcagttagaagaatttttgtgcycacagckcacaccatggcgtccgttgcctctgttcttactttattattttgtttttcccttygtygatttttcatgttgcctkacaagaacaagaattgcaaagaagaagttaaaagaaaacacagaacaaaggrtgaacgccggagagcactacwtatataatttccccccaaaatatgawgggcagttgtgtkcttttttkcattkatcgcatggkggccagcacttcaccacacawcttacggcgactgtkttatccaagccttaaccgctccaagttcygcsccaaggggatttgcaccsagttccttctccagaagaagtygcccacctyctgccggccgacacaatttccgtacaawgccatctcccarcaggcaaattgtaaaggttcttctacctycctaggcaggaaaraagtagccaatactttagccgccgcacacyatgccgccccccagaagtccatcaagaaggccgaaaccgccaagacacccgcaaaggtcgttgcttcca

SEQ ID NO: 66998 - DNA, 563 bp, Triticum aestivum
  unsure (1)..(563): unsure at all n locations
  Clone ID: PAT_TA_66998
atgcatccaacgcgttgggagctctcccatatygtcyacctycacgccgccgccaattcactagtkatttcgrgcggsgcccgggsgggkggcgrrggcggsgccgsgggsgggctcatctccsgccaarggrrrtgrctaccgkkccggggkctctggtgtgggggctcctyrrgvcgggcrrctgcttctttrtcrrgcrkttctgcrgcrgcrrcaccgggggtgcgsttcggcgggnggccgggcggcctctgcggtktccgctcctgcgggttctctyncttttccggcggcggggcccttkctctccggccgtcggccgcggggngcggggctctcgtcctctccgccgccggcgccggcgggcgcrgcgcccctcccrggctccrgcgcrgcrctctcgttctcrggnrgtgccncggggggtccgggtccstcgggggcggntcttccgsrgctgctgcrsgcctygtctygccggcccccccttkcgggctygntccctttgctcccccchgcrccctrgtctgttcccccccccgttcgccsrrgcgtgcgca

SEQ ID NO: 66999 - DNA, 438 bp, Triticum aestivum
  Clone ID: PAT_TA_66999
actcgtcggagactcgcgttttgagcsagcycaccactkttggtcaccccaaagtcgcctactatdcyaaccaaggtgctccaagcstyyttttccsggbacgcgctcyacttcaacatcsatggcatcatcsagcttcacctttgtaaactctgcytttyaaagttcgagaagccgatcgctggcaaggggcgtctcatgacggcgcaaggcggtgggctccgattcatttcyatagtggatgtyacaaatctaaccctsttgtcaggggaggctggaccaaagggagcsatggtatggacaaagcycacggtaatcgatcttaagaagcygcccccycccggggctctcatgacccaaacagttgaatatrggattaatggcgtygcggaggggcacccaagtbatttttgttagcmcatatattggttcctacat

SEQ ID NO: 67000 - DNA, 398 bp, Triticum aestivum
  Clone ID: PAT_TA_67000
aaagcgattccgcagcagaaggcgaghagagcaagtsggagagttcagaacaggagggccasactgttgagcaatagggccaggccgctgyacatcgaatcchgccctcccagcaattttcggcggagctatayacagacgcctgggtgcgctctcggtggacattagggagggagagcargctggtgtattgtaattctttagtccataataattggctttttttgggttattgacgtggatgttgcmactctgaggttttattgttgcaacacctgaggaaaattgtatgatrgggtmtatggcrgdagttacaggatttccccccaagccccgcagwcgttacatttgttacagatgtgaataggtggbtgrggtrgcmmmacmccatggttttt

SEQ ID NO: 67001 - DNA, 451 bp, Triticum aestivum
  Clone ID: PAT_TA_67001
aaaatgtaaaataaatactgttagattcattatgawatatagtttcatagtatatatatactggtatrgtaggcgttgaattttttaatataaattgagttaaacttacaaaatttgacttracataaatttatatgcaaagtaaaaaggaccgaagggagtaacacttctcactagcsagtggagacgatgaggtaaattagttattcactgatgaccgtmaattgcaaaaacaaaaaacaaaaaaatgaatatataaatatgtgcaccttgcatmgtagagaatgttstgagcttcgtccttgcccttggatttgagttggaccgcaaagagrgtgmacvacggtttacccaggtcctcctccgbtgggtsgsggtgcccggtgatgaaaatggcggcggcgcggcgccgtcatctggttgtgtgctgttgtgtgtttggccatccagt

SEQ ID NO: 67002 - DNA, 254 bp, Triticum aestivum
  Clone ID: PAT_TA_67002
agcgcagtcccgggtgcgacgcgcgtgtggcgcagcgcgtcgccagtcccgtgggartgggagcgactscgcgtgcgtgtgcgcgccctgggcgcgcsckmacwcagagcgcacmcagaacagcggaracagtttcygtkchytgcgccctgartwcagtkcacagtgtrcgcggtggggacccmcagggcgsgrgtrcmctccgcasarcastgcagggyscccagggcdstgggaacgggtktccctcccac

SEQ ID NO: 67003 - DNA, 581 bp, Triticum aestivum
  unsure (1)..(581): unsure at all n locations
  Clone ID: PAT_TA_67003
ataaatacacaacgatcatccaacgcgtcgggacckccataymgcgaccgcgcaggcgsgccgcbaatacacyagtgaatwctgagcdgccgcygcggggcagggaccccgcggatcgackggaggagcayatatcaaggaaaaattctcagaggatgadaccrctctggaagckaacaagggkcagagaacaaskyycttgtbrcaakgsggtgtrrgcctaaagcgtgagcgagtggggcbtctacbgcbtcaaaagcacccscsagtsagtctcaaccgbgcyacyccaccbsccccycttgcygtyaacbgcaagaacaccacckykcacaggsaccbgttgckgcatckgaacsggcgcctccsagtgcgcascbycagcggtktctbagacgscagcsccgscagtaactgcatgaggggaggsggaggtatacagtsaggskgcatcaaacbtgtctctkgcggsagtgtagaacacasggccaacaaawdcttkasangggggggcgcaccssggaacgtkataagggtttgcgttcyttacgttcygsatacaaaaccctcagagggcgagw

SEQ ID NO: 67004 - DNA, 692 bp, Triticum aestivum
  Clone ID: PAT_TA_67004
cttagtggaatatcagtgtgaactcacgcatgtrtgtgcgcgcacacmacaaacacatacacacagaaggaagccctcgtttgacccggdaagggaaatcttgcscacgcactccgcagcgagctcgtccaatcttgccgccactccgtctccccggctgcagttctacgcctccatcccttgccactccacatcccccatccccgaatcgctttcgtcaacagccacccgtcgccgccgccatcgacgaggttaccttcaccgccgccaccacagcaccatgcctcaccataatctccatgccccattggtcacgtccacataccaaatatttggacctacaaactggttatacgcttaaaaattgagcatgtaagatcaatgtaaaaccaaacaagattctgcaaactgaaccacatataaccccaggcaaagaagggtcatctgtatcagttccataaccacatgatagataacagataccgatttcccatcagatgagtagacaatgctgcgaacctccccagacggttctgcaaaggctttgttattacaattgaaatcctcctagaaaggacagaaatgtaacaataacaataataataacaaagcctttagtcccaaccaagtkggggtaggctagaggtgaacgcataagataatgcatctaactcatggttctggcamtggat

SEQ ID NO: 67005 - DNA, 280 bp, Triticum aestivum
  Clone ID: PAT_TA_67005
ctcgtcctcctctcgcttatccagcaggtgaggagatgatgccttgcacctccgacttgatgtgcgtgtagaggtccgtcgcagcgcgccggtcggtgaggacgtcctgcctctcccgcatcgggatcggcttcccgaaccggtagtagaaccggcccgggatctttaggcacacgcccgggaagatcacctcatgcttggcatcccttagcttcagatgcttactgtaggcccgcattatctccctaccgaaaggcgcgctcctgatatcgtcgaacgt

SEQ ID NO: 67006 - DNA, 471 bp, Triticum aestivum
  Clone ID: PAT_TA_67006
cttttttgtaggrcaaccgtttgaagcttacaacggcatcatgtttctcgtaaatdcttctagtaagcttttgttttgcgagattaacaattcggatggragagcgattkaccggrtgckatcttgatctatctcggctcttatagtcaataacagtatctgttactgtcgatggtgcacgcaacgtaacacaccttgtttgctctgttttcttaaccttttcctgaaaatctcaatggtataacaggktacacacaatattgcaacaggktgatcatttgctcaccagctccctactacaccttgagaagattgcatatattatgatatatgtttcactgggctgatccttcatagtttcggttcccgtctacacctatttgatcgactcaaaaactatcacaggcgaagatgaatttttgcagttggcattctggacttcagtkttccatctaaacagttggaccatag

SEQ ID NO: 67007 - DNA, 325 bp, Triticum aestivum
  unsure (1)..(325): unsure at all n locations
  Clone ID: PAT_TA_67007
aactaaaaagwatttctattgataatactaattmagacmccaattacttcaagrgtvgcccywttggccacgtttggttccagagaccawattmacatctaaactvgctagaatcagccvagctamgctctgattctgatgttrgcacgatttacactaacrgytrarataaactgamcctggtgccwtgkgtggttmattcagttggtccatacgaagtaagtrrgvgmarachtgtcchathnccrgcgtccagttgcaacacccgaaaaagmacttcccctgcwtcrghcttggaacggacacmacgcctcctctggtcggt

SEQ ID NO: 67008 - DNA, 309 bp, Triticum aestivum
  unsure (1)..(309): unsure at all n locations
  Clone ID: PAT_TA_67008
ktaccagtgtttatatccgcagctcggtgtcaagaattttataactagccacatgggkctttacaagccagcggaatgtataccttgggaatataaatgggaacaggggtttggtaggacatcactagagggaggcatagcaacttttcyaggattagggcycscaataccaknattycrggggargaggsgtggataakgtggggctttaacctancbacctctccaattattctggggckkagggctatctatagctgnaccttcttataccaggggcagggargctccaggaccctatgagcttgg

SEQ ID NO: 67009 - DNA, 269 bp, Triticum aestivum
  Clone ID: PAT_TA_67009
gaactaactgrattttaaaggaagcaaactacactgctgaactcggtgtagactggtagttgaacttgctaaacatccacactagcaccaccagcagaagccgtggtgtcggtctggtgcttgacatgtaagawgatcggcggactagcgtggtgagctgaagatgccatttgtgcagggccagcaccgggcaagatcaaactacgcyattcatgatgcaaaggcyggctgctggctcgtcatcgtcgaactgaaccccgcacccctgt

SEQ ID NO: 67010 - DNA, 478 bp, Triticum aestivum
  Clone ID: PAT_TA_67010
acatcgtgaacaatttattagctcagatacccaacttcacaactaatgtccaaactgcatggcgatcatttgttgcatatgagagaacatgggctctctcagagskcaggcgattctggtcgtccgatgcgtttgctttatgcgttttcgggcgttggatcgagcbgtgggcggastgggccgtcggatgggactcgttcccctggagcaatkaatagttaccccgcgggaaaagatctcgtgcbaccgcgtgtkaattcggtgccccaccgagggcattttcgtctttcaacataccccaggccatatggcttcctctcattcgtkgtttcatccccaatccggtgacaagctagggttccgttttgtcgtctctcccacgcatctctcgtgcagccgccgctctcgctcctctccatcactccggcccgagcgccgctgctcctcttcscctccctcctcctccatgcgttawaat

SEQ ID NO: 67011 - DNA, 191 bp, Triticum aestivum
  Clone ID: PAT_TA_67011
tagtccgccggcgtgcagatcgccgccaggtttatcgtcttggcggagcagatccagcccccgacmcgcrgaaamaaaatcgtcagcggttttctttccaraaattaattcagggaacgccaamtgttttyttttmaagcgacgaactcgctacttgbcvmmctgaatcaatcaagaaamtgaatcccmcg

SEQ ID NO: 67012 - DNA, 312 bp, Triticum aestivum
  unsure (1)..(312): unsure at all n locations
  Clone ID: PAT_TA_67012
ggggggggttacctgtcctgrcctggacccggctgttaawtaaaaaaawtccggtctcaggggctcamcawcccggactcaaagtaaataattwcgcgtangagtmgttcwawggggctcawgttcttwcttmctwtcttctccctgamtgttmtgctkaaataattaagtwmtttccaacgramgaamggtcggtccccwccctgcccctamtgtcsaaaaaggawccaaccaaaamttaggcttaamttaamgtwmgtcgtctcttaaggaattatwmatgtttcggtycatkggaagrtggcngcagta

SEQ ID NO: 67013 - DNA, 476 bp, Triticum aestivum
  Clone ID: PAT_TA_67013
attcatcatcccatcccccaagccataaacccaagtyggactcgccttcctcctccccaactactcctcctcgcctccgcgcatcgcaccgcaccgggggtcacctgagatcacatacacaatggtgaaggctgtygctgtgcttaccggcagtkagggtgtcaagggcaccatcttcttcacccaggagggagatggcccgaccaccgtgacgggaagtgtcactggactcaaggaagggctcacggcttccatgttcacgctcttggtgacaccaccaatggctgcatgtcaactggaccacacttycaaccccgctggtcatgtgcatggggcaccsaagatgaaatccgccatgctggtgatcttggaaatgtgacagctggagcggatggtgtwgctaacatcatgtkactgactgcymatatccccttactggacaaattcaattgtgggcgtgctgttgtcgtcatggt

SEQ ID NO: 67014 - DNA, 249 bp, Triticum aestivum
  Clone ID: PAT_TA_67014
gcttccaggccatagcmattcacacctcacccttggggtcctaacaatttaagtgtagcggttcttttttcacaacsrycgtcatggycttgckgaaactgcattccatttccttgtatttttcatttaacagatcatggatatatcacttttcagttagagattcaagaaatttaatctgaatatgtgtggaatattagtatycttgcgggtctagtscatttccacgagtgctcgargctgttccgc

SEQ ID NO: 67015 - DNA, 707 bp, Triticum aestivum
  unsure (1)..(707): unsure at all n locations
  Clone ID: PAT_TA_67015
acccttcggttgcttcgggcgagttttcagcatcggcatataggtcgtgcatctggaccggttaaacatttgaggatatttctaaatcttcacgagcccagcttctttgcctaattccaggttcaccattcaataaaacaactgaatgggatccgtgcttctgtagtttcaactgccaatccttttttcaagccaggaccaacgtcatccgcctttgtgatacatatttacagaaactttatggctttgattcagctgcctkactagggccattgttcatgttatcctttacatatgtkcgaaggcatccgttgattacccgaggagcacctccatcacaaaaccgctttgccagakctaccgcctcattaatggcaactttgtkaggagttcctttcgatgtcatctctkccatggcaatatgaagaatgcagagttctaggatccttgcaacargttcatccttccaatgttggggaattattttgttgatgactcaacatgctgatccatccactggcaactscactaacatatccgggcaatcgtacacaaattgttgtaccttccccggcggcgckcgaaatcgaattccgcggcgccatggcgcgcgnagcatgcacgtcgggccaatcgcctatagttattgtatgamattcactggcgtcgtttacacgtcgtactcggaaacctggcgtaccmactta

SEQ ID NO: 67016 - DNA, 264 bp, Triticum aestivum
  Clone ID: PAT_TA_67016
accgatctcttccgcgtcctgcttcagattacctctccggtctccgctcgcaccttagagctcgccgtcgcaccgcatcgcattgcggcgcgycgatcygtbcttcacctacgggtctgtatccacttcacaccactcactgattcccctctaagcacgccatttctctgctctgctgtgtgactagcgacccacgtttgtttccgcaagtkcatcactctgctgcacatcgatcaatcaaattaagtktctcatcttccatgt

SEQ ID NO: 67017 - DNA, 297 bp, Triticum aestivum
  Clone ID: PAT_TA_67017
atttaaatcaagctggattaccatatgtccgtctacaattggtggtgttaatctacgatgtctattttcaggtcttaatagatgtcatatagtaccgtagacyytgtagwctaaatasagcataaactcgaacataaatattatgaggaagggccctatcctctagggaccttcctcctctcgacgagcgtcgaaacatwggatattttcgtttctaattcctgatctaaagaagtcatcccttcctcgttyttctcccgtttcactcctcctcggggggtgctaaacacatcttct

SEQ ID NO: 67018 - DNA, 464 bp, Triticum aestivum
  unsure (1)..(464): unsure at all n locations
  Clone ID: PAT_TA_67018
astatagaatactcaagccatgcatccaacgcgtygggagcncycccatatcgtcgacctgcaggbggscgcsaattcactagttattagcgtkgtcgcygccgatgtacatyacaacyacyaacaaggctgtygatttgccataacatgagcyakctttttcttcatcagabctacgtagtttgaatycagcagcbtgtgctttadccgagagttgarttacgggckggttgatcagaagccgttgtagaagccaccmaacgadawgttggccctygtygacgcgccttcccccatcatagatgayatggcctkgttcagcctygatgtytgctgcaccaccttctgaattctcttatcagcgccaaggaacttcagcyggatcttcttcygcgggtggtgctggttcygcttcttgtgcygcagcctgcygccgacgaggaaaacgcagacggtggccgccg

SEQ ID NO: 67019 - DNA, 565 bp, Triticum aestivum
  Clone ID: PAT_TA_67019
cctcagtgcacaatccagctctccagcctgcacaaggtgtggcacgagagtytcatatgtccccttatttgggacacactcgttcttcatcaaattatcatacaccttcttggcctcctggaacctcccagctttgcaatatcctagaatcaactgattgtaggatactatattgggttttggcccgtccttctccaacctctcaagcacagcagctgcatcatcaatcctaccttgtgcaaccaaaccccgcagctttgcattgtagcactttgcgtctggctccaaattcctctccttaatcatttcccatactgcctcggcttcatcattacggccactgttgtgaaaccatccaagagcgagttgaaagtaataatgtcaggtgaaacaccgtgcttcttcatgagatggacagcataaagagcggctgagaggttggacttctggcacaatgtgcggatgagcgcgttgtaagagtataggtcgggcacaatggaggggtgtgtggctgggatctcctggaatgcagcagtgagcgcgccaacatctccggcttcggcgt

SEQ ID NO: 67020 - DNA, 589 bp, Triticum aestivum
  Clone ID: PAT_TA_67020
ataaacccaagtcggactcgccttcctcctccccaactactcctctcctccgcgcatcgcatcgcaccgggggtcacctgagatcacatacacaatggtgaaggctgtggctgtgcttaccggcagtdagggtgtcaagggcaccatcttcttcacccaggagggagatggcccgaccaccgtkacgggaagcgtcactggactcaaggaagggctccacggcttccacgtgcacgctcttggtgacaccaccaacggctgcatgtcaactggaccacacttcaaccctgctggtcatgtgcatggggcaccagaagatgaaatccgccatgctggtgatcttggaaatgtgacaactggagcggatggtgttgctaacatcaatgttactgactgccatatcccctttactggaccaaattcaattgttggccgtwctgttgtcgtccacggtgacgctgatgatcttggcaagggtggacatagagcttagcaagagcactaggaacgctggkacccgtattgcttgcggaatcatcmggctccaggggstaagatgtcatctccaccggccaacgkcgtaccttcc

SEQ ID NO: 67021 - DNA, 671 bp, Triticum aestivum
  unsure (1)..(671): unsure at all n locations
  Clone ID: PAT_TA_67021
acatggctcctatgagcaggtatcccccgcctacaccaagcagaacaacatgatgcagtcccggcaacggatcgaccttctccaagtkccattkgttatttctcagaatggaataattcagccaacatgggtcatatatgttgtccttgtcataaacttcagcgagcattccgagcattccttctgctgcctcgacaatgacaaaatcgctactccatcctagttcaggaggtaggttgacagcaganaactccatggtgcgtgtatyaagcagaaccaacttgttcaggaggggaaaatgccaacagaagcatccsttgacgaactgacgatctgagagcccatccctggggtcttcaagtggagcctgagcactccacaggtcaaatgcaagagaatsccactkcccgtccaacgaggagaagacgagcagcaccatattcgttctgcattgcaccaagcacattaccctgaatgacaacgggtcctcctcatcatcgccgggagcaaggaaagtctccagatggaggaggtccggttcactgaccagcsctttcaggtggccggggacgsggggaagcaggatgtagccgcggtgcacggggtcgcacacggcgaggtccctggccgacaaatagcggtactcggccgcgacacsctaatcgaattcc

SEQ ID NO: 67022 - DNA, 402 bp, Triticum aestivum
  unsure (1)..(402): unsure at all n locations
  Clone ID: PAT_TA_67022
aattatgcgggtcccgacactagtrggctcartgggctgtggggcctggggcrgavagttyacwcacactagaywgtrtagatatttactcagagasscwgggtctaggmgtctmywgggagtmgscagagngtagacccagggbmaaatktatttattdaaacacgctagggggagcsgggggggaargaaacccagcgagaaattcamgrcscgcgcbaagggcyagcgctykytctctagcgcaaacaaacccccacaamcctagktctmtttytctcycaaagcgmgctctagrachaatmttcwraatwwakagmgmycthkckctagcgathtakwgattttmtctcthgaragawadakagmaaaagagaaagcgckctagakctctytwkcgct

SEQ ID NO: 67023 - DNA, 731 bp, Triticum aestivum
  Clone ID: PAT_TA_67023
katttaatgkgttgggaggtkttttatatggttgatttggaggtgggggggaattwawtagtgattttgagggggdggdaggggaggtaagataatatggdgtggtaaatggagcawaggtgagattgaaggtrgtgaaaggaggaaggtgtadaaaattgttatggtggatrdtgadggggkaagtdtaagkaaakdggaatatagggaatatttggattggattggaatgtaggkgtgtkaaaaaaggaggggggkgttttttttktattkattaacaggtgaagaacttttgttktgtatgstattgggttggtgaragaaattwsagagggaacagatgsacgttttggaagvacgggagakagtatatggactaggatggggggaaaattttaacatkagagagttgtkagsattttakaatgttggaggagwggttggtggattattgttkaagtgggaaaaggagagtagtgttggtgggagaaggttvtaaggacyagggtgagggatggatgtaggaggggtctagaacaaggtaggactatttttagaaaatatatagtataataaaggagggtggggrtggkgcagagtgtmtatacttgtgggrtggggatagtgggtttgaaaaggdtttttgsagaattattatayaagagtaaggttgtrtagaaatttwktttkatagawwmgartttgtgtgggagsttttaggactgggtagt

SEQ ID NO: 67024 - DNA, 731 bp, Triticum aestivum
  Clone ID: PAT_TA_67024
ttgttattattacttgtaaagtgrtgttgagatcgtgtaacaagrkggkggaagggttctacgaccatgacgtatgattgcttgttatattgcgtgsaasaaacctgtggttttccaggttatgacgagtccacctcgttgaactgtcaggaagatgacaatgacgaccaccccatggacaggttggtggatgacctgacccaatccaactcgtctcaccagrcggatcgtgaaccaaacaccagggattatgagrttggtcaagaaaaagattcggrtgagkaacatgttcatgatgatcgtgragaagaatatctcttgrtgatgacagkcccaccaacaacaccaaggaccacaccaaccaccgtggcgaccactcgaaagggtcagtgaggtactgccatctggtcagtctgttktttgctttgtgtgggctktgcagcgtgwgkattgagrattgatgctcctaaaattggtcgccgtgcacacttgcccaggtcgatgccgggatggraactccgagcgcgagkgcagatgacccttggacttcgaactgcttcttataagattccttggacaargcaacgggtgtaacgtgggcctcttgcgratttatatcgaggtcggactacgaattagaggagtcatcctgggaggarttcaatatgccacccaamatggggactaagggctaatacgaatccatcacttcacmgggttccgctagtgtg

SEQ ID NO: 67025 - DNA, 472 bp, Triticum aestivum
  Clone ID: PAT_TA_67025
atttaaatcaarcttcaccacatctaacatgatgtcsttatccatbttttggttcatattgtagttacccccstatatcaactggtccacttacttgttaadkttcagtdgttattagtgttatatgttcaacaattattacaatgcttgtagtaaatgtggtacaactcttccttgagatattcgttctattcgakatagtcttcggcgatttccaactcgttcatgtatttatkatcgttdcaaaacatdtattgcaaggtagtggaagtattaagccgctgaatgcagcatgaggtggagttgagacgtkaaagaggggggtgagatggtgagggagggagaggacgcgacgagrgtagtgaagttgcgagcgtgtacgatgtaccgacccgtatccgaatcctaacccacgtcaggcggacgtgacgatccgggggggcccccccccccccccccccccggggggcgc

SEQ ID NO: 67026 - DNA, 319 bp, Triticum aestivum
  Clone ID: PAT_TA_67026
ttttctcttctttttcttcccacvgctcttagtctcykccbgtggwccgcacrttggcttrcscttwttttccaagtarygtttcgtwgccgtctktggtcgtktcrtcscgtggcgggcgaggcgcaggcstttgttccgcgggrtacyaccmcctwgtctccttcmttrtgrcctcttcgttaagagrgctctgcgtgtcctcttctgttrcccgccatcctctccccrccrcrcgrtccagctcctccgtggcttttgttrgccacttttrcttctttttgtgctccggtatagcccgttcctctwttgcctccgg

SEQ ID NO: 67027 - DNA, 305 bp, Triticum aestivum
  Clone ID: PAT_TA_67027
gcccccccgcgacgcyggctgtcttcctcgtgggcctgggctcgccsgtgccttcctctgcsggggggcttccttccccttgcsgtgsgccccvggcgtgcgcggcccgggmggcgcstccgcgtcggcgtggtcgtcgcggtctttgcgcctbtscgcsctsmggggctggtcgttgtccgcgctccccctggcctctcgctygtgtgattsscggccttccgsggccccyctgcgggkcggctgwkgtccctccgtcgcctgcscgcccggggctccsccytgcgtgtgtcgggccttgggtg

SEQ ID NO: 67028 - DNA, 476 bp, Triticum aestivum
  Clone ID: PAT_TA_67028
acattttttacahcatcccctaaccycctgcccgccatthtcgtmaattctccaggaacaaacaaaataaccagctgaccaattcttatcatctkaattyyaagtatcttahmcmcccaatcatatmgttcctttatttcaccattttctagcaatatttttttttgarctttgcacttyactttctctttcccttgtttctttagtatgccccccactaatttccagaaaatttttcccttgtcgtctccttgtttgaaatcaaaaactccargtccatcttttgttccarcarcaaattaaaaccccatggctgctgggcatkttttcaccacctgctgacctcccgtacctggcgtgcmtcatgtatgthaaaaaagtgaaraamgytcccttttcygacatttcccccatgttggatkatatcaachccgtgccsaacttgaaraargtkaacaattggcttctcaaaatgt

SEQ ID NO: 67029 - DNA, 722 bp, Triticum aestivum
  Clone ID: PAT_TA_67029
acaagtccagggaccccaggaccaccgacgagggggagatgctcgavaacctcttcgactgcctctrctgcgtgctcatgccgctcgggaacaaggagcggttcgtcaaggccgagggcgtcgagctcatgatcattatcatgaagcagaagaagtccgcctacagctccgccatcaggacgctggatttcgccatgaccaggttcccccctgcctgcvagcdctttgtcgacgtgctcgggctcaagactgcttttgcggcgttcatgggtaagattcctgtkaacaagaaaaataatwatgagagctatcaggaggagctagaagaacgcatcahttcactagttgcttcattgtttggtggtatcacgaaaggttcacgaaggatcaggttactaggcaaatttgttgagaatkaatgcsaaaagatagaccgtctgawggagcyatacatacggtattcagacagagttaaagctgagaccgaaaggtttgaaagcctcgatttagatgatttagagatggacgatgatgagcggkacggcctctccaagggcggcaacgaggtgctcctcgtgatcbaggcctacaagacgctgagggacagggccccctaccccgccagcttcatgctgtcccagctcaccggcagcyacgccttcgtgctcttcgacaagtccacctcctccctcctcgtcgcatcggacccggagscaaggtac

SEQ ID NO: 67030 - DNA, 180 bp, Triticum aestivum
  Clone ID: PAT_TA_67030
acttgcacacgtcatgctgcgtgagaagctgcacatattcggcattctcggatgcgtcctatgtgtcgtcggatctaycaccatgrycttccatghcccgcaagakcgtyaaattgagtcggtgactgaagtttgggatctggccactgaaccagccttcatgtgttatgtggccgtagt

SEQ ID NO: 67031 - DNA, 265 bp, Triticum aestivum
  Clone ID: PAT_TA_67031
tacagtgtgtccgcttcagaccacgcgacggcaagaccacctgtgaccttccccctgtchyactcaactaaactccgagcttgaytctagggcatgccaggcaatagggttcgcacaagccatacatacaatgatgagatgaagcgggcatttactaaattagccatgactgacgtgattagtagagtgcagtagtagtattacactaagattctagatcaccaatcaggtgacaccgtcagaccagaccgtcaggggcctcggt

SEQ ID NO: 67032 - DNA, 336 bp, Triticum aestivum
  unsure (1)..(336): unsure at all n locations
  Clone ID: PAT_TA_67032
actttctymtcagagctcaggttttgttrggcgccagaccgagcttgtcagatctgctrggccrgtttttcgacggaagaagaacngtcmggggttcasacnggattgtccccatagttagagctwgaaawtcccatttagggtctatcyaactatccaatttggtcwaaagagactattgagtyrkgasggattaaagtckttkggcachatcctcbggcyattaamaccaaggttgccaaattgacmaccgygccattggcccccaccacccyacmngaaagccacctttgacaggtttttgcstgaccacaccaaattttttcccccagtcgc

SEQ ID NO: 67033 - DNA, 688 bp, Triticum aestivum
  unsure (1)..(688): unsure at all n locations
  Clone ID: PAT_TA_67033
accsgcygcbchggccvgcsaccsgcctctstcttgaaccmgtccccytgaaccaccgccccggctygakccgatactngccagcctngcyctngcttcctcwccyccnaccccgycmacccagtctctgshkattgattgaagccgttgaattcttcctcctbcctctyagttgtattcaaggattttcttgctttgatagtttttgcttctcctccgawgcagascagcctcttagctagcttttgttgcyctcgaaccgagtgaaccagtcccccaaggaattgatgcattwttscctttgtcttgcyagctttgttvccctattwctttcacyaaagcacccctsgacmgcaccaccgtttgaccsccactwacccgccccccaagcattaacccattttttcctycaagctngcaaagtmctatactgccacttcttcttcttattcaagttggctcctccgaagtycctttctgacccccyscaaacmgattttttcatwccgggtaccytccgtgcccgcyaacccachgcbaaattccgaatttcccccgctcgcccgcccatngtgcggcgnngyaagcaatagctaacagtccggggcccaaatttccgcccccaacaagttvaagttcgtattaacaaattccactcggggcccgttcgtttttacmaaccgtccgt

SEQ ID NO: 67034 - DNA, 318 bp, Triticum aestivum
  unsure (1)..(318): unsure at all n locations
  Clone ID: PAT_TA_67034
actatcttcancaaagctagccaaccagggacctagaatctccatcactccatcacctcgagtctcaagcaatgggcagtgaactgctcgcagcaacggttgcacbaccagcggasatcccttgatcctgtccacgaccactaccaccactaccgccggcaacggaaccatcacaacaatcaccaccaccacatgctcctccgctgccaatggcacactaccactaccaccactaccgccggcgacggaaccaccaccagaaccgccacaacaatcaccaccaccagatgctcctccgccgccgccgatggcaccagt

SEQ ID NO: 67035 - DNA, 348 bp, Triticum aestivum
  Clone ID: PAT_TA_67035
actccaacgccctccggawkcycccctacmtscsccasccctggragcatgtgchgggaakgggtctrggtrtacgtgtwtgctaaaccaactckgtgamttytgatgaraybgtcrmaggtggaccttgataagatgcwtraacstycctmmacacsccaattagcagcgctactttgaccaagacgacgatcasctgttcaaatttgtctggcggcamccgggcytctkygcagtttgctttccgtcacaaaaactggctccscatttcatctrccagaatttaataaactgatgtgtcacagtaccascyggggcagcagcyatcgttcgcgcgtggacgaccgg

SEQ ID NO: 67036 - DNA, 588 bp, Triticum aestivum
  Clone ID: PAT_TA_67036
gggaagtaccmactcttgatttggtgaaaagtggcgaagggggmccaaacttggtcaagggtrattttctcgttgatcacaaggaccgtmaccctcmaggtgcaaccgatgttggtcttgrgcttgaattcctaaggggcggcgtggaagtgcctcgacctgttccttttggcgcccggggwtttaagggccgatgtggatgcagcgcgccgccmagtgacwtggcttgsggggcaggcgaccsgctcaccgrgttgaggttctggccggcgccgagagtggtgttcgacgtaatgccgctccaggcttcccggatgtagattctagtcttcttgcctatacttggttgttctctcctcttactttttcgctgatcgcggggaattttcctagtggaatttaatttgatttgtaatggaagaatgttgttagsactcaattgtaacggaagatctgtggatcttggtttcmacagaacgctggwttttctgtagtcgtagtgcttgctggttargtaatmaagaaagttctgcacttagtgtaattctttgtgcttcttgatgatcaagaaaattctgaatgtcttgt

SEQ ID NO: 67037 - DNA, 389 bp, Triticum aestivum
  unsure (1)..(389): unsure at all n locations
  Clone ID: PAT_TA_67037
taatcaatatgtgggcaatcaatcgttgccgcgaggcyggaaggacggtgacaccyyccggrygacgcsgttyatgccaggtgagggggacgcygtcgggcgggaccycamgggcggctccttcgagttcntacccyttgggtctggacgacgctcttgcccagcacaaggmctctggtcatcatgcggtgcaattggcyctcccayacntcgcgcatgggtycmaccgggagctaccccmcggtatgakytccgacagmccttgamatgggtgamatgcctggcatcamtgggccacgcgccacacgcstctacgttgtgcctacgtcccgactcaacygcacgttgtaaagtgccgcttgtycgggtgtcccttgtstcccgtacst

SEQ ID NO: 67038 - DNA, 195 bp, Triticum aestivum
  Clone ID: PAT_TA_67038
gccacsaacaaaggatcagccatctttggaaatttcctttggtctttgaacaatggacgagccccatgagacgacagtcctgytcctcacgaggccgattgctatcgagtgcccttcgtcctgtaattagctcgaggaacaccacaccaaaactatagatgtcagacttaaccgttagctgtccagtcgcggcgt

SEQ ID NO: 67039 - DNA, 493 bp, Triticum aestivum
  Clone ID: PAT_TA_67039
aagtactttcaacttaggtgggtttttttctcaagttytcttcccaaaactaagtwaagcabtcvggggtccctcaaagaagaacgccaaagaactagctggctagcamgcacttcgggtttttttaycaggtttgggcrgttgtwaaayccayagcatccmtwttttwgtaygcacttctttggtttccaatwggttaatagaacttgagagctccctttatamcgrataggrcccgacccaattgagggcttttgaagcacttgtaaaacaacrgggccttcacagccaaggcaytttcccttggtagtcytttggccaattrsattttwtttycaattgaagggggaattaattcaaccccaacaaaccttgsaaggcgcggaaaaatagchggssttcaacaggccaattgggccaagcctggaaaatcaaaaatttrggscaactaaaacccccggataaagtctaagtaaaagttcccccaattggg

SEQ ID NO: 67040 - DNA, 531 bp, Triticum aestivum
  Clone ID: PAT_TA_67040
gaaaaggaaattatatttggaaagggtgttctggagcttcccacaactctgctcaatgaaccggtcgatactgtccggaatcatcagctaaaacattgttaactagtcattattgctaactcaaaagcgaactgaagtaaacatagtgaattcagcaaagcaaaattataagggtgcagtccaaaacaaaaaaaactgtatattggacagattagaagttatatgccggatggacagacagcaagaggtagcagcatgtttttttgactccgatgcacctaagcatgtatgcmacttcggtgccaagaatgaaatacaccacgagcaamacaacggcgccactcttccaaggttggtctttccacgacgatagtcctcatdtctctaatacttgccaaatggatatttggccttgcaacaastgttgcaycaataaagactgtractttctcatagtccaatgcracaacatcgtagatagtccgccagatgcaatttggtgtttgaacacctgaaartcwkgacatatgt

SEQ ID NO: 67041 - DNA, 360 bp, Triticum aestivum
  Clone ID: PAT_TA_67041
tggcttgagaaactataatctgctgttgggtstagacttgcctgctatgastcytytgastgataatytgcytyytytgatgactytcytgcytttcctgccttawggkcytgactggaytactgtgggggtsyytcytagaggaaggkcytttttcytsgytgtcytttbgyttyttytataaatctggkgattctggkggactctgaaggksttatgaagtggkstgtatctytttctcttytatgttgagactaaytatggttggatacttataactactgmtyytggcttcttttyytagactastttctttcctggkayttccttagataaaattgtatggatcttctttaaatt

SEQ ID NO: 67042 - DNA, 441 bp, Triticum aestivum
  unsure (1)..(441): unsure at all n locations
  Clone ID: PAT_TA_67042
acatgchattnttggacyggatcaamgcgatcrarggacggaaagcatacgcaacchgggcgatyttcttcctgamtyaaggtgggasawtgaaaccgatwgcgattwaacttthtattkntccagcacagttaggggagcwttagcwgagcaaggtccttacncctgcatgtgatggtasatycaactggatttggatgsttgggaaggkggatgtwagctcyaatgaagsdggtgttcatyagcttwttaatyactggttgaggacgcatgctataatggagskattyatystggggggggactggcgaatgagagcgatggaccskatcttyaagstcctacatybttacatgaggtamhttggswgcgamcacgctaattgaattdwtgywgytgctatgggggggggaggcatgcgaagttggggnsaatttgcya

SEQ ID NO: 67043 - DNA, 151 bp, Triticum aestivum
  Clone ID: PAT_TA_67043
ttcttagtagcgggacgwgcttgacgatcaatcaaagaacaaaaccgacgmmsaggcrgccaccgvagsgataaaagmaracggtmcvcmtgtcgytcttgcggataratgbschtgcygccgatgtcccagtacctcgagmcgcgcacct

SEQ ID NO: 67044 - DNA, 576 bp, Triticum aestivum
  unsure (1)..(576): unsure at all n locations
  Clone ID: PAT_TA_67044
gccgrtaatgaaaaayrmcaaagtcaccagaaawmaatcagtttcatctgccactgaacctttgrcmagncaataraccwcactgctcgctrgdccdgatagtgtctcagcttcctcggcctgctactgctcatccgatgcmttagcmcctgtggacaaaaaagaytaattctwccmcctggtatgggcggcctcgctgmagatagtttgacctmyacgagngcycatccttctgmtrctgaggactttgtgtatmtrtccagttgcttgrgmgaacatgctcgagtccgaamtmaaagammaaaaaraagawcmwrrammammwwaaccctgccgtggtwtgtcctcgggctcttmactctchacmtcctgttcctgctgctcmgcyggttgngaaggggtgccccaatcctgactaawctcttcgccactaaaactaactggtgctgcttctaaagcycccgcatcccgmamatcttctgcctaggagttgwatgcctccgaatcttctwcctctgccgcaacyccctctaawtctgmaatccygtcagccctgcttgcttccaaaactgcctc

SEQ ID NO: 67045 - DNA, 241 bp, Triticum aestivum
  Clone ID: PAT_TA_67045
rgyaccatgaactatyccagttttgtrccagccgaytgycgggscagcgatggcagacaggcytccagcaagtcggstatatcagtyttaggaggcacgactgggcgacctttawaccatggattccctgcatagctccttgatgatacgtatttccgtttgggtagctcggcggtggagatggaaaagaaaacgcctgtctggttttcttgaatacyatcgacgtatatvtccttaactg

SEQ ID NO: 67046 - DNA, 458 bp, Triticum aestivum
  unsure (1)..(458): unsure at all n locations
  Clone ID: PAT_TA_67046
agtacatgtrwkcamtctccggnaccmacggatcgtcgaggttmgggwctgtatrtagaragccantwacyaggygmcactwtgaytatgtcyatgawrggctccattgttccwtcatgtwatcaaggcagatgctcccctatgcatgttgatatatgggtggaaacctttgtttttaatgccacacaawaaraggtttgtatggrttgamtggagagagtraattataaacaattawacaccaccagcatttrggctttccgatgggccmatgatcgttrcwtrccagttgaacctatmttcwgccactragccggagcwgcyggaagtrgggggatccctctrccrrtcctaaagctccttgtrgatcmrcttagncgccawgggggmrgggacggggccggggmcggcgrcttttcaggchgcagackggctccgattccaatmaaaatcgaaam

SEQ ID NO: 67047 - DNA, 148 bp, Triticum aestivum
  Clone ID: PAT_TA_67047
gttcwktttyatarbbcmcrctgaatccaagmcccgggtttgccgccgcgatgtaatgccgccgmatwccagccyctccacccccgaccmtatattacrtttcttttcmtgcccccgtcgttgctaggtgccgctcccgcccagggct

SEQ ID NO: 67048 - DNA, 396 bp, Triticum aestivum
  Clone ID: PAT_TA_67048
cccccgggmactsttgttagcaaggaagaktagaacatggggaggmcgytgagcccccwtgwtggtcactacacttcccccccccckttgaaacttaagtttwggsgggytkttcatcatccgsccaatttascccgcggttattcctttaccyccccacctgaagttttgcttccccggggytmacmaacccatcccggtgagctttgctgaccrggacatagggaaracatgtgttgggamacgggccgtcgacgayyattttagaytaggttagaatagggtttttagttgaaatatgtcgagaatgtamtgaacctsgyccgstttagatgmaaayvwcccggctygatgtaaaaccacccaaattycaakgaatatcggtcctwtttgttt

SEQ ID NO: 67049 - DNA, 258 bp, Triticum aestivum
  Clone ID: PAT_TA_67049
accgtcagatgctggtgcaagcvattcatgcatgtdctgtggaatacccagaggtggctggatcggtggtgcaccttctcatbgacttccttggtgacactaatgtcgctgcggcagttgatgttgtgttatttgtgcgttagawcactgagactaatcccaagctgtgtgtgtccatgatacagaggctgagtkataccttctaccagatccgggcatcccgtgtctkctcaatcgctctctggatccttggtgagt

SEQ ID NO: 67050 - DNA, 610 bp, Triticum aestivum
  unsure (1)..(610): unsure at all n locations
  Clone ID: PAT_TA_67050
ccwtcgccagrcaagtmhtgtcawtchttgccaactcggtctccttctctgctccayggtyaggcaaatgtatccwwccgtctaawgccaaawccctyktkyttttctgttcgctgtgctgccaattyggkgacagtyrayyhggtttgtbatattgtgatgtgmcagmttgcgcttgmwgntgnmnaagttgwttctggctcctcttmgtttgctgatcttggtgccgattctttgggcacggttggkattgtctgggcctcgaggkggctttcgggytctgcgtagwgrtgtcgwgcgcrccgaccctwacyacggtggaggrcgccgcccccctcctcgaccgcctwgttgcamactahtcctywttcctggcasttatgtgctaccccctgccctcrttgctgctrgagatrgctcccattwgbcgtgctaratttttctgtggagrgtcggtgacmwctgtytcygtgtttttgcctgacttgcgatatttcagccttatttyttaagcggttgttgayggyatttttccatgtagaagabtgawwtcygggwmtraccttgatgtgcaaraatttamcmctccymtcttatttrgktccavmcs

SEQ ID NO: 67051 - DNA, 417 bp, Triticum aestivum
  Clone ID: PAT_TA_67051
acaggawagthggmtcagcagccccctccttgtagtaggcgaacaccacgccgccatcatcatgcatgckcgtcgcgcaacaaagaactdmaggtccghwgwdcttgystvaagaagatactwtgtggcagagctcaacattcttcttgaaaacatctaggtcatccccttcaagcttggcagrwaggktcttgatgtagcrcttcatgtaataaaaaactgcwtcttgtcaaaagcaggttgctcctgaagacggaggtgtyacaatgtcaaccaccttcacggcctggtcatcgacaccctcatcawcaccaccaccctcagcagacggattggctccaatgtccacatcaactgckccywgaacgacccaatggccgksgactwcccagaacacgccgttctccagcdccctgt

SEQ ID NO: 67052 - DNA, 438 bp, Triticum aestivum
  Clone ID: PAT_TA_67052
cagcagaaataaggagttacatgaactgggamcgattggwttggacgtggggagaraaaaaggaaatgttmcctcgctgttggcgggaaagagtagtaaagccccamccymaataycgcccttgatgaagaggycraattwtgscmacttacagggtatgtktwtggtgtgtttctcaagtctcaawtctmacatggttggtcttctaatccccctctrgctggctgacagtgggcatgcacaactctattcccccgmcggtgctwgcgtgcwtgaaggdtrggctttgggcccmtcaatcgtgtgtamcctactgwtctgctgrgttgrggkgtttggtwtwtgataaaatgccgrtctgctgagwwraaaaaaaarawgraarccavagrgatgtrgattamcctttttttaacaaacatagatcaactkgatttc

SEQ ID NO: 67053 - DNA, 399 bp, Triticum aestivum
  Clone ID: PAT_TA_67053
actgtsatccytcttgctgttgtcgatgcwrctacagtcctgacacacgwctgcycmtcctttmgamagacgacamcaacsgttttgccaactcaayctccccwgagmgacttgtggacgacaccgagatwgcaccgcmactgagtatgcsgaacgatgsactcaagacgawgargacgaagatgargtartctmggccaagtgmcaccttgccctatcyccgcgcgcsaggggcagahggamgtggcccgcamaarccgawagcctggamatgccatcgccctcctwcctwtctatcmtggttdcgcacggccaatcccmccmtccttgccctggctcagtttctttgtccttrtaatgcctccagatccactacmccygccwcggcacattcgagtw

SEQ ID NO: 67054 - DNA, 413 bp, Triticum aestivum
  unsure (1)..(413): unsure at all n locations
  Clone ID: PAT_TA_67054
gtcttcccttcaccmttgtcttacgtctmcgaggtrgtwtacygatctttvtbatgtyhmtcwccggcabrymcctcyctctgrtggttgagtgctcagtcaccattgacaacrtmaaggcmytgatcmyartaytggtgggcctcccgmcgatcatgaygmscctcctcttwactggtyygcyratggtagtcggaaggycccttgctgacttayacatacagtyagygtccycccttccccttagtaactacgtctccsmggtggtatgcygatatttgtggtgyccctcaccggcynggccttctctctagcagratgrgaactcwgacgmcctagacmaagacmcggccsagctcctagcmccggtgggcyttcccccgraccaaccaagtctcctctttamcggcctg

SEQ ID NO: 67055 - DNA, 343 bp, Triticum aestivum
  Clone ID: PAT_TA_67055
acaaggagwttttgcacaaatcttggtctaatcactgtaaacaagaaaacagctccagctcccccaaccctcatgctaggcagctacgattagwcyattarwctcacgatcwaacacgatttgaaaggccatcttcttgcatgttcgatgttcccttccccggccctgcacccgcaagcaccaagacgtccacaccacgccatggccggcccatggacgacgcgtcaggcgttggttcttctcggaggcatggatgcttcgctcgctctgctgaacaccgacttcatcgggtatggatcgttgttcgcttcggcggcgcgtgargctgttacgttgctgtkgt

SEQ ID NO: 67056 - DNA, 640 bp, Triticum aestivum
  Clone ID: PAT_TA_67056
ccaattcttattcacccacccgcagagccattgtttagcscacttagtkattsacacacttttaywgaatgcgcgcgcgcccacmttctcactctcgcccgcagtcaacccaatmgaaaaccccaatgsrgccagaccgttgatccgcttgcgtkrktgcgcccatgtatggaygcccaattktgbttyttttgattmcacgcgcssgratttaaacgcscttcaagatawcccccgatagcccagtagttagcccaccgagttaraygtgccatcavagtcgcgagaattattgaccaaccatacccgyccaaattgaaacagggrrtcgtcctccaacaawaacatcccmaccaccgccaccrtattgrccaaaccaacaattktatcatacgtsgkccsgctgaaraaacaamaagagwacgccaatagcaccaatgaayttacgcgcgcgcaacacscccagccscataagragaswagscatgccaraacccstccctggtamccascaarcaccccccccgacccgaaatcsgcggtgcccaaacacsggragcaattgagcgctctcrcgccgtaaawwtmcccaaaacaaarccacaaaaawcccccacchacaaacaaacmacaaacaacc

SEQ ID NO: 67057 - DNA, 175 bp, Triticum aestivum
  Clone ID: PAT_TA_67057
ggttccccaagaccaaggaggaaggctggtggctggtggtcggcgacaytccaccaagcagctgctggcgatcaagagggtcactctccagaaaagggcccgtgtgaagcttgagtttttgccgccgtggagccagggagcaaggactacatgakctacctgatgtcggactcct

SEQ ID NO: 67058 - DNA, 818 bp, Triticum aestivum
  unsure (1)..(818): unsure at all n locations
  Clone ID: PAT_TA_67058
tgagcgtgagagagagcgtgtgtgtgcgagagtgtgagrgaganagaaagcgantgagtgcgtgagtgagcgcgggggcgagcggggggtgttgagtgagcgagrgcgcgtgcntgcgagagcnggagagsgagggagcgtgagagggcgagagtgtgtgtgagcgtgcgagtgcgagtgagagcgtgtgagagagtgagtgcgggksggggggsgggggtgsgggggsgagtnagtgcgcgggggcgggagtgcgcgcgtgcccgagtgcgagtgcgagcccgagggcgagggcgtgggcgmggggsgggggsgagggsgggggsgggggsgggagccagtgtgagcsagtganccagcsagggggggggtgagagcscgagtgcgtgagggagtgtgtgtgcgagcgtgtgcgantkagagtgcgcgggggggggagagagrgagcgagtkagggggggggcgcgagtgtgcgagmgcgcgagmgcnccggtgtgagagcgagagcgcgagtgmgcgagggtgagagggcgmgggcgcgtgccmgagkgcgagtgagtgagrgagtnagcgcgagtgcccgccaaagcgtgccagcgagtgagcgcstgcgrgggcgcgggcgagagcgcgagcgagcgtgagagtkcgagagagtgtgcccgcgagsgggggccgggccaagttagggsgggsggggggggagggcgagtkagcgagagcgggtgcgagggggcgcscgagartgtgcgcgcccgcgtsaatgaaagtgagarggtgcgggtgartgttaacgagagtgtgcgagcgtgggggcg

SEQ ID NO: 67059 - DNA, 674 bp, Triticum aestivum
  unsure (1)..(674): unsure at all n locations
  Clone ID: PAT_TA_67059
accgaggaggctgtcgagcagctgaaatcacaccgccaggggctcacgttccgatgagggggcgcacggtggttgaaatccttcggccytaacaagctcgaagagaagamkgackagcaaagyyctyaagstycctgggactyactgctggaacccactctccctgggtcactggagastggccgccatcactggccatcgcgcctggccaacgggtgggtgggaagcccccggatttggcaggatttycgttggaatcatttgttycycytgggyakyaaccycaccatyyycytyakttgaagagaacaaccgcctggcaaccgcagcctgcctgccgcyyagtggccaaccyttgccgcccaagacaaagggtgccttagggastgggcgagtggggcgagcaggaggcatyaatccttgggtycctgggtgacacttgtcagcattcaagccycgggtgacaatcgtcccctgcctgavtgcctcgtccyccctcgagggggtgavtcctyttgaawganttgactcaggyctggaccttacagggagagtyctccyccccgggtgaccaaagaacccctgggggantgagggycttttcctggattcaacactgcaagcaggggtgagaattgaggcctgtggtcacttgccacctggagtacctcggc

SEQ ID NO: 67060 - DNA, 290 bp, Triticum aestivum
  unsure (1)..(290): unsure at all n locations
  Clone ID: PAT_TA_67060
tctccatacccaacccatccaacacctcatattatattttagtcaaatctcaccatgcttcttatcatattatvtataactaaacctacatccccattatcaaaastctaattaaacacwwaaaaacttcttttcwtcatccacactatttttcaagcatacttcccatacatacacatatacatttttcccagtyaacaccacycaacaaraatagaataccttccctnaccccccctcaaaatcaaattcccacmgccaccatgacgcactcagcatactacatccct

SEQ ID NO: 67061 - DNA, 877 bp, Triticum aestivum
  unsure (1)..(877): unsure at all n locations
  Clone ID: PAT_TA_67061
cgcatccgmaccgccgttcggcgacgcgyctcccatgatgcgcgyctgaccttgcgacgcgcgcggccsgcgcgaagttcgacttaagtcgatttaagcggtnggtctgctcggcccgawgwgtccctctgttttactaygactacgcgcgcgggaacbganagancgacgcccgaggckygsgtkgaagackgwtytttttctkgggtgaagacgggagcgmgggcgagaagantgagagtgagcsarscgagagcgtgagacsaatyacccgagaaagaaagcsagcccacbaarcctgacgcgcccgacccccaraaagtscgcagaaacascgagagacgtgcgagcgagtgcgagtgccagaaagacgacccsagagggtgrgggggagagggsgtgtnggtgagtaaccagaccgaaaatgaatgcgtgggtgagaaaatsaccgaaaatngagagagcgagagartgcgagggggagagawtscgsgggcgagagggrgtgcgartraccaatkaacgtgcsaaaaaragagtgcgaaaaaragtgagtgcgaaagcccgggggcgtgggaaagaaaaagagaaagartgcgagagagarttggtgagggcgtkrgrrggggggagagaragggsgggggrgtgactcaaamaaagtktgagtbaccsarggggkgaggggggggcbaaagstcacttgtagcttcatgggtttctccttggaarastgggkgcactcctgggagacrggtagttagragagacaggggtcaggttcctccagcaggaasttagraarcgagcarrggggscttaggggtcccaaacccggccaactcctcactctasttcctctcctcttcctcttctt

SEQ ID NO: 67062 - DNA, 553 bp, Triticum aestivum
  unsure (1)..(553): unsure at all n locations
  Clone ID: PAT_TA_67062
gtctatcwgaccccaatctctactatctaacccgactgcyctccgtgcctcctctcccaagatrcgaagatrcccttgccccagacgcgtggggtgangcgagssagacnccanacatgtgtgcgsgggcgsgggcsgggggsgagcgcstgtrcctgtckcgcgcscgcgccasacacaggggagagatgagagtngcctccctcaccagacagastccccaccctccccccactcrccccccacacagtcccgcasacagacmcctcggcsagggggcccccggstcccacagagtgagagcsgtgagrgggsccaccccccacagagagaggggagtgagactgagggggggagtggggggkcchctgtgagtccctccctcyctwsagagagagtccgagggkgasggacggactcagcgccgggsggcagargagtcagagkgaatgasggaccctccccctccctcacgcccccgcggtagagastccmamammagagagagtgtcttgagtgagkgtcccttgagggggggagtygcgcccccgcg

SEQ ID NO: 67063 - DNA, 516 bp, Triticum aestivum
  Clone ID: PAT_TA_67063
ccccmccccatgaggccataaccctcgggctytwtcatcaaggcttcctgccttcctcatggggtggtccgctccctcttctcccccctgrggaagatcattgtccscgcacattcgcgkgcgcaaataccggrgggggatgaggawcctgttttttttttttttttttttttttttttttttttagcgtagcaattcgtctagcaaatcatgaacggagaatttcatacacttggagaaaagctgttgctcacggctaatctgccaatttctactatcccattcctaccctttcgtaagatgtcaagccgtaaggtgtccatggcgcagggcatcaccttggtaatgaaatcttgatacaaggttaaaaattccacgtgttacaaggtcatcacaggcagggcaggagcatggggtctcttcgatctcttgagtgccacactccctgaagccccaaccctgtaatcactgaaccatgtcaacggccagggctccggatggagaaggtgttcctcg

SEQ ID NO: 67064 - DNA, 916 bp, Triticum aestivum
  unsure (1)..(916): unsure at all n locations
  Clone ID: PAT_TA_67064
actcgcctctctctcgcgcttccgagctttgtccttcgtcctcctcccccgacctctccagcagcgtacgkangcgcnccgcttccgccgttccgacccgccgccatgagggagtgcatctcgatccacatcggccaggctggtatccaggtcgggaacgcgtgctgggagctctactgcctcgagcatggcattcagcctgatggacagatgcccggtgacaagactgttgggggaggtgatgatgctttcaacaccttcttcagtgagactggtgctgggaagcatgtcccccgtgctgtctttgttgatcttgagcccactgtgattgatgaggtgaggactggcacttatcgccagctcttccaccctgagcagcttatcagtggcaaggaggatgcagccaacaactttgcccgtggtcactacaccattggcaaggagattgttgacctatgcctggaccgtatcaggaagcttgcagacaactgcactggtcttcagggattcctcgtcttcaatgctgttggaggtggaactggctctggccttggttctcttctcctggagcggctctctgttgactatggaaagaagtccaagcttgggttcacagtgtacctgccsrgmavgcsgntcgagcgssggrtttacnctaacctgttagcatacacatccatccatccatatctacctctagagtttttccgttccgttctgttctatacaccaaggagaaggaaggagcttaagcaaaaaataacgagccgccattgccgcacctctgcgcttctggacgaggaggcccggtgcagggcaatgcgggatagtcaccactacttcatcatagttactacaaacagttactgtgctggtaacagraaggaagggtttgggtgtgttcgtctccccggaa

SEQ ID NO: 67065 - DNA, 683 bp, Triticum aestivum
  unsure (1)..(683): unsure at all n locations
  Clone ID: PAT_TA_67065
acaacttcttggccatttaggcatgcccgatgaacctggccgaggctagcagcagctaatggttcaacgtcaaatcgttcaaatatctcatttacagatgctcccagctcttcttcratagttgacacagctgtctctgaagggaatggagggacctgatcctgcaattcagataattgatccacatattcttttggaagaatatccaccctggtggagaattgctgtcctattttaataaatgtggggcctaatctcaaaatactctccttgagccacttggcaagaactttcctcctcattacccttttctcttccgtcatcccccctcgataagtgaacttctggttgttgagccaaaccttgaatataaatgcgaagacagagccccatatctccaaggttctttgaatcgttgaataggttttaaaccgattccaacgaccaccaggaacaacagacaccttgggcatggcctctccgtcgcttcgcttaaaccatgcgtcctccctgcctatctcctccactctctccttcctcctcctctcatcctcacccggcccacggccggantaccacagaagtgccagacccggatggcacgggcttcacgctcgcgccgttcccactcctactcgcactcctgttgctgttgctgtttccgttgccgttggacccgaggt

SEQ ID NO: 67066 - DNA, 706 bp, Triticum aestivum
  Clone ID: PAT_TA_67066
acatcgttgttccagagaaaatggtagaacggcgagactggwyacttccgtataggggcttgaggccatctttaatgtggcaaagagagtgttccatgtggagtscatgktccaacacccattaatgacgtgctcgagcaggacacaacatccaagtcggtgatgcccggcatttttgcagcccggataggcacctcgacttgctcccctcgcagcgtggcggcagctcatgagtgttctgggtaaagaccgataaagagagaagaaatatgattgaagttgttgatgcaggccatgagttgaacatacaactacgcctatttattaattacaaaaattataacttttaaatataattattaacaatataatattggctatataatgttttacttacaattttttgatttgattcattttaatactaaacaataataatttcaaattggtatgtctagctggtggtctgagaaggttcaagtcaagcaaactttctcacaaaatcaaaatatacatttgatataattaaaagatattgcacaatattctgctggaaaatagactccacattgttcttttcaccatgaaagatcccacagtattcttaaatacataacattgtttttttagatcagtgttatcgtctgttttttatcttgaatattgcagttttgatagagaaaaggaattttcagctgtatcttgt

SEQ ID NO: 67067 - DNA, 970 bp, Triticum aestivum
  Clone ID: PAT_TA_67067
acataaacaaacaaagatgccagavaggctgtgctggaactcgcacttgcctatttgttgcgcttcactccttcagaccttcagcacctgaagccaaacccaaaggtccttcagaaaatctcaatctgcacgccggggtagtctttgggcgaaaagaagtccaaggcacattccctgcctcttcttatatcaagctcaaactccgccaagtgtccaaagacacgatcatgtgccgtcaccctcggttctacggacatccgcctcagagccactgcgttgtcaaggatgcacaataccacctcaagctgacttcttagaccgataaaccctgaaacctcgaactgctcaagatgactatgggcgcatggccgaaaatgccagtaggcttcaggctcattggaaaaccctaccgagacatgtggaagcatctgaaaatgtaagggttgccagaagttagataacaacacaagcagcattggagactgcaacttagagttatcctccatttgaatcaaatttaaaaatccgaattacagttccatgtagtcgaatctagtataagcttacagtgcagtgtaaactacggcggatcaaatgcaacaagcactaagcaaacatcgtttgtctcaaaagataaacaggagacttgcatcagagcaagaggggcgcttgcatttaactcgagcctttgcagaagaggggccacctctagaagactcactaaacgaagaatcccatttctgattctcgagtccccgagaatacttacagtcacctccagttttatcagatgagtgaacttcatcaggcaatttgaaaatccaaccacctcggtgtttatgcaagtgttcacagatagtgtctccacgtgagamagggtttttggaagttcagtgaagacatgttcaagagtgtcatcatatcccaagagcgtcacagtagcctctgttggcttcatggattcacgagt

SEQ ID NO: 67068 - DNA, 461 bp, Triticum aestivum
  Clone ID: PAT_TA_67068
acaaggaagacaacgtaatggtttatgttttccgacatctcagttaaactatattgtcattgaccttccaaacatgttgagcttgcttttccccctcatgctagccaaatttctcgcaccaagtagagatactacttgtgcttccaaatatccttaaacccagttttgccacgagagttcaccatacctggttgctctggcaagaaggaggggtcgtcaactccgtagtcgaactgggcagcagcaacgtcggtctcgtagtcatggggagggccggtggcgagctcgacgaggcccgggtggctctggggaggttcggagataggggaatcaacagcagggcagcggtcggtgacgaggatgaagaaggcatcgtcgtggttgatgcagagagcttcaactccaacaggtggctccagtagacgaggtagtcggcggttgttcttctggagaaagcaggt

SEQ ID NO: 67069 - DNA, 337 bp, Triticum aestivum
  Clone ID: PAT_TA_67069
ccgaacccgacgccgctgtcgaaccctatcctatccacttcttccccttccctctcctccccgatctggagaggcacccgatgtggtcgtcgccgtcgctgcgccgatcccgcggccaccggactcccctcgtcgatgcaacaagttcaggagctccgtagtgttcgtctacgccatctacaaccatccgttcgagttcggcgcctctacatcatgcggatcgagcttcttcttccccggtcgccgccgactttcatctccaaattcgtccaaccctgcgctcctgagctcccaccgggcctacttgtgcctccacgaccctgagaccgatgccggt

SEQ ID NO: 67070 - DNA, 523 bp, Triticum aestivum
  unsure (1)..(523): unsure at all n locations
  Clone ID: PAT_TA_67070
acaaccgggtagcagcggaagtgatccgttcaaaaacaagaacttggmagaagctctacggatgcaaatggaggttcagaaacrgctccatgaacagctagaggtgcaaaggcagctgcastahgwatagaagaacacgcgaaatatttgcagaggatactggaggagcagcagaaggccggcagtggcrgctvgytctaactgaaaaccccgasggagccgtccgagtcgacgttgaaagacagaactgaacctgaagrgggcaccacctcttcacttcagacgtccaagaacagcgaggcagggtccccttgttcatwacagccgtccggtsttcgccattgccggcsacttgcggargctcaccacttcctcggtggmagrgctgtggtggccatgatgatatacacacgagcatggtagtttgaacgaactcgaggttttagccagtggttagagggtgtatgtatatgtatatnactttcacttgggratagaaatggggggaaccaataagccgacc

SEQ ID NO: 67071 - DNA, 328 bp, Triticum aestivum
  Clone ID: PAT_TA_67071
gccggccagccaggcgccaaggtcaccrgtcggctsgatygttagtcccccaacggcattgtchaaccrcctggcttgtyggccacccatcyaamgacchaaaccscacctbactcccacgtststbgttkgacatyggtkscccaacattgscttccaamgtygtyggtatcaaacctaccgarcccdacccaaggtggttkgtccccaaggtgggtggaccctttgccwgaarggtcccaagacgggcttgtygtwccattgactcctcccaacytcccacccaagtcgtckgtccgagggccttcctccctggcatttggaccca

SEQ ID NO: 67072 - DNA, 551 bp, Triticum aestivum
  Clone ID: PAT_TA_67072
accatracgccccgtracattccccgcgagaaatggcgggaccgcgycctgcrgctgctaggaaagargctmccttcatggatatcgdtgaggcgatgacagaattctatgatggaactgacgacgtggcttaktcgcgtcgtccatgccccmccsccatgacaaaaagtcgacacgyccacgggaactgctggtrgcaaggaagagtagaacatgggrggacgctgagtcccatgatggtmactacacttccccycccgttgaaactaagcttggsgggctgttcatcatcggccaattagccgcggctattccttmccycccactgaagctttgcttcccggggcthacaaccatccggtgrgcttgctgacggacatagggaaracatgtgttgggaaacgggcgtcgacgatcatttagactaggttagaatagggcttttagttgaaatatgtcgrgaatgtaatgaatgtggtccggtttagatgaaaatmayccggcktgatgtaaaatcatccaaatttcaatgaatatggttctatttgttt

SEQ ID NO: 67073 - DNA, 306 bp, Triticum aestivum
  Clone ID: PAT_TA_67073
acgggctgtggcgagccatcaactcttcatgcagaagacggtgactacgttgttggtggtggtggtttgagagaaactgaattgaaaaggttcctagacctatactctgtgagatgggccgtgagtdtggatttcggcgtggccgctgctcattctgccaccttgctacatgtcctcactgcggactgcacccagtccgcctccactgtgtcctgcgctgcttcggcatcccattactcgtaggacaatggccccgcggcgccgacgtcatcgaccacagcaatkccgacgctgcctgggacgtgt

SEQ ID NO: 67074 - DNA, 298 bp, Triticum aestivum
  Clone ID: PAT_TA_67074
acatgggcaccggggctacggctaacatgtttgctcatcctggtaatcttgcctccktcactcccgtcaccatcgaccgccgcatcattgtcggggacggttccacactccctatcacacatgccgggcacacttcttttccttccaattccatacctattactttgtctaacatacttgtgtcacctcatcttattaagaaccttgtttccgttcgttgtttaactcgtgaaaatcctgttastgttgaatttgacgagctttgtttttgtgtcaaggatgctcgaaccaggatggt

SEQ ID NO: 67075 - DNA, 485 bp, Triticum aestivum
  unsure (1)..(485): unsure at all n locations
  Clone ID: PAT_TA_67075
aagtgcataagcgttttgggtaatttttgtttgsggaattttgagggaamggaaactggkgtaaaatgtktatgckaagatttaakttgttctttaaakttttkbatgatgtatydkatgawggggttgntggggttgawgggggtgtggaagtagttggggtagckaamtaggtawtttgggtgggahcaagctaattgaattttcgcgggsgstatggggggggcaggatggkatgttggggtcaatttgskwtatagtgagttgtattawaatttactgggtgttgttttaaaaagtkgtgamtkggaaaaatrtggggttaakdaaattaattggtttgtaggawattttttttttggyagctggggtaaatagngaagaggggcgcactgattgggttttgcaaaagttgsgsaggtggaatggggaatggaaggggcctgtagggggggattaaggggggggggtgttgtggttaaggg

SEQ ID NO: 67076 - DNA, 438 bp, Triticum aestivum
  unsure (1)..(438): unsure at all n locations
  Clone ID: PAT_TA_67076
ggccggcgaattcacctagtcgatttctgagccggcctgcctggggcagggtactctcctttgayscaacacgttggccggctgtygactaactattgktgytaccaccttcckgcctckggatttaaccccagataaattttgcyggagtagggcatctggtgacagctaatcgacscagcatttcattngattngtmgcatctttggacaccccatankccangaatcaacanshgcnscttngatangaaccagrttcaccccatgggggataacggaatnggggtagrmsattngtggtcttcctccggggragcggggcatrrattggtctattggtggtansmgatccatngacaaaggtccacngttttagtctngtaaamrcacatctggcggctcggsgacaaggggcggggtcaaccgggcatggacc

SEQ ID NO: 67077 - DNA, 357 bp, Triticum aestivum
  unsure (1)..(357): unsure at all n locations
  Clone ID: PAT_TA_67077
cccacacaaaagggggtttcaaaaacccccgccctcagagtcwmacaaaagagagagtctctmactctttctncachgcgccgcvcagaacsgasaaagcdctgcccncagctcccctgmgcacagrgtgcgctctgagrgtgcgccytcgcgvgcacacmctctctcagwgtgcgtctgccccaamgggcactchgtgctctctcagagtragagtgagcamtaaaaaaaaaacaacactgagagcacactctgagcacactrcgccrctcagagtaagtaagaaagaaacagaaaacaacaacaaaacaaaacaaaaccaccccaagtaacaccttagcrccccaagagagcaag

SEQ ID NO: 67078 - DNA, 429 bp, Triticum aestivum
  unsure (1)..(429): unsure at all n locations
  Clone ID: PAT_TA_67078
cgagctacccgcggcggcaccggccgtcggchtwtggggtwttttgaggkgtgtctgtcaccatacatccatygccggbccatctgcgtncattatatataattatgtktgtkdaaagtaagaaaatcagacaaatatctatctaaagtaagaaaatcagacaagtatctatctaaagtaagaaaatcagaaagaagataagaacaagaggstcaccacggtggtgccggcgacgagatckgctcgggagatcaacggcggtwaaaacggggacggggcgtkacggagcgctaaatctagaaaaatctcggggaaaatggagctccgaggkcgagcttcgagaggagaaagcttaactagtgttgctcgggcatttcatcaaacacctcatgtkcataggaggggagctagagcacccaaatkcccbcc

SEQ ID NO: 67079 - DNA, 703 bp, Triticum aestivum
  Clone ID: PAT_TA_67079
acggagagawgacggccgtcaaabaaatcctctgtcgccghhyygcatggttttgggcgcatccacttacgccattccggcgagctgcggggtgatgaggttkttttttkcggcgggttgtcggttggcaatgtccgtwgtgttacaccatccggtcaagagggaaaattgtagattaagagcttagttatagcaagggtgggagttcgtgctaatgtkggcatcggttactcgtatgcaacgtcgctaggagaagatkwtgctttcgccaggtgcatcagcatcagctgttgaagccgaagaaggcgtggctgccactgaagctgacgaaactkaagaaggcgtggttgttgctgaacctgacgaaactkaagaacagaaagggtgttctacttcaaacggcgacaaccatacgtkaaccagggcaagctgttgggccccggaggtcagacagaccccttgcgtcgtcgcacaagtatgctgggaaagattggttcacgtcataaggtgggatttacgttcctaaatataggacgttttgatagttcaaacatgagattatgcaagcbagtataadkagtcyctgctatagacagagctccccgttgagtktttttgggcattggggtggatcgtgaaactgtagaaccctcgaaacaaataggctcatgtcccgctttatgtattaagcaaaaatcgcagt

SEQ ID NO: 67080 - DNA, 381 bp, Triticum aestivum
  Clone ID: PAT_TA_67080
acatgctacyytywccttctctkgtggcatttgtdccttghhwttycgccgctaacaccatccgtcttcaagaaacgcccaaaatgtagcttgagakatctctkaatyttattttggatccgcatgaggctatcgataggcttctgtagccagcygtccgtccggaggttcaccccckgttcttgattactgcttyccattagaaaaaaaaacagakctggcacctaatgckctggaacaagawctagcctygggaaaaatkgwwywagatctagccttgggaaaaatgggagaaatggggattcggctkaggkggcgacttgcgcyggaattggcggactggaggacgagcactctctcyggtaatcttcgacyttccct

SEQ ID NO: 67081 - DNA, 315 bp, Triticum aestivum
  Clone ID: PAT_TA_67081
accattgcaaggtctggcacaaagaatttcatggaggccctwwttdctggtgccaatbtgtccatgattttgatggatgccgcaaatagtcgtgcagcccggtgacacttacatatcgagtaggccaggcgacggcgctcctagaaccatgacgcaacacctctggatcattgttgcggccgacgggcttkggcttgtcaagggcgttgtccagaaccatggcttcgagctgtccgcgatcaagttctcgtkgtgctcgttcatttggaggccatgttccaccgacgccggccctcctgctttctgttacacagt

SEQ ID NO: 67082 - DNA, 238 bp, Triticum aestivum
  Clone ID: PAT_TA_67082
gcaggyggccttygascccccaccccaygccaggsgggccacgcccggcgccgccgcscmcycaycayccccgaggcgcycaacaagtccggcgcaaacygcggtcccgaggccgtcysgytcaagactggcgcccttctccttgacggcaacaccctcaactacttcggcaacagcatccccatcaacctgatcctcgccgtcgtcgccgaggtcgtcctcgtcggaggcgccgagt

SEQ ID NO: 67083 - DNA, 291 bp, Triticum aestivum
  Clone ID: PAT_TA_67083
actggtcaacgacggcaagcggggaggggccggcgaagaagtagaagtcgagcacgccaccsatcaccttgtaggtgatgtaggacccgccatacagtatgtccatkcyatttctgttgaggaggagcacgccatgcgcattgccgccagggcgcacatccatgtagaatgggtgcgagccgtagaggttacggtccagtaggtctgacctctccaggtcctcgttccacagcgtgaacgtgtcattgggctggagccggaacgtccgtttcgtgtgctcgccgaacccgt

SEQ ID NO: 67084 - DNA, 240 bp, Triticum aestivum
  Clone ID: PAT_TA_67084
accttgtgcatctttcaattgctgcatcttttgtagcagccgcagtcbcctagtgcaggagccagacggagaatcgatgactcccgtcgccctccagcgcccaaacaggaaaggatgtaggtgccctcgtcaccccgcttgaccccgtgggatttcttccagtaagarctgcgtcasctccagaaagagcggcatcggcctcggcaatgagcgcatacacgcgcggcgtccagagcgtgt

SEQ ID NO: 67085 - DNA, 209 bp, Triticum aestivum
  unsure (1)..(209): unsure at all n locations
  Clone ID: PAT_TA_67085
acaccctcgccgtgatgcacgccctgcccccgccgccgaagctctccaccaccgagtagtcaacctgtccgtcgaaatcacaagtgttatactcrgaaacrgrgcaarrggttcaggctgcggcgagccggcggcganggagctcaccagcgttctgagggagatgatcccgccgtgcgcctcgatgtccatgtccacgaaggccccgt

SEQ ID NO: 67086 - DNA, 246 bp, Triticum aestivum
  Clone ID: PAT_TA_67086
acgtcgtgaggwtcgcagccgccgcgtttagggctgcgccgataaggaagctgatgcygccgcagataatactggcgcsacggccatagttccttgtcacyggtgcggctgcmacctagagacttggccggaaaggtataggatggaggtsaaggcggagagggcctsgttgtcgtacttyyagtaattgttcagggtcaccaagttctttcgccggaacaccgccgggaagaacctctcaaggaa

SEQ ID NO: 67087 - DNA, 202 bp, Triticum aestivum
  Clone ID: PAT_TA_67087
accabtaagaaccgcgttctttcgtcaaaggcctctggggaacctgccgtggttcttgcagcatccgtccattgtgcagtgagagaagccatccgagcggcgaggaaggagtttggaagctcacagctaacgttccaactcgacgtcccttcaccgatgacccacgtkaaggaaatgtgtggtttggacatcgtcgacaagt

SEQ ID NO: 67088 - DNA, 724 bp, Triticum aestivum
  Clone ID: PAT_TA_67088
acacgttgttaagcaatggagtsataccaaatgtttcatcttgaaggcagaaacgaagcagcscctgcsgggggcatcgctgatttttcttatctatgaatagaacagggaacccttgcagtgtatggcagtttgcggacacacaatagggtatggtggatccagcaacgtttccctccagtbgccctcttcaccattaatagtgaagacytccatccycattgcaacagaactgtaatcaccggaacgtagaaagaccgtgcaaccttgtatgttccagtggaaacatcaaggcccaaaccaattggaaggcagcbgggatgctgcaacatattgcggtggcacctgggcagcgcaacaacatctctagttgctgggttgaagacataagtyttggtgtttgtkgggagcaacaccaatccatcacagtgtgccaattgggacaccagcccaaactcaccagtkgggaactgyctcccataaaggagttttgcactactactgctcctgctcatgtcatcttgttgtaaagaccacaggtagaaacggatgttggtggagaaaagaccggaaggatttggttccagataaatctggggggtgacgaggaaggagacgggttgcgatgttgtttctctttkgagcactggagggcgcacgaacaaaacagggtcggraagatagctacytcggcgcaacacgctaatcgattccgcggcgcatt

SEQ ID NO: 67089 - DNA, 589 bp, Triticum aestivum
  Clone ID: PAT_TA_67089
agaaaaccgatgatgtccacctccctgggttcctcaaagcagcaatggttcaaggtgtcggttcttactccaaagatcctgtyagcacwcattcaacgacaacyggatcgtcggtgtattttcttgatgtggattggagtggttccttgaagtctttgtttgttgagaccccaactaagaattacbcatggactggacatgttgttaaacctttcaaaccatttgatttagacgctatgcacaggtgtkctgctgggctcattatcaatgcttttcctgttgakgttgaggagtttttggaaggttatcaagtagagccaggcatgaktcgtccatttaagcgctgcscggaatctgaagggacaccatctcgccattcgccgccctaccgctcgtcgcgcacagaagcaccgtgcaaagatactggagggtggcttatacgactcacgcyccatttcccatgggagttatggggcttatggctttbagccataggttactgtctgtccggtgctgagttcttaaaacgaaacccgtcttaactagacacaagaacacctacacacagtcggttgataaraacgtacct

SEQ ID NO: 67090 - DNA, 366 bp, Triticum aestivum
  Clone ID: PAT_TA_67090
acagcgacascabcatggcgggcgacatcgatgatcgcaagavcacgtccgggggagtctttttcctcggtgatagccctgtcagctggctgtcgcagaaacagaaagtggtggccctttcatcatgtgaagctgagttcattgcagcaataacggccgcatgtcagggcgtgtgggtggcgcgtctgcttgcagaaatcacaggtgaagaacttcaggtgccactgcttctggtggacaacaaatctgccatagctctctgcaagaatccggttctccacgacagaagtaagcacatagatgtgcggtatcatttcatcagggaatgtgtggaggatggaaggatgacagttgattacatccgaa

SEQ ID NO: 67091 - DNA, 460 bp, Triticum aestivum
  unsure (1)..(460): unsure at all n locations
  Clone ID: PAT_TA_67091
acatacaggtcggtgaagaagtttgaagaggtctacttccagagcatcagccagcctaaccacgcgcgtccaccgaagacggcgctggactagagctcgtgaagaaaacgctcgarctgatcgacgctccagtnagggaacctggctgactgaatgcctccaacaacgtgactnahgcgccatgcatgthgcatgagahaaggctgaccagatcagctccacaagaacatctaacctataacgatagtccaacatgaatccctttttatctaacttcattgacggcttcatcgtcgcccgtrtcggctttgatccgagccctctgagaggttagcagatgatgcaccctttgctttagctcttgcgttccgatttggctctgcaccgacacccggatggcgtcttccggtccaaactctctgtatctcctcaattcatcgtcgacgccatcatcagcggc

SEQ ID NO: 67092 - DNA, 159 bp, Triticum aestivum
  Clone ID: PAT_TA_67092
gatttcmgacgccggcrgccmggyscaaggtsaccgacmgggdgscgggccgacyatggaaccccaarccrccggcgacaacmaaggatgggtggccyacaggcrattccvgagggatcstggacaccascgatcbaccbaacckatctatccggagga

SEQ ID NO: 67093 - DNA, 359 bp, Triticum aestivum
  Clone ID: PAT_TA_67093
accagcacygcatccaggcgtctggcacatgcattgacggcaaggaggacgggctcctttcctcgtgcyccthggacccacgcatccygagcttcttwyyctacwactytkgyttcagtdttgcgctctccaaagctccggcattggttgccgacatgcggcgactccgtkacctcagcccgcgtgccttatgttgkttggacgccaagatgggtctkctcgtyygctatgtyagggcctcatctgcytacytyggcaaggtggaggactcggtcgacttcgacatcacctactacyggagctacaccgaagcacgcygcsagcycattctgatgtaatcsacgagctccaacaactag

SEQ ID NO: 67094 - DNA, 331 bp, Triticum aestivum
  Clone ID: PAT_TA_67094
accctgtgccctagtcyccaccwcctctttatagcactgcgcgacargggcccaccaaccttgcttgggctggacgcccccsatcagggcgtgggtcaagggcccaatgagccgttgggcccattggaggagagatcaatctaacattgactgcatacacggatcatatttttaacacgagatttgatcattttgaccgtkaagaaattgatcctcttctttttgagatttggaaacgtctcactaagcgaaagattacattcagacaggctctggaacaaatccagcaagagaacatgttccctcgacaggagaagtgtatacaatttgt

SEQ ID NO: 67095 - DNA, 435 bp, Triticum aestivum
  unsure (1)..(435): unsure at all n locations
  Clone ID: PAT_TA_67095
acgaacgtkctttgagaaggtcctgaatkttggacagcatcarbkggytkakagggrgcctgagaggaatcagcaggcacgctgstgctctccttcgggggsctatggckktcctcaaacttkattttctcaaaaaaaaactgcttctcttcctccgcttcctccaggcgsckcttgrgggagaggctagsgtagtcctgstcagccctctcaaagggggcaagcgsgattctckkgaacctctcagcctccttncgrgcctsaskkkybttkatctggaacatctcagsctcngsstgtttcaaccsaacaattctctcgaactcsgscaccttctggttcttcckcagsstctcggccttgaastcctgaacttgtctggccttctcatcaaactcacggtcacaggcckccasadcgyttctagccasctcc

SEQ ID NO: 67096 - DNA, 322 bp, Triticum aestivum
  Clone ID: PAT_TA_67096
scaggttcakcccaccgwactttacgccacttgcccatgcsccaactyccttccaccaatttgaagaaatacgaatggagcttggaaaggcyctttcattccgttggaaagaawkwacaaagggyytttyatttggtttwwcawgcstkcccggcgcaacgaccgcccgchgcstttyccgctaccggtcacwakycktcgaaggcaacgcaktgaagcgttaaaacmagcggccgartwtgtcagcarcaaaaaaaaarawaaaattttatttaagttgtccgttkktgtactyttttttgytcwcaggggtaaagaaaaa

SEQ ID NO: 67097 - DNA, 506 bp, Triticum aestivum
  Clone ID: PAT_TA_67097
acatgracatggacatacacatattcttaggaacaaataagaaagataaatggagaaggaaaacccaaagcaatgtcagagttgaswmaactgcaatggcactttatatatggcctgtcgtgagtkagckgtttaggccttgccggactcctcgcagcccggtggcttgaaggcgakgaagctgacgcactgcacctgacgcatgttgtcgaatccgatgatgcggacatacgcgtcagggtacgccttcttgacctcctccacctcgttgatcacctgtgtggcgtcagtkcggggkaacataggcagcytccacattgtccaatacyggccatcgtagtatccaggagatgcgttgtgctcacggaagatgaacccaaccttgctgaactcgaggcaaggcacccacttggagcggatcaggtagtcgacctgcttgaggagggcctccgtgctgagsggkggcaggtaagacagggtctcgaacttcttgatgcyctcgatgg

SEQ ID NO: 67098 - DNA, 301 bp, Triticum aestivum
  unsure (1)..(301): unsure at all n locations
  Clone ID: PAT_TA_67098
ccggcaccgaacccggggvccgtgtkaccgccgacgtcgtygtccccgtcgscttttcrcmcycgaacgttccgcmyttcttcaaaaaatccacacvttagggtkggkwtkcggcccaacacctccccgcgtycagartccggaagcacccytccgccgcccycsccgycggccgaatkcrccgckgckcmcgccttggcgagaagcctymtcctwggaacaaaamkgactaacagagaaswgcscgaatwtckggcacctkgagaggcaggcaacctgamkbtgamgcagacccaagntg

SEQ ID NO: 67099 - DNA, 308 bp, Triticum aestivum
  unsure (1)..(308): unsure at all n locations
  Clone ID: PAT_TA_67099
acttacggmggcacccctcacataggccattgatttgcatccgatgacgaagagcttgctgtccttgtccgagaaccagtagggcaactgtgtcatgnytcacccacgcacgactgtatgaagtgttgccgttggccgggttgtagcacccggtgctgatcagaaacctgacccggactctgctctcctctacggaaatccccatcaccgggagggttcggccgacggtcctgttgccatctgcggtcaagttgcagccgagtgcgaascgctatggatggcgcaaggctccctgatgccgaactggt

SEQ ID NO: 67100 - DNA, 596 bp, Triticum aestivum
  unsure (1)..(596): unsure at all n locations
  Clone ID: PAT_TA_67100
acatggmccacgmcctcaccggactcsccgacagsccggratgcgcttcaccgtgccgcagakcaagtsctacatgaagcagcwgcwcacaggcctgsastasygccgasgtcaatcaggygctgcatcgagcatatcaaagcgttctaaccttttgakagcacaatkagggataacctcaagctrgctgattttgggcttgcsaggtcgtctctcataggtgcatcacaatggcaasctgarctaatccgtgtcaatcacstwtatgggkatagacctcccagaractgctatctcggaaagcacaaaggtataggatccaagmtgtatgayatagtrtgtcytgtkaggttcgtattttctcgctcgagctttcwcaagtgggaaaagccaaatccgtgcccaggtgaagkaatcgascccggcagctagccagatccaaaaatwtttcgcagcatyggtgcgcaccccctcgacgagtycmatctaggcctgggwtgtsacwaaagaagccatgtgtaccwcggmccgcnacsacggkcawtcgaattcycgyggccgccatrgcgcgrmmacgcatrcsmcrtysgghcccm

SEQ ID NO: 67101 - DNA, 362 bp, Triticum aestivum
  Clone ID: PAT_TA_67101
acttcaacccyaacatatcgaacctgaacctttctaagaaaactaagaaattgtatttgtcgtcgatgtggtggtgggaacacaaaacagcaggggcacaccaagcagacgtgcacaacagcagcaaccagcaacatccacacacgcacattagcaagcgagcattgagatctgtctttggccgcaagtggaggcggaggctggtagcggctctccaggaataagaccttcttccgccacaatgccatcaccgcacggcggcgggtgagaaccctagctcggcggcggcggaggcgatggaggggatcgaggggagcggccaccatgtagaaagacagcggtgttcctcctcgatttaaagt

SEQ ID NO: 67102 - DNA, 177 bp, Triticum aestivum
  Clone ID: PAT_TA_67102
gcagattgttctggtagctcacttcggcgcctattgcagtttctggcgtgcatgggtgcagtgcggcaggagcatgtgtgcagtccgccggcgtggccggagcaaaaaaatgatgtaactgcttgtaattttattttgggtttgaggagtgctttgtgatattttcccaggccatgt

SEQ ID NO: 67103 - DNA, 239 bp, Triticum aestivum
  Clone ID: PAT_TA_67103
acggatggygtkccacctgcacatctagtgatcctgcrgcactcgccttctctgartwgttgtcaaaatgaacatggagcgactccaaggcaggcgcggcrsmackrggsagagaatccagattgtatcccagttcattggcacgtttgcaatgaatagtttattgagatgattgagccggacaggaatggsggttggktcgatccacatctgacgccctcttaactgcagaacaaggt

SEQ ID NO: 67104 - DNA, 302 bp, Triticum aestivum
  Clone ID: PAT_TA_67104
acaaatcgtagtmggaggctgcccacggcctgccatatgagcytcttcttgatggtggagttccagaagttcttcacctcattgtccgthctgtmrgcaggkcttkgctatctgggcccacctgtwccctagcaccctgtggaggtcgacgatgggggcttcctcctcctgcgagaagctccccctcttgaggtccggcctcaggtagttgatccacctcagcctgcagctcttgccacacytctkcagcccagcttgtcttgggactkarctccagcagccatggccatgcgcggtgatgt

SEQ ID NO: 67105 - DNA, 300 bp, Triticum aestivum
  unsure (1)..(300): unsure at all n locations
  Clone ID: PAT_TA_67105
gcgcacgggcacgccgkcgaccccgaagaagaagggccngggggcccaggrgaacmmgyaggagcggaagrccggcggarggggcgaaccagaggsagaaccggggcscccvcaagccggcgccgcvggcccacacggmggggbrcaacacggagggggcgccgccggaggvgcccaagaactcgaaggcgaacvcgtcgggggkcgcgcccccgccggaggrcaggvagaaggaggagacagtaccggcggagtwgccggcgacgagcctcawccygaccccgaacccgccgaagaggg

SEQ ID NO: 67106 - DNA, 515 bp, Triticum aestivum
  Clone ID: PAT_TA_67106
gacgccggcacgagggraaggcccccggatcccmcaccataggccgggacaacaacgcaagagcagcccacaaccstcccggccttgcccccagagtcarsckggcaaagcccggcccacgcgccaagagtgtgagcacctggcacaggagccaggggaacathgggcgcagcgcatagggccykaacgagcgtcacggaatcaggcggggcacaatcctcagccagcacacaaagcsgagcagcatgcgccccaatggaccsggcagccscacggagcccccccacaaggccatcatgagcacttgactkccdcatgacaagccggagagcgagtcatcaagkccatcggcgcaccaagaaccgggggaggggccgccaccggggcaacaacsggggkcggggccdccrccgccatcscgggcgcgccaaaggccaccgaggcagccgcsaaggagggagaaccggagcccmgggaccccggagaatggagawccgcggcggtagggkatacgc

SEQ ID NO: 67107 - DNA, 430 bp, Triticum aestivum
  Clone ID: PAT_TA_67107
accgccttctccagacaccttggccgacaaggacscaagcaatgacaccaccaaaacttccaccagcaaggatgcgcccacatttcttgagtkcataagccccgdgggggaaatcttcaagtkcgccaccsacatcgaatcaggccaattgcaacabcaagacgacawcgttaaccttggatgcycttgcaagaacgagctggccctcgcgcactacgcgtgcgcgcgycaagtkgttcatcagccacgggtccaccgtgtgckaragttgcggaaacgtcgccacaaacgttaggcccgaggatttcaacatggtgcbtkcgtccyttaaggactacsaagctcttagggaaaggacgtccaccggggatctgtccyacttgcacyaccgggcggatgcgttcgtcgatccggtcgccctcgcggcagt

SEQ ID NO: 67108 - DNA, 224 bp, Triticum aestivum
  unsure (1)..(224): unsure at all n locations
  Clone ID: PAT_TA_67108
gcraacmgccgtctggcggagcctcvtcgcctatkattgagtccgaccckggccagcgcrcggctctcgccncgcacactctrcrcacrtwcangntatgyaytctctacaygaaygcacgcgcrcacgcgcrcacgcgcygcacacgcgatayacatagcgacgcgccgcatacgcacaccccatacayrcacacacacacgcccrcacacgcacacgtgttc

SEQ ID NO: 67109 - DNA, 455 bp, Triticum aestivum
  Clone ID: PAT_TA_67109
acccayctccccaggtcyccmcctctgtagtagadmcaracaacagtcttctrtccacccactcactccytrgagcacactgatgtctacatatccttcttgacaatkaggcvatctatsacadctgccgcsgctcccttgacattgavgcgctccaasatacaccaacctcaacaggcttsthtcgtgcargtcatttcatcactgacgagcwtccctsaggyttgatggtgcacttcaatggtcgakgtcaatgaatwcgcgagascaactytggtgcccayacccgcaggatccacttyatgcgtacctcctatgccccagtcatcmcagctgagaaggcttaccacgagcagctgtccgtygctgakatcaccaacagcgcctttgagccttcgtccattayggcmaagtgcgacccccgccamggcaagcacytgccsgggmggcgctcg

SEQ ID NO: 67110 - DNA, 698 bp, Triticum aestivum
  Clone ID: PAT_TA_67110
gacaagaggaggcttgtvaccaggtcacttccagcccacatggaagttgtatttgatgatgatgggcatgtagtgttggatcatgcacttgtcccgagcatacaggagcaagctctttgggacaccactaatggggaagctgacacagatcatggccaacatatggcgccacccccagttcctgatgagttcagatttggccagctgggagctcactacgtagaggcaggaggcttggctggtcatacbtatgacgttcctcccatgctgcagagacagattgatcgccagacggctatccttgagcagatgcagagacagattgatcaccagacggctatccttgagcagatgcagggacagagacagattgatccccagacggctatccttgagcagatgcagagacagattgatcgccagacggctatccttgagcagatgcagagacagagacagattgatccccagacggctatccttgagcagatgcagagacagatgcaggatatccgcaacctgggctgtggtttctattggtcagagtattcgccgtgacgctcgccacagtkatattctggctcttctcgatgagagtvttagtgcttyctgtggactctaggcggcctcctgtcccaccgggtttgacgcaacagactctacttctcagtgtctagttttgtggtatgatgagctgc

SEQ ID NO: 67111 - DNA, 316 bp, Triticum aestivum
  Clone ID: PAT_TA_67111
gaggaaggatccwcaacctccattatcaatagcccggagckgcatcggccttcggatcagatctgtggtagcctggtagggatcgagaagttaggggtcgaggaatttggaggaggtgatatacgaagggaagggaagkaaktgaatwgagtgayawacytkatgtttggtatgtatatagtcaggctaattagtgaatatccaaaacaacgattaadagaaagaaagaaaacagagttcgatgggaaaggaatcggtgaggtattgaacatactccctccggtcctttttactctgtatattaggtttgtytkaa

SEQ ID NO: 67112 - DNA, 253 bp, Triticum aestivum
  unsure (1)..(253): unsure at all n locations
  Clone ID: PAT_TA_67112
accbgrcctawghgctcatcchtgccaggtgggmcatgctcggcgccgccggatttchtcytcccmgaagagcagactacaaacaagwtcgagcgcaatctgrhkhgaccccgyggcsatawtaggttcaatgtccgagcgcaccattacatcmtcgaaggcayactccctamtctwcttmaggcyaaagcytcccchwmhyactgatcctmgccgacgtcagmcgaggacgtcctcgtmgaargagacgnaw

SEQ ID NO: 67113 - DNA, 136 bp, Triticum aestivum
  Clone ID: PAT_TA_67113
actcttcagcbgccgcscttgasccacttctcgacggcgtccatctcctcgaggatgcggatgccgcgcttgtcggggatggccscygtgbggccgaagctgawgtagttgccggacacggcgttgagcgccgagt

SEQ ID NO: 67114 - DNA, 340 bp, Triticum aestivum
  Clone ID: PAT_TA_67114
acgcgcttggcatggtgatccttgagctgctgacggccaagtcaccgatcggactacctgagctggtggagcgagcagtggaagacggccagattactgatgtcttggacaagagtgcaggggactggcccgtgaaagaagcgcatgaacttgcccagctagggctaaagtgtttggagatgcggasaaggaccggcctgacctcaagagcgtggtggcggtggatctggaacggctgaagcatggcacggccgtcaggcttggccggaccgcccagccacttcatgtgcccaatactcaagaaggtgatcgcagaacccgtgcctggcggcggacgggt

SEQ ID NO: 67115 - DNA, 511 bp, Triticum aestivum
  unsure (1)..(511): unsure at all n locations
  Clone ID: PAT_TA_67115
scctgtctytsgggcttggscgtggsgctgtttcctttgctgtgctassttstygsgntcsccccbcgggggtgrcggsgtttgtggsgccctycgycsccctccycgyggtggggttcgcctcccggggcgtccccgrgctgctggcsgtgcccggcgyccgccccggcsgggttvtcccgcccctgctcmgcccagcgtagccttgtccctggttctcgtctccscctatgtcgggtagcgcsggtcccgcttctcgccsgccttrtrcctaccccgcgttccccggggcccccctctctttccmsgggsttcnccgctatycctcggccgcmgccyccctantcggcttccccccgcccccgtagccccrcgcgcctaccgcvtccggcccccttcsccctatmcthgstcstwttacccttcsctagccctccttttaccccctcctaactagncgccccctaacctthccccccttmctccccttaccgctcgtccccctttcgcc

SEQ ID NO: 67116 - DNA, 311 bp, Triticum aestivum
  Clone ID: PAT_TA_67116
acaccgactagtcmaaatgktgmgtctktwcctccgccaccycaagacaaacctccmactcckcccccgtggccaycatctccaccacctckaccacggcctymgtttbstkysaawcaasgttcacargttsaaggagcatkccatgttgsaccttatcgagtcgagccacagactttaasaaatgtycwagatcagcaccctcattctattgywaayaatcggaggcaacagyggrtccttgtayggttccattccagcctccaccgccctagacttctggctgtmcagggcatccaaaccagatgcat

SEQ ID NO: 67117 - DNA, 301 bp, Triticum aestivum
  Clone ID: PAT_TA_67117
accatgcacaggacgacgatgctcggmtcggatcggatcgatttcgcctagtggaacttgaggctggtgaggatgttgttgttgacggggtstgagargtggtcgaggaggttctggaaggrcccgamgccggtaaagatggcctgcagggacatgccgaggaaggcgagcatggcgaggcggccgttcttgatctccttgagcttgarctccttcatctccttctcgctcttggtcccgaacccgagcgggttgaagawgggcccgccggggtaggcggggtcgccggarccgccgaggt

SEQ ID NO: 67118 - DNA, 471 bp, Triticum aestivum
  unsure (1)..(471): unsure at all n locations
  Clone ID: PAT_TA_67118
ggaacgcgtngcyggmgagcyctactgcctcggagcatggcattcagcctcgatggacagatgcccggygacaagaccgttgggggaggtgatgatgctttcaacaccttcttcagtgagactggtgctgggaagcatgtcccccgcgcggtctttgttgatcttgagcccactgtgattgatgaggtgaggactggcacttaccggccagctcttccaccctgagcagcttatcagtggcaaggaggatgcagccaacaactttgcccgtggtcactacaccattggcaaggagattgttgacctatgccttgaccgstatcaggaagcttgcagacaactgcactggtctccaggggttccttgtcttcaacgctgttggaggtggaactggctctggccttggttctcctctccttgagcgtctctctgttgactatggaaagaagtccaagcttgggttcacagtgt

SEQ ID NO: 67119 - DNA, 214 bp, Triticum aestivum
  Clone ID: PAT_TA_67119
acaggastyaagccagccatgtrgtcctcaaaaccgtaaccatcccgcttttctgcgaaadgtgcgccactcaacagtagagcgtccagaccggcgaamacatsatcaaaagctgctgcactcgcatcacgcatccttaccacctccatggctttcgggtaaagcgtcgagtgcctacaagtaaacgacaggttaactgarttgtccctttggt

SEQ ID NO: 67120 - DNA, 506 bp, Triticum aestivum
  Clone ID: PAT_TA_67120
acatgaacatggacatacacatattcttaggaacaaataagaaagataaatggagaaggaaaacccaaagcaatgtcagaattgacaaaactgcaatggcacdttatatatggcctgtcgtgagtmagcygtttaggccttgccggactcctcgcagcccggtggcttgaaggcgatgaagctgacgcactgcacctgacgcatgthgtcgaatccgatgatgcggacatacgcgtcagggtacgccttcttgacctcctccacctcgttgatcacctgtrtdgcgtcagtdcactttwacataggcagcttccacattgtccaataccggccatcgtagtatccaggagatgcgttgtgctcacggaagatgaacccaaccttgctgaactcgaggcaaggcacccacttggagcggatcaggtagtcgacctgcttkargagggcctccgtgctgagcggtggcaggtaagacagggtctcgaacttcttgatgccctcgatgg

SEQ ID NO: 67121 - DNA, 259 bp, Triticum aestivum
  Clone ID: PAT_TA_67121
ctaagctagacagaccccagaaggcagttcrcagrgastcaaaaggwgaagraratmaaradcrgccgcctcgcacatgtatctccatgttcggcttcttcgtgcaggccatcgtcaccggcasaggrccctctcgaaaacctcgccgaccaccttgccgaccccgtcaacaacaacrcctggacctttacmwccaacttcrtrcccagcaagtaagcwgctaggtgttgtattatgtctggaaaccgaccgtacacgt

SEQ ID NO: 67122 - DNA, 503 bp, Triticum aestivum
  Clone ID: PAT_TA_67122
acagcagtaacaatagccctcaagcaacagcatccgactccaagattagtcaaactttagacaggatacttgggcgttcggcatccacttctgccccaaacaatcagtctgataatgggggtgtaaatgctgagactcccaggaaattaacaggccatcttggtgatatcgaccccgttccttttgtgccattatctgctgatctgtttaccaagccacagaatgcaaagagtaatgaacaggcagatagggactgtcaaataaatagggaaactggtagttccacacccggtatcacacaggcctcaactgagaggaaagatgttgatagatcattagatactgctgagaaatggtccaagaaagtcgcagaactcgacagtgtaaatgacctttcaagtgctatttctgatgaagactttcctgatattatgccaatgaggaagggtgagaaccggtttgttattagtaagaaaaaraccgctcgctgacatcaccacagt

SEQ ID NO: 67123 - DNA, 438 bp, Triticum aestivum
  Clone ID: PAT_TA_67123
cggccgaggtacctcarttcgtcctgactggcttggcggacatgttcaccatggtcggcttgcaggagttcttctacgabcaagtgbcggakascctgcgcagtttgggccttgccttatacttgagcatattcggaattgggagcttcatcagtkgctttctggtgtatgcaatcgaccgggtaaccagtgacggtggagatcgttggttctcgaacaatctaaaccgaggtcatcttgattacttttactggcttctggccgcgctcagcgttgtcgggctggctgcttacctccacttttcacaagtgtatgtccccaagaagaagggcatttcagcagaatgatggtatgcgccaagtgactgccaactgagatgcctgaaatccatgaatccatgtctgccaactggtatgcgasttttctctaggctgttgt

SEQ ID NO: 67124 - DNA, 732 bp, Triticum aestivum
  Clone ID: PAT_TA_67124
acgccttttccccaacgacacgatgaatcccaaacccagcaaccctgggctcaaattcatcggcaagtagcacattgctcgmcttcagatcgcggtgcagcatgcsaggagtataatcatgatgaagatatgccaatccttgagccactcccagtgcaaccttcaacctgtcgttccatcccaccgcgaatttcggcgcacagatcatatcctgtaagcttcctctctgaaagtattcatatatgacgctgacytccccttccgagtagcagaagcctgcaatcttggcaatattcttgtgccggattttcgccagcgctttcatctcgttcttcacttctctgaatgtcagcytggctgaactgaacagccgcytcaccgcgactttttgcccgtcttgtaacacgatcagataaacctttccaaatgctcctcttccgatcacattcttgtcgtggaacgcggcgaacaagtcctctccggtgatcttgattgggtggaaagcaccagcytccatggggaggagggcctgttgccacgtatcctcctgcaaactgcaaacacycctactgccaacagagccaatcctgtaacgaaggaggccaccgtcgcagccagtkctaggccctkatgctttctcaatggcgcatcgcaatcgctcggcaaccytggaccgcacaggcctgggttccyctcaagaaacacggcgggaaggccggagaccagccccgg

SEQ ID NO: 67125 - DNA, 214 bp, Triticum aestivum
  Clone ID: PAT_TA_67125
mtctcaggacaatacaatgatgaagtttgtttgagatacaaaacactctgtctaccaaaagttcatacaaacactaatcatgtgagacaatgtattctacacgtcaccaagaatacgaaaaatacmatatrtactttaaattgcagttggtgcagtcagtcgattctgccacaacaatctttggaatggcctcccatccacctcccaacatgac

SEQ ID NO: 67126 - DNA, 227 bp, Triticum aestivum
  unsure (1)..(227): unsure at all n locations
  Clone ID: PAT_TA_67126
cccctakgaactccracaraacmackggagkgghacknacatacaccmccaccrghccaaaccattctmatacacaaatcgaatattaactsgttattattacaacatwtyamaatcaracaacgtcgtcggtccgcttrggcwacrggcmaaaachgtgtgattratctaagcgaghagcatggbgtktcrgggctccaattttcgtcgatggnacatggggccca

SEQ ID NO: 67127 - DNA, 453 bp, Triticum aestivum
  Clone ID: PAT_TA_67127
gatggttcacgccgatgttaactgatttcggctggcttcaaavgtgctcgaaamgactggatgcgagagcgctggargatagcctggggsaagcccttctcacccttccgcttcgggrgcagcaramcctatttgaagaatggttcccagtcttcgcatctaggggcgcgggrtgcccgaaccttagccgagcttccarkatggtggsgaaaggtcattcactagrtagattgtcvgtagavcccctggrgcagcagaarcctatgragatattgcttggtccgcatgagttatatcmgtatttgtagtgtgtgtgtgtatgattgtaarataagaagaattcctgttascctgtagrgttgaatttttgtttatgatcttgcctcagttcttcccagtgtatgcactacttgacagtcagagtcascaatagaattgttgtagaattgcttc

SEQ ID NO: 67128 - DNA, 164 bp, Triticum aestivum
  Clone ID: PAT_TA_67128
accaacagagcccgggggtcacgctgcgccgcagtgagtctgggagcvgcgaggggaagtcgggaggggagagcgcgtggctabggttttgagatttcgcggccagggaccgactgtcgggaagacgatgcggagaggaacggctcgggtaaatcgggttcgtc

SEQ ID NO: 67129 - DNA, 553 bp, Triticum aestivum
  Clone ID: PAT_TA_67129
taaacaaataaamccatattcattaaaatykrartaattttacatcaamcsaaakaattttcatctaaacsamacaacattcattacattctcaacatatttcaactaaaaaccctattctaacctaatctaaataatsctcaasaccsatttcccmacacatatcttccctatatccmtcarmagactcacsgaatggttrtrascccsrgaarccaaggcttcastggaarvtarggaatagccgcgrctaattgcccgatratraacagcccrccaagcttagtttcaacgggaggggaastgtagtgmccatcatgrgactcagcgtcctcccatgttctactcttccttgctaccagcagtgcccgtggacgtrtgactttgtcgtcatggcggtggrgcatggacgacgcgaagctagcgacgtcgtcagtgccatcatagaattctgycatcgcctcatccgatatccatgaaggtmgcttctttcctagcagctgcaggacgcggtcccgccattgctcgcggcgaatgtdacgggcgtcatggt

SEQ ID NO: 67130 - DNA, 343 bp, Triticum aestivum
  Clone ID: PAT_TA_67130
actacacyctgttgcaactcaagttggcgttgaggaagaagagggtggaacctgatggccgagtrccgcgcgccgccgcdagctcctbaacgaccatctctcgatggtccgctccgtggtgcggtggtccccaagatgagcaaggtcttgtggtctctttgcctgattaggatcytaatgaagttcgttggtggctgcagtaaaactgtkgttgggcgctgttgattttgtkgtggtaggctgtttttcgatttggtccactttgccggacaggtgatggtcggtgtcgtggttattctacagccaagctgaatatacacyccacctgaactatctccattgt

SEQ ID NO: 67131 - DNA, 703 bp, Triticum aestivum
  Clone ID: PAT_TA_67131
acagtbsaagccacttctttcccaaatctgaaagcgcttgatttctcaggaacggcacaagcatatgttacgttcgtgaaagggtctgcgcccaagcttgagcaaattttgcacatgccattcagtgtgcccaagcttgatgacaaagacgcaacaccatcagaaagcaaggctgcagctgctgcgatcaggaaagaagcaggtgccaatcccaaccatcctacagttacttttgaggggaaaccagagggagaggacaatgaagagacgggtgccagtgacgaggagaagagcaaggaagatggcatcgctgatgaggattaaagtgctcagaaccctgtgggaactctgaatacctacgctgttgttgttaattcacttatattctgttcccagtagctacctgcatttgttgggacctaagctccatttgcattcatggacatctttttgctgaacacttgatttgtctttccctttgttccaaaataagttttgttgaattactsgtgctctgaacagagcagatccaccattggaactcattcatatatctgctactatgtgttgttattcgtcagtttttgttctgacgaaagcacgctgtgatactcttgacgttttgaggtgaagtatcatggaacgaattttttgatgtgttccaagttgaatgaccacatccccatgtgtatgtagtaagctg

SEQ ID NO: 67132 - DNA, 385 bp, Triticum aestivum
  unsure (1)..(385): unsure at all n locations
  Clone ID: PAT_TA_67132
atgggtggcagcakaatgcccctccgccaccccctgatcatgttgtgaagatgaattcacatccttccactaaacarccgccgcctchngtcaatgtaaacagcagtngttcgggktcacatttctcaggcggcggtgagaatcgacycctgcaatcwccgtttggcaacgccctcagcttctcgrratgcacttttacttatgaagagttggctgtygcgaccaatgaattcgccgatgctaatcttctcgggsragggggckttggatttgttcacaaaggagtgctgccagawggcacagaagttgccgttaagcaattkagagagggaagttggcagggagaacgttagtkccaggcagaggttgagawtatcagccgagt

SEQ ID NO: 67133 - DNA, 435 bp, Triticum aestivum
  Clone ID: PAT_TA_67133
aaggscgctgacgattcttataggtagtctgctcaaacagaagacbccaccagttcccaataaaagyaatagrtcaacaaataattagttgcagaaccactattgaaggcaaaactgaaccactatttaagtcaaaactgctgcaaaaccgaaccagcatgctttcaaacagaatgccaccaatctggaacattattagcttcaaagtacccggtggtgagtaagaatgcaccagagccgatgctcaaaaaggaatatcatcaaatcatgcggasggtcttaaactctactccatggtagacaaacatcaagtgattgaaatgcagcagagtccctgcagtacttacctagctagctgagagcgagtgatgcccaggctgcatcatcggtgagacaagaggtgcaccttgaccgggaggtgtaccccagggttga

SEQ ID NO: 67134 - DNA, 364 bp, Triticum aestivum
  Clone ID: PAT_TA_67134
acagtyagactggaattcatgcatggaagccgacgcaagcagctcaacctcttcctccagacgaccagagtcatatatctgctccagyacagsaatagcttttgctttctcatccttccggtaaagccagcsgggagattctggcagaaaaagcatcagcacaaactgtatgattgctggcacggcagcaactccgagcatccagcgccatgttccaggaacctcagtaaagccaagattcaccaagtaggagaagaattggccaccggtaatcatgaggacattagttgacaccaaacctcccctgatttctgaaggagcagcttcagcgatgtaaacgggggcagttactkatgctattccc

SEQ ID NO: 67135 - DNA, 459 bp, Triticum aestivum
  Clone ID: PAT_TA_67135
cggcccccggccgccgccgtcctccgtccccgcgtctcgcctccggccggcacgcggcccctccgctccaggctcttcagctccttggaggaagatggggaaagtgcgatgaggctgtaccaagagaatctagctacacttgatcgagtgaagaaacaccaggaatgcatgatttctcaagtgaaatgatcccaaccccctttccttctttctgaaggtcgcgcattgcgtttctcgggaaggtgaacaagtgtctgagatggtctttcaagctgcttatgcctattcccaccgcagctgttatcctgaaagtgatcgatcaccagttagaggagaagtgattatgccttgatctgttttatctatctacatggcatgtattatgtatttatgcctgaagtgcttgtctggtgtatgaggattgtgtggcgtatgttatgcgatgtgagacatccatta

SEQ ID NO: 67136 - DNA, 546 bp, Triticum aestivum
  unsure (1)..(546): unsure at all n locations
  Clone ID: PAT_TA_67136
atgcaggacaccagccagaggcatcacagccacgtccacgccgaagagtcgctccccctggaagtcgacggcggcctgcggcccgagccggcgaccgttagcgagcgccacgacaacgacgccccgcagccggagccgccgtgcactaggcagacgccctgcagctgccaggaggaggaggacgcgccggcgccgacgcggctccccgaccacctcgctctctccggcggccccgtgcagctcgccgcgtccaccggcttcgcctgggccaagaagcccagagtgccggacgcggcgacgaccaagaggagcgctcccaggggaccaagaagtaccaacaccgacggaggcgacgccgcaagcgcaagaacgacggccagcgccaccacaggtccatacgaggcggagaagcaggagatgatcaagcagtgggcgcaggtcgcagaggcgttcacctcatccgaagcctacaacagcaggtccaccanggagccattggacgccaagcagctcaagaccagcaagaagcacaaggggaagatgaag

SEQ ID NO: 67137 - DNA, 347 bp, Triticum aestivum
  Clone ID: PAT_TA_67137
tagtttgtactcaccccagttgcaagtcaaccatgtactcgcaactaggggatgtagttttgtagttgccctagttggaagttcaccctctactcgcaactcgagggaatgtggttttgtattcaccccagttgcaagtccacctccaactcacaactcgagggatgtagtttgtaatcggcccagttgaaagtcaaccatgtgctcgcaacttggggatgtagttttgtagtttccctagttgcaagtccaccctgactcgcaactcgatggatgtagtttgtaatcgcccaagttgcaagtcaaccatgttctagcaacccggcgatgtagttttctagttgcac

SEQ ID NO: 67138 - DNA, 552 bp, Triticum aestivum
  Clone ID: PAT_TA_67138
atgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggcgtcaagatggagttgatcgatgccgcatttccacttctcaagggagttgttgcaacaactgatgttgtcgaggcctgcactggtgtgaatgttgcggttatggttggtggattccccaggaaggaaggaatggaaaggaaggatgttatgacgaaaaatgtttcaatctacaaagctcaagcatctgctcttgaagctcatgcagcccccaactgcaaggttttggttgttgccaacccagcaaacaccaatgctctcatcctgaaggagtttgctccatctatccctgagaagaacatcagttgtttgacccgcctagaccacaacagggcactcggtcagatttctgagagacttggtgtccaagtttctgacgtgaagaatgctattatctggggtaatcactcg

SEQ ID NO: 67139 - DNA, 290 bp, Triticum aestivum
  Clone ID: PAT_TA_67139
tctgatcggcgccggggacaagctcgggatccccgaggagaagggcctggagatcaccgccgaccagctcgaggccctggagaaggcgtctatcgatcttgccgtcatcaagcttcgagaggcttctgattacttcaacgctgctggctgcggcgcggctgcgaggcaggtctcctatctgcccgaaccagagtgagtccctcatttcctcatcttacatacggcgcactgcttgttgaaggaagcctgaagtctttgttcatgactgcccctcgtctgtgatctgatat

SEQ ID NO: 67140 - DNA, 195 bp, Triticum aestivum
  Clone ID: PAT_TA_67140
tcctctgtagttattcggcgataaagagcatacttccttggagaaagcgtcaaactgccgaagaaaggggaacctttattgaagaacaagaatggagaagagggtggggatgatattgactatgatcgccggctattaacctcttctggtgaatccgtttctgggggatcaagtggttctgttagtactatggag

SEQ ID NO: 67141 - DNA, 618 bp, Triticum aestivum
  Clone ID: PAT_TA_67141
caccttcctgcggggacaccgtgttgcaagccaactcttctttcgaatttgatgggaattctttggcgaaggcctctgagcgccagtgttggagtggacaggagccgcgcatcagcatcctcgactccttccccagcgatgtatctgccttcctctgcttcccctactccctgaccccgtcgcggctgtactggtctctgcaacacgtcgcagctatatttgctgtgcgtgcctcgcctgcaaggacctttccaccatcgatttgtccgagggctgagctccgtggccgcgccagcacgacctgctgcagctccctgcctcctctacaacataaatgataagacggacacccgtgctgatggacaatgcgccgaacttgcatgaaaattcatgacttctggttctaccctctgtagatgttgccaggtttagtggcgttctcctaatgctcttttctctccacgacttctgctgatatcctcttatctacattatcacattttctgacacgttcatgcgcaggatgattgatgcatgcattgctatgagcaaggggttaacaaaataccagtagcatgctgcaacatctcattagattttcccaaactattctataaa

SEQ ID NO: 67142 - DNA, 526 bp, Triticum aestivum
  Clone ID: PAT_TA_67142
gcagggcgggggcgtatcccggtgtccgaccgttctgcggaggcccaaccggaagctgcgccgtcatcgcagcgaggggcgtcgacaacacaggatgaggtgtcgggatctaggtcgagggcagggcggcggcggcggcggcgtatcacggtatcagacgagtctgcggaggcccaaccagaaggtgcgccgtcatcgcagcgaggcaagaggaaagcctccccggagccgtcgtccgcagcatcgcagggacgcaggaggcagaagagaaccgccaagaagcggaagagaactgacgagaagaaagccgctagcagcaagggcgaggaggccgcggcgacgacctcagcttcaccaggcgcatcgcatgcctcctcctcctccgaggcttcctctgcggccagctctcctctgcgttgccctcttccccccgcccccgccatgggcgcaggacgtaactacgaccctgcgatggagcctgcctgcgaagcctatatggaattgagttccaagtaccatgcgaaaa

SEQ ID NO: 67143 - DNA, 592 bp, Triticum aestivum
  Clone ID: PAT_TA_67143
tctatgtttatttggatgtgaaagcttaccagcggttctacatctgcctttgtccttaaagaccatatggattgatggctgcagtagtattcaagtcctatcatgccagctgggtgggctccagaaaccagaagccactacctccagaagcagaagtcctatcagcaactagcagcagcaacagcgccaactgcaagagagcatttactacctccccatctcgaaattctagtaatactggactgtgctggcatgttgggtgggactctccgtctgcctgcacccctcaagacactgcgcattactggcaacagtgggctgacatcgctggagtgtctgtcgggagagctggaatcgcttgtgtaacggaattcaaaccattgaaaccgaagacatggaaggaaataccgaggctagtccgtgagcggaggcaggcctgccggagctgaagctgaaggtcattcagcttctattcaatgacaggcctgatccctgattgttgcactgctctgctaggggaatggcctgtgattgcttctacaagacaactgtgccgcagtcgctctccatcgagaacttcttggatgatgat

SEQ ID NO: 67144 - DNA, 465 bp, Triticum aestivum
  Clone ID: PAT_TA_67144
ctcgccgccggcgccgccgcgccgccgcctgcagcagtacaccatgctccgcctccacaaatacatcctcacccaactcctcccttcttcccccgcttccaccatctcccctctccaccgcctcatctccgccgtcgcgcccgccgttttccccaaccctagcttcgccgtcgaggactacctcgtcgccacctgcggcctcacccgaccacaggccgccaaggcctccgccaggctctcccacctcaaatcccccgctaagcccgacgccgtcctctccttcctcgccggtctcggcctctccaccgccgatgtcgcagccctcgtcgccaaggaccccaagttcctctgcgccaaagtggagaaaaccctggcccccaacgtcgcggagctcagtcgcggccgcttccgcagtagatccatcctctccaagctgcactactacctgcctctcttcgactcctc

SEQ ID NO: 67145 - DNA, 252 bp, Triticum aestivum
  Clone ID: PAT_TA_67145
gggcgcggccatgttgctctacttcgtgctgagccggaggctggcgaatcacgaggaggccgccggtagctccggcgggggcggaggagggaaaaggcggaggggacgcgcggcgcggcagccatctcagccgcctgcgacatggatggaggcggtgggtacgctcgccgagacgctgcgattcacctactcggagacgctcgggaagtggcccatcggggacctcgccttcgggatcaagtacctcatgcg

SEQ ID NO: 67146 - DNA, 452 bp, Triticum aestivum
  Clone ID: PAT_TA_67146
gggcaacgccagccgctggcgacgcgtcgaacaccgcgccacgcgagcccccttccccttccccttcccactcttcctctacatccatcttccacctcctgcggcagagatagagggacgtagctgcgccctcctctgctcccctgcgctcgacagcgcgtgcttggcggcgccctccctggccctcttgtcagcgtgcgcgagcacagttggtgaacgcgccgctgccaaccggctcagtgggttgccctttgcccctttcggggtatgttcttcccgacccctcggcttgccgatgcgtgtcgagatcaagaggaacggcgcggtacagcagcggcgctactttttcggcgagcccaaggcccttccctgaaactttaggcatgtttgcaattggacaaatggtgtataacaatgatcatcatctgtaaattggacaatcggacagcatc

SEQ ID NO: 67147 - DNA, 422 bp, Triticum aestivum
  Clone ID: PAT_TA_67147
cccgtcggcgtcgacgacgacggacactctgacctctgcctcgtcgtcgtccctgctatgggaggacgccgtggcggagttcgagtgcggcgacgacggccagttcaagatggagagctccgcagccacgcagagcttctccggcctgctgcgcgagctcaacgagctggagcagagcgtcgtgtcgtggggccggaagagccaccgcagccgcgacgacaagaaagcctcgtcgccgccactggagcacaagcaggcgaccatgaaaagcggcgtcaagggcggcgacgtcacgacgggcggcgctaaagatcgccatgtcggtgacagcgtcgaaccggggactgttggtgcttgcgtcgaagtggggctcgacggcagcgtggcggtggtgaagcagtccgaggacccgctgagcgact

SEQ ID NO: 67148 - DNA, 267 bp, Triticum aestivum
  Clone ID: PAT_TA_67148
cgcttcatcgtcatccccttctccgcctgccgctccgccgccagcgtcgacgtcgtccagtccaagaaccccaagtacgcgaccgcgcactgctgtatatcgttttagttcttgttcgttggctgatcgattggatgttggattggcggcgactgtacgtacgcatgtgctggcggtggcggcgaggggacggcgtcgtcggccgcgccggggattaagccggccaatggggagtcgctgtcgctggtggcccggctgctgcggggg

SEQ ID NO: 67149 - DNA, 220 bp, Triticum aestivum
  Clone ID: PAT_TA_67149
caacagggcagcctcgggtcaaacctgaccaggggtcccgcgtgtcagtgtaattagtctaactaatttttagttaacactaatcctaacctaattaacaggccggccccacctgtcatggacacacggggggtcccgccgtggtcaaagtgggtcaaacccaccggcggcttgacgccggcgaggccagccgcggtggcgagcctcgggttttgcccac

SEQ ID NO: 67150 - DNA, 428 bp, Triticum aestivum
  Clone ID: PAT_TA_67150
ctgtcaaatgattcggctcaacaagcagcagcaatggctagtacagccatgccgcaggctcaggttcaggttcatgcgcaggctcaagcacgtcagtcgccagttgcagcagcagccatgatggcacaagcccgtaagtctccataccagcaagtcgcggtccctcgcacgacttctagaacgagccagcgaaaccaatcccgaacaccagtcacagaacaggcacggggctaccagcctcctcctcctgttgacatgggtcaacagcagagtgcacgacccggtgctcattacgacacatcatcatcacacatgcccagcggctctggctataatgactatgggcgatattgcggagccaatactgcggcaaaccaccaggcagctatgtcagcagcttcggcaacaccgagcactatggggacgtc

SEQ ID NO: 67151 - DNA, 342 bp, Triticum aestivum
  Clone ID: PAT_TA_67151
tttcactgctggttacaagcagtgttacacatccactctgttgttgagatgtgaattgtgatctcataagaaatgcatgaaaaagcaagtactgacccaaaaaaaaaaaccaaagaacctcttttggaaaatgggcattgtatttgccgtgtcagtgactatttgattgctaagaattctctgatttccctacttggaagtttactctacactgaaggaaacaatactgtagcaagttgtgatttcctccattggaggtaacgttttcacttaagccatcttgacggatatgggagaatgaagtggcgctgtctcgaaatagttttggaacagtgagatcga

SEQ ID NO: 67152 - DNA, 569 bp, Triticum aestivum
  Clone ID: PAT_TA_67152
tcaccacaggcgctggggtcgacgcagagcatcgacgacggtgtcattgtcctcgcgtgattcatcagatgcaacctcacccccgcgccggcttttgacggagctgctcaccaaggaggacctcgtcgcctacatcgcatctgggtgtaagcccaaggagaactggagatgaaattgcaacacctggtaccgagaccatgctgggattttctgatcatgtcaggagctttgtaaatcctgtatggacgtcttctttgagtggaaattattcgaatacaacatcacggacaggaaaacagttggacatcagccatgaaaaggttcgaggtctttcacggagtttcctaccagctattcatctagagcactatccttgtgaaaatttctcattttctcctccacctattgataggagacgcactcgacaagggtgtaagtagtctcaccagtccaattcagagttacaaaaaagttctaaatctgataatattattttaaacgtgtgtagcatgtcctgattgttatgtgcctgttgactagaccctggcattgatgccagctgctaatct

SEQ ID NO: 67153 - DNA, 357 bp, Triticum aestivum
  Clone ID: PAT_TA_67153
tctgctgcaatgtagaatgtgttactgtgcccatgtatccagtagagtagataggatttttgtatgtccataattcccccgcaagatgaggtaccgttctttttctttttgtattaaatatctgattagtagtttgaagcagagaattgcgtccatagtttatatttttttgtatgtttttttttgcatgttgaatgcacaatagtgtctctcgcgtaatgaatgatacgcacactcgtgcgtattcgagaaaaaaaatagtgtctctcgctcacgcacgtcgattggaggtgtttttgtgtgtgttttcatgcagttgtaaggtgctggagagtgtggaagctcatactgtttttg

SEQ ID NO: 67154 - DNA, 164 bp, Triticum aestivum
  Clone ID: PAT_TA_67154
acagcaaccccaataacaacgtccctgggtttggtgtcgccggacaccatgacgtcaagcaaagtgggtcccgggaggcagttcgcaaccccgccaacggcgaggtcggagctgtacgacgccgacgatagcattggcgcgccccataggtttcggcgcatggg

SEQ ID NO: 67155 - DNA, 437 bp, Triticum aestivum
  Clone ID: PAT_TA_67155
tcgccctcgccccccgtcccctcgtcggcgcccgatctaagtcaagatgagtcgtggcgggagtgctggtggtggtcaaagttctctgggttacctgtttggagatggtgagcctgcaaagcccgctgcagcaccagctgcgaagcccgcacctgctgagaaaccagcaccggcagctgctgatgtagccaagcagattccagctggcattccaggtagccgggcgaacaactattaccgtgcagatggccagaacacgggcaacttccttacggaccgtccttcaaccaaggttcatgctgctcctggcggtggctcctccctgggctacttgtttggcggaaagtgatgttaatgatgctgcttaatgaacgaacgatgaattggcctgtatctcctgtatccatgtggtgaaaactggaagtgtttggtttcag

SEQ ID NO: 67156 - DNA, 181 bp, Triticum aestivum
  Clone ID: PAT_TA_67156
tgccaccgcccacgtccgcattggcatggcgctgcgttcacctcccaatcaatgcgagtgcctttgggatctatccgtccgctcctgaccgctgatgcacggtagtcggtggtacaccacaacacaaggttacatcatgtgctattctagttgccctttgttctttgccacggcatgcaac

SEQ ID NO: 67157 - DNA, 403 bp, Triticum aestivum
  Clone ID: PAT_TA_67157
agcagcagcgcaccaccgcctccggcccctacccagccgccgatgccgccccgcgccgccgccggcgacctcagctgagcatggcggccgcccccgcgggcccccagaaccgctgcgtcttcgttgggaacattccgtacgatgcgacggaggagcagcttgtgcagatatgctatgaagtcgggcccgtggtctccttcagactggttgttgataaggaaaccggaaagccgaaaggttatggattttgtgaatacaacgatgaagagacagctctaagtgcacgccggaaccttcagggtcatgatgttaatggtcgtcagttacgtgttgattttgctgaaaatgggaggaacactgacagaaatagagaaaaggtggaagatcctcagtctattactgt

SEQ ID NO: 67158 - DNA, 474 bp, Triticum aestivum
  Clone ID: PAT_TA_67158
tcaaccactgcaataactatctctaaatccaaatcacaccaaatgacaaccccccaaaacaccgccaaaatgagctttctcggaatgggtcgacctcagcctacctcggagcaaaagattgctgccgttgagagtgagatgcgcatgatggccgacacctacaaccgtctccagcagtcttgccagaagaagtgcgttcccaacgactaccgcgagggcgagctcaacaagggcgagtctgtctgcctcgaccgttgcacagccaagttcctcgacacatcgatgaaggtcagcgagatcatgcagcagcagggccaggccctcggtggccagcagggcggcggcggcatgttctaagcgcaatgagtgaaatagctgtccctccaccacagctggaacaaaccgcttagaggagagggaaggatatcgaatcggaggggcgatcggagaaactttgtacgactattggagagc

SEQ ID NO: 67159 - DNA, 395 bp, Triticum aestivum
  Clone ID: PAT_TA_67159
catcaccggcgcgctggacccgtacgtagaggtgaagctgggaaacttcaagagcgtgacgcggcacctcgagaagaacgccaacccggtgtggcgacaaatgttcaccttctctgccgcccacctgcagtccaaccagcttgaggttatcgtcaggcacaaggatgttcttcgtgccgactttgttggccgcgtcgtcttcgagatgtctgacatccccagctgcatcccacctgacagccagttggccccgcaatggtaccacctttccgatgcccacggcgagaggttcccccatggcaatagcctcggcgagattatgctcgccgtttggcttggcacgcagcccgacgaggccttcctggaggcgtggcactcgggtacacactccctct

SEQ ID NO: 67160 - DNA, 450 bp, Triticum aestivum
  Clone ID: PAT_TA_67160
gaagaactcgtcgggagggctcgagatctgtgtcgggagagagggaattcttgagatcggaatcggaacaagcgggcgcgctcgggatcggggttaccatacaatttttcccaggaacctttagtgaatgtgctaatggagtcgaagggtggcaaaaagtctagcagtagtagttccctgatgtacgaagcacccctcggctacagcattgaagacgttcgacctgctggaggcgccaagaagttctctgctgcatactcgaactgcgcgaagaagccatcctgatatcgtttttggcatccccttctcgtagtttaggatttttatgcaattttattctgactcttttctcccaccaatctctctggcttgctgcttcacgataatcgaccagttctctagtctttctccctctgttcctctctgctctgctctctgactcgaactgca

SEQ ID NO: 67161 - DNA, 474 bp, Triticum aestivum
  Clone ID: PAT_TA_67161
tacacggacgacgacgaagacgacgaggaggaggacgacgacgtggaggacgtccggtcgcctacccacccccacgatctggactcttttccccagtcgatccttctcgacgtacatgcctacatcgacgaccgcaccaacgccaccaccgccgatgcccccttcttcaaggacgcagggggtccgggttaccttctggatcgcccacccgccgcgcgtctcccgcctcacggtccactccaacggcgtggaacccagcgagttcaccaatacgcccatggtcgtcgccgcccaggacgacctggtcctcctccgcgccgccgttggccctcaggaacacctcagtcccaccggttacatcaatcattactatgtctaccgggccggcaccaacccaactcttcgccggctcgccgacgccagctcctttgtctttgccgactgctcagcgggcattgttcgccgtggtgacgg

SEQ ID NO: 67162 - DNA, 407 bp, Triticum aestivum
  Clone ID: PAT_TA_67162
ttgcatgcccccctgagtttgggtccatcgtcgttcatgacttgaccatacgggatggtcctaacctccaaaataaaattggtgcgcgcgcccaagactgcatctcggggccggtatgaacgaaacaaactggtttaccagtttcaacataattttcaccgatgagaggtttggtggttttacacttgtgaatttgtaccactccattgattcacacttgttaactatgtcgttaatcttgtgggatgctatttaggttcaagggatccactcttcaggtgctcggaactacgagcataagagatggtgaatgggccatcactggtggcaccggagagtttgcctttgcgcagggtgttgccactcacataaaaagcaaggaacgtggtggtgctggccgtgactgg

SEQ ID NO: 67163 - DNA, 271 bp, Triticum aestivum
  Clone ID: PAT_TA_67163
ttcactatatttctgatggtgataacaatggtgtgatctactatgctgggacgtcattcgggaagcgtcaatggatcaatcctgttttagccaagaatatcactgtgacggcaagcagcccaaattcgaggtacacggatccaaatgctctggtttcaaaaaattaccaggggacttgttttgctgggcctcgagacgaagatggcaagaagtgttcttggtggatggtacacattggacaggaccaccagcttatgtgcaactactacac

SEQ ID NO: 67164 - DNA, 363 bp, Triticum aestivum
  unsure (1)..(363): unsure at all n locations
  Clone ID: PAT_TA_67164
tggctcgccgctgtcctggttgtgctacttggttctggttggaagaactgctctgcttctgcatctgcacctgtagcctgctgctgctactcaaggtttgctctccttttccactacatgtgccttgtttatggctcaacatgtatttatctcttggtgccctgngcttatggcgtcgtcttcttcaaccgatgaggctgcatcctgtgctgccgtttcagttcaaggtatttcgtcctcatccgtctcttcgagaagaaatattacaagagcttctatttcttatggtgaaacaaaatgcctagagatccggacacactaccatttccagatcatcttctctactgatagtagaactgcacg

SEQ ID NO: 67165 - DNA, 429 bp, Triticum aestivum
  Clone ID: PAT_TA_67165
cccacatgccctctccagcacccatcgcctcgaacaccactctgttgctgcttagaccagcaccgtggccgcactcagatgcaacagcagagagtgggagagttcagagcaagcaggggcatctgagaagtagaaggagcagcagcagaggcgtgaggacagaagtagcagcagcagggtagcccgagcaggtgtccagaactccagacaccattggctgtggtcagacgcgccggttggagggagaccacgcggatgaccagacaccctcctggtgtggtcttgtggtgctgacggtgctagttgtatgtggcctcaacaggaactcgccaccataccgccggtcggtcaccggaggcaccacagccggcgaccaccttcctcaccatgcgccccttctccttctccttgcttcctctctcccccacg

SEQ ID NO: 67166 - DNA, 422 bp, Triticum aestivum
  Clone ID: PAT_TA_67166
atctgaagatggtaggcatgttgactacagaagcatccagggttgtgaggaatttaaaaggtatattagaacaactgaggagcttcagagggtggaaactagtgacctgtcacgtgaagaaaagattgctttcttcataaatctgtacaatatgatggctatccacgcgttagtgacatgtgggcatcctgctggaccattggacaggaaaaagttctttggagactttaagtatgtcattggtggatgtgcctattcactgtcagctattgaaaatggcattctgcgtggcaaccaaaggccaccatacaatcttgtgaaacctttcggacataaagaccaaagatccaaggtggtcctatcataccctgaacctcttgttcactttgctttggtatgtggtaccaaatctggacctgcac

SEQ ID NO: 67167 - DNA, 576 bp, Triticum aestivum
  Clone ID: PAT_TA_67167
cttgctcccacacaaacaacccaacaccaaccatcaaaatctagttgaccacctctctcttcgctctcgctgccgccactggcgctgtcgccgctccttctgctcccctcgaggctgtctccatgatggtcgccactcccatgtggaccatcgagtctatgcagcgaacatgcgataagcccgacaccacctgtacatggaacttcaagatcaacaccggcagcggtgccgccactgcttgcaagtacgtcgtcaaggcttccaagaacgcctctcaggccaacggcggccctgtcaagtgcggcactttcactgtcacctctggctggagcggccagttcggccccgacaacggcttcaccactctgtctgttgtcagcaacaagaagcagatcgtttaccccagctacaccgacaagcaggtttctggtggcaaggttgtcaagcctgaccagaagtacgcccctgcttctctcccttaaccgttggacaatttatggatgatggatagatgggctctgagtaccacggcagtaatatttaatactggataattagacgggttggatagatgta

SEQ ID NO: 67168 - DNA, 366 bp, Triticum aestivum
  Clone ID: PAT_TA_67168
tctttttcctctccccgcggggagtctcgttcgtcgacactgttgcataccagtcaaacataaacaccatcgcccaagatgtctgccggtctcaaaaccatcatcgcactctccttcgtgctcgccgtcggattcctcctcgttatcctgtcctgcgcgctgtggaaggtctactatcctctgctcgtcgttgccacctatgtcattgcgcccattcccaactggatctgcggacactgcgccaaccccgatgatttcgtcgagagctccggtgctgcggttctagatcttggacgtttctttacgggattctttgttgttatgggaattgctctacccgtcgtcctcgcacactccggcctcatc

SEQ ID NO: 67169 - DNA, 173 bp, Triticum aestivum
  Clone ID: PAT_TA_67169
cagctgcagaacgacagcagcttagcactgttcgtagcactgttcgagtagctcactgaactacccaagtccagctcccatggccagcttcgcctaccaactcctggatgtgtcctacgacctcgacgagcgcgtcaccggctacagcgtccgccccgacgacgacaatggta

SEQ ID NO: 67170 - DNA, 275 bp, Triticum aestivum
  Clone ID: PAT_TA_67170
gcatgatgtatgcatctgaggcatcctaacaaacgaacaaactgtgtagtcaaagcgggccttaattgggctagtcaaaataatattaagtgggtcccaaaagagtggcccaccgtaacaatggctcttaccaggccgttaacaagccaaaggcgtgatagggccgtataaatggaaatggcccgcaggcctctagcaggccgaaatagatgtcaattttgtctcggcccttttactttacgggccagtaagaggccgaaagtgttatggggcat

SEQ ID NO: 67171 - DNA, 467 bp, Triticum aestivum
  Clone ID: PAT_TA_67171
gacaaacaaaattgccctcacttctttagggcgctcatatccaattcattcatggaacacgtgaccattccaccaggattccacaaatacttggaagattgtacaggaatggtgtccctaagaggtccaagcaggaataaatggcccgtagagctggctaaaatctccggggagctatgctttgcgcgtggatggaaggagtggcgctccgaccatcgcgttgggtatggctacctgctggtgttccgttacgacgggcagtcacaattctcagtgacggttttcttaccatcgtcctgtgaggctccgtatgcatctctcgcacagccacaacacaaggacatcgacgtggccagagaggaatagaaagggctcataagcaccaatgtagatgatactgccccgcaagaagacgctcgctctggcactagtgtagatggtacaccacaaaatgaagcttcagaagt

SEQ ID NO: 67172 - DNA, 504 bp, Triticum aestivum
  unsure (1)..(504): unsure at all n locations
  Clone ID: PAT_TA_67172
tatcatcaacaacgacatttctttatataaaccttgataccgccaaactcttgactgtggtctggcaaaacaaccacataaaccgagcatcgctctcacaaccgcctagctcatcatataaataatctgcacctcgctagccaagatgatgcacccatcgcggcaggcgtatgtcgaggatgtcgaacctcaaggcatcggggggggagacgttcccgatgaccacgactatgatatttccatgggaggaaccggtgttccatcggaaaaggcttccgcaatcctcaaccaattcaatcgcaagcgcttggcagcaacgatagcagttcccaccgatgacacacgagtacgcgcgaagctccgggagatgggcgagcctgtcacactcttcggagaggcgcttgttgaccgacgagatcgtttgcgcgagcttctcacgatccangccgagattacagggttagaaaatggcgatatcgacatgggagatgccgacgacgatca

SEQ ID NO: 67173 - DNA, 160 bp, Triticum aestivum
  Clone ID: PAT_TA_67173
cccacgacctcgcaccgacctcctgccgcgtcgccatccatcaagtccgccgccccgccaagtcgttggagccccccgtggcgtccgaaccctgcttctacatctcactgctgtcccgccggagttccctgcccgtcgactctctatgcttccttcccct

SEQ ID NO: 67174 - DNA, 241 bp, Triticum aestivum
  Clone ID: PAT_TA_67174
cgcctacgcagatgctcctacgcctcctccccccacccagtcacaatgatttggcccagagagactcggagatcctctgctagtacctgagcgcccagccgtctcggagtgagtgagtgaggtggttgccaacacatctgtccccgtcccttcctcccccttttctcccctgccggggggggggctgccaatatttggtgctgggaggaggaggggggaggcaatggcgtcctctccgccg

SEQ ID NO: 67175 - DNA, 177 bp, Triticum aestivum
  Clone ID: PAT_TA_67175
ttccaatctttctttcaaaatgacaagttgcattagtacaccatcatgggacaaaagtagctgaactgcacttactgtcaggtcaggttggtttatagtgttgcctttcatcaaaatctcaagaggccttctcaaatcagctattatttttttcgcatttgcagtgagctttaaccg

SEQ ID NO: 67176 - DNA, 437 bp, Triticum aestivum
  Clone ID: PAT_TA_67176
ggcgttgccggggctggtggcgatggtgtgcgtctggtggaaggcgactgtggctgctattgttgtggctgcgttgcagctgggtctccacccggatcttgatgcgccagatctggcagacgcgggggcatctcgacaacagggggtgtgtcctcacgctgtgcttggctgccccccgcgcacgtgtcgacactcggtcgctcgatgtcgtcggtggctggccctgggtattgcagatggccgcaaggctcggtggtgagctccctccgtccatgtcgaagtgggctctggtggaaggttggagaagcttttctcctccgataggtggtggccatgtgatcttgaggcggcatggaggtcgggtgtccgtaggtgattgcacgggtcgttgatgtggtcgcggtggtggttggcgtgcatccgtggggtgcgggtgg

SEQ ID NO: 67177 - DNA, 462 bp, Triticum aestivum
  Clone ID: PAT_TA_67177
cacgcgacgagaccttcaatccggatctgatccgcgcgatattcaagcttgtgtggagccggcggaccgataggggcggccccgtcgacgaggccgtagacatcgagcctgctgcggagacgtcaaggaggaaccggagtacctctgctaatgcaagtgcactgcaagtgagctgcgaacttcttcggatgtttgtcgcagaggctgtccagcgctgtgctgttatcgctgaagcagagggggcgaccacaattgagcccacccacctggagcgagtcttgccacagcttcttctggacttctagctagccttcttggtacctgtctcggacacagatggatagacaaggcgcctgaagcaatccataattaatcttgtaacgagaatgttgtttgtgtcaccctacaaaccagttcagttaaataacactgccgccctgattcacaagtctgtaaactggg

SEQ ID NO: 67178 - DNA, 344 bp, Triticum aestivum
  Clone ID: PAT_TA_67178
gtggagtttgcgtgggggctcgcgcagagcgggaagcagttcatgtggatcgtccgccgagacctggtaaagggcgacgccgcggtgctccccgaggagttcctggccgagacggcggggcgcgggctcatggcgtcctggtgcccgcagcagcaggtgctggaccaccccgccgtgggcgccttcctgacccacagcggctggaactcggcgctggagagcttgtgcggcggcgtgccggtgatcagctggccgttctttgccgaccagcagaccaactgcaggtatcagtgcaatgagtggggcgtcggcatggagatcgatagcaacgtccggcgtgacgc

SEQ ID NO: 67179 - DNA, 386 bp, Triticum aestivum
  Clone ID: PAT_TA_67179
tctctctctctctctctctctccctcgtgccgaattcggcacgaggcgcagaagcaccacgccatggccgcgcacttcgaagcttggcgtccccgtcaccgctgcctgcctcgcctcctgccgagcgcctccctcacccgcggcctcctcctcgtcgccccatgccgtcccggtctcttccaccgccgtcctgcgcttggagccgcgccccttagttccctgcgcctctgtttcacgccgcgctgcccctctgtttctttcgagcagagagagatcgccacaaccccgccgcgttgacttcttgtcgtgagatccagctgccaagtcccagcgcgctttcagcccagcgctgaggccgagtgcatccccagcccatcacctccgat

SEQ ID NO: 67180 - DNA, 255 bp, Triticum aestivum
  Clone ID: PAT_TA_67180
gtgtgtgtgtgtgtgtgtgtgtgtgagttgagttctgagaagcattttttcccatgttgacaacatgcagggtgaagcaggtgtgtagaacacacgatcttgccgatgtgagtaccctgctctaataaattgcttagatcagagcacaggggttaagaagtacatgagactgcagtttgatatgcacacgacatttgacatttgacatttgacacgcttgggagaggggaggtgttgggaggaggagacatgatg

SEQ ID NO: 67181 - DNA, 202 bp, Triticum aestivum
  Clone ID: PAT_TA_67181
ggcgaggtgtttggaatcgtcgtgcaaactaggtccagcctgcgcctgcaggcagtagcatcttgccatctacaagaccattagtgcactatgcaccacaagctttactagttgtgcaagcaaattgtagcaacaaactacataatgtcccttctaagtcagaccaaaccgttattaagtcaacaaaaaaaaaaaaaaaaaa

SEQ ID NO: 67182 - DNA, 103 bp, Triticum aestivum
  Clone ID: PAT_TA_67182
gctattcctcatgcaaatgcaaagcttggaaccattggatcttgcaacctcttgctctctgatgtccatcaaggtgactacccaaggtccctgttcatctaca

SEQ ID NO: 67183 - DNA, 466 bp, Triticum aestivum
  Clone ID: PAT_TA_67183
ctcaccaaacttcccccagtggcattttcaccaacatcacagtcatcttcatttcctataatgtcaggtgcttcctcttcagctgcatcgctcttatcaaccatgcaagcatcagctgcaaagacttctgatgtttcatctccaacggtttcttccacactcccaccacaggagtcagcaccaaaaactcacccaacagtacctgaagggaccgtgtcttgttccctgccatctataccaacacctgttaaggagtcattacctgacttgaataaaaatgcctctaaacctgaagtggtgacaccagaggtaactggaaccacagtctctgtaagtgctactttgacaggcgtgcctacaagtgaaagcaaaactgccttgcttccggtgaccaatggcagcttatcttctaatcctgcatccattcctgtgcctaaagttgtgccacgggcaacagaatctgctg

SEQ ID NO: 67184 - DNA, 453 bp, Triticum aestivum
  unsure (1)..(453): unsure at all n locations
  Clone ID: PAT_TA_67184
caaaacccggggctttctttaacttggtaccaaacaaagtttacaagcttctttctcatctaccgaactcaggtacgccagggatcgagccagtaccagcaagcctcagtgtaacgttcaactcctctctgagggtccgatgtttctaaatggacaacttaagcttcattcaggtgccaagaccaggtttatctttgcctgtcgccggtggcagacccgttcgagcctagaaatgctacgatgcctactggagtacctgctgtttcagtacaccttggccgagcaccacttgtaccatgtcgcaatcccattcaaaacgtctttttttggggcctgcgagagcgacttancgactatcccagctccggaggtggtcccaatacgtcccggccccgtgcgatcttcacgacgatcgtgcaactttgacaagccaatcgcaacaatagttttact

SEQ ID NO: 67185 - DNA, 223 bp, Triticum aestivum
  Clone ID: PAT_TA_67185
gtagcttggcgtcaattttacttttttctcagttagctcctgatcatgctgtccggatccatgctatcaataattatggtttatatttagacagtgtttggctgttgtctattgtgtggtttgaagttgcaagcttgcagctctggcatctgttcagtctctatgatatttatgttgtatactattactctggagttcggcaaagttgcagctttagtcattc

SEQ ID NO: 67186 - DNA, 225 bp, Triticum aestivum
  Clone ID: PAT_TA_67186
cggcgtgacctccatgcaaaagggtggcgcagccttcaagccttcggcaacattgccttcgcctactcctactccatcatcctcatcgaaatccaggacacggtgaaggcgccgccgccgtcggaggcgaaggtgatgaagaaagcgacggggataagcgtggcgacgacgacggcgttctacatgctgtgcgggtgcatggggtacgcggcgttcggcgacgcg

SEQ ID NO: 67187 - DNA, 170 bp, Triticum aestivum
  Clone ID: PAT_TA_67187
agcacgtacgcgccgcagatcgtggacaccatcggcgccggcgtggagaagctggtcgcgaatgggggccgtggacgtggtggtgccgggggtgctccccatcggctgcttccccatctacctcaccatctacggcacctccagcgccgccgactacgacgccctcggct

SEQ ID NO: 67188 - DNA, 557 bp, Triticum aestivum
  Clone ID: PAT_TA_67188
ctccccactgtccgtgcgctccggccagctccctgtcgcgctcgagacctcctctagtcttcccgccgaggccttccctgtgaccagcctttgacttgggtctcctgtccgcctcggcgcggacgcccgccacgacgccggcggcaagcggcgacgcgtgcccggcgatggagaacggcaggataagcggcgagacgcgtggtgctgagccagtcaataaggaataagggccgcgggcatagtttctaacaaatttagggggggtttacgcaaaaacgaaacgtttttccaaagtgccacttaaacagggactgcgggttaatttcaaagaaacagaggggctttttcgcaaaaacaccgacgacgtacgaccagaagcactccgtgctttattagtactagcaaaagggcccgtgcgttgcaacgggagaaaaaaattcataatttcaaatggtcatgatcacatttcgttgcatcaccgagatacaatatctctctcaatttctcgaaatcataaacattttgaaattatgaacaatttgttaaactcatgcaca

SEQ ID NO: 67189 - DNA, 563 bp, Triticum aestivum
  unsure (1)..(563): unsure at all n locations
  Clone ID: PAT_TA_67189
ttccctctccaatcccccttgtccgtgtggtttaggagcaccgcagnaaacaacaatggagatgggtagcttccccttcttctacgtcgccgccatcacctttctcaccgcccttttgctccgctccttcctcaccaagaagcggcgacggctgccacccggcccggcgctggcggtcccgttccttggccacctccccttcctcaagaagccgctgcacgccacgctcgcgcgcctcgccgcgcgccacggcccggtcttctccctccgcctcggctcgcgccccgccgtcgtcgtcacctcggcggagctcgccagggagtgcttctcctccgacctcgacgccacgctcgccaaccgcccgcacttcccgtccgtgcgggaggtctccttcgactacaccgtgctcaccctcgccaactacggcgcccactggcgcgccgcgcgccgcgtcgccgtcgtgcacctcctctccgcgcgccgcgtcgacctcatgtacgacgccgtcgtcgcccgcgagctgcgcgccctggtgcgccgcctcgcgcgccttaccgccggcg

SEQ ID NO: 67190 - DNA, 452 bp, Triticum aestivum
  unsure (1)..(452): unsure at all n locations
  Clone ID: PAT_TA_67190
tgatggtgggcttcttgttgtagcgggcgagcttggcggcctcgccggcgagcttctcgaagagtcgttgatgaaggagttcatgatggacatggccttggaggagatgccgatgtcggggtggacctgcttgagcaccttgaagatgtagatcttgtacgtctccacgctcttcttgcccttcttgcggcccctcttctcgccgccctccttggaggcggtcttgcccgccggcagccgcttctcggccttgggcttcttcgccgccggggccttctcggccttctccgtcgtcggctcctcctccacgggcttcttcgccgccggcttcttctccgccttgggggccatcgatgcttcgggttggggggattcnctggtgggcggtgagcgctggaactggaagaaggtggggaatttgtttggaaggaggagcggtgctgctgggttta

SEQ ID NO: 67191 - DNA, 450 bp, Triticum aestivum
  Clone ID: PAT_TA_67191
ggcttaacctcccgtaaacacgctatctctctctctccctttctcattgccaccatcaagccaggatgaggtcgttctacaagatgctactactttcgcttgcccttgttgcgctgctatcctcagatctgatgattcaggcgacggctaatggtggcggctcgctaatccctgaagactgccggcagaccccagtcatccctgggccgtgtaaccccaaggcttgtctccgcaactgtcaaatcaacgttggccccggtgcggttggcgattgtgatgctggcggatgccggtgcacatactgtactgcatctcagcggaactaagcagtgattgttgcttaatttttctcagtttcgataatatgcaaaatgttgggttcaaaaaaaaaaaaaaaaaaaaaaaaaaaaaaaaaaaaaaaaaaaaaaaaaaaaaaaaaaaaaaaaaaaa

SEQ ID NO: 67192 - DNA, 599 bp, Triticum aestivum
  Clone ID: PAT_TA_67192
ttttttttttttttttttgtgaatagaaacttgtattactcaaactccaacaatgttacaatctgaagcagcaagttctaaaactctgggaggtccagaatctaaccaagtcatggttctaccttcctctctagcaaaaatagctaaacaatcactaactttattttggggtctacgaatatgggtaatactagtctcccgaagactcatcatccagtccggaaacagaaaggactttttatattcgaccagcatctttacaaatcaatcgttgccagcttcgtgattcgtagaattgtgtacactcgctaaccaggctatacagcaagtggctgactatagtacattggtgcaaattttgtgtcatgttctaccttctagctaaaacctaagtttcattcattctacgatctttctgaagctgcctgacgaacaagcctgagggactcagcaaagtcatccaatagttgatgagagttcgggaattgttcatcgtccaccgcaaggacaagcttcatgatgttcatgtaactttgaaaatgcacggttaaagcatgtggatgcccgtagacacttgtggcaatgtagacgatcggatg

SEQ ID NO: 67193 - DNA, 670 bp, Triticum aestivum
  Clone ID: PAT_TA_67193
tgccgccaatttgtgaagaacaaaaaaaccaaacgttggagctgttaccgctgcaagcattattggttttgggttaataatgctcatggtgttgttactgatttggaggaacagattcaagtggtgtggtttgcctttgtacagcaatgaaggtagttctgctggcatcatagccttcagatacactgacttagttcgtgctactaaaaacttctcagaaaagctgggaggaggtggttttggttctgtatacaagggagtattaagtgactcgaagactaccgtagcagtgaaaaggcttgatggtgccaatcaaggggagaagcaattcagagctgaggtgagctcaattggactgatccaacatatcaacctagtcaaattgattggtttctgctgcgaaggtcatcacagattacttgtgtacgagcacatattcaatgggtctcttgatagtcatctatttaagaagagcaataatgctgatgctgctgtcctaaactggaacaccaggtatcagataaccctaggagttgccagagggttgtcctacttgcatcagagttgccgtgaatgcatcatacactgtgatgttaagccagaaaacatacttgtggacgcatcctttgctcccaaagttgcagactttggattggcagcgtttgttgga

SEQ ID NO: 67194 - DNA, 551 bp, Triticum aestivum
  unsure (1)..(551): unsure at all n locations
  Clone ID: PAT_TA_67194
tctcggcagtcatttcttctgcagagatttagggaaaatctgatactcctctggtccagaagatcaaggaagcgcttccaaggctccctcagaatacgattgctgaagatcaaacactcatggaatgggcacaagattttaaggaccctgaagttacccatcggcacctgtcacatctcttcggtctttatcctggtcatactataaccatgcagagaaatcctgagatttgcgaagctatttctaatagtcttcacaaacgaggggaagatggacctggatggtcaagcacgtgngaagatggctttgtgggcgcgccttcttaacagcgaaaatgcatacagaatgatcctaaagttaatcacgttggctccacctggtgaaaaagttgggttcgaaggaggactgtacaccaatctgtggacagcacacccaccattccagatcgatggaaactttggattcgcagctgcgatcgctgaaatgttgcttcagagcactcccactgacctgcatctactgcccgcgcttccacgcgacaagtggcctga

SEQ ID NO: 67195 - DNA, 571 bp, Triticum aestivum
  Clone ID: PAT_TA_67195
ttgtgcgctgtgggcttttctcacaatgggaggaaagctctgatgaagatgaagatgaaggaggtgaaggaaagaaagagacgccaaagaggagcgatgttgacccttatgctgaagcagccatgagggagtaccctcggttctttgagttcattccccagagaccacattacagagggttggtgaacaccagtgacactatacgagatctggtctgtagtggactgtggttcatgttggttggcttggctagggaagtgctcaagacatcctgtgatacagaagctttggaggttgcatatttgatgagaaaagctcggcaactggaacgaaatgggttcaatgtgaagcatctcattgcccgtctgagggagccacaggcccggcttagaaggcttgaggattccagggcaaggctcgaggatgcccggaccaaagagcaagaaccaaaagatgtgaagtcactctcaagccatctgagtaatctgaaacacaatgtcctaacaatgcagaggcacttggagggaaaaaagcaagctcgtagtgcatctgtgcgtgatgagtcgagcga

SEQ ID NO: 67196 - DNA, 592 bp, Triticum aestivum
  Clone ID: PAT_TA_67196
ctgctccatctactaccgtataaatgcttcatagaattgtccattggatggcacagtatgtacaatttttagctagcagctgtcaaggttgccttatccaacatcagtatgttagcctgttatatagtaaaatttgcatgtgactgaaattttcaagtgagctcctcctgttcttatcatcattaggctaattaattaaaagctagaacggtaataatatgattattgctttgttgcatgtccattgccaaatgctaactatggttctgtgcatgtatttttctaactagtggaacctatagcactattaatatcagtagtctgcttatggattgaccagacatttatgagtaattattgattagcaaatttcctttgaatattcagactgccataaaatctccttcattacttggtaatgactattatccttcttcctagcacttggcaatatatgtgtcttctaatagacatttcaatccttgtcacaaaagatatctttttgccccttagattacataacatcttaagcttttccattgatttattggtcttactttgcttgttggcgttactgctggagatgatgaag

SEQ ID NO: 67197 - DNA, 571 bp, Triticum aestivum
  Clone ID: PAT_TA_67197
catttgctataacaattacatcgtttatgagattgatacaatttcactcaacggctcctcaaaccagtcaacagtagaagaaaatttagctatcttggcaagttcatgagcaacctcatttgcttccctattacaatgttcgaacctagtaatgggaaaaaccacaagccaaaaaatagcaatcgtcaaacactgccaccgctgtacttgccgtgcttccgtccttcctccgttattcatggtttcaatgacctccaaattatctgaattaataacgaggcgattgcatcctgcccttttagcaattgatagtccatacctaagcgccaaaggttcagccattaggacatccgtgcaccaatcaattcttcagttcccctctgcaataaatttttctttatcatccctcaacacagtacccgccgtgcccctaagcaggtcatgatcaaaagatgcatccacattaagtttacaaacccccttggaggtttgctccacctccctcttttcataatagcctttggggctatagccataggatagtttaacgtaatagcccgaatccccatag

SEQ ID NO: 67198 - DNA, 526 bp, Triticum aestivum
  Clone ID: PAT_TA_67198
ctgtgcacggtgacggaggtggaggagacgaagcagatcatgaagctgatccctctgctggtgaccatgttcgtgccgtgcacgctgatcgcgcagaccaacaccctgttcgtgaagcagggcaccaccatgaaccggcacatgggcgcgggcagcttcgagatcccgccggccagcctcggcgcgttcgtgacgctcaccatgctggtggccatcgtcgtctacgaccgggtcttcgtcaaggccgtgcggaggtacaccaagaacccgagagggatcagcctgctgacgcggatgggcatcgggctgctggtgcaggtgctgacgatgggcacggcgtcgctgatcgagagccagcggctgagctacgcgcggagccacgggctggacgtgaccggcggcaagctccggctgagcatcttcgtcctcctgccgcagttcgtgctgatgggcctggcggacgcgttcctggtggtgggcaagatcgagttcttctacgaccaggcgccggagagcatgaagagcc

SEQ ID NO: 67199 - DNA, 554 bp, Triticum aestivum
  Clone ID: PAT_TA_67199
gaacgatgactgtacccgacatgttgtccgtgctctgctccgtaagtgtggctatgaagttatctctgctgagaatggattgcatgcatggcaatatcttgaagatgtgcaaaaccgtattgacctggtattaaccgaggtcgccatgccttgtctatctggcattggtctgctcagtaagatcacgagtcacagtatttgcaagggcattcctgtgatcatgatgtctaagaatgactcgatgagtacagtctttaggtgtctatcaaagggagcagttgacttcttagtgaagccgatacggaagaatgaacttaagaccctttggcagcacatatggaggcgatgccacagttccagtggaagtgaaagtggcatccatacacaaaaatgttccaaaccgaaggctggtgatgaatatgagaacaacagtcatgatgacgatgacgattgcggcagtcatgatgacgatgacgatgacgatgatgatgccgatgacgactttagtgttgggcccaatgctagggatggcagtgataatggcagtggcactc

SEQ ID NO: 67200 - DNA, 513 bp, Triticum aestivum
  Clone ID: PAT_TA_67200
ggccgccttatttctaactctccccataaatctgctcgggaagaagcggcgagggctgatctcgtggaggcggaggcggagcagcagccaaggacgcctctgcttcgaagtctacccccgttctccctccatgcgaacgccggcgagatcaagcgtggcggcgcgcgggaatccggtcgcgaatctaagcattaagagacacctaaggcgggagagctgaggccggcggcgccctccacttaagcgccatcggctgcgcgacaagagaactcctacccgtccgtgggtgtgggggatgcagatccccgtcgctagcctgcacaaggccacggttgatgcgccgacgcaggggtcaccgccgtcttcgtcaggtgactttttcatgccatttatacatctgaaaagtagagaataccctctaaatcaaagcaacagatttgtggatttgtggaattggtgttgttccgtttccacctggccaatcatctttggtcactgattctgaggtacgtg

SEQ ID NO: 67201 - DNA, 176 bp, Triticum aestivum
  Clone ID: PAT_TA_67201
tcgttgctaatctcggtcaccggtggttttgttttgtctacggcatcgggtgttgtgatgtttctcgctctgggttgccttcagcgttgagatgcaattcacacaccacataaaccatgtgttgtgctctttattggttcattggttgtggtagctgcggggctggcggccgcatt

SEQ ID NO: 67202 - DNA, 255 bp, Triticum aestivum
  Clone ID: PAT_TA_67202
tgttgaaaggaataattttgctaggatgaaaagattcagaatgcatgacatcttacgtgaattggcagttgacttgtgccagaagaactgttttggtgttatatacgaggataagtgtgggggttctctacagatggatggacgtcttttggtaatgcatagagtgaagaaggatattcaccagtcattttctatcatgcaccaccttcgaactgtcattatactggatggctgcatgccatcattcactctact

SEQ ID NO: 67203 - DNA, 322 bp, Triticum aestivum
  Clone ID: PAT_TA_67203
tttcctgactccacgtaacaacagggattattggaagtgtagtctgctttctcctctatgcagcaccaatattgacattcagaagagtgataaagaagggcagcgtagaagaatactcatgcataccatatatcttaactttgttcagcagcctcacatatacttggtacggtcttccagtagtgagctccggatgggagaattggactctgtccggaatcagctcactaggagtgctctttgaaagcacatttgtcagtgtatacatatggtttgcaccacgagagaaaaagaagcttgtcatgatgatggtgtctgcaat

SEQ ID NO: 67204 - DNA, 129 bp, Triticum aestivum
  Clone ID: PAT_TA_67204
tacaaattggcgtgttagcacttggtctcatcatcgatttattgatgaaccgtcttttgcttcctagtctacctgaaattcctactgatgaaaaataaacaacatatgctcatcttgtggctggactga

SEQ ID NO: 67205 - DNA, 380 bp, Triticum aestivum
  Clone ID: PAT_TA_67205
cctctcttaccgcttgcgcgttctttccccgcccgcacctccgactggtttcatgggcgccgcctggcccgcctatggaaaccggcaccatcacgcggccaaatctttgacgccaccatgcatggtcaaggggcaggaagcaggttaacacgactaaattcattgccgcgggagctgccaagggcggcggatcatcgtcttcggcgccaggggccagcgacggtcacgcacgacgacgtgtctgcgatggcggatggcggtcaagccagcgggatgggagacgacgagcagcagaaacagtcttgctccgcgccatgttgttgatcgctaacggcgcttgccttggagcccgactgctatcgccgcttcccgtcgcgacg

SEQ ID NO: 67206 - DNA, 410 bp, Triticum aestivum
  Clone ID: PAT_TA_67206
tggccggcctctcgcgccgcctctccggcctcctcggcggcgacaaacttgccgtcacgcctgccaaggaggaggtgactgcggggtcgcccaagtcgacgctgtgcgggctgcccaagtccggccaggagagccccaacagcggcgcctcccagggcaactcgccgccgtcgtccccgctggagcagcagccgcccgacccgtgggacgtcctctacgaggcggccgggcaggtcaacagcatcccggcgccgggcaacccctacggtttacacggccgcggtggctttctgccgcctgcgcggaaggcctcgcctcctccgccgccgcctcacgtgcctgcgccagccggcacggccgcgggcggcgtgtactaccacccgttcgcgcacctcatcacgcagcgccag

SEQ ID NO: 67207 - DNA, 136 bp, Triticum aestivum
  Clone ID: PAT_TA_67207
tggcagtgtccacagagaatttctgtcgtctgaaatgggacaaagcatacttcttaaatcctgaagaatacttttcaagtgttgcttctgagctgaatcatttggtcaattctgctgccaatggtcttagttctga

SEQ ID NO: 67208 - DNA, 381 bp, Triticum aestivum
  Clone ID: PAT_TA_67208
aacaacaagccgctgtagatattgtgtaatagcaacattaatgatctgcgaatgttatatttttttcttctttccttaatatctacatgaccaatgtgtatttttaatgatcacacatgcacatgtcacattaagaggttgagagtagctcaaaagatatgcatacatcctctaccttttacctagtgaaatatttctaaaaccataggggatgtcaggtgtaaatttcatgaagaactgttggtttttgtaattatttcgtgaaactttcattgtagggttctaggattggtgaataagcagggttgttttctttctttagtatctgcatgatcaagtcggtctgtacttttaatgatcatacctgcacatgtcacatta

SEQ ID NO: 67209 - DNA, 384 bp, Triticum aestivum
  Clone ID: PAT_TA_67209
gtcactattgcgcgtgtttcagtatgccaaagctgaaaacatgtgtggcaggtagttagaatagtgtggtgtgcgagctacaaatgggacacgtgtcacgctccggaggcgacggacgcccgtgctggatcagccggcagctcccaagcttttcccttgttctaaattggttaactgaagttctctcatgctcgtgaatatttggtctttgtgaagagattctactattagaataatgagatcactaggtggatcatttaattgcctaaaatgttttgcttttaagtgttttttattttccatgaaaaaagcaagtttgataggaattggctttaattggtgaagaaagtatgccttcagtattactttttctggttttctaac

SEQ ID NO: 67210 - DNA, 321 bp, Triticum aestivum
  Clone ID: PAT_TA_67210
tcaacgtcggcagcaggccccaacgcctcaacaccatcaccattggctgggaaccgtcatggggttatgggaatggtcgtatcattggcatctccttcgtctacgtcgaccagaatgacaaggaaatcacggtcggtccctggggcaagatcgaccgggaacactcccgggcaatccagatagaccaagacgagaagctgtatgtcgtgagtggcaccttcaacgacgccggcgtcacctcgctcatgctgaaaaccaacaagacagagcacgggcccttcggccatgcggcagggtccgccttcagcgtgcccctgaagc

SEQ ID NO: 67211 - DNA, 650 bp, Triticum aestivum
  Clone ID: PAT_TA_67211
ggggtccaatggaacagcaggagtgtggagaattaacgcactcgaggactctggaatatggatggagagaacgacagttgaagacatggatattgttgtccgagcacatataaagggatggaagtttctgttatggtttatgacttttttgtatggcattcatatctttactgatcattcaagcagtgctacacgcatttccattcagtgttagtgtgaattgctggagcacaatatgactcatgctcatctccatgtcaatgctaggaggagaaaaactacattcagaggttacggaatggcaatgggtgggttacctcccaggagcagatgactggcatggttagtgatcactaggccatgaatctcatggatcccatgatacaggtatctggtccagatccgacggagacaagcaaaatcgtgctgttgcttcttcttttgattgaaaatccaggtgaaacctttcaggaactcaggacgacacgcattgattatatttcattgtgatggctgctgccgacacagctactatgggtacacgcaacttctatttcgctcgtcaccggaaaccaccgcccagatccatctcttctcaaccatgccgacgtggtggttaggggtgcttacaacttgtgaggacctgcgtt

SEQ ID NO: 67212 - DNA, 517 bp, Triticum aestivum
  Clone ID: PAT_TA_67212
gaatccgcctcgaattccccgatccagcagcgcggccagccatccacatccccaccccacccgcgacgactccgccagagcgaaaaagaggacccttctcctctgctcccatccttcgtccccccgcccagcgccagatccctacccagacccagcggtaccccatcaccacccccgccttcctgccagtagtagatcccttatgagctggttggctgcggtttcacttcagtttgggggctactaagatgggtcagcagctgggcagagacaagattggatcaaacttaacagctgatgacatagcgagcgctttctacttctcgctcctgctctcccctgttgtctcctactgggattgcatcttccgcaagataagatactccttcagacccgagtgggtgtagcattctgcgccaaccgcttctgcactagttggtccgggagtaaatcggccggcccgtaggaagaaagcatctagacaggagtccaataactatgtactttgcagattttg

SEQ ID NO: 67213 - DNA, 641 bp, Triticum aestivum
  unsure (1)..(641): unsure at all n locations
  Clone ID: PAT_TA_67213
tggacctgctcgtcgtcaacgtgtccatgttctccccggcgccgtcactgtcggcgagggtggtgcgccgctacggcctccgggaggacgtgaaggtgttcaacctcaccggcatgggctgcagcgccaccctcatcgccctcgacctcgccaacaacttcttcaggacgcacgcgaacaaggtggcgctggtgatgacgtcggagtcgatcgcgcccaactggtacccggggaacaggcgctccttcatgctggggaactgcctcttccgctccggcggctgcgcctacttcctcaccaactcgccgcggctgcgcccccacgccaagctgcgcctccgccacgtcgtgcgcacgcacacgggcgcctccgacgaggcctacaactgcgcgctccagatggaggacgacgccggccgccccggcttccacctcggcaaggagctcccccgcgccgccgtgcacgccttcgtcaagaaccnccgcgtgctgtcgccccgcgtgctcccgctcccggagctcctccgcctcgcctacgccacgctctccgcgcgcttncgcacgcgcaccaacaagaagaagtcctcctccgcgctcaccatccggatgaaagccggggtggaccacttctgcgtgcacacc

SEQ ID NO: 67214 - DNA, 628 bp, Triticum aestivum
  unsure (1)..(628): unsure at all n locations
  Clone ID: PAT_TA_67214
gatctgctcccaccggcactgctcccgtcgacaccgccaccgagtccgctcctaccggtactgagtccgcccccgtcgacactgccactggcactgctcccgtcgacactgctactgagtctgcccctaccggcactgagtctgctcccgttgacactgctaccgagtccgctcctaccggtactgagactgctcctgttgacaccaagaccgactctgtccctacaggtaccgagactgctcctgttgacaccaagaccgactctgtccccactggtaccgagactgctcccgttgacaccacccagactggcgccaacggtgtctctaccactggtgctaccgtcccttacaccaccaagactgtctacaccactgccgtcaacacttacaccaagtgccccgactacgtcaaggactgccccgctggtggtaacggcccttacaccgtcactgagaccgttgctgtttctaccactgtctgccctgtgaccgangagtacccctccaagcccactggttactctcccgagaagtacaccaccaagaccatctactccactgaggtctacaccgtcaccaagtgccctccttccgtcaaggactgcccttacggatccgtcaccac

SEQ ID NO: 67215 - DNA, 680 bp, Triticum aestivum
  Clone ID: PAT_TA_67215
atgggggatcaaaatccctatcacgcctccattccccatcaggcctggcatctccatctccctcactcgaccccttctccacctccggccgccacggcggccaggcaggcgtggcggcgcgccaccagcacctccaccatcacccttcgcttcccatcaatccatcatccaacccgccagcacacaccgcgcctccactccacgctcgcgcgcccgacgagacgaggtgcctggtgccccgcgcgaccatccccacgctgctgttgctcttcccacgtccctgatgctgctctgcttgcgcccaaccttgctgttgctctgaaccttaacctgttgctgcttcttctctcaatctcgctgctgctctcttctccctaaaacagctactgctccttctcctcatgtccctgctgctgttcctcttctgaaccccagccgcagctctcttcttctctctcaaacttgttgctgctctttctcttctccctccacgcctgctgctgcttcctctcaacgcccctgctacttcttcttcttccacctactgctgcttctctttagatcctcaactcgctgctgcagtttctagctctctctctctttaattcacatgattcagtactatacaatatatgatttgttcaatttcagacttgtgtttttttagtggtacacatttt

SEQ ID NO: 67216 - DNA, 306 bp, Triticum aestivum
  unsure (1)..(306): unsure at all n locations
  Clone ID: PAT_TA_67216
gtcctgtgtgtcgcccacttactaagaacacttcaatgggaattcactggcaaaacctcttacaagnacagctattgccaacgaaagggactcactcctcatcgagctgatccacatgtaaggcaacaccgcccccctgcagctggaaggactagacgttgtcgccaacgcgctgaacgagttgatgaaagactcaggggtttagtcgcagttcaaagtgttatttacaatgtatctaggagggttctgggaaacaaagcagcaccattgtcgcgaattacttatctaattttaaccacattatgt

SEQ ID NO: 67217 - DNA, 204 bp, Triticum aestivum
  Clone ID: PAT_TA_67217
cgatgcgcttgcaaccaaaataagcttagtctcctcaagtacacaaatgatgaaatgtgggtgttcaatttatatgaagtattataaaatgtacttgtatggaaaatcatggttccatgtcggcgtgtcctaacatcatgaacgttctccgaataatggttgtgtctgatgaaagcatgctcaatcattgtgaaaaaagaccgt

SEQ ID NO: 67218 - DNA, 142 bp, Triticum aestivum
  Clone ID: PAT_TA_67218
cacctcaagccgtgatatctgccaaatcggacggagagagagataaaagagagagagagaagctgccgtaatccacctagtattatcatgttccgcaatgactggttgttgacctaagcatgggtctgaactctggtgtgct

SEQ ID NO: 67219 - DNA, 254 bp, Triticum aestivum
  Clone ID: PAT_TA_67219
aggccgagccgagccgagcacaccaaaaaggagaggaggaggaggaagaagctagagactcgcgcagctagagagcacggccgcgagaaaggctcgagcttttcttgctttcggcgccatggcgaggcggacggcgcagcggtgcgggctgctgctggtggtggcgctcctcgcggtggtcgccgtggcggacgaccgcggcgagaagtgcgcgggcgagtgcgggaacccgtgcggcgccccgtgctcctact

SEQ ID NO: 67220 - DNA, 511 bp, Triticum aestivum
  Clone ID: PAT_TA_67220
aggatgatatctgcctacagcctcgaagacaacgagctatggaaacgacatatagtaacccttgtgtctcaggtcacggtcgcgttgtacgtcttctgcagatggtggtccggcgagaaaacgcagctggcggcaggggtcgtgctctttatttttggcgtcctcagattcgctcagaagccatgggcccttaggatcgccagcttcaacagcctccagtccagcacggtgcccctgagaagggggcaaagagaatatacgcctacggaatatgtagaagcagcaaagaggtgcgtactggacacgaaggtaaatattgaatataaatacaatatggattgcatgttcgttgatcagtctgctccatactctgttcgaattgaagggttaacatctttcctgaagcttaaagataagcatgcatacagtgagttgcagaaggggatatctaatacatatgatggcatgtacaccagagttagatcagttgtcactggacttggcattagcg

SEQ ID NO: 67221 - DNA, 397 bp, Triticum aestivum
  Clone ID: PAT_TA_67221
gtgagttactgtacgcacacacgcgcacacacacacacacacacacacacacacacacacacacacacacacacacacacacacacacacacacacacacacacacacacagggactatggatcggaggaggatcagggtgctcctggtggaggacgaggagatccacagggttgtggcgagagcggtgctgagggcggccggcgtggaggcggacgaggcggagaacggcgccgaggctgtgcggcgcgtgcgggagcgcgtcggaggcgccggcgccggcgcgtacgatctcatcctcacggacaagcagatgccgatcatggacggccacgaggcgacgaggcatatccgggccatgggggtgaccacgaccatcgtcgccgtgtcgagcgaca

SEQ ID NO: 67222 - DNA, 543 bp, Triticum aestivum
  Clone ID: PAT_TA_67222
aggctgctcctgctctgcttcactagatactgagaaatcaggtgcgcgctttagctagcacgtaccgggcactgctctgtgagatcgtctgccggccatggtggggatcacggtgcccatgtccatggacaaggtcccactggtgaaatgcgctaatgcggcggcggttccgactgtcgacctgtcggcggcgggcgcggcggcggccgtggagcaggcatgccgcagcgtgggcatcttcagggcgatcaaccacggcgtgccgaccgccctcgcagacgcgctggaggccggcgccgcggccttcttcgcgctgccgcacaagagcaagctggaggcgtcggcgacccccttgggctacggcagcaagagcatcggccgcaacggcgacgtgggctggctcgagtacatccttctctccgtcgggtccggctccgtcgccgccgcctccctgccgccgccgctcggggcggcgctggaggagtacacggacgcggtacgcgaggtgggagcgcgcgtgctggagctcatggcggaggggct

SEQ ID NO: 67223 - DNA, 446 bp, Triticum aestivum
  Clone ID: PAT_TA_67223
aggggttcatgtgtgcgacgaacgctatctcacggaacaacaacggcggcttactatgctacaatcgacgtggcagcgacaaatctgcttgcggatctttgtctagaaatcggacaaagagccctcgtaggccgtgtgtgcatggacaatccggacatgtgccccagctactaccgcgatgagagtgtcgaagaaggtctggaaaagacaagacagacgatccagcacgtgcaaaagattgatccagggttcaatttggtttcgcctgtgttgacgccgcgctttgcaccgacttgctctagtgagtcgatgaaggggctggcaaagattcagaaggagctagatcttcctgtgcagacacacgtttctgagaacgaaggggagattgaactggttgcggagctgtttccggaatcagagtcatatacgcaactttacgatgaatg

SEQ ID NO: 67224 - DNA, 554 bp, Triticum aestivum
  Clone ID: PAT_TA_67224
aggctcaaatgtgtgtattcctgctgttgaattttagaatcagcactctgttttcttttcaagcatctctcgcaaccatctttgagaaaaattctttactaagtaatgatttcttcttttctgtagtattcctcaagtttatgaatgaactgatagatgtcatctactgcctattaagtaggctatgcaaaatatgttatcatgtaacttgtacccatgcatcagtgataaagctgataattttcattttatctcaagggtgctccgtccatttatctctttttatgttcagtagtgaagagggttatattcctaactatgcagagattattaaaggtgttaagttgcttctcataagtgattgggactatgagatcattaaagggcattgagccgctgcccacagggatactttcttttatttcttatatatttcaaccacttagttttgttgtctctaaaccatttttgatgactcaagttgatcatactattgtgagaatcttggccacgatcattctttatatcatgtttggatcatcttagaattcgta

SEQ ID NO: 67225 - DNA, 152 bp, Triticum aestivum
  Clone ID: PAT_TA_67225
aggcgcttcctcaagagagcagagcaaacccagcacgacaccctcatctccgaccaagatcaccgccgagcagaccacccgtccagcgccgccgatggattcgtctcaccacaaggtgatcggggtcgctccggcggcggcggagggagggg

SEQ ID NO: 67226 - DNA, 547 bp, Triticum aestivum
  Clone ID: PAT_TA_67226
gacatcaggtatctgaaaaccgagctcgccattattgctgctaaaatcgacgaccagcacaaggggcagcagcctagtgtcttgcagaacatatccaccgcagacatgcgcgatttggcattcgacatcgaggattgcctcgaccagttccttccctgtgccgcgtgcaagcgaggggccgtgtcaaaaggcgacttagtggactttgccattcaggttgggaaactcaagaagcggctggagagggccaagcagcagagaaccgataatggtgccaacggcaaccagcaagccatcgaccttgctgaccaattgcttgctattctagctgagcctgcagatcaggtgggcatcgaggaacccaagcaggagatcctgggtttgctcggtagtgagaagctcctggtgatatccatcgtcgggtttggcggctcgggcaagacccaactcgcaagggcggtgttcgactgcgatgaagccaaagagaagttccgtgcccgtgcctggcatacggcatcggagcacaaagatgggcttgagctcttgc

SEQ ID NO: 67227 - DNA, 431 bp, Triticum aestivum
  unsure (1)..(431): unsure at all n locations
  Clone ID: PAT_TA_67227
tctctgaattgattgcaaaaaaataaaataaaaaaaatgagcaattgccatccggnaaacaaaacgactgagcgaggcatgtattacggaggtatctgaaacggaaacattgatccaaacatggcctaagtggtagcctccggtaacgacctaatctcgtctctggccataacctcttcctctcaaaggttccgggccatgtacccagacatggtcatctgtgtgcgaaaatccggttgcttgcgcagggcccagctccttctccaccagcccttgattgtcatcgacgttgtgccagcaccagcagctcttggatcagtttgatgaaagcagagccaaacttcccaggccaatgggcaggtcagcatgagactggcagccgactcgaggaccacgaggagccggccgtggaggcggaggtggaggagaag

SEQ ID NO: 67228 - DNA, 584 bp, Triticum aestivum
  Clone ID: PAT_TA_67228
tcgtccactcgcgcctcgcgtcgccctcccgccgcccgcatcaccatcacgtgagccttcgcgatgctgccggcccgccgctggtagtatagtcctcccctgctttcctccgcgcggccggggagccagagagcgcgagctcgagaagcaagcgcgcaggagatggcgggagacgacgcccggaccggcgcggtggcgccggcggaggaggagccgcacgtggagcggcttccggccgacatcctcgcccacgtcctctccctcctcccctccttccacgacctctccatggccggggcagtgagccggcggtggcgccgcgcggtgggccggtcgctggcgacgcggcggcggctgagcctggcggggcagcgcaccggcgacgagtccaccgcgcgcctcgtccgcgccgccgtcaacctccgcgacctcgacatgtatgtgagccgatcggtcaatcgatcgcctgagcaatcatggccaatcaaacactcaattcccgctccacatccccaattatagcttaatcatatctttctaactctctccgcccgttcttggagttcacgaagctgctgggggtg

SEQ ID NO: 67229 - DNA, 585 bp, Triticum aestivum
  Clone ID: PAT_TA_67229
aagtgagtgagcatctcacttcgcattggtcggaagcaagggcacaccagccagctgctccccgccgccgccactctcctcccccatcgccgtcgccggacgccatggatccgcccctctgggtcgagcaactcatgcactcctaccttccagcctccccggtttccgccaccggctccctctccgcctccacctccacctctgaccaggacggcggcggcgaggaccgcatcagcgctctcccaaacgacctcctttgcaatgtcgtctcccgcctccccgtcaaggacgctgcccgcaccggcgcgctctcccagcgctggcgcggcctctggcgcgccgccccgctcgtcctcgacgacgcccacctcctcccggacgccgccgcggcgttccgcgtcctcgcctcccacccgggccccttccgctccgtccggctcgtccacaacctcatcgacgagtccaacaaggacgcgctcctcgccgagtggctccgcctcctcgccgacaagggcgtggaggatctcatcctcgccaacgacccttgctcccgtggagcgatgcccgtgcagctaccgccgtccc

SEQ ID NO: 67230 - DNA, 418 bp, Triticum aestivum
  Clone ID: PAT_TA_67230
gacctccacttcatccctctccccacgccctcgccttgctccgcccttgccgtcgtcccgcggcgagcagctccagtagaacaccaggaggccatgggcgctaccccttccgagctcgacgacctctaccctgtagacctcccgagccggtccagcgttgcctactcctgctggcgaccagcaggcaacaggggcggccatggccttgtagctcgtccccccccagctcggagatccgatccgcacctcccctagccggatctggaaccaggcgcctccccgcgcccatcccgttgttccccgccgccgtccgccacctgcagtccccatctcgtcgatcctgggatcaagcagcaccgcctcgccctgcttactgtcccgcccgcgccaaggacagagcccagcctctccttcccct

SEQ ID NO: 67231 - DNA, 543 bp, Triticum aestivum
  Clone ID: PAT_TA_67231
caccggacttcatcaagaacatgatcaccggtacctcccaggctgactgtgctgttctcatcattgactccaccactggtggatttgaggctggtatctccaaggatggccagacacgtgagcatgctctccttgggttcactcttggagtgaagcagatgatctgctgctgcaacaagatggacgccaccactcccaagtactcaaaggcacgttacgaagaaattgttaaggaggtctcttcctacctgaagaaggtcggctacaaccctgaaaaggttccctttgtccccatctctgggttcgagggtgacaacatgattgagaggtccaccaaccttgactggtacaagggcccaaccctgcttgaggcgcttgaccagatcaacgagcccaagatgccctcagacaagcccctccgtcttccccttcaggacgtttacaagattggtggcattggaactgtgcctgttggccgtgttgagactggtgtcatcaagcctggtatggttgttacctttggtcccagtggtctgacaactg

SEQ ID NO: 67232 - DNA, 466 bp, Triticum aestivum
  Clone ID: PAT_TA_67232
tcaatatctacatggcccagaaccagctaacacgggttcctggtgccatcttcgacttgacctatctcactattctcagtctccgccacaacaaactcactgaactcccacctggtatcggcaaattacagcatctcaaggagctcaatgtgtcacaaaaccgcttgcgacatttaccagttgagttgttggatctatttgtatcaaatagtaaactcgacacactcgttgttcatcccaaccccttttggcaaccaaaacgagccctagaacagaccgaggagaagtccgataatgtgctcttttctcacacggaatcagaaccttcttctgtgccacatttggtgagtcgattgttgggccggtctccttcgcaactctcggatactacagggcgagtcgtctcagacttcagatttccaacagaccaccggaaactcgtattgcctgttgatgagggagaacc

SEQ ID NO: 67233 - DNA, 428 bp, Triticum aestivum
  Clone ID: PAT_TA_67233
ctcgccctcaacccatggcagaatttgacgtatcgccaaccaagtacagcaaaatagaagactcaaaagcgaaggataagccggcgtcagtcaagtccagatggatgacaaagaacaagcgtgttaggcctcagtcaatggatttagatcacacatgatgacccccagtatctggaacatcaaccccaaccaggacagcaacccgctactcaagatacggatagagcttcagccaagattgctccttctgaccaatccatcgccgagtcagaaacgtcagctaaagcctctggcaacctcctactaccgtccttctccagcacataccgtatgaaggacaacccatccattgtgaagcagctgacacaattcctgcttcgcacgcagcaaacacctcccaaccatgtcttccgagcggacaagcctcc

SEQ ID NO: 67234 - DNA, 168 bp, Triticum aestivum
  Clone ID: PAT_TA_67234
cccttggtcgggcatggagggagttcggcgagttctcagccgtggaggtgctggtggtatggttgtgtgctcctggctgtgcgggtcttgggagggacaccgacttctcggctatgatggcgaagtgctgctgcggcggcggagtggccaacttggatgctgtggccc

SEQ ID NO: 67235 - DNA, 363 bp, Triticum aestivum
  unsure (1)..(363): unsure at all n locations
  Clone ID: PAT_TA_67235
ggcggtggaacagagcttgcgtctgtgcgggcggccgagagctgggaaggccgggcccgcgccctcctcccatgctctccccgcagatcagggccccgccggtgaggtcctcacggccaaggccgaggagaagggaagaaccacggtgggaggaaggagcagcgaggctttccggtgccgtcntggtggagtggacctgcaactgggttctctactggtggtgttagagatttcaaggatgtgggggatctggtttcacgagtgtgtgctgctcctataagttaactcaccttgtttcactttggacggggcctcgacgcgctcatctcggtctcctcgccccgggtcttcatcttccccatc

SEQ ID NO: 67236 - DNA, 403 bp, Triticum aestivum
  unsure (1)..(403): unsure at all n locations
  Clone ID: PAT_TA_67236
aagaagagcgtggagacgtacaagatctacatcttcaaggtgctgaagcaggtgcacccggacatcggcgtctcctccaaggccatgtccatcatgaactccttcatcaacgacatcttcgagaagctcgccggcgagtcggccaagcttgcgaggtacaataagaagcccaccatcacgtcccgggagatccagacctccgtccgcctcgtcctccccggcgagctcgccaagcacgccgtctccgagggcaccaaggctgtcaccaagttcacctcctcctangctangatgcttttctgtaatagtcagctgttcagaccatgtcttcctgtaacttgtgttggttctgtgggaacaccctgtttcattacctcatgaaataaaaaaaaaaaaaaaaaaa

SEQ ID NO: 67237 - DNA, 625 bp, Triticum aestivum
  Clone ID: PAT_TA_67237
atcgctatctctaccaccatttgccccgtgaccgagcagcagactaagcctcaagccactggtcctgagcccactggtcctgagcccactggtcctgagcccactggtcctaagcccactgagcccaagcccaccgagcccaagcctaccgagcctcatgctaccggacctcaccccactgagccagccaagaccacaggttacactacctcaactgtctacaccaccagtgtccgaactgtcactacctgcgctcctggtactcccgattgccccgaaggtccccatgttgtcaccgaaaccattgctatctctactactgtgtgccctgttactgaggaacagtctgcccctaccaagccttctgaacctgagcagccccagcaacccgagcagcctggacagcccgagcaacctgctcctaccaagcctgctggcggcaacgagcctcactacccagttcccacccagcacatcgtgaccaccggctactccacttctaccatctacaccaccgctatccgcaccgtcacagcctgtgctcctggtacccctgactgccccgatagtccccatgttgtcaccgagaccatcgcgctctctaccactatctgccctgtcacca

SEQ ID NO: 67238 - DNA, 360 bp, Triticum aestivum
  Clone ID: PAT_TA_67238
ctctgctccttgcgctgagacccgtgagctcctctctcgccatcggcctttctgcgagcactccacgcacgatccagttccaatttccaatgggctcgtctccagctccagatgatgccatcaggcagcacctgctggacgtggactgtctcgccgccgacggacccaagatgcgggtgcgcgggctgacgctgcggccgccagggcccaacggcgagcagacgcgtgcccgggtcggacctggacgtgccgcgcggggtggtgatgggcgtcatcggccccagcggtagcggcaagtccacgctgctccgcgcgctcaaccggctctgggagcccgcccccggcgccgttaccctcgac

SEQ ID NO: 67239 - DNA, 374 bp, Triticum aestivum
  Clone ID: PAT_TA_67239
cagctcaggcgcgtccacgcctgcgatccgatctaccccgaggacctccccgaccgccgcttcgcctacggcctcgccgtcggcgtcgccggggaggtgctgccggagacgctcgagcggatgattcggctctgccgcgcggtgctcgtggacgcgcaggcgctgatccgggccttcgacgccgaggacgacggcagcggcgctgccgtctgccacgtggcgctggaggatacgccgtacgcacggcttctgcagcgagtggcgttcctcaaggcgtcgtcggaggaggcgccgtacgtgggggtggagacggcgagacggcgctgctgcgtgatcgtgacggaggggaaggatgggtgccggctgtattggga

SEQ ID NO: 67240 - DNA, 490 bp, Triticum aestivum
  Clone ID: PAT_TA_67240
gccgccatcgtctctttcctgctgcccctcgtggcagcaaagcctgcccagaagggcaagactttcagcaatgttgagatctttgatcctcctaccaactacagagatccccaggtcctctacgcccgtcctcttgagctgtcagatggcaccctgctcggcacctgggagaactactcccccgagcctccagacgtgtggtttccaattgtgaagagcaaggacggtggcaagacttggaaggagatttccaaggtcaaagacacccataacaactggggtttgcgataccagccccagctttacgagcttcctcgtgcctttggaaagtaccccaagggaaccgtcctttgctcaggcagcagtatcccttcggatcttagcgagactctgatcgaggtctatgctagtcgcgacaagggttacacttgggagtttgtcagccatgttgctcttggtggcgaagctctgcccaaccctggcctcactc

SEQ ID NO: 67241 - DNA, 364 bp, Triticum aestivum
  Clone ID: PAT_TA_67241
ccgcggccttccagccgcgcctctcgcacagccacccgcagccgcacgcgcacggccaccagcgctgcgacagcgaggcgatcagccgcagcggcaggcagccccgctgcggcgaggtggccggcggcacggcggccgggtgcgccgccgtgtgctgctgcttcccctgcgttatggtggaggtcgtcgtgctcgccgcgggccgcgcgcctgccgcgctctgccggcgcgcggtccgggcgcgccggcgccgccgctcggcctctgcggggcaggcggtggacatgtacgagctgctcgtcgacgacggcaccgtggccgggcccggcgacgcggcggtggtctggcccgcgggtcagccgcc

SEQ ID NO: 67242 - DNA, 463 bp, Triticum aestivum
  Clone ID: PAT_TA_67242
ccccaaaccctaccgccgccgccgccgccgccgccgatggcgaagcgcccgcgccggtcctactccctggagtcccgcgtgcgccgagttatcctatcggatgccggcctcgccgtccctggctcctccgccgacgacgtcgcccgcgccatccgctcccgccaccgcgagtaccaacgctacaagttggagttattcgcctccgttgtccgccgggccatctcctccctacctcctgccggcgatgcctgctccgacagtgcctcccccccctcccgccgctgccgcagtcatgacaccacatcgtcctccaccaccctctcgccgccttcccctgcctttgacgtgacgaaatcgctgctacgttccagctactcctcccaaaaatccaaacgagaccccgacgctaaccagcagctcgagatggaggtcaccgcggagaaggttatgatgcctgacgctg

SEQ ID NO: 67243 - DNA, 152 bp, Triticum aestivum
  Clone ID: PAT_TA_67243
atcccttcgagcagcagcagcaatgggcgcccaatcccctccatgcgttcgtgctctccgcctgggagttgctctgttgccaggttcaggaagagctatcttgtgcacatgagttgctattggcagtggacaaattatctatgcagagagct

SEQ ID NO: 67244 - DNA, 463 bp, Triticum aestivum
  unsure (1)..(463): unsure at all n locations
  Clone ID: PAT_TA_67244
tgcacccgccgccgccaccttccctcccccaccacaccctggggcatggcggtcgtggagccagtgcccgggggcgacgtgaagctcttcaaccgctggaccttcgaggatgttcaggtgaccgacatctcgctgaacgactacctcgcggtgacgtcgatgaagcactactctttcctgccgcactcngccgggcggggggcggccaagcgcttccgcaaggcgcagtgccccatcatcgagcgcgtcaccaactccctcatgatgcacgggcgcaacaacgggaagaagatcatggccgtccgcatcatcaagcacaccatggagatcatccacctcctcaccgacgccaaccccatccagatcatcgttgatgccatcatcaacagtggtccacgtgaggatgctacccgtattgggtctgctggtgttgtgaggagacaggctgcggatatctctcccc

SEQ ID NO: 67245 - DNA, 440 bp, Triticum aestivum
  Clone ID: PAT_TA_67245
cttgctcgcaaccacggcactcttgcttgccggcggcgcggcaggcaaggctggcccgccagctggcggccacggcaccggagccctgccaccgctacctcccgcggcagctcctctgcggcgggctcgtggcgccgtcgctctcgtggggggcgaagcccaagaccaagagagccagggcgccggagcacgcccaccggtgcctccggccggagctcctctgccgcgctcccgtggcactggagccctgccaccgctacctcccgctgcagctcctctgcggcgcgcccatggcgccctcgccctcgtccttccagaattcaaaggccaagaaatccagtgcgccggagcacgcccaccgctgcctccggccggagctcctctgccgcgctcccgtggcactggagccctgccatcgctacctcccgctgccgctcctc

SEQ ID NO: 67246 - DNA, 482 bp, Triticum aestivum
  Clone ID: PAT_TA_67246
ggaacaatgtcaccggcggggtgatcgcgcactggaaagcgctgcggagatggtgttggcgaactgctctatgtacgtcaacaccgacagagcggcgcgcgaactcggagtggaggcagaggaggaaccttgagaaggtgatcaacgacatggcggtcggcagcctccggtgcatcggcttcgcctacaagcaggtcaacagcactactgagcaatcgaagatcgacgacgatggtctgacgttgctgggcttcctcgggctgaaagacccttgccggccagaggtcaaggcagccattgaagcttgcacgaaagcgggcgtcgccgtcaagatggtcaccggcgacaacatcctcacggccagcgcgatcgccaaggagtgcggcatgatatccagcaacgaccccagcggcatcgtcatcgaggggcacgagttccgcgccatgtcgccggagcaccagctggatatcgtggacaggatc

SEQ ID NO: 67247 - DNA, 366 bp, Triticum aestivum
  Clone ID: PAT_TA_67247
ccatggaggaggacctcgtcctcgccaactacgtcgccgccaacggcgagggcgcgtggaacagcctcgcccgcgctgccgggctgaaccggacggggaagagctgccggctgcggtggctcaactacctgcgccccgacgtgcggcgcggcaacatcacgccggaggagcacctgctcatcgtggagctgcaggccaggtggggcaaccggtggtccaagatcgccaggcacctccccggccggaccgacaacgagatcaagaacttctggaggaccaagatacagaagaagcgcagcggcggcgccaccgccagcgacagcaccgggtgccagcttccgagctcgacggcggtgaccgagtccc

SEQ ID NO: 67248 - DNA, 452 bp, Triticum aestivum
  Clone ID: PAT_TA_67248
ctaaagtgattcaggaagcggatcagagaaaaacggatttggcgagaagcagcatagcgccgtgcgatgtttacgatgggaggtgggtgttcgatgagagctatccactctacgcaagcaatttgtgcccattcgtagaccaagggttcagctgtgaagcaaatggaagaaccgaacaaaagtgtaccaagtggaggtggcagccaaggcattgcaatatccctaggtttgatgctaggaaaatgcttgagatgctgcgtggaaagcggctggtgttcgcaggggactcccttaacaggaaccagtgggagtccatgatgtgcttgctgagagaagcagtgtcagaccccgcaaggattcatgaaacccgtggccgcaagattaccaaggagagaggggattacaatttcaagttcctggactacaactgcactgtggagtaccatgtcacc

SEQ ID NO: 67249 - DNA, 467 bp, Triticum aestivum
  Clone ID: PAT_TA_67249
ttaccccggtctgggcatgccaatttcgaagaaaccgggccagcgaggcgattttgtcatcaagtacaagatcaacttcccatcaagtttgactgcagaccagaagcagaagttgagggagatcctatagaggctcgccgcgagcgaaaacatttgcaattctggccggatactagagatgtgctggaattttgttcaagccagcaacatcaagattcggttgcaaaagcttgcattacacatgattggtgttatggcgttgggaactttacgaataatgaaaagagtggaagtctgatgaatggacctcgtcccttgaaggagctcaggttgaagaatacaaagttataggcggatgaaagggagttgattagcatgtggcctttgatatccatttgatggttgtttaattagtagtacttatgtcttatatagctgtctaatattgaggcaggtttgaacattcg

SEQ ID NO: 67250 - DNA, 470 bp, Triticum aestivum
  Clone ID: PAT_TA_67250
cctccctcaacgctaacccgtctccacaccacgaccgccaccgcccgtcgtggccgcccccgccacctcccgccgcggccgccgcctcagctccagccgtggccatcgcgcccagatccagccgcggccgccgcccccacgtcccaccgcggccgctgccctgcgcgccaacgaccccttcccccgctgctgcgccacaggtccacttcgccatgagctccagcgccgacacatcccgccgcttctcgtgatcccctcttccgtcagctccacttcaccggaaccgcggccggcgggcgacgcgaggcgcggtggcggcgcgaggaagacgggcagatccgggcacggtgtcgatcgatctggcggctggtgtggcggcttgttccagtgccagcggcgtcctgctcatccagagaacgagagagaagggcctgagggagagaggaaacagaggaagaaagaagaaggag

SEQ ID NO: 67251 - DNA, 318 bp, Triticum aestivum
  unsure (1)..(318): unsure at all n locations
  Clone ID: PAT_TA_67251
tgggtttatgacattgggtggcagtataattctcatgctgacgacaattatttttttgacgaggattcagtggttgtctgtggcatgtggttttgatcatttcaaactactccagagcatactgttttgctctctcctaacagtgatgcctttcagttcaactaggaactcatcattattggagtatttcatctgtntataccaaagcaaggcgggagaagaagcanattgattgatgaaggaaacacatgaaaaagaggaaaagagcacctaaatgattgatggggcctgtgacctatccctgtcggttctcctttc

SEQ ID NO: 67252 - DNA, 539 bp, Triticum aestivum
  Clone ID: PAT_TA_67252
gtgaaaattcccctcgagtagtgggagctgctgctgttgcatttaggtcggcttgtctgaatcgacggcctcagactccagccgatgcagttgcgaccctgcctctagatcagctcgccaaccaaccagttgctgctgtcttcaatcagtctccacaatccccgacaacctccggccgtcatcagcatcatgctccagccaccactcatcttctaccctgttcatctactaccatgtccgccatacacctcatgcaccaaccctagtgggttgagtacagcctcgatggctcatggaccacacactcctggcttgcttccagatgcttcatagttcatcacccacaaagctagctcccatgaagctatgactcgacacatgcaaccagtgggtatgttcgtgagatgcagatgaatgactcaaatttccgttcactatttgatgaccacatcaattcattgctagttactacaaaaacatttcgacgatggtattgcgaaagctgcagggataaattggaaccattatataataatacc

SEQ ID NO: 67253 - DNA, 582 bp, Triticum aestivum
  Clone ID: PAT_TA_67253
cctgtggtgcccctattaaccgaatacgtgaaggagctgcactccatggtgattaagcttggacgcctttcaagtcttcatgcagggaatcttcataaggctttagaagttcttgaagaaagtgaaactgggagatcacaggatatgccctctgcacgtccagatcttctgcaaagtgattcgtcagttgagaaggataaaagctcttctggaagcagggaaggtgtctctcaggatttggttattgatactgatggttctctacaagatgaatgttggatttctccaccagagcactcatatactagcagttcaggatgtacaacattgttgacccagcttacttcttctgagaatttggagaaaatagatgcccttttggacagcgggcctggaatagagggtcctgctgctaatagtcagcaagcaagcgatggtagaactgattcagaatcagactcaagtagcaataagcaggcgttttcaaacaatgtcacacaagctagcaatattcatgtggctgaaacttcttttgcggaggagggaagaattgaaactgaggataacactggagccttcaaa

SEQ ID NO: 67254 - DNA, 495 bp, Triticum aestivum
  Clone ID: PAT_TA_67254
gttgccggctcagctcaaggcggctatctcaaggacctctccgccccgtctggcttcaagtacgtcgagggctcgcgcccgtggaagctcgtcgagagggtcgacgtcgctctcccgtccgcgacccagaacgagctcgacgaggaggacgccaaggccctcgttgctgccggctgcggctttgtcgctgagggcgccaacatgccctgcacccttgaggccatcaacgtctttgaggctgcccgcaaggagaagggctccaagggcgtctggtacggcccgggcaaggcggcgaactgcggtggtgtcgccgtttccggcctcgagatggcgcagaactctgctcgtctccagtggaccgaggaggaggtcgacgccaagctgaagaacatcatgcagaccgcgttcaagacctgctacgagaccgctcaggagttcgccggcgagggcgagcttccttccctcgtctccggtgccaacatcgctggcttcctc

SEQ ID NO: 67255 - DNA, 377 bp, Triticum aestivum
  Clone ID: PAT_TA_67255
atgaggtatggcggtatctctccgaacggcatcacttttaacactttgattaggtgcatgtgcaaccagcgtatgtatggccgggcaatcaccttttggaaagagcaattaagaataggttggccaccatatgttatgacgagcaccttgcttgttgatcttgtatgcaaaaactgtggtcctaagcgtgccatggaagtcttgaatgaacttgctctggagggatgtcaaccagatgttgtcacctacaatgctcttatcagtgcatcatgtaaagcaggcaggctgaagtacgcaaagaccatcttaactcgtcttattgctgaaggccttgaaccaaatagtacaacctattgcatcttactccattctctctg

SEQ ID NO: 67256 - DNA, 294 bp, Triticum aestivum
  Clone ID: PAT_TA_67256
actttgtgctgaccaacttaccgatgtggggcgctattatatatggtggatggaaagggcatgaggacgagtcgatgggggaagaccaccatgatctctgttatttggcgctcaccgagcctcatcccctcggcgaggacgataatcttgatcatctctcgcttgagcaagcccacgaccttgccctcgagccgggcgatgactactcgcagggccctcttgccgttgccccagtcgtccagtcacggatgatggttgtgagcaccgagtttcagcttgtggtggggcaggagt

SEQ ID NO: 67257 - DNA, 396 bp, Triticum aestivum
  Clone ID: PAT_TA_67257
aggctgtttcccagctctttctgtgttggtgatagttggctatgaggaatgtgtaatgcagttcccatcatccagctcactgcagaaacttaccttctcatgtttccggggcctggttcttgtgcctgaggagaaggagaatggaggaggaattcaggaggacaactcattgctccaatcattaacaatagtgggatgtggcaaactcttctctcgttggcccatgggaatgggagaatcagagaccatttgccctttccctgcttccctgaaaaaacttgatgttttccaagagccaagcatgaagtcaatggctctgctctcaaacctcacgtctctcaccactctacagctaaactactgcagtaatttaacagtggatggattcaatcctct

SEQ ID NO: 67258 - DNA, 277 bp, Triticum aestivum
  Clone ID: PAT_TA_67258
agggcagcctcgaccagggatagataaggatagatcgggagtcagcttgggagagagagagagagggtcgagagagaggaggaatcgccagacacgatgggcgccaccggccaacgtcggctgtcatctctgcccgcggcggcggccgcgcccctcctgcttctgctcgtcgtgtcctcctggagccaggcggcggcggcggctccggtctggacgacggcgctggagaagcacgtggcgttcttcgacaccgaccacgacggcatcgtctccttct

SEQ ID NO: 67259 - DNA, 319 bp, Triticum aestivum
  unsure (1)..(319): unsure at all n locations
  Clone ID: PAT_TA_67259
agggagagagagagaactagtctcagttttttttttttttttttaaccaagttaacaggggttttattttactctgtgtatattgcgatatacaattatacatgatgagtgatgaattagcagcagatgccacttcagaaaaacagggggggtgatgcaactacaatgtcattttgacggctccgtgatcccatcaatgtgatcgtcactatgaggagcaaggattgaggttgcanaaaaccatgcctgtccaaccaagcctcctcttccatttccctcccccctcagttcacatggatgccatggccgatggagcttg

SEQ ID NO: 67260 - DNA, 506 bp, Triticum aestivum
  Clone ID: PAT_TA_67260
tcgtctctactgcccgtacccccatcggctctttccttggctctctgtcaagccagaccgctgttcaactgggttcagtcgccatcaagggagccgtcgagcgtgccggtatcaagcctgaggatgtcgatgaggttttctttggcaatgttctctccgctggtgttggtcaaggccctgcccgccagtgtgcccttggcgctggtctccctcaaaccgtcatcgccacaaccgtgaacaaggtctgcgcttcttcgctcaaggccatcatccttggtgcccagaacatcatgctcggcacctccgatatcgttgttgctggtggaaccgagtccatgtccaacactcctcactacctccccaacctccgaaacggtgccaagtacggcgaccagaccctcgtcgacggtgtcctcaaggacggtctgaccgactccttccagaaggaccacatgggtatctctgctgagctctgtgtcgatgaccaccacctcacccctgaggct

SEQ ID NO: 67261 - DNA, 482 bp, Triticum aestivum
  Clone ID: PAT_TA_67261
aggcttctttcccccgcctccttcttccacctccggccgccgccgcggccaggccagcgtggcggcgcgccacccagcacctccaccacgcgccaccactctcctccccctgcaccatccatccatcgcagccgcaccacttcgccatcaccagcatccaccatcatcgatccatccctccaccatctccagccaccgccgtacctcgcacgcccaaccagacaaaggggagcacaggtgtctggtcatccgcgtgagggtgcccccgttttgctgttctccttctcctgcgcccttctgcttgcttcttctcccgagtctactctgcttcttctcttcccttacctctgctattgctcttgcttcttcttcttccccacgaacctcttgcttcttcgtcaacatgacctgctgctgcttcttcttgcactccttgttgctgcttttcctctgaatcccctgctgaactgctgctgctccta

SEQ ID NO: 67262 - DNA, 527 bp, Triticum aestivum
  Clone ID: PAT_TA_67262
aggctcacctcaggccaaactctagccatgtcgtccgagtcgaccttcaagcgtttcgttgaggttggccgcgttgtctttctcaacgacggccccaacgctggcaagctcgcgaccatcgtcgagatcatcgaccacaaccgcgcgctcattgacggcccgtccaccggtgtcccccgccaggcgttcacctaccgccgcctggtgctgacgccctacgtcctcaagaagctccctcgcgcggcaggctcgaccactgtcaagaaggtctgggaggcgtccgaggttgaggccaagtgggccaagtccgcttggaaccagaagcgtgttgccgctgagaagcgccgcaacaccaccgactttgagcgcttcgaagttatggtcctcaagaagcagcgccgccgtcttgtgcaggctgccgccgccaaggccgccaagtccgcgtaaactccccccactcccttcctactcgactttcgcactctctgtcgacccggctgtggcgtgtaacgcggttctgaggttgt

SEQ ID NO: 67263 - DNA, 578 bp, Triticum aestivum
  Clone ID: PAT_TA_67263
aggcccgatccatcgcaaccgccgcaaacaccacacctcgagagtcctcgtcgccggagaagtagtagcaagcaagatggccggcaggaagggcggcgacaggaagaaggcggtgacccgctccgtcaaggccgggctccatttccccgtcggccgcatcgggcgctacctcaagaagggccgctacgcccagcgcgtcggctccggcgcccccgtctacctcgccgccgtcctcgagtacctcgccgcagaggtcctggagctcgccggcaacgcggccaaggacaacaagaagacccgaatcatcccgcgccaccttcttctcgccgtccgcaacgaccaggagctcggcaggctgctcgccggcgtcaccatcgcccacggcggcgtgatccccaacatcaactccgtgctgctccccaagaagtcccccgccgccgccgagaaggaggccaagtcgcccaagaagaagaaggccgccaagtcgcccaagaagaatgtcgccgccaatgagtagccgccaccatagcctagcctgcgccgagtaaccgtgtcgtgttgcctaattagttggatct

SEQ ID NO: 67264 - DNA, 566 bp, Triticum aestivum
  Clone ID: PAT_TA_67264
aggccaccgatctccaaaaatggccgcgcccaatctccccctcttcctccccgtggcgttcctcctcctcgcggcggcgccggccccctccgccgcggagaagttcgtcgtcggcggcaagaagaactgggccgccaacgtcaactacaccacctggcccgaccagtaccacttccacgtcggcgactggctccagttcaactacgccagggacatgtacgacgtggtgcaggtggcggacgcggcggcgtacgacaagtgcgacgcgagcaagcccctcgtcaaatacgaccgcggccgcggcttcgtgttccagctcaaccacacgggccgctactacttcatctgcagccgcggctactgctggagcggcatgaaggtcaccgtgctcgtcgaggaaagtcccgcgcagccgccgcacgccgcggcgccgtcgcccaacgcggccgcgcgccacggcgtcgtcgcgtgggccgtcgccgccgccgcggcctcgctctgcgcggcggttctgggtttgccgtttgcggtgtggctgtgaatgtgaccgtgtgagcggagggaag

SEQ ID NO: 67265 - DNA, 184 bp, Triticum aestivum
  Clone ID: PAT_TA_67265
aggcaaaaagctcgcacgcacgcacgcaccaccaacaccgcaccgctcctcctttccctcagacccacccacagccacaacagcatatatcatcagtccgttactcgtgtgcggcgccgccggctcctgtcttcaacgtacctacgtgccggccggcggcatggggaggtccccgtgctgcgag

SEQ ID NO: 67266 - DNA, 501 bp, Triticum aestivum
  Clone ID: PAT_TA_67266
agggatcgccaacgccacctcttcctccccaccagctccaccggcgagcccctatgctgcctacgcgcgcacaacctccgtaccctgctgctctccctgctggccctcttccctcgcccggatcgctgctctgcctcgaccggccagcgcaccgccataaccggccagcgcgccgccataatcggccagcccaagctcgcatcgcccgctccgtccgcgcctgcgacgacctcctcgacgccctactcttctgcgggccgaggtccttgctggcgccctccgtctcgtgctcgagccgccctccgcgcacccccttcccctcggctagatccgaccgcctgccatctcgaccttgcggcctctcgatgatctgctgcatgaacatggtggcatgctcttccaggacggttcatctccctccatctctctctcttcccctactctctctttgtcatgatttctttatctaaatctctctctctctctctctctctctctctc

SEQ ID NO: 67267 - DNA, 193 bp, Triticum aestivum
  Clone ID: PAT_TA_67267
agggctctgacgatgagggcctttctactggcgccaaggctggtatcggtgctggtgtcggtgttgctggtctgattgttatcggtggtcttatctacttctgcctccgcaagcgccgcaacgctaagaaccaggctgagtacgacgatgtctttggcgcatccgaggttcctgttggaggtcgtggtggtgg

SEQ ID NO: 67268 - DNA, 532 bp, Triticum aestivum
  unsure (1)..(532): unsure at all n locations
  Clone ID: PAT_TA_67268
aggaacaaccccaccgcccaataacacaccacaagagagaagaatctcaggtcctaatcgcacaggcgagaacgcgagcgagctagctccggcgaggcctggccggagccgcccatggagtacaagaggtcatcgcatgtggaggaggacgaggatgaggattgggcgatgagggaccgtcngtaccancatcancatccgcaccatcatcgccatcactacaccacggtgccggccacggccgcgcccccgcagacatgcacctgcacggccaagctccccaggttcttgactcgcttgccgcggctgccccttcgccctcctccttgatggaagccgccgctttctctaggcccctcctgctactgaatctggtttatatccattaaaaaacatgaaattattctcttgtgaagactaaacggaattgctggcgtcgttgcanaagatatcaagataatgctgatctggggcgatgaggacaagcttttcgacatagagctggccaagaagatgaacgagcagctgggcg

SEQ ID NO: 67269 - DNA, 618 bp, Triticum aestivum
  Clone ID: PAT_TA_67269
gtaagaccattttcttttcatcatattatattctgatgataggttcaaagcaaggatgcaacatcatcagtaatgagatgtgccctttttaccatattggttgcaactggttgagagaaattaaaggatttttgtatttcgtactatatctctaataatgtatctgcctaagttgtcagctggaatcagtgagtgatggacttgttaatctggattgctgttttgtacaagcttatgtgccctgacatgttgcattacattctgtatgaactcttcgatatgcgctagctaggtaatccctttacttaatctaatatgggatccacctactgatatgattgattatgacaattattgtatggactggacggttgtgcaaccgattgtactgactcgcttatccccgagaacacctaagacacaggaaaggattatggtaaaatattcagtggttcactccactgggcaaggttttagagaaacctgacaaattttcagcattgcctctgatctgttatagaaaaagcttgtgtactggttgggttgtctatttagagaaatcttcctttgcaattctttgatataaactgtaaatgcaccagtgcacacagtctgaaa

SEQ ID NO: 67270 - DNA, 437 bp, Triticum aestivum
  unsure (1)..(437): unsure at all n locations
  Clone ID: PAT_TA_67270
tttgtcaagcagcagcagcagcagcagctcagactcggaggaaacggacaccaacaccgtcggcggcagctccgagtcggaggaaatggacatcaacaccgtcgacgcgccggcgccgcacacgccgacgccgcagttcgtcgtcgagttcaagaaatgccactttgtgaagcagaatgggcagtacctgaacgtgccgatggagttcggcgttgtgcaccggtacaccgagaagaagaaggtgctgctgcggatggggggcgagtcgtgggccgtcaacctcaancacggcctcacgcccaccggcaggccccgcacgtccctccggtacgggtgggaccagttccgcgtcgacaaccgcctccgcgcgggcgagacctgcttcttccgagccctccccggggacgacggcggcgaccaccatgtgctcaaggtgg

SEQ ID NO: 67271 - DNA, 340 bp, Triticum aestivum
  unsure (1)..(340): unsure at all n locations
  Clone ID: PAT_TA_67271
attcggcacgaggcaacctccctccctctccaagcagccgcaacgctcaccagaacccaaacacgccatcaccgccgtcacaccaaacgcagcaaagcagagcagagggcgaagggtcgacatcggatcggcatgatcctggtggcgggtanggcggagctgctggaggagtacacggcggcggtggcgcgcgccctggagcggctgctgtccgcggcgccgctgcgcatcctgccgcgccgcgtgcggttcgtcgtcctccgccccctccccttcgcctccccctcggcgcccgtgccgccgccgcccccgcacgccgtccccgttctgctcgcgcgct

SEQ ID NO: 67272 - DNA, 448 bp, Triticum aestivum
  Clone ID: PAT_TA_67272
ccccgggctgcaggccggctgctgtccggcgaggccgcggccggccggggcggcggcggcggcgcgtcggcgcggctgttcgggagcaagcgctccatgcactccaccagcagcctgccggacctctcccagatgcccggcggcgcgggcccgggggccttttcctgcggcgtcggcaccgccgccgtaccaggcgcccgagtgcctcaagagcctgcggcccaacgccaagtgggacgtctactccttcggcatggtgctcctggagctgctctcgggccgcgtctactcggaggtggagctctgccagtggcacgccggcgccgtcgacgtgcagcgcggccgcgtgctgcggatggccgaccccacgctccgcggcgaggccgccgacgccggcggcgaggacgcgctgctcggctgcttccggctcgccttcgcctgctgcgcc

SEQ ID NO: 67273 - DNA, 561 bp, Triticum aestivum
  Clone ID: PAT_TA_67273
agggttaaacacacgcaccttcccctaatcctccatccacagacgagtacacatgcttccttcgtcttcttcgcgtgctggcgctggcgtagctcttcgctgttaaacgcggctgcggctgcggcagcctcactcagtcaacagcgtacagctacagtttgcttcgttctttggtttggtcatggccaggtcatggctggccggcctgcggtctcggctcggcggcggcgccaggcaggacgggctcggcatcctggccttcgaggcggcggccgccatgtcgcgcctggtctcgctccacctctcgctgtccgacgcggaggtcaggaggctccgcgccgacgtgctgcgcgccgagggcgtcgcgcgcctcacgtccacggaccagtcccgcctgctccgcctcgcgtgcgccgagctcatggcgggcctcgaccgcgccgcagacgacgccgcgcgcctcggagcgcgctgccgcgggctgccggacgcgccgttcctgcacgacttcgaccgcgtctacgccgacgcgaagcggggggccggcctcgcgcggctgga

SEQ ID NO: 67274 - DNA, 531 bp, Triticum aestivum
  Clone ID: PAT_TA_67274
gtctaatgggatgacgatgatctgatgtagattgtgcagctggagaggcaccttgaccgtcagcaaacggtgcacggcgcactgaagaaagccttgggtcctaactctgctcagttactctattcaatgagagggcaatcctcaagccaactaaccaactgataagggaggttgccacactggagctggagatcaagcacctggagtagtacctcataacattgtacatgaaagcatttgaggaagcacctacattgagttcacggtctgcggtgctcgaggaaacaccaaaggcaaaggcgactgtcgaaagaggtagtgatgcaatgctccattgcagctgcctccccttagcaagaggaggaatggcacatggaggattcctctccgtccaaatgcccaacgaagggtcgatggtcatgaatcaaagtagctgcgacatcaaaggatggagggtacacctgatgtagcggacttcgtcgtctcatcgacaagctcactcgtgacagtacaccagctgcagctctggga

SEQ ID NO: 67275 - DNA, 375 bp, Triticum aestivum
  Clone ID: PAT_TA_67275
attcggcacgaggagggtacggagcatgcgatagcagcattctgcaccggcgtttcgtctgtgtcacaccgcccggtgaatgaacatgcacaagtcgccacccttgtggcccggtttacgtcagctcgttgggaccatgctcgagatcgactcgccgtccacgcggcttactgcgcctatgattgactcacccatccctgccggcttacaacgccgcgcccggctcatctgtctgctcccacggccgactcactcgtgagtgatttcaacttaacctagtgatcaccaaattcatggcggattatttctggcctggcacatcaggtgatatccattttaaatatattttattggcacaaaaaaaaaaaaaaaaaa

SEQ ID NO: 67276 - DNA, 536 bp, Triticum aestivum
  unsure (1)..(536): unsure at all n locations
  Clone ID: PAT_TA_67276
agggtaggattttcgggtggttctgtgaagtagcaggtctagctcacttggccttatgcttttaaagattgctgcgtttctcgttgtccaaatgctccagcagccaagggtgatctactcgatgtaagaaggtttccgcatagagcccttcagagcaataatctatttattggcagaagacaaattggtttgatcaaaggcagggaataaatattcagaagacaaattgcagacgacaacccagctcatcaactccactatggctaacattagcaaggtctggtagcaagccaactacacgctactgtaattggggtgcagaagatggaggggaatgatcaccgttgacaaaagtgcattgagtggttggcatcctaagtaatgggtgtcaacggctaatctaccatatctgagtaatagcgagctcgagagtgtgtctcctggaaagtcaggcaggtgttaccgttgcccggagctcanatcggcaagcctctccgattcagacctcctcatcgccttccgcgccattgtcgatg

SEQ ID NO: 67277 - DNA, 616 bp, Triticum aestivum
  Clone ID: PAT_TA_67277
aggcacacattgcaaacctatgtcgtatctctcttaccttttttgctctctctgtctctcatgagatccaatcgagggctcgaggcacacaacccaccgccgccgccgtcgtttgctggtcagagctccctcgttcgccaccggtccgacctccttcgtcggaggacgaatcgtcggcgctcttcaacgcccaccccggggctcgccgccccacttgaacaccgtcgggttccgccgccgccgaactccgccatcaccgtgggcaccgcgcctgcggacgagctcgccggagctcacacgccgcccgccaccaatctagatgaagaagcgggaggtgaagggagcacatacgcatcacgagtcgcaactggcatcgtgtttcttcccttttctcccctcaagcagagctgccgctgtcaatccagttgagtcgaatctccgccgccagcatcttctttcgctgcccatcttcccctcagccatcttgtctccctccacctgttcatccagactggggaaaatgttttaggtcggtcttattgcttgcagcctttctggtgcatattttggttcagacttcagacttcaactcaattcagacttggtttactggctc

SEQ ID NO: 67278 - DNA, 178 bp, Triticum aestivum
  Clone ID: PAT_TA_67278
agggcgcggcttgcatcccatccgatgcaaggcatcgaatcgcgccaaccgtccgcgtgacggctgctcctttgttccctctccactcctctactttcccctgctccgccgctcgcctcctcctttctatatccgctccagaatccactcccgagccttcccgagtagtgctcatatg

SEQ ID NO: 67279 - DNA, 666 bp, Triticum aestivum
  Clone ID: PAT_TA_67279
aggccaccgcccctgtgcgccgtgccttggccgcctgccccgtccacctcttccacgccaccgccggtcccgtgcgtctcgtcgccgtcgtcttccttcacgacggcgcggccgcggactctggtgtccccgcgcacaggaccctcgtcttcctccacaggaccaccgcctgcgacgtcgagcggcagcgccgcctcgccgaccgctcccgtgtcgtcctgctgccccgagcgctcagcggcatgtcgggaattccggctcctttgctcccacgaggagcagcgccggtcctcgcccgccgtctctcccctgtcgtccccatactccaccgcctgctcctcccctctgctggcgtcgccgcccccgccgccgttccaccacggcgagctactatccgagtcgtttcctttgaccttgcgctcctccaccggcgaggaggccatgtcaccgcctcatgatctgcttcctcctccgcccccgccgctgttccaccgtggcgagctgctatccgagtcgtttcctttgaccttgcgctcctccaccgccgaggagaccacgtcgccgcctcatgatctgcttcctcccccgcccccgccttggctgccgctggcgcctgctggtacatgggatgaattcctcttcatccctccgactccgatgatgaca

SEQ ID NO: 67280 - DNA, 350 bp, Triticum aestivum
  Clone ID: PAT_TA_67280
tccactccactccacatccaaaatgtccgccatgactttctatatctttgcttccttgatgggcctgtggacagggacggccatggctctcgaaggagacatcttcaagttagccttttatagtagcggccattttgccggcgccggtgaggaataccgtgggggcactggcgcgaagcagccctgcccgtaccgcctccgatgccctggtaggtctctttctgggcatggtctgcgtgatgtacacggccacgttcttgttcgtcgtcgcggtcctagcctgcggcgggaactgctccttggcctgcgtcctgtgtgagatctcggaccgttccgagacgctctccctg

SEQ ID NO: 67281 - DNA, 451 bp, Triticum aestivum
  Clone ID: PAT_TA_67281
aggaacctccacagctcagcttccacccactctcaaaccctctcgccggagcccgagcaagccagcaagcaagcaagatggacggcatcaaggcgcaagaaggtggcggcgaataagttcggcgggccgaggaataattctgtgaccaagtccatcaaggccgggctccacttccccgtcggccgcatcgggcgctaccttaagaatggccgctacgcccagcgcgtcggctccggcgcccccgtctacctcgccgccgtcctctagtacctctcagcagaggtgctggagctggccgggaacgccgccaatgacaacaagaagacccggatcgtgcccaggcacctgctgctggccatccgcaacgaccaagagctctggaggctgctgagcggcgtcaccatcgcccacggcggcgtgatccccaacatcaacccggtgctgctcccca

SEQ ID NO: 67282 - DNA, 392 bp, Triticum aestivum
  Clone ID: PAT_TA_67282
aggcctacgtgcgtgccacccgctgagctcggcgcccatgaggaggcggcgctgggcgcgcgccgccgccctatgcctcgccattgccgtcctgctgcagctcgccgccgtccactgcgcgggcgcctcggccatgattcttgccttctccacgcgcgcgcgcggaagcgctgcgcagaggtggccctcgacgcccgtgcaccacgccgtgcccaagcccattccaagagccggcgcccgcgcggtcgccttcgacgccaccgccaccttcgcagccgcccggtgcaagagcaaggtcaagaccagcgcggcgtggaagcggaagccgaccgccggcggccgcgacgacgccgcgtgcgacgacgacgacaagcggcgcatcccgacgggcc

SEQ ID NO: 67283 - DNA, 600 bp, Triticum aestivum
  Clone ID: PAT_TA_67283
aggcctcggcccatttgcgcgctgcaacatctcggtgtactgaacggcggtggtggtcggtgttggcggcgtggagctctgtgtcggcggcggaagaagtcagcggcgctcgggagtgggagcgaggaggcggggtcgcgcgacatggagcgcatgatgccggtgcgcgcctgcggctgctgcgcggagcaagcacgcacggcctgctgcgcgcgggagctgctcccgctcgctggccggacgaggagtcggacgcgccttcttctcctggcggctctcaattctcaaagggcggcgctccagtggctcttgaagaacaattggatccacgcacaaaagttgttcgatgaaatgcctcgtagcaagagagatgtgaagaagatgattgtctagtcattgacaggtggggccaacgtttcatttgccatatcagttgatcaaagtttatagtctttgtcacgtcagcccgacaggtgagccctacctgtcggtttggctgttttcgcgaccaattcagagcatcagccgcgttacaaattaggcacaatttcggtggtttttttttgccctggtacaaatgtggtaccgagttgttaccct

SEQ ID NO: 67284 - DNA, 404 bp, Triticum aestivum
  Clone ID: PAT_TA_67284
attcggcacgaggctcaccgtttccccgttccccatccagagagtgagatagaggggaaagcttcgcgagccatgtcaaagctggaagctcgttcgacgatcctgctatatgctatgccaagctcgtttctccggcggaagaagcccatgtttcagatctggatagtccgtcaagaagatttcagatcgactgaatcgtaatgaattcatagaagtttcataacactgttcttatgaaatttctgtgaagatcttacggtccggaccaatctttttcgttgctgtcttacggtatcatctctccgacaaaaaattggaagcaataaggtaccaatttaagaagatccacaggacaggtgatgaagtggtggatgcttacaacagagagcttattgatttattta

SEQ ID NO: 67285 - DNA, 675 bp, Triticum aestivum
  Clone ID: PAT_TA_67285
aggttcttaactatcatggatctagttacctgtcacatcagatgatctatcgaaaaggaaagttgcagaactttgtggatagtgccgagagggcttacaggaaatttgtaagagtaaaactttcggtatttgaccagaacgtgcggtctagcttgaatagatgtggtctctgcggagtacaagcttcctcgtttgagctttaccgcaacaagttcgtcgaggccaagaagtcagacctcactgatccagaagtagtcgaggctcaaaaggactgcccaggtgctatagtgttcttcaagactcgctacgcggcgattgtggcctcccaagttcttcagtcttcgaaccctatgctatgggtgacaaatctggcgccggagccgcgcgacgtctactggtcgaacctctggataccctacaggcagatctggctccggaaaatagcgacgctcgcggctagtgtcttcttcatgtttgtcttcatcgtacccgtcgcgtttgttcaaagcatgatgcagctggaacagctcaagcaaatgttcccaaacctgagaggtgcactgaagacgtcattctgcgtgagagtcgtaacgggatacctccctagcgtggtcctgctgctgtccctctacaccgttcctcccctgatgatgcgcttctcggcgatcgaggggt

SEQ ID NO: 67286 - DNA, 324 bp, Triticum aestivum
  Clone ID: PAT_TA_67286
agggttcactgagaaggcattcgtggagatgtgcatatgtcctcacaaggaagctgcaccgcgccttgctgaagactatgtggcttcttgccgaggagaagtgccaactaatttcagaattacatgaaccaagagcatgctatgaaaattggtaactgtatacggtgcgacgaattcctatttctgtgtactttgcctagctggatgttggttctacacttttagatgctggtatggccgttgttaacgctgggtttaagtgatgatttgaatcctgatatcttaatggatcatttagtagaggaaaaaaaaaaaaaaaaaaaa

SEQ ID NO: 67287 - DNA, 636 bp, Triticum aestivum
  Clone ID: PAT_TA_67287
aggcacaaggatgtgaagccacaaaatgttttgttgggcagggcctttggatgggaatcatcttcagtattcttgtccaggtcttgctgttcgtagccatcacactgcgcaccatcaggcaaaataaggcaacaaaggcgtacaagtatatcgcaaggtcaatgctatatgtgtatgtatgtatgtatggatatgtgctactgaagtgagattccgagaaaatccgcatacaagtatatcgcaaggtcaatgctatatattcttagatgaaaattacactaggttggcttttaatatacttggagcatcgatacttccggaccagtgaaccgccggaccgatgctggtgttcatggagttagttagcaacttttttctggtcagcaaactccaactttattaacccactacaggagagcagagatctaagaaagaacagaagaagaagaatcctgcggaagattttggtgaagaacaagatgaacactcctatatctgcattcaaaggaaaaggacaggctattgtgcctaaaactcctagatatcggcccttcctttgtcctatcatacattctgagagttcttcctctttgcttatgactgctgttttttttaaaatcagcaaatcactgtgcc

SEQ ID NO: 67288 - DNA, 581 bp, Triticum aestivum
  Clone ID: PAT_TA_67288
attcggcacgaggcacaatgctagtatatcaaaggccttagttgtttttggtgctgatgccccaggcacaagggaatcaccaacaaaccagattgctgacatggatcgcttggtggaggatgacagcttgggagataacgtggactcattcttgtcacatgatgatgctgcaggtccaagtgatgcccgcagccgttctatggcttcttctaaaggattcacctttcgagagatttcttcagctcgagcaagcaccaacaaggttgtatgttgtcacttctcatcagatggaaatctacttgctactgggggtcatgataagaaggtggtattgtggaatgctgaaactttaaaacaaaaggcagtattggaggagcattctcttctgataaccgatgtacggttcggtccaagcatcccacgtattgctacatcatcatttgacaaaactgtcagggtctgggatgtcgacaatcaagatgatacagtccatacgtttaccgggcactcagcatctgttatgtcggtggattttcacccaaacaaggatgacctcatttgttcttgtgatgggaatggtg

SEQ ID NO: 67289 - DNA, 458 bp, Triticum aestivum
  Clone ID: PAT_TA_67289
agggtctcgcgtcgcagcggcagttccactccctcgccatgggcaagattaagatcggaatcaacggtttcggaaggatcgggaggctcgtcgccagggtcgccctccagagcgacgatgtcgagctcgtcgccgtcaactacccctttatcaccaccgagtacatgacctacatgttcaagtacgacaccgttcacggccactggaagcacagtgacatcaagctcaaggacgacaagacgctgctctttggcgagaagccagttaccgtcttcggcgtcaggaaccctgaggagatcccgtggggtgaggctggtgccgattacgttgtggagtccaccggtgtcttcactgacaaggacaaggccgctgctcacttgaagggtggtgccaagaaggtggtcatctctgccccaagcaaagatgcccctatgtttgtggttggtgtcaatgaggac

SEQ ID NO: 67290 - DNA, 625 bp, Triticum aestivum
  Clone ID: PAT_TA_67290
aggctctcgctcgctagctaaaccctctccgccgcctcccatggcgaccgccggctgtgccggccgctgggccccgctcgccctcgctctgctactcgccgccgtcgtcgcgctggcgctcatcccgcaggccgccctcgccgcgtccggcggcgtcatgggcgggcgctcctactcctcttccgagcccgacgactcgtcctcctccaactcgtattcgttctacgactcgtcgagtcacatatcgatcggcgcgccgtcgcgtcgccgcgcggccaaggacgacgacgacgacgacaactcggatgtgatattctggatggtgttcgtcggtctcgttttgctgatcgctgccgtttggtactactacgagtacgaacgccagaggacgaccgtggttaagctccaggttgccttgcttggctgggcgaaaccgtttcagaaggaattgaacgagatcgcggagagagtacaggcttccaacaagcattcgtacaaattcatgttgactgagaccatatgttcattgagccgtcacagggattgctgcgtattttcaagcttatcagttaatgtgaaaaatggagcggatacttgggaggcgcatttcgataaactttctatc

SEQ ID NO: 67291 - DNA, 406 bp, Triticum aestivum
  Clone ID: PAT_TA_67291
aggacctcctcccctcctgcccccgagcaccgcagccgccgccgccgccgccgccgccgccgactgcagccatgtcgctgatcgcgggtgaggagttccagcacatccttcgtgtgctcaacaccaacgtcgacggtaatcataagatcatgttcgcgctgacctccatcaagggtgtgggccgccgcttctccaacatcgtctgcaagaaggccgacatcgacatgaacaagagggctggagagctttccgcggaggagatggaccgcctgatggcggtggtgcacaacccgcgccagttcaaggtgccggactggttcctcaacaggaagaaggattataaggacggcaggttctcccaggtcgtctccaacgccgtggacatgaagctcagggatgaccttga

SEQ ID NO: 67292 - DNA, 507 bp, Triticum aestivum
  Clone ID: PAT_TA_67292
aggctccttcccctgaccaccgccggggtccttcccgggcgaaccccttctcttccttccgcgagcagcagcgaccctgcttctcagtctagatcgagcgctgcccgccgtccaagtcgaatccctgccgtaatattcggcaaaacagccatcctccccgttctgaattgccactagcctccgccatgttcgcctagctccatggccatctcgtgttgccgcgtgcatcagtacgtgtgtgctgccgcatgacactctttgtttcaagccctgtgtgtgctgctgcatcagctcgtgcatcagtacgcgtgcgttagtacgtgtgtgctgccccatcagtacggaaaccctgcctcggaagagcccatgcgggaaccgtggcctccaccgcgtgtggtcgtctccgtcctcgttatcttttgtacagtgtgctgtcgaccccttcatttcaagcccgtttctcgctcatcacatactgcttgaactgaggagcttgaactacgtggg

SEQ ID NO: 67293 - DNA, 422 bp, Triticum aestivum
  Clone ID: PAT_TA_67293
aggctctccctctactccgccagcgctgcttctccttggccggccaccgcctaccgatcctcccctacgtcccctgcgccgacgatgcggccccgtccagcccctccagccacaccgctgagtagtagaagagtgcctcggtgaacctgtcgaggaaccccggtttgttgtggtccgcctcttgctcgacgaccgtgaagatcttgggctgcaaggaggcgacgcagtctaaaacggcgtcgatgggcgcctgatcggctatgtcggcgaggaggcggtggagctggagcacgaagttgaccgccacggcctcgcccggcgtgatctggagcatccacgggtggacctcgttgaggctgttggcggcgaccccgcggaaggagaatcggacgcggacggagcgcgcgaggtcggcgaggcgg

SEQ ID NO: 67294 - DNA, 394 bp, Triticum aestivum
  Clone ID: PAT_TA_67294
agggcctccctctgcccatgcgcgtgtgatgtagtgtggaaccaaggccagctcttcaccgaccccccttcatcatattccggtgaggtaccagcccatacatgataggcagtactgacggcgacgccatgcagttctccgtgcgaatcccgtccaggtttggtgttgttcagaaccatttctactgctttcagaagaaaaaaatgatgagttgtttttgatgcagtgcagttcagacgctcattgaggacttgcagctcgcccgcgagtggctcgtggtccgcgcagctcgggcgtgcagtgaactattggttcctccatcgctgcaagtcctccacctgttgcgccgtcctccacggtacagtccacacggccagagtatgccacagcccac

SEQ ID NO: 67295 - DNA, 361 bp, Triticum aestivum
  unsure (1)..(361): unsure at all n locations
  Clone ID: PAT_TA_67295
aggcgccaccacccaccaaggaaaggaggatgtcttgctgcggcggcaactgcggatgcggcgccggctgcaagtgcggcaacggctgcggcgggtaaacatcttanaaccaaactggacgtgtgtgggtgaattaacgtttcagactaggtactgactcgccgtttgcatgtgtacctgtgcaacgtaggtgcaagatgttccccgacgttgaggccaccgccggcgccgccgccatggtcatgcccaccgcctcccacaaggggtacgtatcgtacgcgctgactgattaatcagctcttctgtttaactgagaacgtgcatgcatggatctctgactgactgactgactgactggtgg

SEQ ID NO: 67296 - DNA, 439 bp, Triticum aestivum
  Clone ID: PAT_TA_67296
agggcgcccacaggcagccagtatccaacatgactggtcagatccggcacccagtgcatcagctgcaaccacccttgctcgcaccatcggccatgtaccgccgtccacacggtcagcaagccgcccagcaccacctcgccctgtagccgctgcctcggcgacctcccacttgcagatccacgagcacaatgcagactccctgacaactcctgcctccaccaaacaccaccagcacacccactcccgctgcctcactcgccgggaccaggatctcgcccgagaatcagcagggtgcctccagtgagcaccctggctggcaccaccggcgctgggcccgctaggaccgtgcccccatggccggggagagcagaggagccatcccgaccagaggaggacgtggcccgaaggcccatatccactccccccaaacgctgatgtg

SEQ ID NO: 67297 - DNA, 481 bp, Triticum aestivum
  Clone ID: PAT_TA_67297
aggaacaaatcgaagaagatatgcaccaggtttttcagcgactaccacttcggcgatgactgtcgttttctccatcacttccccaccatggacatgatcaggctatttacgaaaaaagatgaacaactggacctaggcgctgaggggagctcaggaagccaatgtgtcttgggagcagcttcaagaccaggctatgcatgagctttgtcgtcgggggtgccacttggccgatggcaaagttgagctgcgcatgccagacgcatcttcagaagtccaagatcaagtagttttcatggtatttgtgatgattgtgtgtctgttgttttgcagaaatgcctaaatagaaacttatcttttttgttgtagtccattttttcggttcaatgaaggcatgataggcaaggcaacaaaaatggattgaacaggaactcattgtatctcttagtatgttcctctaattctaaaaaaaaaaaaaaaaaaa

SEQ ID NO: 67298 - DNA, 506 bp, Triticum aestivum
  Clone ID: PAT_TA_67298
agggtcgccagcggttcccccgacgaccacgggtcctccgccaggggcaggcccttaggcgcctccccagcggagggcctacctcctaagaacgccttgctccgaacgccgcggtggtgatgtgggatctctgcccctatcctgaagccccatgcgccctcctcccgaggggtaggagactgtgggagcagggcagctgctcgctgcggcgacctgcacctcctgcgatccatgattaccgtatgcctgctcctgaggaattaggggaacccgataattgtcgcctccagcgtggccgatggagccgtcccggggctcctggaagagctcagcttctggcgtctcgtctccccagcttgggctgagaagcgagccttgttcgccctcgtgagcgtgcccttggtccaccatgtggggcacgtattcttcaggcgccgtcatcccgaaggcggtgctgtagtgctccatgtgccatgcagcgctgcttgacgtgcccaccgcggggt

SEQ ID NO: 67299 - DNA, 469 bp, Triticum aestivum
  Clone ID: PAT_TA_67299
aggcagcatgcttccttaccaaggcaataccttttttttactagaagaaaagcattatagtttactaagctggaggtgttttttttttcatgtcattagagtgaaataggataattcattgatttaaattctgctgcatgaagcagagttctgtatctctgccatatgaggtggatcatgcaaaactcatttgagtttctataatcattttacaaagaatgagcaatataaacaacacaaagggtgtggcgtcgttcctcttaggtctctataataataactcattgcctgcatgcctgtgatctctcttgaactaatatatcctctatcttatctcagggaaagagttatcggcagcagtgatgagcctgaaaagccaaatgcagattactgtataaaattgcatgtaggtgaggtaccaggtcacacatcggtgacagatggccttaacaagccactgttgaacact

SEQ ID NO: 67300 - DNA, 536 bp, Triticum aestivum
  Clone ID: PAT_TA_67300
aggagcagaacaagctgcgactgggaagaccttctaccacattgctttcgagccttggctcaaaggtcctgccgatgtcatcagctcatggcttgttcacatcaagatagtcaagaatcccgaggttccaacctttgaaagcctagaagacatgattcgcgagattgaacaggctgcagctgtgcgcttgacatccgtggacgagggaggtgccgctcaacaaagcacgacaagccccttggacgcgatccttcttggtttctactattccgaccatttacacccgccaactctaaagtcttttcctgcagatattcccgttatagcaacaggtccgggagctgaaatcatcaaagcttggaaccacttcagtacaatccgagtcatcaataatttagatgcctcagcaacatcatggcagaccccagaccttcatccaggcgagccatttcccaaatggctcacaccaatattcttacctggaagtagtattttgaactttgtattcgccatcatctggtcacatacagtcgatg

SEQ ID NO: 67301 - DNA, 167 bp, Triticum aestivum
  Clone ID: PAT_TA_67301
tagtggatcccccgggctgcttgcagtgatgaagaggttagggacgacgaaatttcttctcaagaggcgtgcatgggcactccgcatgtgcaatcatgaagatgatgcatgataggcgaagcttcttccggccagccgccgcgctccagaattcaacggacgagact

SEQ ID NO: 67302 - DNA, 306 bp, Triticum aestivum
  Clone ID: PAT_TA_67302
tcggcacgaggcaagccacgaccacgaggcacgagctagctaaccccagcacacctgctaatcctagcacacgagcaaccatctagcttaactacttcgagagtgagtgaactccagctaataaagtagcaagcatggcgtacagattgctggaggtgaccctccagtcggccaggaacctcaagaacgtgaacctcatgtcgcgcctcgaggtgtacgccgtggccaccatctccggcgaccccatgacgcgcctgtgcaccccgccggacccctacggcggccgccaccccacctggaacacca

SEQ ID NO: 67303 - DNA, 509 bp, Triticum aestivum
  Clone ID: PAT_TA_67303
agggtgacagactgacagcacaccccatagttcgtcaccacaggctttggcatagctagtggtcggacttgtgctctctaccgcttaatattctactagtagtgcctttgatgattactgcgcgtccctcgtgcgtgcaggtgagagcctgaacatgagctacctcagcccgtacatggaggcgctgggctccgacttcggcgacggcgccaacttcgccatcgccggctcgggcaccctgccgcgtgacaggccctttgctctccacgtccaggtgcagcagttcacccacttcaagcagcgctccctccagctcatcgcccatggcgagaaggcaccggtggacgcggagggtttccggaacgcgctgtacctcatcgacatagggcagaacgacctctccgccgccttctccatcgggctgacctacgatcacgtggtccatcacaggatcccgtccatgctatatgagatacaggatgctatcgtgactctgttctacgatggag

SEQ ID NO: 67304 - DNA, 367 bp, Triticum aestivum
  unsure (1)..(367): unsure at all n locations
  Clone ID: PAT_TA_67304
ccgtgttgatcggacgactaaacgctcagatcgctcctaaagttgatatagtgttttccttttgatatgtcttgccaagcagagcattctttataatttgttgtgttgaaagaaatgttgtttgatatgtgcagttcagagcgaccaatgcaaggaggaccaagatctgagatggtgagctcgccctcatctacctcttccacctttgccgcctatcacggagggggagaagattacaacatgattcagctttgacttctttttttctatttcatctancaactctggtggcagaatgaaattatccagtaaacttaactgtttataagtgtcttggttgtactagaatttgcagaattttgcccaa

SEQ ID NO: 67305 - DNA, 237 bp, Triticum aestivum
  Clone ID: PAT_TA_67305
aggctaaaccctaccctcgccatgtctccggcggacgccgccgccgcccacctgaccacggcccccgaccccgacgaggacatatgccccagccccgctccccccgctgcccccgaggagatcgcaccgcccgtgcccacgcccctgcctccgccggcgtccgcggaggagagggtggagcgcgcgtgggcgcactggaggcggctggggtccccgacgctggtggtggcccccatg

SEQ ID NO: 67306 - DNA, 385 bp, Triticum aestivum
  Clone ID: PAT_TA_67306
aggctcccccgtgcgcgacaagcggctagggtttcgccctcccatcccatccccgctccgccgtcgcctcccacccccgccgtcgcagccctcgcctcccgcctcccgcctcccgcctcccgcctcccgcataccatccccgccgccgtctctcgcccctccgccagccgcgtccttcgcggccggcacttccaccgagctcccgcgccagcagatcgacgccgccgggcccgtccgccccgtctcgccgccgcccagctcgtccccggcctccggctcgcctccgcccaggtctgtactgccagggttacttccatttgcattgaaagctctgcgggtcacttcgacggagattgtgcaattacccgaaccgacttggcggaac

SEQ ID NO: 67307 - DNA, 397 bp, Triticum aestivum
  Clone ID: PAT_TA_67307
aggggcgcgggggcggcgaggggctccgggcggttcgccgccgactacatctcgcttggcatcagggagcccgtctacgaggtggtagaagtgaaagctaatggaagcgtgtctaccgaaaaaataagccgccggcagctactgaaatcaagtggcctccgtctacgagatacaagaagcgttgacccgtcactatggctaatgaattcaatgccttccctgctggtacgtgaacaggccatattactcaaccttggttccttgcgagcaattgctatgcatgaacgtgtccttatattcaattataacagcccaagaggaaaggtctttttagagctattacgacctcggttaaatccaaggaacatcaatggtgggcctgcaatgccttttcaac

SEQ ID NO: 67308 - DNA, 302 bp, Triticum aestivum
  Clone ID: PAT_TA_67308
aggcaggattttactactgttatggcaaaagaaggctaaagctggagaaagacaacaatgtcaggagccggccgaggtaaagagacctaagttgacaagcagggttgtgcagttatttttctctgctattcattgagcatatcaggagattgatagacagtctagatccaaaatgcagagaggcaaggtttattttcctggaggtcctatattgcagctggtgctattttgttatgtcaaattgtgtatttttccagcttcccttcctcatgtatgagcttgtctatggtgggatggggatt

SEQ ID NO: 67309 - DNA, 524 bp, Triticum aestivum
  Clone ID: PAT_TA_67309
aggggcagccgcacatcagcagcttgctctgttccatccggcagcaatggcggccaccaccaccatggcgctctcctcccccgcgatcaagctcgccggagcctcctacgccctcggcggcggcggccgcatcaccatgcgcaaggccgcgcccaaggcctccgcctccaacagcccgtggtacggccccgaccgcgtgctctacctcggcccgctctccggcgagcccccgagctacctcagcggcgagttcccgggcgactacgggtgggacaccgcgggcctctccgccgacccggagaccttcgccaagaaccgcgagctcgaggtaatccactgccgctgggccatgctcggcgcgctcggctgcgtcttccccgagctgctcgctcgcaacggcgtcaagttcggcgaggcagtctggttcaaggcgggctcccatatcttcagcgagggcggcctcgactacctcggcaaccctagcttggtccacgctcaaagcatccttgccatctgggcttgcc

SEQ ID NO: 67310 - DNA, 491 bp, Triticum aestivum
  Clone ID: PAT_TA_67310
aggcacacttacagatttcatcacaaacagtttagagtatattgtagaattatctttttggggaaaatttcacaagaagtagaaggtgcaccgtcctccgggctcctcctgctgctcctctcctctccctcaggggaccaaccccctgcgcaagctcctcctgccggacccacctccgacgactccagctcccccgccgcggtgctgctgcacaagctcattctcacggcggccacctccgcctcctcttcctatgcgctcgtcctcactgccggcgcctggcgcgctcaccctcgccgccgtcttcgaccgccgcgcgacccctctcgcctgcgccaccgacgtcgtcgccgcgctctcctgcgaggaggcgcgcctgggccgtccccgaagcgacggccgcgtccaactactcgatcaggtcctccaacctcggctcgcggccgccggggtccctagggcgatctcattctccaagtgccggggggtgg

SEQ ID NO: 67311 - DNA, 352 bp, Triticum aestivum
  Clone ID: PAT_TA_67311
aggagatctgccgagctcccctcgctctcctcgatccagatcgccgtgctctgctcctccctccctcccctccggcaagatccccacgcccctccctccctctcttccctccggcggcctctctctcctcgatccgcaaccaatcaaaccgcaaccaatcccccaccccacccttcctctctcactcgcgtaggtgcaagcgcagggcacaacgcccaatccaaggcgacgccgtcctcgtgcgcgctcgcggtggccatgacggcgcaggcgctcgcgccgccgccgccggagccgcggcagctcagcctggcggacctcagggccgtctccgtgctcggccgcggcgccc

SEQ ID NO: 67312 - DNA, 388 bp, Triticum aestivum
  Clone ID: PAT_TA_67312
aggctaataagatggatatattcaatgacaacggtgggatgaagtcaggaagtcactcgatctggatgtgcgagccattataagtgtagctgttttcatcggccgaagtaccatcatgcctgatatgcatggctcttggccactgcaggacaatgcttattgacaaatttttgctttgggaaacatttccattatgctgcctgagatggattcttcattatgctgtctttgaattcccaccaaattcagtcgcagaagctcaaatgcgaaggacgtcaaacttcctggttacattgcaaagtttagttactgtttattccaagaaagagtttgtttagtcatattcagtggagcaacaagcttatatcgctgcagcaatagggttatg

SEQ ID NO: 67313 - DNA, 347 bp, Triticum aestivum
  Clone ID: PAT_TA_67313
ccccgggctgcagggagatttttggtcatttatatttggctgcttcattcttctctaaaagactaaaactgcaggtatattgggtttgattaggacatactgtatcttaaatgacattccccattgggcaattaaaacgatggaagggccatatgcgaatggcaccaaagcaactttgaatgacaaacatttgcaaatcgcatttctaggtatggttaattcatgcattattgttgtaactctttgtttcatcaggaattcagtcaccaagccagttggagagtggtgatcacctcgcactccagctacctattatcccaaggatagagactctaaagttctgaaac

SEQ ID NO: 67314 - DNA, 220 bp, Triticum aestivum
  Clone ID: PAT_TA_67314
agggtatcactcacccgcacggcaaaaaaacgcagaggcgagggccggaaaaggagagaaaattccttccgccccgcccccaaatcgcgccgggcagtataagagcacaccccgccgtttgcgccccgcatccaatccgtccgtcctcagcgccgacgacaccgccggagatagcggccgagcactccacctcgagccagtgagtggcggcgggaggggg

SEQ ID NO: 67315 - DNA, 300 bp, Triticum aestivum
  Clone ID: PAT_TA_67315
agggcgcaaccccatcatcacacaccacaccaaccgacccgtctcgtctcgcgttccactcttctttcttttgtttcgctccgtggtcccacgtgctcccagccatgtgcggcggcgccatcctctccgacatcatcccgccgccgcgccgggccaccggcggcaacgtctggcgggcggacaagaagaagcgggccagggccgatgccgccgcggggaggccccgccgcgcgcccgaggagttcgaggaggagggcgacgcggagttcgaggccgacttcgaggggttcgtggaggcgg

SEQ ID NO: 67316 - DNA, 274 bp, Triticum aestivum
  Clone ID: PAT_TA_67316
attcggcacgaggagtcgacggagttcttgaaggggttcctcggcgtgcaccggctgatcgaggcggtgaagcacatgctggccgtgcggatggacctcggggaccccggcttcgtcaacgtcgccggcaacgtctccgagatgatgtctcctgagttcgcggacaagatccggcggaggatcgccgacaacaccaccttccctcccgcctactacctcgcaaaatggagccagctgcgtgacaacggcacgagccacctgtgcgtggtggacg

SEQ ID NO: 67317 - DNA, 606 bp, Triticum aestivum
  Clone ID: PAT_TA_67317
gttcaacaagtacgagctgaaagctaagcatttggaaataatagtaggaacggaaagctaggaatttaagctggctggcatctggaatttggaagctggagttgaatgtgcgagcgcactctagtttgatgggcttcctggatcactggaggatccactcggagaatcactcggttcagtagcacctggagttccactggccacatcctgtttggtctcctctttttcaccagctgcaaaccttccaatgaccacctgaacaggtgatgctgcaatcagaggtcctgctaacccaccgccgaagatgcggccatcagcaccgacaagcgaaatggcgaacccaccctttagagagctcactccatcagttttggacggcagatacgagccggtcatagagacaatgtcaaaacaacccttatggataactgtttcaagcggagaagctggttgatgcagtgtcacattggatacggcgccctcggcagacatgataaaaactgcccaaccattcccaccatacgacttgacttccattgctacatcctgtccaccttgaactatgatgatttgaggaactatttcagccgcacatggctcaagttc

SEQ ID NO: 67318 - DNA, 579 bp, Triticum aestivum
  unsure (1)..(579): unsure at all n locations
  Clone ID: PAT_TA_67318
attcggcacgaggatcgtcacgagcgaaccagcgagccgatcgtacaactttcgtgtagcgagttcaggaatctcttctcgggtggtcttagtttgaggttgccaaggtccagcgtagccatgccgccggccatgcaagcagcggaaggggcggggcagaggaggagcggcccccggatcctgatgaacgccgcgcagcgtgccctcagccgcggcgcgtcgtcgtcgctggggagccccaggtcgccgccgccctcctacgggagcatcgtcaccgtgctgagcatcgacggtggcggcgtccgcggtatcatccccggcaccatcctcgccttcctcgaggagaagctccaggagcttgacggaccggaggcgaggatctccgactacttcgacgtgatcgccggaacgagcacgggcggtctagtgacggccatgctcancgcgcccgatgacgcaggccgcccgctcttcgccgccaaggacattaaccagttctacctcgaccactgccccaatatcttccctcaagccagcaaaggcccttttggcttgatgaggagcatgatgggacccaag

SEQ ID NO: 67319 - DNA, 590 bp, Triticum aestivum
  Clone ID: PAT_TA_67319
aggatcagcccctgtggaacaatgaacggcctgaagcatctattgctggttttgcacatactaatgatggaatatggaatgctgaaacctcaagctatgaagcagggtgggagcatgcaaaccagggttttgcagctgatgattcacaaaatccaaaatcttctgtttgggggagaatagcatcaaagagaaaatccgggcctggtaaaacagctaatactacttcgacaagtgcaactggaaaccaaagaagtgactacaatgatgatatgggtcctagcactgtccaagtaaagcctgcttctactaaggatactaatggtcgacccagttcaagaatgtctgcagatgtgggccggcaaagtaatagcaggacctctcataaagcatctcgcacactttatgtaaatggcattccaccagaaagcaacagatgggaggcccttctgtcgcacttcgaaaaattcggtcaagtaatagatatatatgttccagctaacagtgagaaagcttttatccagttctctaaaagggaagaagctgaagctgctctaaaagctccagacgctgtgatgggaaaccgttttata

SEQ ID NO: 67320 - DNA, 554 bp, Triticum aestivum
  Clone ID: PAT_TA_67320
aggccgcaacaccctgtcaacccaatctcacaggctcctatcgcccgcccagatcttcttcgccgccaaaaggaaatgatgctctacaaaatccactcccatggcccaaatccaagacctgcaggcccgctccgatgagctgggcctctccaataagaccatgcttgagagtcttgtctctctggagtcggtgcgcatagcgtgggagtcgtatgcgctcctccgcccgctgatcaaggagtcatggatttgggtatgcccgcagctgaaaatcctctcggacgtggcaggcttgtcgttggaaatccaaaagctcgagcatgatgtgttaccccagctcaagcttcaggaggctaagctggaaacgggcgccctggaagccctcctactcatgaagaactcagctgttgcgctcttacatttgaggaagtgctttaaggaagacttgggcgtattgttttgcgaggatcatctggtctcagccaaagtcaaaaggctgagcaaaatgctaaaggataaatgcttcaggagcgtgaatgcaacattgtcgggct

SEQ ID NO: 67321 - DNA, 455 bp, Triticum aestivum
  unsure (1)..(455): unsure at all n locations
  Clone ID: PAT_TA_67321
tgcggcggcgcgcgcataggaggcgaatcagcagcggaaccaagccgccgacgccaccatgggtatctcgcgtgactccatgcacaagcgccgggccaccggtgggaagcagaaggcttggaggaagaagcgaaagtatgagctcggccgccagccagccaacactaagctttcaagcaacaagacagtgaggagggtccgtgttcgcggaggtaacgtgaagtggagggctctccgtcttgacactggtaacttctcatggggtantgaggctgtgacccgcaagacccgtctcctggatgtggtttacaattcgtcaaacaatgagcttgtgaggactcagacccttgtcaagaatgccattgtgcaagttgatgctgcccccttcaagcagtggtacctgactcattatggagtcgaaatcggtaggaagaagaaagctgctgcagctgcca

SEQ ID NO: 67322 - DNA, 383 bp, Triticum aestivum
  Clone ID: PAT_TA_67322
tggcgccgcccgctctccggccaagtccgtgagcgtctcgtcttcttcctcctcgtcccctgccgccggcaagagccgtcggtcctgcatgtgttccccgacgaaccacccgggctccttccgctgcggcctccacaaggagcgcaggcaggcggccccgtctggtagcagcaagccctgctccccgccgtgcgtcggcagcgccggctccaagtgcacgggcagcgcgctggtgcgggtcgtccccatggagagcgggcactgggcacgcagagcgctcgcgccttctcccgcggcgcagcagtcgcttcagcggaggcgcgcgggcgggtcccgcccacggccgagccggctctctgccgtgtccgtggccggcgaccgcg

SEQ ID NO: 67323 - DNA, 556 bp, Triticum aestivum
  unsure (1)..(556): unsure at all n locations
  Clone ID: PAT_TA_67323
gctcgtcggctgggcaacaacgagcgctggacatgtagaggaggcgatgagaaggggatgccatggggggctcggcttcacctctcccatactttctcttcggacgcacccaacctctgccacaaatctctctctctctcggttggggacaaggttgacgtcagctcatgctgccgtcctcgtgcctcggtgtgtcgtgtgtggcgccgggcctccccacgccggccagcactcctccaccaatccctgcccctgagatccgccgccgccaccactggctcctcgctgtagtgccagcagcggcacaccgcgaccgcggcaactctcgagaaaggcgaggcggcggatggggccgggacagtggcggggttcactgtcgtgatgaagttcggcgggtcgtcgctgtcgtcngccgcacggatccgggatgtggccgacctcatcctcagcttcccccgagaggcgcccatcgtcatcctctccgccatggggaaggccaccaatcgatgagctcgctgtcatcaaggagcttcatcttacgaccattaatgagccg

SEQ ID NO: 67324 - DNA, 542 bp, Triticum aestivum
  unsure (1)..(542): unsure at all n locations
  Clone ID: PAT_TA_67324
tcggtctgactggccgtcacgccccagtcgtcggcccgctctgtatccggccagcagccccgcctccgatccgattcggacggccccacgcacagcctccgccacctacgggctacggcatgcccccagaggttctgctgatcccgcgccgctcatcctggcttcatcctctgctcgcggctcgcgttgaccgcctcgccgcggcctgctccaggccaccaatcggagcctgtccacgaagtccagccggccctcctcccgggcgcgctcctcggccgttgccgcgtgctccgccagcaacttcgtcattagcccgtcgaattggcggtgcacctggcgcatcttggcccagccacgaccgcgccagcacgaagtcgctaatgttgaatagccccgtgctgtccaggagcgacatgatcatctccttgtagctgctggactcgtnctcgtccccgaccgcaacgcctggccgatgccccctctcttcctctgctgcgaaattgctatctcgcaagcgccacggcgaccacgaccgctctatc

SEQ ID NO: 67325 - DNA, 416 bp, Triticum aestivum
  Clone ID: PAT_TA_67325
gtcctggcctttggcgccgccgctacctggccggaggccgtcgtccagtgcctcctcttcgtcctcgccgcgggtatgctcgtggccctccactccctccctcgtcgagttgcccatcgtctccgccgcggcgccagcggctcctcggccgctcaatcgcgccggcacttcgcgctgggtgcccagctcctcgcccgcgcgcgagcagctgctgcgaagcccccgggcccgctcgcccgcgcggccctcgccgaggccgaccgcgccatcgcgctcgacccccgcgacgcagcgccgctgatcctcaaggccctcgccctcgacctccagggtcaccgcctccccgcgctgcgcaccctcgacgtcgccttggcgccgccgctcgcgcgatccctgtaaccgcgggagcgcgggga

SEQ ID NO: 67326 - DNA, 391 bp, Triticum aestivum
  Clone ID: PAT_TA_67326
cttcgcttcgctttccgcaaacgtgaccgcgaagccgccgggaagtcgccgccgcctcctcgctcctccagctcactctggagtcccgatgccgcaacaactctcaccctcgcgggctccgcccaccatgtcagctccatcggccgcgccgcaacgcttcctgtccaagccgagccgcgccgcgacgcctccgccgctgcctaagcagcctagaccccgtcggagcctcagatagatgcgagagaggtcgcctcccgcggccgtgtgatgggcaacacgtgcggcgtcacctttagatccaagtacttctccagcttccgcggcgcgccgcagcgccacgactcgggctacgcgcccgtcgccgtcgccgatgccgatgccgactccccgc

SEQ ID NO: 67327 - DNA, 518 bp, Triticum aestivum
  Clone ID: PAT_TA_67327
ctgccttccccactagccggccaccctctcctccttctcactgtcgcttcatctcctagcctccctccctactcccaacctccaccggccgccacatgattcaccccccttgatcctctccaccttccacactagagcccgtgggccgcggtacccactctgttgcctctaggaccctggcctccttcctcccgacaccggagcgcaactaccttcttcctcctggcgcaagaggtgccgcgcgcggccgcgctccatgtgtcccccgcaactcttcgatccccctgtcccgaccccagatccggcgaggatccaccaggcggtgcctcagccgtcaccgtcgggatgctttggatcgggcgacaggggagcccccgcgcggccatgcactggatcccctgtcttcctcgctggattcggccttcgccagcaacacctacgctcaggaggtcccaccaccgcatccccgacccgccactgtgactccgcgacacgacccgccaccgcgctcctcacct

SEQ ID NO: 67328 - DNA, 243 bp, Triticum aestivum
  Clone ID: PAT_TA_67328
gcacttgtgctggtggaagagtacgaaaggaacagcccctcgtcttggagcggaccgccactcactcgtggattaacaatgggactttgctctagcaattcacgcggtatggatgcataaatgacgaacttccaccgccgcccggccgtgctggtgtcggggcttccgtggttttttacgatgtgggtgagcgatgtcggagtggtgacaatggttgatgtagtcgggtcggtcttctttggt

SEQ ID NO: 67329 - DNA, 241 bp, Triticum aestivum
  Clone ID: PAT_TA_67329
ctcctcgtcaatgctacgcggccggggtcatcctctccacctccctcgtccacgtcctcccggacgcctacgcggcgctcgccgactgcgccgtcgcgtcgcgccggccctggaaggacttccccttcgcggggctcctctgcctcgtcggcgcgctgctcgcgctcctcgtcgacctctccgcctcgtcggacctcgaagcccacggccaccatcagccgcagcaggaggagggccagcc

SEQ ID NO: 67330 - DNA, 365 bp, Triticum aestivum
  Clone ID: PAT_TA_67330
ggggagacattgtgctgcagctatgaagaccggtgccatggaccttccttccttcccctgctcccatgctagctagcaagcaccctccatggacggggatgaccacgacaaggagaaggacgaggaccaggacgcataggaccccaacccctagcccgagaaggaggacatcgttgggtctgacctcgtgctcgacgccacggcttcatccaacccggccatcacaaggcaccgcacaagatatattcagccaatggtgctcctcatggtgcttggtgcttgttgagcggctttgctccatggacaggttgcttctcgagctgcccaacacactctagaaaatgctggccgaccagcttggcgct

SEQ ID NO: 67331 - DNA, 500 bp, Triticum aestivum
  Clone ID: PAT_TA_67331
caacaattccggcacgccatcgtcccctcaacaaccaaaccgtgccggtctccactgtgcactacaatggcgtgtccgagtacaacgcgcacaacctcttcggcctcttcgaggcacgtgccacgcatgccgcactgctcaaggacacagcgcgccgccccttcgtgctcacccgctccaccttccccggagcgggacggtacgcggcgcactggaccggcgacaattccgcgcggtgggacgagcttgccaactccatcaacactatgctcagctttggcctcttcggcatacccatggtcggcgccgacctatgcggcttcaggggcaacacaagccaggagctctgcagccgctggatccagctcggtgcattctacccgttcgcgagggcgcacacggagagaaccaccgaacgacgagagctctatgtgtgggagtcgacggcgcagtcggcgaggaaagcgttcgggacgcggtaccggatgctcccctacatc

SEQ ID NO: 67332 - DNA, 297 bp, Triticum aestivum
  unsure (1)..(297): unsure at all n locations
  Clone ID: PAT_TA_67332
tcgtcccggcccgttgttccctcccctcctctcgttcggcctctctgccctgcgaagttaccatcctgcccttggtgggccccacggccatcaatctcctggagatttttttttcctcctcccaattgtttttatttgtttctggggggtgcctcctccacatacatacatatcccatcaccanaaaccgcgggcctctccatcgacggctcccctgggctggtgctgctgacgtggcgaggtctcggccgtcgatatgtcgctgagcgagaagctggaagcggcgcgtatcgccct

SEQ ID NO: 67333 - DNA, 446 bp, Triticum aestivum
  Clone ID: PAT_TA_67333
cgtgcccctcgccgtcgtcgccccgccgtgcccgactccgccgcggcctcgcgccccccgccgggaccgcccggaccccgcgcccctcgccgaccccgccgcggcctagacaggcttccaagaaaatggcaagaaatgcaagggcaaagaggcgtgcggctcgtcgtctcagggccacaccgtatcccattccttcgtaccgctggaaggcaatgaaaggagccaacaggaagaaagcactgccaactgtgcagaagatggactgggaagatgccaactgctccgtgtgcatggaatacccacacaatgctgtgcttctcctttgttcatctcatgacaagggctgtcgcccttacatgtgtggaactagctaccggcactcaaattgcctcgatcagttcaagaaggcatacaccaagggggcattgcttgaggaactgcctgcc

SEQ ID NO: 67334 - DNA, 398 bp, Triticum aestivum
  Clone ID: PAT_TA_67334
cacacacacacactcgctgcgccattcgtttctgggacagagacttccgcagcggcaagaaaattagcagcgcagagcgatggagagcgtggatgaaaatggaggaagccgccttgtggtgaccgagctgggctacatcaaggagctggtgaggcagctggacgtgaacctgggaggctgccccgaccactgcaagcgcctggccgcccagatcttcgctgtgaccgagaggtgcatcggcatgatcaggtccgggcacttcgacagccggaagcgctccgccgccggcctcgactcgccgccgttctccgcgacgcccagccccctgagcgacgtttcgggcatgcctttccataccaacaacaagaagaggaaaacaatggagaaacggaagcatc

SEQ ID NO: 67335 - DNA, 227 bp, Triticum aestivum
  Clone ID: PAT_TA_67335
attgatctgtctgagcttgaaagtcttttctcagtatccatgccaagtacggatgcaaaacggacacgccaacgtcctcctgttgcatcaaaacaagaaaaagttcacttgattgacctccagcgttcaaagaattgtgaaattatgctgcggaacattaagatgccattgcctgatttgatggcttcagtgcttacccttgatgattccatcgctgatggtgatca

SEQ ID NO: 67336 - DNA, 620 bp, Triticum aestivum
  Clone ID: PAT_TA_67336
tctgtcgttaaccaacaaggcgttgttatcattacttcttctcccttcgctggctcgtcatctgcttgctatcaaggtcttcctttgcgacgtctggctgcctgatcggctaattttctcactcccggttcgccaagtttctgctgtggttcagttcatgtgatgccttgcgccctgtctttcatcttgccaagatgacagcagttaaacgagaagaagcagacacaaccggtgatatcagcggtggccaaattacccatggcaaagcaggttcaatccaaaagttcaaaggcaagaaaatccaactaaagcctggaaagtacattctccgtggtgagccttgcatccactacttagatgagtttagtcgccacattgtgggggcaacatagttaagctctacaaccataatgtttctagactgcgaaagatcatccgcaccaccaccacgcccgatcgctactatgtgtgccacatgccagagacatttgcaacaaatgacaaaagaatgtactttagtgttcccttttctacgggttctcttttccacacatggatgctgaccacggtgaactgtcaatcacaactggagacatgactaccgctgtcacaacccgctt

SEQ ID NO: 67337 - DNA, 234 bp, Triticum aestivum
  unsure (1)..(234): unsure at all n locations
  Clone ID: PAT_TA_67337
acgaagcagtggactggatctccaagttcccagtgtcaaacacatccctagaatccctcatgtttgattgcgttgctgtcccattcaactttgaggccctanaggcccttgtggcacgctcaccctctgttcgccggctgcgtgtgaaccactacgtttcggtggagcagctgcgccgtctcatggcacgggctccgcagctcacacaccttggcactggggcctttcgtcctg

SEQ ID NO: 67338 - DNA, 533 bp, Triticum aestivum
  Clone ID: PAT_TA_67338
aagccctcttcaaaccctagggaactcaatgaatgcaaattccacaccttgaaggattgatctagcactcttggctgctaactgtttgcttggtggagataatgatggaaagagaggacagatatgttagatttcaggactggagatcagagcaatctgttaactcagagaacacagtttcaccacgcagacatagtgtatttagatcacttaaagaaagaactggtggattatttgcattccttggaaacttattccattttaaaaccttgaagagatcaatgctggaagactggaagtccacgcaaaatgtttttcacccacaaggaccatttctgcaaagatggaacaagatatttgtgttatcatgtatttttgcagtctctgtggacccattgttcctctatatcccggttatcagtgataaaaatccttgctggtatttggataggaagatgaaaatcattgcaagtgtcctgcgctctttcacagatatattttatgtactccatatcatattccagtttcggaca

SEQ ID NO: 67339 - DNA, 546 bp, Triticum aestivum
  Clone ID: PAT_TA_67339
caatccactggctgtcgtgacaatcccaccaccaagccagtgtcctcctctcacccaagcccaaaaacaacgcatcgcccgcgaattcaacatttcagaaaccgtctttgtccatgacgtcgagaatcattcagagtcaagtgagagacaaattgacatattcactccggggcggaactcccatttgctggtcacccgacaattggcactgcagtgttgcttcatcctcaaggtgtcaaaactatgattgccaaagcagggaagattgatcttgaatttgatgccaatggctctgctagtgcttctattccacacaacgtgcgacttcattctcatcgcctcacccagcccgagtacgaagctggttcagatggccagatcgctcaagttgctgcagctgagcatggcgcgcagttgttcagtattgtcaaaggaatgacttttgcgttgattgagctaccatctctcgacttgttgggtgctgcaaagattggagcaatggcttatatatctggagacctacaagatgaaggttggaaacatgac

SEQ ID NO: 67340 - DNA, 183 bp, Triticum aestivum
  unsure (1)..(183): unsure at all n locations
  Clone ID: PAT_TA_67340
gtcaaggaacctgaatggttcaacgtcaccaagggttcgcttcatctccccgacacgcggcgagnccttttctccaccagtcctcctcaatccgacgctacccagcctcaacgagaacgactccgttgagttcgagatcatcaccggcacgacggacgcaccaagccaacgacgtcaccgcac

SEQ ID NO: 67341 - DNA, 484 bp, Triticum aestivum
  unsure (1)..(484): unsure at all n locations
  Clone ID: PAT_TA_67341
ccccccctgctcgctcggcgcccgccaccccctggcgatgaggccgccggcgccggtcgacgacgccatgcgcgcggtcttcacgcgcctgccggcggacgacccgaggagcctcgtccgcgccgccgccgtctgcaggagctggcgcgccatcctctccgaccccggcttcgcccacggctaccgcgcgctccacggggcgccgcccatgctcggcttcctccacaacgagtaccgcatgggcaaccgcttcgtccccacttcgaccttccgccggcgggcgtcgcaggaccgcccagactgccangtcctcgactcccggcacggcctcgtcctcctctacgctcctgcttacgacccccctcttgaagcccgcgacctcttcaccggcgactggtgggacatcgacgacgaccccaagtgccgtgacatcatgcactggccgggcgacggccccgacgacttcttcaccgggactgggatg

SEQ ID NO: 67342 - DNA, 585 bp, Triticum aestivum
  Clone ID: PAT_TA_67342
gcgacttgatcaacatcaactaggtatgcacctgcctcttgggtgcaacccccattgtacctgccatgcaatgaattctgctagaggaagactgagaggcctcaagttgtctcgtctctaaaccacttcacactcgtatttgatccattgctatcgtcttgcccattcacacaagccccaacaaacatacaaagaacgatggaagtgctccaccacagcgcctccatattccgagctgcttaccggtttgcgaaaacggccttctgcatgcgtcccagaaagttaccaaatccaatgagtatctccgtgggcccttgctttgactttggcatgaagcgtctaggcttgcacaacgatgcagaacaccctcagacttccactggatacaggtacgacttctcgagacaatagcgcttactagggctgcagcagcccattgaactgcgcctgggctacgagtctgggcgttaacccccgttcctacagtagggtttgacctcagacgcacaatattgcactcgccggggcatcggttagagtcaccgggtacctacgataacccgcctcgtgtgctcgcatggcgac

SEQ ID NO: 67343 - DNA, 532 bp, Triticum aestivum
  unsure (1)..(532): unsure at all n locations
  Clone ID: PAT_TA_67343
acaggtgctgcccgaggaggtggtaaacgccaagcagggaagaagcggaagcaatccccagaggaggatgaggggcagagcagaggggcgaagccattaggaaccaggcacatggagaagtcggaagcagagatacaggtgctgccaaagggcgataatgtcgatggcaaagagaagaaaaagaaagggaaaagaatccggaggagtaaactaaagaaggaccggcttatcacccgcgctgcacaacgaaatatgtttggatcggctttgaaggatgaatttcctgtgttaaaagatggctcaaaaccaaaagtactgataacagcatgccagtatattatggacaagcaaggaccttcatcttcatttattcatgagctaatgcaactcattccagatgcatgctatattcatcggacgaatgtttgcctcgatgaagtggttgagtatgcgaatgaaagaaaatttacttcacttattgntgctctttctgatggcttaaaaattatcaacttgcctgatggtccccttg

SEQ ID NO: 67344 - DNA, 452 bp, Triticum aestivum
  unsure (1)..(452): unsure at all n locations
  Clone ID: PAT_TA_67344
tctccgcgcgcggcgccagcgacgccgccccgggcgccggcggctcgcgcggcagcgacgatgacgacggccgctcggcgcgcaagaagctgcgcctctccaaggagcaggccgcgttcctggaggagagcttcaaggagcacagcaccctcaaccccaggcagaaagtggcgctggcgaagcagctcaacctccggccgcgccaggtggaggtgtggttccagaaccgcagggccangacaaagctgaagcagacggaggtggactgcgagtacctgaagcgctgctgcgagacgctgacggaggagaaccggcggctgcagaagtagctggcggagctgcgcgcgctcaagacggtgcaccccttctacatgcacctcccggcgaccaccctctccatgtgcccctcctgcgagcgcgtcgcctccaactccgccccggcctccgcggcg

SEQ ID NO: 67345 - DNA, 463 bp, Triticum aestivum
  Clone ID: PAT_TA_67345
tttttttttttttttttttctgatgttctcaagcatgttttgagctagtactctgaattattttccattgatttacacacgtttcaagcatctgtcggaatccctttactataggaacttacaagatcatttacacattccactatattagcatgccccaattttttaacagaaaaaaaatgcaattaaatcttctcctatctgggcccaaatcaatggcgattcggccttcatggcgagggcccaaatcaatggcgtttctctcttatatctactttccctgagacgttccctggccaaagtatatcgaggctgaaaaattcccacggtcccttgaatttactctctgcgggctagatggtgacgctgttcgggacgcctcggcaggtgatgcccggcccggacgacggcgccatgagctcgtacggcagcacgccggcgccacagcggttgcgccgggcgg

SEQ ID NO: 67346 - DNA, 572 bp, Triticum aestivum
  unsure (1)..(572): unsure at all n locations
  Clone ID: PAT_TA_67346
ggtatcccccgcacgctcaactgccactaccgtcatccccgcttatccatccactctcaggcctatgacaattaagcagttgtatgatggattcctggaggacatagagcgttaccctatcgtagttgacggagacaccgtgtcatcagtgatcctgataggaactgtttcacactctactgttcgaatgaatcactggtccttcgatctacaggatgccacagggtcggaaacaacttccgactttaaacttgcttggtcatcaagcaatggcgactatgttcaactatttggcaaacctgccatgaatgacagattccttcagattaaatctttcaagatcaggttaatcgaaaactacaatgacaccacacaccactacttgtataccatacacaccacattagacattcgtaagagaaacacccacaaggcaagaatggaacctgactccacagcatcaactgttttccncaaagggccgtcaattaccccgtcggaggtgcccttgcattcgtcaacaaaggacaagatagttgccatcctgcgagacccatcttaccgcgatattc

SEQ ID NO: 67347 - DNA, 451 bp, Triticum aestivum
  Clone ID: PAT_TA_67347
attggattcatggtcgcaagatctctaagatcgattaacttgcttttaatattatatgaagttcaaatccctttatattccaagacaagaaacactgagttgtaaaactctgtcagtgttgaatagtgtaacaaaacacatattgggataatggggcgtgtaatttgtttgccatactcaccagctcacctgatttaccagctgtgagcttcattgatccaaaaccattttagccatcatgagatcgaagtttgtaggccccccttgaataagctaacgtttccaccttattgtgggtaccacgaaaacattaataataagaggcacaaacaaatattattttgtttgtttagatgatgcatttcgtaacgtatcatgcattgaaataatgaatcccttgctatgtagtattatttgtgcaattccatgctactctgggtggaagtatgta

SEQ ID NO: 67348 - DNA, 489 bp, Triticum aestivum
  Clone ID: PAT_TA_67348
caatcagcttcagtcttgcttcttttgtagcaagtttagttgatttgtccccagaccagaccagccctgtacgacaagactagtctcagccagtcagtcattttaactcgccaccgggcataagcgctcctggcttgaccagatatcacatattcccgcccatcatgtctcctccagttcctgagcagaagcctcagcttcaacaatcacagcagcaacaacagaccccaccaggagaatcagcatctggcagtgctagcaacgactccaagtctgtgacacctgcacccagctcttcctccaacacttcccaaagcagcggtgctgcatcaacatcaaacgatgacaaccttatctgccgatggaacgcctgtaaccaaaagttcccggctcccgaggctctctatgagcacatctgtgagcgccatgttggtcgcaagagcacaaacaaccttaacttgacttgccaatggaactcatgccgaacta

SEQ ID NO: 67349 - DNA, 269 bp, Triticum aestivum
  Clone ID: PAT_TA_67349
gctgttaccttttgtgttgtgtcccaaatacatcacctttacttctgggatggcatattactgcgttacagcttgcatagagcggctgaatgctaaggtgataccagatggacctagagaagtgcaagcatgcttggaaataacggaattgtgggatttgaagcgcctggagtgtgaaatagtgggattttcaccatatctcctgcttcttctggcacctggaagcagcaatgcaaggattgctatatgcatctgcatctgcggacatg

SEQ ID NO: 67350 - DNA, 486 bp, Triticum aestivum
  Clone ID: PAT_TA_67350
atgtgtctttgccccaaaagacccgtctgatgaaaacgggcatcataaccctggctttgccgtcgatgctcaccgtgcggaaggatcaaggcgtccttctttcttcagcgaggaaccccttctgaacagccctgcacacagcaccgaagacaagcctaacgagaccaatcctaccggaggagactctgcaccttctggccagaaattcatgaacacagagggctcttgtcgatggtcccaacctctgcctgctgcttcagccaccactgatatttcctgtgctacaacattgaactcactgcaaggcaaggggagccgtagcctgaatagtagtaggaggacaaggaagggcaaggggcagtctgcaacgcccgccgtcgctccgccaaccgagaaaaaatcacgaggtggaagcatcgtgagccggttaaactccacggtcgaacggatcgaagcgtggagatgaatgagctcagatgctactgt

SEQ ID NO: 67351 - DNA, 342 bp, Triticum aestivum
  Clone ID: PAT_TA_67351
gcctccctcgacggtggcctcccctggaagctcttgaacctacaatggagtcggttccctgtcagtatgaaattcttgcgtttggccgtcagactattagttgtaaccatgttattctgtcaagcttttccatcgagttgccggaacaatatcaaagtagacgatgttaaatatgaaagtaccaagttatgtactctgctattgtggttgtgaagctcgtacagtctgcttgatgttcgcaacaaatttccttcaggcaacaggatgatgagttcagtgcaagtcttcaaattgcagggctaatcataggcaaagaattctggacttctgtgggttttcatg

SEQ ID NO: 67352 - DNA, 412 bp, Triticum aestivum
  Clone ID: PAT_TA_67352
caccactccaccatcacctccatccatcagcgccgtgccacccagcacctccaccatgcaccaccagcaccactccagatccacctcacgcaactcaccagacagagggtcggcggtgtctgatccatcgcgcgcccgatgctggtgcctccttcttcaacctgctgcttcttcttcctcacctccgctgctgttgctcctgctcttcttgcgctcatgttgctgctcctctgaacccctcgtaccgctgctcctaatcttctccaacttgctgctgctctgcttactctatctccttgcaccgctgctgctgcttctcccgcgcgccccaacctgctgctgctctttccccaccgaatctgctacagctccactctctaaggcctcctttgctgattctttgctctgaacc

SEQ ID NO: 67353 - DNA, 234 bp, Triticum aestivum
  Clone ID: PAT_TA_67353
agcgggctcgcatccgtcacccgcatcgccccccgtctcgcgtcgggctccccgccaccggatggagagagggagggcgtgagatcgaccgcgcgcccccgatcggaccggaccccgccgaggagccgcgagcgggcgagctcgatccgaccgcgggagcgccgcgcccaccggatcggggctggcagccgagggatccgagccggggaggagacaggtggtggtgattggtcg

SEQ ID NO: 67354 - DNA, 437 bp, Triticum aestivum
  Clone ID: PAT_TA_67354
ccgcctccccctctttccgtcctgacacaggcggatctggacaggcttccctcatcccctaccctcgttcatcctcctgccggcggccatggcgccgcgcccgccgctcgtccggccgcccttctcgcctcgacccgctacccatgcccttctggcgcccctctgtaatcggcagttgatgcacgcgagacgcgtccatggaatcatgccgctcgccgacggcagatcgagcgccgtcgtcgatccgcgagctccgtgccgtttcctggcggccaagagcaccttccgccaacggccagcagtgcatgcaatcgccggcttggatatttcatccagctgactgcgccgtgtaggtctctaagcttgcatggtgtttcctagctctggagatcgacaaatccatctgcgacgaggagctaattgcatacccatccacc

SEQ ID NO: 67355 - DNA, 347 bp, Triticum aestivum
  Clone ID: PAT_TA_67355
acggggctggtgctgctggacttctgggtgagcccgttcgcgcagcgctgccgcattgcgctggccgagaagggcctggcctgcgagtccctcgagcaggagctgctgggcgccaagagcgacctcctcctcggctccaaccccgtccacaagaaagtccccgtgctcctccacgatagccgcgccgtctgcgagtctctcgtcatcctcgagtacatcgaggacgccttccccggcgcggccccgcggctcctccccgccgacccgcacgcgcgcgcgcaggcgcgcttctgggccgactacgtcgacaagcgggtgtacagctgcgggacgcggctgtggaagct

SEQ ID NO: 67356 - DNA, 467 bp, Triticum aestivum
  Clone ID: PAT_TA_67356
tccgcttcagttagccaccatgcctgccctcgccaagcccgccgccgcggcgccgaagccgaagccagccgccgccaagcccaaggcggccgccgctggagccgcccacccgacctacttcgagatgatcaaggaggcgatcgcggcgctcaaggacaggaccgggtccagctcggtcgccatcgccaagtacatcgaggagaagtacggcaaggctctcccggccaacttcaagaagatgctctccgtccagctacgcgcctccgccgccaagggcaagctcgtcaaggtcaaggcctcctacaagctctccgacgccgccaagaaggacgcgcccaagcccaaagccgcggcgaagccctccaaggacgccgccaagcccaagaagaaggcggccgagaagcccaagaagaccgccgccgctggcaccaagcgcaaggcgcccgagaagaagaagctggtcacca

SEQ ID NO: 67357 - DNA, 464 bp, Triticum aestivum
  Clone ID: PAT_TA_67357
cgaacacctccgcgaatcccaaactaccaacccgatccctcctccccctcgtcccgacgagcaccagcggccggccatggacgcctcagccaccggagccggagcgaaggcgaagaaggcgcggcggggcgcaaggccggcggccccaggaagaagtcggtggcgcggtccgtcaaggccgggctccagttccccgtcggccgcatcggccggtacctcaagaacggccggtacgcgaagcgcgtcggcacgggcgccccagtctacctcgcggccgtcctcgagtacctggccgcggagctgctggagctcgccgggaacgccgccaaggacaacaagaagtcccgcatcgtgcccaggcacctgctgctggccgtgaggaacgaccaggagctcggcaggctgctggccggcgtgaccatcgcgcacggcggcgtgctgcccaacatcaacccggtgctgct

SEQ ID NO: 67358 - DNA, 240 bp, Triticum aestivum
  Clone ID: PAT_TA_67358
aattgcaatagctgacatgataccgcggactgtacatctggtgcaaatggcacgtactgaagaaagcaaaggagagccttggagcactgcttgcaaaagggagtgaattcaagccagagttcagcaaactagtccaccacgcagttagtattgatgagttcgagaatgggtgggcttgcatgttggagaaatatgggctgcaaaaaaaatgcattcctgacccagctgtatgaggtgagg

SEQ ID NO: 67359 - DNA, 158 bp, Triticum aestivum
  Clone ID: PAT_TA_67359
tgcactgtcttttgaaactgttcgagtagtaattggatcgtccggctgggatgttcttgttcctggagtagcccatggagccctgatacaggtagaaagaatcattcctggatcattgccttcatccatcaaaggacctgtggttctacttgtaaata

SEQ ID NO: 67360 - DNA, 303 bp, Triticum aestivum
  Clone ID: PAT_TA_67360
cagggtggtttatatccaagaatgcaattgtatctggcctagaacttctatgcatcaagtatggtgcacctgaagatgcctctccaaagcttctgcgaaagagaattgtcctatagaagtaggtggatgaggaaaaatctaactattctttaagcaaacagcgagtttgatggttttgaacttttgatacccatatgctggaacagttttgcttcagttccaccatgccttgtgttgcctatcgaagtacgatggatgaaggaaaattagaacagcttcagttgcaatttggggccatgatga

SEQ ID NO: 67361 - DNA, 308 bp, Triticum aestivum
  unsure (1)..(308): unsure at all n locations
  Clone ID: PAT_TA_67361
cgcctcctgctccctcccaccttctcctcctcctccttctccgcctaggagcctcgccgccgacggctactcctccaccgcctcgcctcttcctccttctcgccttcccatcgctcgcgcgcaggtcacccgacggcaggggtggtcttgaaggcttcccanactgacggaggagcacgccgccgccgcacgccgcccgtcccgacgcgcgtccgcgtccgccccgacgcagcctggccgatctttctcgggaggcagcgagagttgcatgcgccgcggttggcgtgcacgcgctgctcaactgggtc

SEQ ID NO: 67362 - DNA, 516 bp, Triticum aestivum
  Clone ID: PAT_TA_67362
ccgcagcgccgccactccacccgcagcggcaaccatggcggtcggcaagaacaagcgcatctccaggggaggaagggtagcaagaagaaagccgtcgatccgttcaccaagaagcagtggtatgacatcaaggcgccgctgctgttcaccagccgcaacgtcggcaagaccctcgtgtccaggacacagggtaccaagattgcctcagagggtctgaagcacagggtgtttgaagtatctctagctgatcttcagaacgacgaggaccaggcctacaggaagatcagactccgtgctgaggatgtgcaagggatgaatgtcctcaccaacttctggggcatggacttcaccactgacaagctcaggtcccttgtgaggaagtggcagacactcattgaggctcatgtggatgtgaagacaactgacaactacatgcttcgcatgttcgccattggcttcaccaaaagacgcccgaaccaggtgaagcgcacttgctatgcccaagcaagtcagatc

SEQ ID NO: 67363 - DNA, 498 bp, Triticum aestivum
  Clone ID: PAT_TA_67363
gcggctaactggcgctacgcaaccgtagtcgcgccccgtgcccgctcctccaccatcgtcgccagcctcggcacccccgcgccctccaactcctcctccttccgccccaagctcatcaggaacacccccgtccaggccgcccccgtcgcacccgcattgatggacgccgccgtggagcgcctcaagaccgggttcgagaagttcaagaccgaggtctacgacaagaagcccgatttcttcgagcccctcaaggccggccaggcgcccaagtacatggtgttcgcgtgcgccgactcccgtgtgtgcccctcggtcaccctgggcctggagcccggcgaggccttcaccatccgcaacatcgccaacatggtcccctcctactgcaagaacaagtacgccggtgttggatcggccatcgaatacgccgtctgtgctctcaaggttgaggtcatcgtggtgattggccacagccgctgcggtggaatcaaggctctgctc

SEQ ID NO: 67364 - DNA, 324 bp, Triticum aestivum
  unsure (1)..(324): unsure at all n locations
  Clone ID: PAT_TA_67364
gttcactgccctacgtgcaccaagtggcagattgtctgccacgatggtctctgcgctcctgaggagtgctacgacgacacatggcaccagctcaagatctgctnacagcggaaagtgccactacgcctcgtacgagaaggaggagtgcaaccagcgcattgtctgctacggcaacaagtgtgagcgtgaccagcactactctatcgactacgctcgcaagttcgtctgcgatgtcgacgaagaccgatggtacttcgatgactgcaaggacgactgctacacctacgagaagtgctctcacggcgagtgtgagcccgttcaccc

SEQ ID NO: 67365 - DNA, 317 bp, Triticum aestivum
  Clone ID: PAT_TA_67365
gtggcgcaaaatttggaatgatgccccagctttgcctgtctctgaacagaaatctctgcttgattctgttcgagaaagagaaaaggtggttcattaccttgaaactttgagtccacagcagcttcttgagcaaatggtctgcacagctttcaaatcatcagctgacattctaaacaagaccacatgtggtggcttcaaattaatgaagactaaaatggatcaactttatgctacattggcgtcgacattaagatctcttcaagggaaatctgacccaagtgatttggctggagatttgaagcgactttgtcaagttt

SEQ ID NO: 67366 - DNA, 308 bp, Triticum aestivum
  Clone ID: PAT_TA_67366
cacagtcgtcaaatgtctgccgatcagcctctccccttcatctaccagttcgccgcaggcgccattgccggtgtctcggagattctggtgatgtaccctcttgacgttgtcaagacccgagtccaactgcagactggttccggtgccaccgctgagtacaatggcatgcttgactgcttccgcaagatcatcaagcaggagggtttctcccgtctctaccgtggtatctctgcccccattctcatggaagctcccaagcgagctaccaagttcgccgccaacgatgaatggggcaaggtctaccgaaa

SEQ ID NO: 67367 - DNA, 332 bp, Triticum aestivum
  Clone ID: PAT_TA_67367
aaccataatgtttttgagtcgtactattgtagcactctgactgctccccttgcatcacccaactcacgcctccttgccagtacaaaatcctccctatttgactggccagttggaagtgactcttggtctgaactcaagctttccaatgtgcaagtacggcagattgtggaattataatggtcagttcattgccatggatgatcatatgaagatctacactttgcagttggcgccccagcttggcctgcaagacctaccaatagagtggtgcggcggcaagataccaagcatggattcgaaaccatttctagtggtctgccgcgacatgcttc

SEQ ID NO: 67368 - DNA, 373 bp, Triticum aestivum
  Clone ID: PAT_TA_67368
aagtctggcctacggtggggtggcggcatgcgcagcatggtcgtcgtttgattcaggagcgacctccggctgctgaacaaccagtcactggagcacgtgtggatggcctctggcactgtcctcaccaatggaggagcctcgcctatgctgcagtgctgcagggcggtggtcggggtggtccgcaccggcgcctacaatgtgtgcctcatcctaactggcaaagtgatcttcagcctccccatcaactacaccctcggcatctcccttccgaggatctgcaagtcactccccgtcccgctcgtttgtagaatacggcgacgcagatcctagctccagatgtcttaaattctcctttgttgaccttgccttgaca

SEQ ID NO: 67369 - DNA, 414 bp, Triticum aestivum
  Clone ID: PAT_TA_67369
acaaattttttgctgaccacacaagttggtgggcttggacttacactcaccaaggcagctcgtgtcatcgtggtcgatcctgcttggaatccaagtacggacaatcagagtgtggatcgtgcttatcgaattggtcagaccaaagatgtgattgtataccgcttgatgacttctggaaccatcgaagaaaagatatacaaattgcaggttttcaagggcgctttgtttagaacagccacagagcagaaagaacaaacacgctacttcagcaagagggacattcaagagctctttagtctgccagcacaaggtttcgatgtttcccttacacaaaagcaattgcaggaagagcatgggcagcaacttgtcatggatgagtcactgagggagcacatagagtttctggaacgacaa

SEQ ID NO: 67370 - DNA, 569 bp, Triticum aestivum
  Clone ID: PAT_TA_67370
tattggctcaatcatcaagcacttggcccctgggtcagcgcttaacagcatccagtccaagaaccccgacgatatcgtcatcactctcgccgtgcgaacaccgctcacaaaggccaagaagggcggcttcaaggacacatcacttgaatacatggtctatgctattctgaagcaagtccgagaacgatcgaaccttgaccctgcccttgttgaggatatctgcctcggaaacgtctctgatgtcaaggccgcctacaaggtccgcgcctctgctcttgcagctggtttccccaacaccgccggtgcctcttccatcaaccgattctgctcctccggtctcaaggccaccgccgatatcgcccactccatctccaatggctccatcgaagtcggtatcgccatgggtgccgaacagatgtccatcggtggcgacgcgcttgacaagcccttcgacgaggccgttacatcacaaagccaggaggctgtcgactgcatgcagcccatgggttggacaagcgagaacgtgagcaaggactttggcgttacccgtgagatgatggacaagttcg

SEQ ID NO: 67371 - DNA, 398 bp, Triticum aestivum
  Clone ID: PAT_TA_67371
tggctctccaccctcgcgtcgcttaaatactacgccgcagccccacgcaaagccactctctccctccccccttctctctcgcgacctcctgtttccgcccaccttctccggctccggcgccggcgaacccaccgcggatcgagcgattcccccgatcaggagaggcgagccgggaggaagagcacctacgcgggaggagaggagatggggctcacgttcaccaagctgttcagccgcctgttcgccaagaaagagatgcggatcctgatggtgggtctcgacgccgccggaaagaccaccatcctctacaagctcaagctcggcgagatcgtcaccaccatccccaccatcgggttcaatgttgaaactgtggagtacaagaacatcagcttcactgt

SEQ ID NO: 67372 - DNA, 253 bp, Triticum aestivum
  Clone ID: PAT_TA_67372
ccccgtcgtccgatccggtccgatccggtccctcgccatggcacagcacgacggcaagccataccagccgcgccgtgtccccgagcgccccccgcagccggcggaggacccgcccgcgcccgccgctgcgcccgcagcagcggacgccgtgattgaccacctcgcggccgtggctgccgaggcggaggccttgaacgcgtgcatagcggccgtcgcggccgaggcggaggcgatgaacgcgtacgagcacgcg

SEQ ID NO: 67373 - DNA, 396 bp, Triticum aestivum
  Clone ID: PAT_TA_67373
ctttggtgaatcaaagacccacaaaacaaacacccgtatggaaggaacattgtaagctgatggtctagcatgcatgcatatagttctttaatgcgcataaattcgtgtacttgtattgctaacgacttgaaaaatgcttattgatgtcataaagaagattcatggcaccagaatacataaatgagtgtgcgatatcaccaaagaatgacgtgttcagtctaggcgttataattttctacctagtggctggacgaaagggctacggcgaatattgtgactcacggtcctctccccggcaagaattcattgatagagtaatttgttttcatagatattttgtcttgtaatcttgaagcataaatattatatgtgtttgagcttaccctacatcgcaat

SEQ ID NO: 67374 - DNA, 156 bp, Triticum aestivum
  Clone ID: PAT_TA_67374
tcgtgggtgcttcaatggagcgccgtcgggcatcgtttgtgcttcacgcctattattgctgccatggaagctgctgcactgaggctttttgctgtgctccgtgctgctcatgcacccggtggctcccgctgatgtgatgcgcggtacccggtggct

SEQ ID NO: 67375 - DNA, 367 bp, Triticum aestivum
  Clone ID: PAT_TA_67375
ggggcagggggcggcccgtggggttcatcagccgcgcggcgcccgtggtggcgatgccgatgccgatgccggtaccggtgacggccgccacgccgacccccgcggtggtcgtctcaacgccaccaccccccgcgcccatgtcctcatccgtcgccgccgccgccgccgtcttttttacgccgccccttagtgacgtggtagggtgtgcttccggcgcaaattttacacctcatatcttgaatgttgctaccggtgaggatattaatatgaaggttatatctttctcccaacaaggtccaagggcaatttgcattctgtctgctaatggtgtgatttcgaatgttacgttgcgtcatcatgattcttt

SEQ ID NO: 67376 - DNA, 521 bp, Triticum aestivum
  Clone ID: PAT_TA_67376
acaactgcaacaaggcccgcctctctcgccgcctccttgctccgacgatcatggctaccgccgccgccgtggtggatgctgccaactcgaagccgcgggacacggagcgccgcccccgccgtcttcgcagggtcaagaagacagggccgcgggcgccaatgcggcagtcggcgagggcaccagggagagcgccggtcccgacccccacccccaggtggaggtggagtacgtgccggagaaggccgacctcgacgtcgacgacctcctcctcggcgtcttcacgaccatcttcgagaaattcagcttcacggtcaccgccaccgccaagggcgaggggaacgagaaggaagcatctaatgatgccgcaaagaagaaggggtccgatgttgattatgatgagcaggatgccccaaaaaagaagcagctgcagaggatgaagattgcagagttgaagcagatatgcaacaagcctgatgttgttgaggtctgggatgctactgccgttgatcccgagttgcttg

SEQ ID NO: 67377 - DNA, 328 bp, Triticum aestivum
  Clone ID: PAT_TA_67377
cgtcggtgcatccatccgtccatggcggccaccgtcggcaaggagagggaggaggcggtggtccacccgaacgcgaggcaggggggcaagctcctctccaggctgctcaccagggacagctcggccgccgcgccgtccttcctggtctactacggcgtggcctccgccggcgcggtgccgttcctgtgggagtcgcagccgggcacgcccaagaacgccgtctccgacgccgcgatgccgccgctcacgccgccgccgtcctactacgccgctggaggcaccgccgccgcgaagaagcacgcggcgcgcaaggccgccgccgggggca

SEQ ID NO: 67378 - DNA, 501 bp, Triticum aestivum
  Clone ID: PAT_TA_67378
ccaaagttgctccgtctgccgtggtcggaagatcgctgcgaccaaaaggaaccctcgtgtacacaatgcaccaagaaggggatggcatgtcctggttatcgcaacattgttgatcttatgttccgagatgaaagctcccatgtcatcaagaaagcagaaaatagacgagcccagcatctcgttccgaataaaaagagctctgctggccagggactcccctctccgtctccgtctccctcgacaccaactgagcccatcggctcatcaccgacattcatcattaatccaagacctgttggagtcttgccgcctgcttccaaagtagagaattctaacaaagcaacggatagacgttctagaaaacgggccgctcgttgccgcgcacccgtgctttcagctttgaataacgattggagccgttcctcctcagagacttcggaaagcccacctgataccaatgatgatggcagaacttccgagctcgacgtccccttagacagg

SEQ ID NO: 67379 - DNA, 527 bp, Triticum aestivum
  Clone ID: PAT_TA_67379
cattattgcgcacaggtgtcgcaatgtgcagccgaggctactaccaactcatccagcattaactcgcggctttgcagatgccaagcgaccaccctcagctccaaaacccatcgtcgatatcaagcacattcgccaacatgcagaactttatcagcagacttgtgtagagcgcaattatcgcaagcaagcgcaaaacccagctaaaattctagagttgcacgcaagatggcaggatcttcagcgacaaggccgcgcgctgcgtgagcgatcaaatctattgagacgccagcttgcgaacccggctaccagcagcggcgatgaggatctcaaggaagtgcgccaattgacccgcgagcagatccaggatgaggctcggcagctcaaacaggatctttctgcgattgaaaaaggagagtcgcagtcagttacgcagatggaggaacttgcgctggagttgcctaacctcactcatccggatactcccaagggaagtgagtttgaggtgatgagctatatcaacgaccctc

SEQ ID NO: 67380 - DNA, 405 bp, Triticum aestivum
  Clone ID: PAT_TA_67380
tggtcggcgtgtccagggcgatcccggcgctggtgccgctgctgcggagcaccgacgccggtggcgcatgacaacaccgtgacggcgctgctcaacctgtccctggaggagcggaaccgttcggacatcacggcggttggcgccatcaagccgctcgtctacgcgctgcggaccggcacagcctccgccaagcagaatgccgcgtgcgcgctgctcagcttgtcgggcatcgaggagaaccgtgccaccatcggcacgtgtggcgccgtcagcgccgctcgtcgcgctgctctccgcgggctccacccggggaaagaaggacgcgctcaccacgctgtaccgtttctgctcggcgcgccggaacaaggagcgtgccgtcagcgctggagccgtcgtgccgctctt

SEQ ID NO: 67381 - DNA, 367 bp, Triticum aestivum
  Clone ID: PAT_TA_67381
cggtcacaagagactgccgatctcaaaagttgtgtactcctttctcaatgacacgctgtctgcatcgttccattacccaaaatggaacaaggggcgagtcatatgcctgaagtcccagttgaaaaagctgcaggcggccatagattcctcttaacggcgcggctgtgcctggcttcgtgcacatgacggagtcccgtctgccatctcctggctcgaaggtatacacgggggagccccatgttgagaacggctcggcccattccaccgctgaatcgttggtagaagaagaaaaggagtcggaactccttccgctgtgagctctcagggttgcagagatatggtatttattatctggccgaacagggga

SEQ ID NO: 67382 - DNA, 298 bp, Triticum aestivum
  Clone ID: PAT_TA_67382
gcagttccactccctcgccatgcgcaagattaagatcggaatcaacggtttcggaaggatcgggaggctcgtcgccagggtcgccctccagagcgacgatgtcgagctcgtcgccgtcaacgacccctttatcaccaccgagtacatgttttacatgttcaagtacgacaccgttcacggccactggaagcacagtgacatcaagctcaaggacgacaagacgctgctctttggctagaagccagttaccgtcttcggcgtcaggaaccctgaggagatcccgtggggtgaggctggt

SEQ ID NO: 67383 - DNA, 233 bp, Triticum aestivum
  Clone ID: PAT_TA_67383
tcaccagctcccaaacctcgcgtgcaccactccatgtccggaccagcagcgggaggcggagaggaccgcggcggcggccagctctacggcgaccatccgcctgccgcggccgacgtactggtggacgacgtcttctttcagagtcgttcggcgtgcggcggcggggacgatggtggtgtcgcgccgtcggcctactccagcatcaccgactacctgcaggggctcctcgaccc

SEQ ID NO: 67384 - DNA, 315 bp, Triticum aestivum
  Clone ID: PAT_TA_67384
ccaccacctgttccgccgccgcgtcgggccaggctgcatctccctcgacttcggcaaccttgctcgcctcgccgaggagtcccgttgcttctcggtgaacgaggtggaggcgctgtttgagctctacaagaagatcagctgctccattatcgacgacgggctcatccacaaggaagaactgcagctagcattattcaagactcctagcgggcagaatctttttattgatagggtttttgatttgtttgatgaaaagaagaatggagtaatagagtttgatgagtttattcatgctctcagtgtcttccatccatg

SEQ ID NO: 67385 - DNA, 551 bp, Triticum aestivum
  unsure (1)..(551): unsure at all n locations
  Clone ID: PAT_TA_67385
ctattgaaccccttcactggctgggcagattgggccgtaaggctcctctccctggggtttatgatgatgaatgcgatgaggatggcggagtcgacaatattcttcagaacaacaatgagcttgttgtcaagggtaccgctaagttttttacctggcatgttggacttttcaaggcttgttgatgctaatgcgcaggagccatctactggtcctatcaattccgtgcagtttcataggaatggacagctgatgcttgctgctggcctggataaacatctgagatttttccagattgacggggaaagaaaccccaagatccagagcatatttatccaggatcccccgcaaaaaaaaattatcgaggattgtccggtttacaaggcatcctttctacctgatggctctgaagtgatcctttcaggcangaggaaattcttctactcatttgatttggtgaagctgctgttagtaagattggacccttgaccgggcgcgaggagaaaagcctggaaagctttgcgatatcacctgactcaaaaaccattgcgtct

SEQ ID NO: 67386 - DNA, 227 bp, Triticum aestivum
  Clone ID: PAT_TA_67386
ccacttactagtggcagtgtcccactcctgtggactcctgaaactagagtttttggagcacctcctgaagagctacacgaacaacacggagttatcccccagattcaaattttttgcggagtggggcagtgtggagctaccccgtttggtttgtggttttgagagtggtgctggaatttacggagtggagcagtcccaaacaggctcttaatctttgcagtgaaggg

SEQ ID NO: 67387 - DNA, 294 bp, Triticum aestivum
  Clone ID: PAT_TA_67387
ccgcccgccccgccggcccggggctctacgccgacatcggcaagaaagccagagatctcctcaacagggactacaccaccggccagaagttcaccttcaccaccaccgccgccaacggagccacaattactagttcaatcacaaagaaaaatgaagctatcttggctgacctccagacccaggtgaagatcaagaatttcacagtggatgtgaaagcaacttcggactcaagtgttgtaactacaatcactgttcctgagctgtacacaccaggcttgaagggagttctttctc

SEQ ID NO: 67388 - DNA, 198 bp, Triticum aestivum
  Clone ID: PAT_TA_67388
tcatcgatctcgacctccgcggcgatggatttctccggcggggccagcggggacggggcgtagtgaagctgtcggagatgtattggagcgcacggaggctgctgctctcggcccacgtcgagcggctcgcctcggtgccgctcgtcggcgcggcggacccggcgggagctgacgggtgtggagggaggcgcgtggcgt

SEQ ID NO: 67389 - DNA, 333 bp, Triticum aestivum
  unsure (1)..(333): unsure at all n locations
  Clone ID: PAT_TA_67389
tggccatgaggagcgcgcagccgccagatccatgggcagatccagccggcgccgtcggcagccatccctccctccggtggccgtaagaattgaacaggcttgagcagaacgagtgcatggacggtgcgcacctccggcgataggagccaccagtcctcgtcatctgctagcatccacgaggaatcgatccatatgtaagctagcttccagaataatccatccagctggctgcttgcttgtatgtgtactagtggaaacganagcaaaatgcgagaccggcgtcgagggtacatgcccgctgctaattgattctccaggtaatataatactccc

SEQ ID NO: 67390 - DNA, 257 bp, Triticum aestivum
  Clone ID: PAT_TA_67390
cgcggctgttcgtcgccctgccttttccatgccggccgcctccttcttccccctccactacgcgccaccgccgccgcccaggcgcggcctcgatccagcgccgccgcccaccactaccaagaccccggcccgccgtcgcccaccaacatgatgcccctgtgcgcgcaaatccgatcttccctctgctccggcgcgaccttccatcccctccagtgcggcctgccctctcctgcggcgcgccctcctctcgcaccacc

SEQ ID NO: 67391 - DNA, 236 bp, Triticum aestivum
  Clone ID: PAT_TA_67391
tctagcccgccccaaagccggttggcgctgccgcagcccgcaccaagctcggctctccatctcatgcgcgcgcgctgctccctgccgcctgcttccgcgaggagagcctcctcctcctccaccagcccgcggcgggcgccatggacctgctcggcgtcttcttccatggcgcgacgctcgcgttcgagcgggacgacctcgggaaggagatcatggggatcgcggtgccgggcgcg

SEQ ID NO: 67392 - DNA, 686 bp, Triticum aestivum
  Clone ID: PAT_TA_67392
ttgcttattattcacatgatgatgtacatcgatcgacccctgtcccctgctaagaagaagttccaactttgtttggaggagcttcctccagtttgagcaatgaaatccctttaaccccgaaaaaaaaaaagaagttccaacttgatggatatactgctgctactagtaggtagctacttggtggtttggtagggcgcctcgcagaactcgccgcaaagatccctcgtgccgaattcggcacgaggtgctaactggaactggatagtcgatcctttaaatggcgaaaagtttatcaaagttgccgaggttcaggggtctgaaataaagccatttgtggagagtttatctaaatgcccaaagcatggacttcacaacccacttagagctccagagaggtatctcatgtatggagatatatctacaaaagctgcacacatgcttggtcaacctgaggtcttagatttctttgctaagcttgttcaaagggtttccccgaagagctatcaacaagctcttttggaagttcaagtttctcaaaaattcttggagaatttctgtggagatcaggtgcgctttctggctcggtcatttgctgtccctggaaatcatgttggacaaatgagtaatggctatcgttggccatttggcccagttgcaataatcacaccattcaatttcccattgga

SEQ ID NO: 67393 - DNA, 321 bp, Triticum aestivum
  Clone ID: PAT_TA_67393
cccgcctcctcgcgcctccctgcatcgccggcagcaacagctaccgctgaaccagcagcaaacgccgtcgcccttccgggagccgacacccatggagcttgccgctgcttcgtccaagccgcgtcctccagccggagctcgccagccgcatcgatccgccgtgagcagcagcaccagcagatgagctccgctcatgttctctccttcctccacctccttatgcctgtcccgtttttctctcctcacactacggtctgtgtctcccttctaagcaggagcagccagggacgtcactcctcaagcatcagccgccgctgacct

SEQ ID NO: 67394 - DNA, 330 bp, Triticum aestivum
  unsure (1)..(330): unsure at all n locations
  Clone ID: PAT_TA_67394
actgcctcggcgctgatctgggcagcaccaggccgttcaccactggatccagtcctccaccaccctccttcgttgttctcgcgccgctcaccccaccgacaggtgcgaggcgtcgtcggcgggctgtgcagctcctccatcgtcaggcgggcaggcgggcagctcctccaacccccgccgatctgctaggaaccggcgaggccgtcctgccaagttccgtcgccgcctccttcttctggccggcgacgaggtcanccctctcttatgtccccttcttccacctcacctcctcctccggcggctgcagctgccttcccctcctctttcacc

SEQ ID NO: 67395 - DNA, 263 bp, Triticum aestivum
  Clone ID: PAT_TA_67395
aaaacccatcattcacagaccttgttaggagtgatgtatctgaaaatctcgagggagctgagacccaagcttcacaagaacctcctgcggagtggggttctgaaggcgcacctagctcggcatctggccccgatgatggaaacttgccttacccttatcttcctactgtgcttgaggagcctagtacttctttctctgaagttgcagaggatggcccactgccagccatagatgggctaagaatcacaggtgaagcttttcct

SEQ ID NO: 67396 - DNA, 387 bp, Triticum aestivum
  unsure (1)..(387): unsure at all n locations
  Clone ID: PAT_TA_67396
ccgccttcgccgtcgtggagcatctcaaaggaagggagacggcagcagcctcaaccagttcgtgtacaactgcctgctaggcgcggtgaagaactccggggaattcgggaggatccaggatgttctcgcggacatggaggcgcaggggatctccccgaacatagtgaccttcaacaccctgatgtccgtctacgtcgagcaaggcaaggtctangaggtgttcagggtgtacgacgacatcgagggccgcgggctggtgccgaccgccgcgacgtactcgacggtcatgtcggcgtacaagagcgccggggacgggttcgccgcgctcaaattcttcgtcaagctcagggagaggcacaagaacggcgatctcgtgggggaacccgc

SEQ ID NO: 67397 - DNA, 305 bp, Triticum aestivum
  Clone ID: PAT_TA_67397
gtgcctacttcgactccgcggattgggtccttggcaagcaagctgcaaacagcagctcaacggctgcggtggaatcgctcaagcccaagctcaagagaactcctcatccccagcttccccctcgcaagcccacctgtgcgtctggctgagacatcagggtcgcattgcagcagcaggtgaagagctcgcggggaggagaggattgagctcggatcaatgttgtttagctgctcctaaattcgcaatgtaggaaacaactttgcattgcctgcaaattggcttggcacttgctgcctctatgtctg

SEQ ID NO: 67398 - DNA, 215 bp, Triticum aestivum
  Clone ID: PAT_TA_67398
ttcatgaggcttgatcatgtggaagataccttgattatctggaaaaaccaaaacatattttgcgacggctgttgctttatgggatgctaacttctatgtcaaagttgatgatgatgtgcatgtaaatatagccacccttgggcagattttgtccaaacatatttcgaggcccagggtatatactggatgcatgaagtctggtcctgtgctatccg

SEQ ID NO: 67399 - DNA, 194 bp, Triticum aestivum
  unsure (1)..(194): unsure at all n locations
  Clone ID: PAT_TA_67399
cccgcgttctttccaacttcatgaagcaacagtgcctcggccaccgactcacctatggccgtgccatccccctccgatccctcgtcgacatgattggtgagaaggcccagatgaacacgcagatgtacggcaagcgaccatatggcgtcggtctcctanttgctggcgttgacgagcgtggtccccacctgttc

SEQ ID NO: 67400 - DNA, 150 bp, Triticum aestivum
  Clone ID: PAT_TA_67400
gctggtgctcgacatcggcgccatggagctctccgtccaggaggtccctgcgccggccaggttctgggaagagaacgtcgccgtcgtggaaggcgcgaacggcgaagtcggcgtgttcgcgcacgaattctaccacgccaacggcaacgc

SEQ ID NO: 67401 - DNA, 158 bp, Triticum aestivum
  Clone ID: PAT_TA_67401
tcagtggcagtttcaagccgggagtcctgacggcgttgatgggggttagtggcgccggcaagaccacactgatggatgtgttggctggcaggaagactggaggctacatcgaaggcgacatctcaatatccggctacccgaagaagcaggagaccttt

SEQ ID NO: 67402 - DNA, 339 bp, Triticum aestivum
  Clone ID: PAT_TA_67402
aacgactccttcgagtgggcacctcggtctggaactcctccctggtcctcgtcaagttcgccgagcgctgcctcggcgacgcggctctgcccttcgccgacgcgctccgcttcgcgggtgcccgcgccatcgagctcggcgccggatgcgggcccgccggcatggggctctcccgcctcggcctcgccgacctggtgctcaccgacaccgccgccgtcctcccggcgctccgccggaacctggggcgcaaccgccgccacctgccgcgcgcgccccgcctcgcgcagctccactggaactgccccgcgcacctctcccagctcgccgccccgcgccgct

SEQ ID NO: 67403 - DNA, 364 bp, Triticum aestivum
  Clone ID: PAT_TA_67403
gcatgtccggtttaatggggcatggcatggcaaagtgcaacaaacaacactacaaattaagtggaggtcaatatgcaacgagttgcatattgacgaaacaccacatttaattatttatttctcttttatttatgtacccaacaatattaaatgtggattaacatggcaagaggtgaagcataagtaaactaactatgtaggcaatttaaatgaggccggaaataacaaacgacaataccggaaaatcctcatgtccatattttttatttggtactgttctgccataaacacaattttaatgttgttaaacagcaagataaaatgcagcaagttaatctatgcatttttctaccccatttacata

SEQ ID NO: 67404 - DNA, 487 bp, Triticum aestivum
  Clone ID: PAT_TA_67404
ctgcttgtcgggactgcagagagatcgttctttatttttaaaacagacatcgagttaagtaagctggaggatgtggacaccatcaacaactatgccattttcattggtcatcagaggtgcctggctgtctatgctgataagttcataggcattgaggcaaactgcatctactacactgaaaatctgggttcgtccgctcgtatatgcaagtgcggcatcaaggacagaaaagtagagaagatctctgaaactgccgatttcatcaagaaagacaagaagtttgtcctcgttgctgaccgtccttcgacgatcatcgaccttctcgccagctacaccatcaacatcccggactctcggctggccttgcaacagattccataaggcgccggcagatcttcgttcaactctggggatctcgatgaccaactgacaaggctatgctttcgctaagtaattgctcctaattactgtctagtcccctgctttg

SEQ ID NO: 67405 - DNA, 154 bp, Triticum aestivum
  Clone ID: PAT_TA_67405
ggcctggcccctgactgccttgcctatctctaccgcccactcctctctcgacggtcgatggcttgtgctagctgcgtgcccagatctgccatgaagtgcatgcgacgtgtgcgagccgagcggcctcatcttctgctgcgccgacgagccgcgc

SEQ ID NO: 67406 - DNA, 514 bp, Triticum aestivum
  Clone ID: PAT_TA_67406
cctccttccccaccgcctcaagatgcagatctttgtgaagacactcacgggcaagaccatcacccttgaggtggagtcgtctgacaccatcgacaacgtcaaggccaagatccatgacaaggagggcattcccccggaccatcagcgccttatcttcgccggcaagcatctggatgacggccgcacccttgccgactgcaacatccacaaggagtccactctccacctggtgctgcgcctgcgtggcggcatgcagatcttcgtgaagaccctcacaggcaagaccatcactctggaggttgagagctctgacaccatcgacaacgtcaatgccaagatccaggacaaggagggcatccccccggaccatcagcgccttatcttcgctggcaagcagctggaggatggtcgcaccctcgcggactataacatccacaaggagtccaccctccacctggtgctccgcctccgcggtggtcattaattgccctggcgttcaacctgctggtttatc

SEQ ID NO: 67407 - DNA, 159 bp, Triticum aestivum
  Clone ID: PAT_TA_67407
ggcacgcacgacgccctgatcgccgtcaaggcggcgcctacgcgtccctcgtcgccctccactccgcgtcgtcggcgtcgtcgtagcgccgctccaagaggggcgctcgcgaatgaaatcgtgccgagcctgcgagattgttgggggtggcacgcctgg

SEQ ID NO: 67408 - DNA, 547 bp, Triticum aestivum
  Clone ID: PAT_TA_67408
ggcagccatgggccccaaaggcagacaagaagccggcggccgagaacaagtggagaaggcggcggagaagacccccgcggggaagaagcccaaggccgagaagcggctgccggcaggcaagacggcgtccaaggaggccggcggcgaggggaagacccggggcaggaagaagggcagcaaggcgaagaaaggcgtggagacgtacaagatctacatcttcaaggtgctgaagcaggtgcaccccgacatcggcatctcctccaaggccatgtccatcatgaactccttcatcaacgacatcttcgagaagctcgccggcgagtcggccaagctcgcgaggtacaacaagaagcccaccatcacctctagggagatccagacctccgtccgcctcgtcctccccggcgagctcgccaagcacgccgtctcccgaggcaccaaggccgtcaccaagttcacatcctcctagactgacgacgcgccgcttgttgtgacagatgtagttggctgctgttagtcgctgactctgcttatgtatctgcaagta

SEQ ID NO: 67409 - DNA, 169 bp, Triticum aestivum
  Clone ID: PAT_TA_67409
accaatggcacggtatcttctcccttccaccaccaccgccgcctcctcgctcccgaggaatgccagggcctcgccggcgccgatcctcgctctccgctcgctcgcctccaggtccaagcacgcgcgcgctatcatggcggtggcgtcgagccagcccgccgcacccagc

SEQ ID NO: 67410 - DNA, 311 bp, Triticum aestivum
  Clone ID: PAT_TA_67410
taagctcccacgctagccgccgtcgccatagacagagcgagcgcgagatctgctccggcgtgatccccgccgtctccagccttccgaaaccgcgagaagcagcccctcgtccgccgccgtcgacccccgcaagctgcaagaccggaggagccgggaacgactacgtccgcgtcctcttctacttcccggacgtgggcggcttcttcctctctctcgactccgctccgggccagcctacgtggctgttcaacctcgtgcgcgagccatgagtttcgaagacgcggtctgcaagctcgctgccgacatagcgg

SEQ ID NO: 67411 - DNA, 262 bp, Triticum aestivum
  Clone ID: PAT_TA_67411
tttcgtgccagtcgcgacgaaactgctcgccgctctgggtgttccctatgtgctcgccgggagcgtctttccgagtctcggttactccgccgccgtgaactcgacggtgcgccgctcggcgtggctggtctgatcggcctctgcgtgctctgccatctcgccaagctgttctgggtcttgaaaccgctcgactgtcgcgccaagctgttctggttcttcagtgcgctctgctctcgcgccaagctgttctgggatcttctgc

SEQ ID NO: 67412 - DNA, 327 bp, Triticum aestivum
  unsure (1)..(327): unsure at all n locations
  Clone ID: PAT_TA_67412
cgtcacggtcacagctgctgctactgcattgagaggtgcagccacatcgagggcgagggctctgaaggaggtgtggaacatagcggcggtgatcccggtcgagaaggggacgatgggaggaggaggtgcaggaggagggcaccatcacaancanattgtgcaaaagcagcattttttttagctggagagcaacggcagcagcgtcagcgatctttcgctagaggaggagaacaacttcctgggcgcgtgcagccaagaacttcttgttcgcggcaccgagctccttaaacgcacgcggaaaggcgcactgcattggaaggtcgtatc

SEQ ID NO: 67413 - DNA, 294 bp, Triticum aestivum
  Clone ID: PAT_TA_67413
actagcgagcagagccatggcgcccaacggagacaacaccgtggccaacgtccacagcggcatcgacagcaccaacaagacgctgctcaagagcgacgccctctacacttacatcctcgacaccaccgtgttccccctgttatcacgagtgcatgcgcgacctgcgcctcatcaccgacaagcacccatggggttacatgcagtcgtcctcggacgaggcgcagctgctggggatgctgatcaagatggcgggcgccaagaagacgatcgaggtgggcgtgttcacgggctact

SEQ ID NO: 67414 - DNA, 262 bp, Triticum aestivum
  Clone ID: PAT_TA_67414
ctcgttgcattgcctgccacttcggttgcgtggagctgaagttcgccgatcagatgcatccttataaagtgaaagacatttgcatcccgctgcggcggtttagtttgataccgcaagcacttatatataaaaatagaatgtgtatagcagcaaaactcgtgtctttgatacctgatgagtactgtcatgtgtccagaaacatggtggcacttcgatgcttagtaaggagcgacaaacggctagggatgcaaatgtgtagcct

SEQ ID NO: 67415 - DNA, 326 bp, Triticum aestivum
  Clone ID: PAT_TA_67415
ttgcggccgttgctgctgccaccgctgcggcctcaagttccggcaaggacgatcgcgcggcccgcaccgacatggccatggcctctgctgcgacgctcgtggccgcgcaatgcgtcgaggccgcggagtccttgggggctgagcgcgagcatttggaggcggttgttagctcggcggtgaatgtcaggacgcctggcgacatcgtcacggtcacggctgctgctgctactgcattgagaggtgcagccacattgagggctagggctttgaaggaggtgtggaacatagcggcggtgatcccggtcgagaaggggacgatgggagga

SEQ ID NO: 67416 - DNA, 376 bp, Triticum aestivum
  Clone ID: PAT_TA_67416
ttcctcatgttgccactgggttctctgatacttcttctttgctccgtgaactgacactgaagtcgatgcttgtattggcaccaaaattatctcagcgtacaatctcaggatctctcttgaagtatctctctaagcttcaggtcgatgaagaacctgcaatccggacaaacactacaattcttcttgggaatatttcaacttacatgaatgatgggactaggaagcgagtattgatcaatgcattcacagtccgtgcattacgtgataccttcccgcctgctcgagcagctggaatcatggcactgagtgtcactagttcatactacgaaatgacagagatagcaacccgtatactgcctaacattgttgtccttac

SEQ ID NO: 67417 - DNA, 279 bp, Triticum aestivum
  Clone ID: PAT_TA_67417
ctgccacaccaacatagccgatttttgtgagacatatctcaagcagaggaccgacctagaagatccacagtcctgattcaatataatgtctttggaagaggtgacggatctcaaactgaatttgctagaggcaattacaaaccaattttccgagaagctcaggatcggaagtggtggctatggagaagtttacaggggattgctcaatgggtgtgaaattgctgtgaagaagctttatctcaacaatgcatcactcgatgataagagttttacaaatga

SEQ ID NO: 67418 - DNA, 589 bp, Triticum aestivum
  Clone ID: PAT_TA_67418
ggagaagaagccggcggcaaagaagcccgcggaggaggagcccgcggcggagaaggccccggcggcgaagaagcccaaggccgagaagcggctgccggcggggaattccgccgctggcaaggacggcgacaagaagggcaagaagaaggcgaagaagatcgtggagacgtacaagatctacatcttcaaggtgctgaagcaggtgcacccggacatcggcatctcctccaaggccatgtccatcatgaactccttcatcaacgacatcttcgagaagctcgccggcgaggccgccaagctcgcccgctacaacaagaagcccaccatcacctcccgggagatccagacgtccgtccgcctcgtcctccctggcgagctcgccaagcacgccgtctccgagggcaccaaggccgtcaccaagttcacctcctcctaggctccggtcttcttctctgagagtttccctcttttctggttcctggcggtgtgtggtgaatttgatgttaccctgtagttagattatgttccgactgtcatcctgtaagaaatcgtgcactgctaattggatctgaaaaaaaaaaaaaaaaaa

SEQ ID NO: 67419 - DNA, 451 bp, Triticum aestivum
  Clone ID: PAT_TA_67419
atgcacacggatcaatgtgaattacttcctggccaccgcaactacatcatgtcgatcgatgatgcaagtgtttggagtatcatttatcaatatgtaatgtgccagtatacattatttttattcttaccacccaattttcaggaaggaatgggtccgaagctcgacacctcgtccaatggtcttaagtctcaaaaaacttcagggcatacttaacatggagcagtctatggacaatgattgtttcaacattgtcgtgcatatactggcatgtgacgagggagtattgttcgcagaccctcctatacactacatggatttacaattttgtgtaaattatcaaaattcttcattcaatatcattagtatcaacatgtttctaaatagttttttactcagtccatgatgctggattcaacacgagatcaaaagttctgcgataaggaaactattc

SEQ ID NO: 67420 - DNA, 559 bp, Triticum aestivum
  unsure (1)..(559): unsure at all n locations
  Clone ID: PAT_TA_67420
gctccttgtcctgtctctcacgttgtcacaacacagcggaaaacatcatcatcctgaggctcccttttccgtctaggactctcagtcatcgcaaagtagatgcaatcctctcgagctccacattgggctgctgcagggagcgagtgagagcagcctcggctgacaaagagcgcatgccccatcaacgtgtccaccttgctccagtgcccatggccgccgatcaggtccaccccctcacaggcctcgagctgggtccgtatgggcctcgaaccgcgctctcgggtgccaccctcccagaccacgaagcgctcaacgagggtccgcctttccaccattagcagccggtcgccgcatgcgacaaggtagaagacggagtgccaggttcggtccacgccgtttcttgcgtccaggcaggagaccgaggcaggccanggtcgtcgtccacgtggtttcttggcgtgcggcgtatgcattggactgacctgacgcggttctgctcgtcgccgatttccaggcgatggagctccggcagttcagagccactcttgttgtgtttatt

SEQ ID NO: 67421 - DNA, 297 bp, Triticum aestivum
  Clone ID: PAT_TA_67421
gatgcttttctgaagaagtcacgcacttacctattgcttcttgcaattcttgcagtgtctttgacatatcaagctggtttaaatccaccatgtggctgctggacatcaaatgtcactaagcactctgctggtgatcccattcttggggacagtggtcgcgtctggacatcaagtggcactaagcactctgctggtgatcccattcttgaggacaattatcataagagataccttgccttcttttatttcaatgccactgcatttgcagcctcccttgtcatgatccttatgctcctg

SEQ ID NO: 67422 - DNA, 242 bp, Triticum aestivum
  Clone ID: PAT_TA_67422
tctgccgggttcaatcttccgtcatacttttcctctatctctggcttgaacgtgcgggcagatggccaacggacttgccgcagctcgcgagtgaaggcggggcacccaacctcaaaagcaggtaaccgtctccaccgggcatgggctcatcgacgtcggggccattgcgcctatcggactggcggcgggtttcgcgacgtcgcttgatggtgacgcgtgcgtcctccctccgcctgtcttct

SEQ ID NO: 67423 - DNA, 157 bp, Triticum aestivum
  Clone ID: PAT_TA_67423
cgttgcctttccagttagtccagcttgaggtggcgatcgacggggaaatggccgcggcgacgacgggcatgcccatgctggcggcgctggcgatcctagtcctcgtgccgtctgcgcgagggctcgaccgcgccgagttcccgccggggttcctctt

SEQ ID NO: 67424 - DNA, 377 bp, Triticum aestivum
  Clone ID: PAT_TA_67424
gtcctgcgtctgcgtggtggcatgcagatcttcgtgaagaccctcctggaaagatatcacccttgaggttgagagctctgacaccatcgacaatgtcaaggccaagatccaagacaaggagggcattcccccggaccagcagcgcctgatctttgctggcaagcagctggaggatggtcgcaccctcgccgactacaacatccagaaggagtccacccttcacctggtgctccgcctccgtggtggtcagtaattgccctctcactcgacctgctgctgctgctgtaccctgtgtcgtcctgtgggtgcgcctttgttcaagtgctgtctcgtttgtgtgaagtcgtactgtgtctggtttaatggaccatcgagtc

SEQ ID NO: 67425 - DNA, 343 bp, Triticum aestivum
  Clone ID: PAT_TA_67425
tgttgccgccgccgccccggcgaccgccccgccgcgtcacccgtgtcgcccgccgcccgtctccccttgcccccgaccggagatgggctacccgaggcgccgcgcccacccgcgccgcggcgccctgctgccggcggtggcggcgctcctcctgcttttcctcgccgtatcgctcctgtccatcgccatctccgcgccgccgctcgcggaccgccaccccggcatctcccgccgatccctccgccaccctccgacgagtcgatggactgcgagagatctgtggggttcggagctcgctagcaacttctatggatgcagtcactctagcggaaaatttctcgat

SEQ ID NO: 67426 - DNA, 372 bp, Triticum aestivum
  Clone ID: PAT_TA_67426
cgtctcgtcggagcagaaggtgtacgacgtggtggtgaagcaggcggcattgctcaagcgccagctgcgcccctcgcagcagggggggcaggcgccgccagccgtcgccagggagctggacgcgccgcgcggggggctcggggaggcctacgcccgctgcggcgagatctgcgaggagtacgccaagaccttctacctcgggaccttgctgatgaccgaggagcggcggcgcgccatatgggccatctacggtaatctgaaaattcgccgccatatgggccatctacggatcaaagtacacgagaaaaggttgcaagaacatattcctcaaattgcctggggacatgaatctgaggtatggtgcacgaggac

SEQ ID NO: 67427 - DNA, 176 bp, Triticum aestivum
  Clone ID: PAT_TA_67427
ccgtccgtccaccatgggagccggccaggacctggaggccggctacggcgacggcggcgagaagaagatggcccactcctcctcctcctcgggcccgctcccgccgtcggagccgccgcacctgcggggccaggaccccgcccagtaccagtacggcaccttccacccccctgccc

SEQ ID NO: 67428 - DNA, 532 bp, Triticum aestivum
  Clone ID: PAT_TA_67428
tcatcaagacgctcccccccgacgccctcgtcgccgaccagcctctgcctcccctgcccccgcccccgcccccgcccccgcccggcctcggggactggttcgcccggatcctcgacgtcgagctccacaagctcaacgacttctacatggagcgggatgagtggtacgtcatccgcctctcagtgctaaaggagaagattgagcgagtcaaagcgaacaagaatggtgcttttacatccaaaactgagttcactgaagaaatgttagagatacgtagagatttcgtgcttatccacggcgaaatgatacttctgcagacctacagctccctgaactttgctgggctagtgaagatactgaagaagtatgacaaaagaacaggcggcgtgctcagcctacctttcactcagcgagctcgccaccaaccatttttcaccaccgaaccgttaacaagacttgttcgagaatgtgaggctaatcttgaaatccttttccctgttgaagatgaagtactcgagtctggttcctcttc

SEQ ID NO: 67429 - DNA, 187 bp, Triticum aestivum
  Clone ID: PAT_TA_67429
tgccgcctgcccaattaggagacgtccggcaggcggcagcagggagaggtccactccaccccacccgtcgcgccagcccggcgatggagctgctgtgcaaggcgccggtgctgagctgcggcgccaggaggggcggaacggggtcgcccatgggcccgctggcgggcgcgttgggccggtggatcta

SEQ ID NO: 67430 - DNA, 568 bp, Triticum aestivum
  Clone ID: PAT_TA_67430
aactgccaacacttcacttcgaatcttccacttgcctatctcatcaacaacttctcccagtgcgtgaatctggaacagaggctgtacttcatgctgccaattttgttctcgcgctttcatcatttgctgatggcaaagctctgcgaaggtgttctgccattttatttgaatgggatgatcatcttaaaactggtgttgtgttgacgacggcacatctaatccgctcaaattgcccatccattgaccactggttaggaaagaacgagtaccggcctgatgctaaggtggttgttcattttttagatgatacaactgcagagggtgacctcttgtaccatcaagaacactatgatattacttttttcaaagttaaagtcggtcaatgcccccaactgcctttgtttgttgacaatgtgaaatccggtcaagaaattttccagcttggaagagatgagaagttgaacctgagaataacctatggcagggcacaatctaagaatccaaacatgtatcgaagacaacacttcatgtacatgcatcgtaaagatgataacaatgagtttgatga

SEQ ID NO: 67431 - DNA, 323 bp, Triticum aestivum
  Clone ID: PAT_TA_67431
atgaacaacacaaaggctttatgctttgtacttctgattgctttgtctaccttgcagtactggccttgtcatgcatccgagggccatataagtgttgaagaaggtgggattagacatatgtgtaggtacatgcttggcggtaacactacgaccgagaggtgcagagagctttgccttgcacttggcagtatctacaatgcggacttaatttacctccaattctgtgacaaacgctacacgtgccagtgttgctgcaaaatgtactgattgatgcgaaagatttaataaacttgtcatcacagagcaaaaaaaaaaaaaaaaaa

SEQ ID NO: 67432 - DNA, 396 bp, Triticum aestivum
  Clone ID: PAT_TA_67432
tcgcatccgcctggcgtccacctccccggtcgctccggcgactcctcgccgtcctcgcccctcctccccgacctccctcgcgacggctaacggcgtcgggtggctgccgagcctccgcagcgcagcgcggttcctacaacgcatgggcagccgccgcctgatgcgtgagccgtcgatggcagtgcgggagacggcggcggagcacctcgaggagcgccaggctgactgggcctactccaagcctgtcgtcgtgcttgacgtgctctggaatctcgctttcgtcgctgtggcagcagccgttctcgccgcctccctcacggagcgccccgccggcccactctgcttcttgcttgccggttacgtgctgtagtgtctccttcactttctctgcgtcgt

SEQ ID NO: 67433 - DNA, 606 bp, Triticum aestivum
  Clone ID: PAT_TA_67433
tgttggcaaaaggtgagaacagtgtcgctcgcgaccaaattgaggagttgttcaaccgatgtatcattcatcggcgggacattaggcaaaactctagggtgaagtcatatcagattggtcctgtactgcttgaattcatgatctgcaagcaagcctgcagaaacttcatcactctgatagaaaatggccaacgccaaccttattgtgggaagaaagacagtgccgttcgtcaactctacctgagtggcaaaactgcaagggctgtcgaagaggaccgtctgtccagtatcaggtcacttacaatctctgaccatgatggcgaggaactggtggattttgaaaagtgtaagatgctactagtcttggatgtagaaaactgtaagaaggttgaggacacagacctccagaagatttgcaagttgttgtacctcaattatctcaacctgagaggcaccaatgtgaagacccttccaagtaaagctgcaaagctacattacttgcagatactggacatgagagagacaagtgcaaacatagaattgcctatggaagtcctaatcctgggacagctagtccacctgtttggccgatttaagctacctcctg

SEQ ID NO: 67434 - DNA, 602 bp, Triticum aestivum
  Clone ID: PAT_TA_67434
tggtggatccccgaatctcctcgatggctcatggccaacgagcgccatgaggaagctctcaccatcctctcgaaataccacgccaacggcgatgtcaacaacgcgaccgtgcagttcgaatacaacgagatcaaggacaccattgccctcgagtaccaggcccagaagaccggtagctacatcgactttctccgaaccaagggcaaccgttaccgtctcatgctcttgatctccctgggtatcatttcgcaatactctggtaatgctctgatcagcaactactccaacattatttacgagggcgctggaatcaaggatcaagctcaaaagactggattgaacgccggagagaacatgctcaagcttttcgttgccattggttgttcgctgggaattgatcgcttcggtcgtcgccctctcttccttactgccactgttggtatgctgttgttcttcctcgcctggacaatcgtcgccgcccgatttgaagccaccggtgagacagagatcaagcgcctcggatatccccagatcgcccttatctggctcttcgacgtctgttactccattgcctggtctggtctgatcgtcgcctacgctct

SEQ ID NO: 67435 - DNA, 528 bp, Triticum aestivum
  Clone ID: PAT_TA_67435
cgcctcccttctctgctcccttctctcctccgcgcaggcccggcgaaagggaagcaagatgtacaccgccaggaagaagaccagaagacaaggcgtcgagccctccgagttcgaggacaccgtcgcgcaggctttctttgacctggagaatggcaaccaggagctcaagagcgacctcaaggacctgtacatcaacactgcaatccagatggatgttgttggcaacaggaaggccgtggtgatccatgtgccgtaccgtctgcgcaagcccttcaggaagatccatgtcaggctcgtcagggagctggagaagaagtttagcggcaaggatgtggtctttgttgcaacaagaaggattgtgaggccacccaagaagggttctgctgttcagcgccctcgcaccaggaccctgacagctgttcatgatggtatcttggaggatgtcgtgtacccagctgagattgtggggaagcgtgtcagataccgtttggatggtgccaaggtcatcaagatctacttggacccaaa

SEQ ID NO: 67436 - DNA, 467 bp, Triticum aestivum
  Clone ID: PAT_TA_67436
acatctaccaactctcacaagtccaacaccaactcagccatcatcatgactaccaactctttcggcggagctctccctcgcttcgacttccctgctcaaccacaacccgccatgtctcgcattgcgcgcatcaacaaagcacttccagtagtcttgttcgcagccacagtaaccgctttggctatcaagacaagacaaaacttcgatgcacccatcactacatcaatgttgtttgcgcgtccccagaacttggtacctcaagggcagcagacaagattggacaagaggaatggcgatgtgggattaaagccaaatcaataagattagacattgcaatcggcgacagaattgggaagcataaggaagcgattgacacaaccattagctattcaggcatgagattagggctggtcccaatacatgacatcttaattacttgcatatcctcaaaaaaaaaaaaaaaaaaa

SEQ ID NO: 67437 - DNA, 393 bp, Triticum aestivum
  Clone ID: PAT_TA_67437
aatggcgtccacctcctgcttcctccaccagtccaccgcgcgcctggccgcctcggcgcgccctgcgcccgccgtcgggcgcacccagcttttcgtctgcaaggcgcagaagaatgacgaggctgcatctgacgctgccgtcgtcaccagccggcgcgccgcgctgtccctcctcgccggtgccgccgccgtgggcgtcaaggtctcccccgccgccgccgcctacggagaagcaggtgcgagctagctgccgtgcatgtgagcgacagtgacagtagggttcggtttcggatgagtgacttcgcgaatgaatatgttgcagccaacgtgttcggcaaggcgaagaagaacacggacttcgtggcgtacagcggcgaagggttcaaactgatg

SEQ ID NO: 67438 - DNA, 526 bp, Triticum aestivum
  unsure (1)..(526): unsure at all n locations
  Clone ID: PAT_TA_67438
cccatgctccagctggccgagctcctccgcgcccgcggcctggccgtcaccgtcctccataccgacttcaacgcgcccgaccccccgcaccatccggagcttgcctttgtctcgatccacgaggcgctcccgcacgtggccacctcccccgacgccgacatcgtcgcgcagctcctggccctcaacaacggttgcgaggcgccgttccgggaggccctggcatcgctgctgctgctgcgtgaggacgtcgcctgcgtggtcgtcgacgggcagtggtacgcggcgctgggggcggcgggcgtgctcngcgtccccgtgctcgcgctccggacggacagcgccgccacgttcggcagcttacttgcgttccctcggctgcgcgacgccggctacgtccccatcaaagaggagcggcgggacgagctggtgccngagctcgagctgctccgcgtgcgcgacctcatccgcatcgacggcagcgacgtagacgcgctctgcggcttcatcgcccgcgtcgctgacgccg

SEQ ID NO: 67439 - DNA, 386 bp, Triticum aestivum
  Clone ID: PAT_TA_67439
gtgctggcgatggtgctcgcggccatggtggtggcgccgccggcgactgtgcacgccatatacctgctccacggtgtacagcacgctgatgccgtgcctgcagtacgtgcagcagggcgggtcgccggcccggggctgctgcaccggcatccagaacctgctggccgaggccaacaacagccccgaccgccgcaccatctgcggctgcctcaagaacgtcgccaacggcgcctccggcgggccctacatcacccgcgccgccgcgctcccctccaagtgcaacgtcgccctcccctacaagatcagccccagcgtcgactgcaactcgatccactgaacgaacctgtcgacgtacgtctgccgtgtgaggagtcccatgtccggag

SEQ ID NO: 67440 - DNA, 278 bp, Triticum aestivum
  Clone ID: PAT_TA_67440
ctgtggctttggagaacgccggcaggagctgggcaacgccgggagcgcgggcgcgccggatcatgccaagaagccggaggaggccgacggcgtggtctgggccccgccgtccaccgtgcggttcttccccgccgtcgcgcagcacacggcctggcagccgccgccgattaagctcgagggggaggacctgccgtcgtcgccgcccacgaccgccggctagggcgtcgatgaggacatggccgccccccgctacctctggctggtgtacgctctgggag

SEQ ID NO: 67441 - DNA, 351 bp, Triticum aestivum
  Clone ID: PAT_TA_67441
gcgccgccgcggccgcaggcgccggcaacgcctcctctccggcgcgctacctccgcggtatccaccctccgggagtccccacagccgcctctagcgcccctgagcatctcctctcggcgcgccgccctcctcgccctcgtcctggccgcctcgccggcaaggcccgccgccgccgccttctccttcagcttccctgggccgaaggagttgctgcgggagcagaagaggaagtcggcgcgcttcctcctcgcgcccatcgccgcctcccgcgagaccctcgtcaaggcccagaaccttctcgcttcggagaatgcgtctgcggcggacgcggaggaggtgagggggcggctg

SEQ ID NO: 67442 - DNA, 462 bp, Triticum aestivum
  unsure (1)..(462): unsure at all n locations
  Clone ID: PAT_TA_67442
actctgccccttgaaaactacgtgatcggaaatgtgcacaaacgatgggctttccagttcggagattgctatatgagatgctcttcactggccagatggcacgaggaagtattcttcgagatccaatccggatgaagatcatatggggctattgattcaagctntgttggacaagtacaatgaggagaataatcttttggggggatgatgcatataatgttgaaaatgtcgtgagctgccaagaagtttatgagggcaaaggtggctggtactatcatctgaattgtactagaaagactaaaggtggcgtcgacaatctcttctttgccgaagtcttgagaatgaatagaggactacaattcaagctcacctgtctccatatggttaaacctgctgttgataacggtacatgctatggtttgtaaaaaaaccaatgttagtatgaagcaccccattgacgct

SEQ ID NO: 67443 - DNA, 433 bp, Triticum aestivum
  Clone ID: PAT_TA_67443
aatcaggcaaccaatggggcagtattctgatctcatctcacacatcctatatcatgctttgtctttattacttgttattttatatattattatttacatatacttgccgtatcgctgtattgctgtttcaaaaaattaccatatcccgtatcaccatactcgtatcgtcgtattcgtgtcgccgtatccgtgtcgccgtatcggtgcttcataggtcgtcaatcctcccgcaaaagtgcaaatcaacctgtggttgagttggttaggtggacagtggtatcttcaacccaccagggttcaaatcctggtgctcgcattattcctggatttatttcaggatttccggcgatgcgctttcagtgggaggagacgttcccgtcgacgactaggcgcctacggtgacttcgtaaatttcaaaatgatatgccggctc

SEQ ID NO: 67444 - DNA, 291 bp, Triticum aestivum
  Clone ID: PAT_TA_67444
gccgccatccgccgcgacctggcgccctggcggcgccgcgacggcggcggcggcggcatcacgcgcgcgctcgtcgagtcgggccgccaccgcgcgtgcatgcgcgtcaccatcacgggcggcgggacgcggctgcacgtggacctctactacgcctgcgtccaaagccgcgcgctcttcacggtgtggagcctgctgcagctcatgcggcgctaccccggccgcgtgccggacgtggacctcatgctcgactgcatggaccggccggccatcaaccgcaccgagcacacc

SEQ ID NO: 67445 - DNA, 468 bp, Triticum aestivum
  unsure (1)..(468): unsure at all n locations
  Clone ID: PAT_TA_67445
gggtctccctgccccctcgccgggctaccgcgcccacggacgaacacttcgacggcgccgacgacaaccacgacggcggcggcggcggcgacgacgacgacgacctggacgcgacgtggaacgccatcatgcagaagacgcgcccggcgacggcgccggccgcatccaccacctcccctccagccccacgctcgtcgcctccccggccaaccccatcgccgcggccgcgagcccgggagccatccgtcggcgcggtggagctgagcaagcggtcggaggatttcatcaagaagatccacaactccttcgggcggcaccaatgatcccaaccacccacccacctaccatcaacccaaaaatcccaaaccaatccaaatcaaaaatttctcggctgtgtaaagatcatatccccttaaattagtctntcttcttcccttcttggtgtgccctgtaccgatcgccggagca

SEQ ID NO: 67446 - DNA, 575 bp, Triticum aestivum
  Clone ID: PAT_TA_67446
cctccgctcttctattatcactcgggcttctcctcttccacaccactccttggtcatcctcctttgtagctgcaaacaatgatactctcatggcaggccaagttctcgcggtcgggggcaggatcgtctcaagaaatggcaagttcgcgcttggcttctttcagttccagccagcaagcgccatcagtaagtcgtcctacaacaccacatctccaatccccagcttgtggtaccttggcatatggttcaataagatcccagttttcgcaacagtatgggttgctaatagggatcagcccatcaccaaccccagcatcaaccaaacacggttcaagatatcaagtgatggcaatcttgtcatcgtaaaccatgccgccaacaatgaatccattgtttggtcctctcacattgtaaataataggacacacatcaacacaaacaacactagtgtcgctgttctcttgaacagtggaaaccttgccttcaaagagagcccgttatctgacctaccggtctggcagagcttcgactacccaacagatgttatacttcctggtgcaaagtttggtcgggac

SEQ ID NO: 67447 - DNA, 336 bp, Triticum aestivum
  Clone ID: PAT_TA_67447
atttctgtaccgatttggatgcggaaattatgggtttctgtcccgatttcattcatgccggattcacgattccccaatccagtattagttcgtgcaagccagattagtagcccagagtagcgtgtgacttcacatgctctagttttgcgcttcacttcgtgctgattgatgaggggtcagtgactgtacgccctagtttagtttgctggaaatgtttgacgtcacagaaacacatagttacacgccaatttctctcttgtgatcaaccttgtaaatcatctaggaggtagcaaatcaattgcagctgtattgcttgctatgtggtagctctctgga

SEQ ID NO: 67448 - DNA, 525 bp, Triticum aestivum
  Clone ID: PAT_TA_67448
tgcacaccacgccgggctaccgcctcgacttcccgccgtcgtcgccgttccaccgccggcaggtgcccagcaagccgacgcggtggggcaacgtgaatgtcgtggacgcggagcggcggctgctggcgaacgcgctcctcgacttcagcaacgagcgcttcgtgctcgtctccgagtcctgcatcccgctctacccgctcccggtggtgcatgcctacctgacccgctctcggcacagcttcgtcggcgtcttcgacgacccgagcccgcacggccggggccggtaccgcgccgggctggccccggacgtgactctctcccagtggcgcaagggcgcgcagtggttcgagatggaccggcgcctcgccgtgttcgtgatcgccgacgagcggtactacccgcggttccggaccgagtgtcgggcgccgtgctacgtggacgagcactaccttcccaccgtgctctccattgaggcgccgacgcaaatcgccaaccggaccgtcaccttggtcgactggtcccgcg

SEQ ID NO: 67449 - DNA, 261 bp, Triticum aestivum
  unsure (1)..(261): unsure at all n locations
  Clone ID: PAT_TA_67449
ggcacagcacagccaacccggcgcctcttttccccttccatccatccatccaaccccccgccccgagaaagagaagcaaaagctgccgctgccagtccaaaaggccgcaccgcaaatttcggcgacggatttccgggccggtggtggctggcgcgcccgacccttccccgcccccctccctcggctccggcggtcggtcggggacagcgattacngcgggaatttgcccggctggtgtggagcggtgcggcgcgcggatct

SEQ ID NO: 67450 - DNA, 527 bp, Triticum aestivum
  Clone ID: PAT_TA_67450
ccgcctcgcacacagctccgtcccgctctcctcgccgtcgagcaccacggccgctccacctttaagctccgccctgcctctccaaacctcagggtcttctccactgatcgagcccccatcctcatctacgattcatgcttttttcatgtcaaatcgggtgtgccagcggctgaatcggctaccaaagtagcaccgcccggccggagaagctgcaatagactgcaaaatacggccgccaccaccccaattacaagcgccccatattgaaatcgacgtattgcagcgcatctaccaccgcagatttgattatccaacagccgagtacttattggtttgtatcttcattgactgcctagtatcgttctggtgatgtgttaggtcatttgtcaacaaactttttgtaggtagagatttgtagataatttgataacccatagcttccaaatgttgagaaaatattcgtttgtctcaatattcagtgcttcgaatgatggtgagaaatgttgagaaaatattgtttcatcatt

SEQ ID NO: 67451 - DNA, 219 bp, Triticum aestivum
  unsure (1)..(219): unsure at all n locations
  Clone ID: PAT_TA_67451
gtttgtgctttcttcaatgctgctctggaatcgactaatgccttgtgcaggtctcatggctgaagcaacattctgcacccacaagtggtgtttgtgtctcaccctccantgacaagataattgctacagttggcctcgataagaagctatacacactcgattctgcatcaagaagagcagcacacactattcctcatgatgcccctttctcattattgg

SEQ ID NO: 67452 - DNA, 412 bp, Triticum aestivum
  Clone ID: PAT_TA_67452
cgccgacgccaccatgggtatctcgcgtgactccatgcacaagcgccgggccaccggtgggaagcagaaggcttggaggaagaagcgaaagtatgagctcggccgccagccagccaacactaagctttcaagcaacaatacagtgaggagggtccgtgttcgcggaggtaacgtgaagtggagggctctccgtcttgacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccccttcaagcagtggtacctgactcattatggagtcgaaatcggtaggaagaagaaagctgctgcagctgccaag

SEQ ID NO: 67453 - DNA, 217 bp, Triticum aestivum
  Clone ID: PAT_TA_67453
gaggccgcgcggtcaattcggttggttggttggttggtttctgggtcgtgcctgcgctgatccaaagcggagcctacgtggatggatggatcacctgctcgtctaatccggcgtctttctagctgtttctttcgggtttgtgccctgttgggtttggtgcgcggttgttggaacagcctaatggcttgtccatttttgtacagtacagatcatctat

SEQ ID NO: 67454 - DNA, 365 bp, Triticum aestivum
  Clone ID: PAT_TA_67454
gcccgcgacttggatcccgaggacgtgatgcatcgggtctcgcctggcaagaccgcgggcacggccgcgagggctcagcgagacgacgagcttctcgatgacaggtgggtggccgagagccggagacgggggaaggcacgtggagcgcagccacagacgaagcacctcaatgagctcaattgggaggtgatcgtcgtcagagataagctcatcaatgcaatgtgtttgcctggtggtaaaattgtagtcttcactggattgctcgaccatttcaagacagatgctgagattgcgacagtgctttcgcatgacattgggcacgctatcgcgaggcacttgccagagatgatcaccaagggcatgtg

SEQ ID NO: 67455 - DNA, 692 bp, Triticum aestivum
  Clone ID: PAT_TA_67455
gtcagtgctgccaccgccgaaaacatgcagcagctcgaacaaagctatcgagactccaaagcagcagctaccaaccctgtgagagggtccgagatcgccaacgcagctagtcgtttcctgggtcgcatatgggcttcatcaaacaacaaatcctcaaaccttagccctggtactagcgcacccgcacgaccctcaagtatactgcgacgcactgcatcaaagcagagcctcgcatcaacattaaattcaatggaggccagctcagcaagcgtaacaagttcgacttcgacagatgctactaccatgtctagagattcttccaacaccgaagacagacgcgattccacgccagtcggcaacaagacaataaccatccacaagaacacggacgaacgaaacctgcatagtcagatcgaagatctcttgactgctctgagcgagctacagcgcaaccactcgttgctatcgaaccagctacagcgagaacgtgaagaccgacaggaggatcagaaagcggtccagtccctcctgaatggattaagacagaaggcagactcgacgtcgtctcgatcgagtagcccgcaggtcaccgtatcgcccaacaaggaggatagtccagttgacgaaatggacgaatctacaacaccaagccccaaggaaaccgtcgagtccagtgaagacgaatctcccac

SEQ ID NO: 67456 - DNA, 481 bp, Triticum aestivum
  Clone ID: PAT_TA_67456
ggcagcgcagtggccggcggggtggtggtggacatgagccgcgggggcaaggcgccgtcgcgcgcattgccggtgtactcgccggagctgggcgggcactacgtggacgtgtggggcggcgaactgtggatcgacgtgctcaactggacgctctcgcacggcgggctggcgccgcggtcctggacggactacctctacctgtccgtgggcggcaccctctccaacgccggcatcagcggccaggcgttccaccacgggccccagatcagcaatgtctacgagctcgacgtcgtaaccgggaagggcgaggcggtgacctgctcggaggcgaagaacccggagctcttcttcggcgcgctgggcgggctggggcagctcgggatcatcacgcgcgctcgcatcgccctcgagcctgctccccgcaaggttcgctggatccgggcgctctactccaacttcaccgagttcacggcggaccaag

SEQ ID NO: 67457 - DNA, 410 bp, Triticum aestivum
  Clone ID: PAT_TA_67457
gcaagtcccgccgcccttggcaagaaattcggtcgcctgctgctgatccccccaaatggacacggcaaacatgtgcaccgtggagaggcgcggccgcgtccacctcatcaccctcaccggcgccggcgagcaccgcctcagcccagccctcatctccgccatccgcgccgccgtggccgcctgccccggcgccggcgccctcgtcctggccgccgagggcaagtacttctccaacggcttcgaccaggcctgggcgcgcacggtcccgccccacctccacaccaccatgagcgagggcttccggggcctcgtcgccgacctgctcgcgctccccatgcccaccgtggccgccgtcacgggccacgccgccgccgccggctgcgcgctggccctcgcgcacgactccgtcg

SEQ ID NO: 67458 - DNA, 233 bp, Triticum aestivum
  Clone ID: PAT_TA_67458
ttgcctaccagttccaccagatttaccatacacacagtaaggaggccaacacaaagggcttcaaccctttgctcaacaacaactttaccaaacggggcgagctggatggaccggccatcaaattctcggcccaactgacagaattattgtttggcgaaagttggcaggagttgcaattactaacaacaaacgactggctcaacaacaacacaaaccatacttttacaatggac

SEQ ID NO: 67459 - DNA, 478 bp, Triticum aestivum
  Clone ID: PAT_TA_67459
tccttccctccggcaagatttccccctctcgacctgaactgcttgcccaaaaccacttcctgtgctagggtttcgccatccggcgatcaccttcgtcttcggcccttctacagccgcctatggcgcttcttctccgtcgtctatagcgccctcacgcgcgccctcgcttcctgatggtccacctcgagaagggcggcacggaggacctcatcccgtacgatccatggatgcggcgcaccgtgcagccacccgtcccggaagagggtgggcaccgtggctggtactgctgaaccacagctgtggcgagtgcgtgtgctgttcctcatccttaaactccaatgagaagcgccagtccaacagaagcacaccccgcccgtgaacaatggccatggcgctatgattctgcgacagacagctgactactgcgccatacttatctgccgaatcggctgattgagggtactgttgggttgacaac

SEQ ID NO: 67460 - DNA, 587 bp, Triticum aestivum
  Clone ID: PAT_TA_67460
tgctctctcccactcgctctcttctctcgaagccgtcgcccgaaacatccgcctccgcgccgttgacatgctccggagcaaccccggggcctcgcggagatgtccaggcgtcgcgccttcatcgtctacatcgactacaatgatcggatcaagcaacccctcattgagccgaccggatcgagacactccatcgcctttggtcactgtcgtccgccgcctcaattcatcgtgtgccttccttctaagcctccgaagagccttcatgtgctccttcggtgagccctgccccctttgcctctcttcccgagctccggctcctcccctagcaagaaagccgcaagctccggcaccaccctccaccatggtcatcgaatacgatgaggtcgtgctcacctgctccttttgattgtgtgtgtgcacgaggcacccagtatatgccgcctaacccgcagccttgctcgtttccgagctcatgtttcgttctggccgaacaccgcggccacgcacttctcatctgctgcttattgttccttgccgtgacatgctttgctgctgctagcgccactgcccgcgccctcatgcatgtg

SEQ ID NO: 67461 - DNA, 338 bp, Triticum aestivum
  Clone ID: PAT_TA_67461
aaagtttaaaactgcacaaacaccgcacgatgatttacagcacggaacaacgaatcaaacaccccgcgacgctttgccgcagaacacttcggcgctcgctcgatcacgacggtcgggttagcctgctgcctcacccgcgacgccggggttcccgcctacttgatccccaggaactcgctcatggaaagcaagtcacaaaaccctgctcctccgccctgcatgtccgcctggaactcccaacagatgccgccgtcgccagagcccctgcaacgagtccactgggccgcaaagaccgtccaccgtggtgcttccgctcgcgccctgctgcgccgggctgc

SEQ ID NO: 67462 - DNA, 537 bp, Triticum aestivum
  Clone ID: PAT_TA_67462
ccttcttccccacaccggccgccaccgtggccaggccggcgtggcggcgcgccaccatctctacttcgccgcaacacacccatccatccatgccacacccagccaaccatcccgccatctccacaatccaacacctccagccaccagcgcccatctcgcctgccatactcgcgcgcttgaccagacgaggggatcctggagggtgatccctagcaaactctcctactgctgctcatctacaactctccctgctgctgtttttcaacaagatcgcctcccatccgcgcccttttgttgtcgctcttgcttcttctctgaacctcagtctgctgctgcttcttctctctgaaccgcttgctgctcttcctcaacgccccctgcgacttcgctcttctccacaaccctgctactacttctctttttcccctaacgctgtcgttgctgctcttcttctacctgtcgctgctgctgctctcaacctctctccttgcgccccttcttctcccacgaactgctgcgccttctcctctcaacgcc

SEQ ID NO: 67463 - DNA, 597 bp, Triticum aestivum
  Clone ID: PAT_TA_67463
atgatttatttattttctccagttgcaatgcacgggctattaccaataattttcattatcaaatgcagtgttagtgaaagggtgttcctttatcacgattaaaggttgcatgtcttctgataagtgcctcgatatcttttcggtctctacttgaatgtcgcgtacttaattttttagtgcccaacaatctttgcactgattcttgcaaggggtcctcgaggaagcaaagtaaatgactattctcagtggagacgacaccatagatgttgttttgaagtaagctcctgctcaccattcttttgtagttccttcagaagaaatgattccattcttttactcgagactgaagagttgtttttgcccatccatcttagtttaatacaaagtagatgccaggacagaaatatatacttgaaacccaatgaggtcaatgatgtgcgagattctgtgttcggaggatggctcaaagatcaattacatcaaactaagaaggtttaaccaaaatgatgcaagtttgaattgcctctcgcttaaactttcttaattatgcatttatcatttttgagatgttaagctctgatgatcacactacttgat

SEQ ID NO: 67464 - DNA, 436 bp, Triticum aestivum
  Clone ID: PAT_TA_67464
gggtatttatgccgacctaaaaatcagtgagctggatcttaacacattatcatatcagagcctggaaatgtcatactttggggcaaatgtgttgcatccccgtaccattatacctgtgatgaaagacaatattcccattgtcattagaacatgttcaatctctctgcccctggaactgtgagtttgcaagcagcctgctaacaagatgctgatttggatgcttgtgtcaaatcatttgctactatagataaattggcccttgttaacgttgaagaactggaatggctggtgttccggtacatcgagtgccatatttagtgctgtaaaagaggtcggagctaatgttatcatgatatctcaggctagcagtgaacactcgatatgttttgctgttccagaaaaggaagttgcagcagtctctgcagccttgcatgtt

SEQ ID NO: 67465 - DNA, 578 bp, Triticum aestivum
  Clone ID: PAT_TA_67465
ctgcgggggccagcttactatactacatggatgcgagcggccgccgcgggagggtgctttggctcgtcaggctccagattgtgttgattctagtctggtctggaggagctagtgcaaattccgacgacggcaaagcatcgttgtcgctggaaggcgcggatgctggagacaaggatgtttaccttagccattcttgcatccatgacgaaatactgcatcagcggcgacgagctggtcgaaaggagtattctgtcatgccacaagtctaccatatgccccgagagaaagtggagcgcgtaagaggcaggcaattgttgggggtgtcatcttggcgtgctccacggagtaatgtcaagaagccaatacggatatacctcaactatgatgctgttggacactcacccgaccgggattgtaaaaatgttggtgacattgtcaagctcggtgaacctcctgtaccatcggcaccaggaacacctatctgttctcctcatggagacccaccattggtgggagattgctggtacaattgcaccttcgaggatatagctggggaggacaagaagcaacgacttcgg

SEQ ID NO: 67466 - DNA, 467 bp, Triticum aestivum
  Clone ID: PAT_TA_67466
gtgaactccataaggccggcgagataaccatgtgccaagatttgctgatctccgtcaggttcatttgagacgaggcaacgggatgatgaaccgtcggcagtttctgaatctggttgtttggagctggagcgaccgcctttactcgctgcgccgcatcgacccctccaagaatctcttctacgagtcaacacagcaagctcagaaagccgcctctgcagagaaaagaaagaaatttgacaagacatttcggagcctgcctgaccccatcgccagcttcgatccgtcccccaccggcgtcgtcaacagcggcctcgagtggttcgagctgttcgccccccgcagcagcgagagcaggatcgtgaactccaataaggccggcgagataaccatgttcgacgccgacaagcgcctcatcctcgccttgccaaatctataccagcctaaggggcacgacgcggttgttatct

SEQ ID NO: 67467 - DNA, 153 bp, Triticum aestivum
  Clone ID: PAT_TA_67467
gcatttgccttccttgttttccacgcaagtgatgccatggacggtttgctgctgatgttcgatggacctttgtgacattctttttgttgttcggactaccttcttttgttacaaatggggaatttagtgcaaatcaagctgggtatggcagtt

SEQ ID NO: 67468 - DNA, 548 bp, Triticum aestivum
  Clone ID: PAT_TA_67468
atatctcagactctaagagatgcgagcaggaaaagatgtcggatgcacttgcacaagcaaagctccgtcttgggaatctgcggtttgctgaagaggcttctgccgcacaccttgaaacagagtgcttcaagaagtatcagaaagtgggaaagacgttctacaactcccagatagctgccacggttcggtggctgtcgtcttcaacttctgaccaaattcacgaccgacttgaaacccttaccaaccagactacagaagctggtgcagccaccagctctccttgcaacatttctgatgctttgggcaaagctgaaaagccagcagaagctactacaagccacgagcacgcgaaaaccaagccttctgatgagtttgcaaagaccatggcttcaactgaaaacatggagccttccaagatgtcaccatctgagaaatccatagacgaagaagcaagagatcgcgcgatcagtaccatggaccttcccaagataccatcattcagagaattcatgagccagaagggaaggagtcacacaaccggctcttct

SEQ ID NO: 67469 - DNA, 460 bp, Triticum aestivum
  Clone ID: PAT_TA_67469
cgcttccccccaccccgcacatattcaaaccacgcccccttcgccattgctccctcccttccagttcgtccacgattccaatcctccccgacctcgaacgaggcccgccactaatcctcaagttagagacgatggcgttgtcactcatcaccagattgctaaccctggctctaggttatgcgtacccggcgtactcttgctacaagatgctggaagtgcacccgccgcagatcgagcaattgcttttctggtgccagtactggattctcgtggcgacgctgacggtctttgagaggttcgcggactggattgtgtcgtggctgccgatgtacggtgaggcaaagctgctgctcgtcctctacctctggcaccccggcacgcggggtgcggggcatgtgtatgatggcctcctccgtccgctggtggcgaggcatgagcacgacatcgaccggggcctgct

SEQ ID NO: 67470 - DNA, 478 bp, Triticum aestivum
  Clone ID: PAT_TA_67470
tgctctcctggtgcccgccgtcgccgtcgcccgctcccccaaacccgctgggcggcttcgtcaccagatcctgtagcaccccaccagtcgtcgccttgcccgaagagctcacacgccccccctccgctcccggcatcgtcgtccctatagagaagtggatcctcccgccgcaacatcccgcccgattccggtgtccttcggcggcgcgggggcaccaccgtgaccccctccccgccatcttcctcccttgcacaagccgcttgaatcctcccacaggtcggcagtggctgggctggagacactgcttcccctgcacactgcggtggcgtcagtgcacctcatgtcctgcatcaccatcgactccacctgctggtgctccatctcccaaggcgacctcatggacagcagcgacgatgacgatgatgagtaggatgaccaggacatgtgcgaccccacccctgagcccaacgagctcgac

SEQ ID NO: 67471 - DNA, 555 bp, Triticum aestivum
  Clone ID: PAT_TA_67471
tttttttttttttttttttttggactgaacgatttatatattcttcacaaaccacaaccaaaaaagagtacttgattagcaactccgcttccagacacttctcccgtcccgtcccgtccccagccaacctcccatctccgtctcgcgtcgcggcggcagttccactccctcgccatgggcaagattaagatcggaatcaacggtttcggaaggatcgggaggctcgtcgccaggggagccctccagagcgacgatgtcgagctcgtcgccgtcaacgaccccttcatcaccaccgagtacatgacctacatgttcaagtacgacaccgttcacggccactggaagcacagtgacatcaagctcaaggacgacaagactctgctctttggcgagaagccagttaccgtcttcggcgtcaggaaccctgaggagatcccgtggggtgaggctggtgccgattacgttgtggagtccaccggtgtcttcactgacaaggacaaggccgctgctcacttgaagggtggtgccaagaaagggggcatctctgccccaagc

SEQ ID NO: 67472 - DNA, 488 bp, Triticum aestivum
  Clone ID: PAT_TA_67472
gcgaccgcactgccaagctgcttacgatggaggtgctaagcgtgtgctttgtggtcgttgctacactgtccgccacttggcttctcaagctcgctgcactttcttgtaatagtatcaaggccaagaagcggatggtgctgcctcccgggccatggactctcccgattatcgggagcctccaccatgtcatcagccttctcccgcatcgcacgatgatggagctttctcgccgacacgggccggtgatgcttttgaggctaggtgaggtacccaccgtagtagtttccagcgccaatgcggcggcgcacgtgatgaagactaatgatctcgtgttcgcgagccggccattaagcccaacacaggacatcataagctgcggcggaaagggcatcgtcttatcaccctacggtgaccactggcgtcagatgcggaaggtgtgcatcctggagctcctcagctccaagcaggtgaaccgcatggagggcatc

SEQ ID NO: 67473 - DNA, 174 bp, Triticum aestivum
  Clone ID: PAT_TA_67473
cctaccgcaaggccgccatcaaaaaccaccccgacaagggcggagaccccgagaagttcaaggagctggcacaagcctatgaggttttgagtgaccctgagaagcgtgagatatatgatcagtatggcgaagatgctctcaaggaaggaatgggtggaggaggtggtggtggag

SEQ ID NO: 67474 - DNA, 442 bp, Triticum aestivum
  Clone ID: PAT_TA_67474
gcgcgggcgcgttcggctccgtgctctccggcgtcggcgacgcctcctccgaccagtggttcgtcgaccagctcaacgccccgccgcccggttccatcgagcgcggccgatccgaggcctcctcgatcgtctcggaggtcccggactacctcttcggcttcgacacgacctccgaggagcccagccccggcgcgggtgcgcagcccaagtctgacgcggaggtggcgcaaggcgacgatgacgacgacgcgccggctcccgtgctgggcgctcctctggtgccatacgtcccggagagcgccccgtggccggccccgcctccaccgtacatggcgcagccggtgtactacgtgcctgtgcgcccggtccactacctcaacgcggctgcgcacggcggctacatgcccgggccggtttaccacattgtcggtggagggagaaa

SEQ ID NO: 67475 - DNA, 312 bp, Triticum aestivum
  unsure (1)..(312): unsure at all n locations
  Clone ID: PAT_TA_67475
aggcccgccacggacttcttcatccgtcccgagcaccgaacgaagccgaggtggcctgtgcgctcgccatcgagctagtcttcgtcgcgtacgttgtcgtcgtccatcgtcgattaccaccgttccggtccacctcgatcttccccgagcgcggggggggactcncaacgctggagcccaggagccagacgccactgtcgacgacgactcctactacactagaggtgcctactactacgtgcagcccgctgacgacgaccaggagtagtttagggggatcccaggcaggatgcctgctcctctttcgatctg

SEQ ID NO: 67476 - DNA, 364 bp, Triticum aestivum
  Clone ID: PAT_TA_67476
cggctaccaccgtggcacccttccagggctcaagtccacagccggtctccccgtcaggcgccgctccagcgccagcctcggcagcgtaaccaatggcggtaaagatcaggtgcatgcacgtgtggccaattgagggcatcaagaagttctagaccttgtcttacttgccacccctctccacggaagccctcctgaagcaggtcgactacctgatccgctccaagtgggtgccctgcctcaagttcatcaagggtggcttcctcttccgtgagcacaacatctcccccgggtactacgacggtcgatactggacaatgtggaagctgcccatgtttgggtgcaccgacaccacacaagtgctcaa

SEQ ID NO: 67477 - DNA, 497 bp, Triticum aestivum
  Clone ID: PAT_TA_67477
gaccgccatcgactcgcacgtcttcctgctcaggtggttcgaccgcttccccgagtacaatggccgcgagttcttcatcgtcggcgagagctacgccggccactacatccccgagctggccgtcaccatcgacgtccagaacaagaaccccaagctcacccccatcaatctcaaaggaatctgcattgggaacggcatactggagttcgcggaggagcacgcggagctgtacgagtacctgtggcaccgcgccttcatatcggacgcggcgcacgacaccatcgccaagcactgcaagggccccgacgacctctccaccgtctgccaggcggccagggacaccgcctacagcaacaccggcgacatcagcgccttcaacgtctacgcgcccacttgccacgacaagaaagtcaggccaacagactccaagtgcacggacattgctggtccatgcctcgcacactgtgtggaggcgtacttgaaccagcgccaggtgc

SEQ ID NO: 67478 - DNA, 403 bp, Triticum aestivum
  Clone ID: PAT_TA_67478
agtaaatggtttgacctgttaaatgtattaaaacctgtcatattaacccatcaaaatgatactcctgtgtgggtattggaatcatctggctcctactctgtgagttctttttataaactagttaattttggtgggatcccatctgcattgaaagactatctggaaaatcaatgtcccactgaacatacatgtatttttgtggctgattgttacaacaaaagcatgatgcttgataatttagctaaacgtagataagtagatgatatgacatgtgtcttttgcggggaactagaatcaattcagcacctattctttgaatgtattgtagcttggaatatatgggggataattgttgatattattggtatttctatacctcagtcttttgctgatgttgcatgct

SEQ ID NO: 67479 - DNA, 156 bp, Triticum aestivum
  Clone ID: PAT_TA_67479
gttctttgcaccgcaacttcgccagtccactactacgatacagaaggatcacaagtcagtctccactatccagcagcacagcaagaacaaggtggaggagaagagatggctgctccggcgaaggcatcgtggatggtggccacaagcgtgggcacc

SEQ ID NO: 67480 - DNA, 584 bp, Triticum aestivum
  Clone ID: PAT_TA_67480
tcctgggccacaggttattggcgccaagaggttgtcaacgatggtgccactcacgttactgattcctccgatcacgccttcaaccttgccacacagatggcgttcaagaagtccttccctgaagccggtggccaggtccttgagcctctgatgaagaccactattactgcccccaacgagttccagggtaacattctgatgcttatgaacaagcgcaacgctaccattcacgataccgatattggtagcgaggactttactcttatctgcgactgcagtttgaatgccatgtttggcttcagctcccagcttcgtgccgctactcagggcaagggcgagttcagcatggaattcagccactacgctcccgcccctcctcatctccagaaagagttggtcgccaagcaccaggctgagattgaggctaagcgaaccaaataaacaagtcccaggacttggaagagaattgccagacacatagagatgtgatggttgaggcacaatccatattgcgccaatgtacaacacaaatgaacgggtctatgatcttgtaatataatgtcataacgactccttgccagggg

SEQ ID NO: 67481 - DNA, 604 bp, Triticum aestivum
  unsure (1)..(604): unsure at all n locations
  Clone ID: PAT_TA_67481
gtggtggtcatgagacaaaggatgagatggatggtggcaaatttcctgtctcggaggaacaggtcacggttctggggacccaggagataccatgctctctacttcttttggagatcgaatcctatatgcaggtgcttaacgaactgaaggatgcacgcagatgcttctacggtgaagagcttgataactccaaacagctgcggatcaaaggggtggcgggtaccaaagaggtggcagctttgcataccaggctaagtgaagcaaaacgtaaaatggaccttcttctgcggggggacacagaagctgccagccgggtactcaaatgtgctcgggcgcatgaggtagagcgaaagcagttgactggggttgggatggaagacagttttttggagaagcaggtgattggtccattgccttgtgaggctgggatgggaggggaatccggcaagcancagcagtctcaatttcttccttgccgccctgggatccagagtagtgatccacacatgatcgaatggaccaaatccaacgtcaaagctacagatctcactcccaccatcaccaaaagtgaaaatggcgacaatggtgatgttgatgttgatga

SEQ ID NO: 67482 - DNA, 437 bp, Triticum aestivum
  Clone ID: PAT_TA_67482
tggcagtggcagttgcactgccccgcactcctctgcctcctccgctccctacttccaactatccactccatcaatggtcgcaaccccccacgcagcagccgcaggtctatctccacactcagcccgccggtagccctcctcccgcagacacatggcctggaagcggctcgccgcccgctcccgccgctgtcccgtcccgcccgccccgcggcccccggcgccgcgcccgcccccgccggcgggacccgccgcggccacgccgccgctgcgccgcctcctcctccccctctcgccgcgccgcttcgccgccgccgcagcctcctcgcccgcgcggctgttccacgccgctgcggtgcgctgggggagcaggtcgctcgccagtgatgcctccgcggcgagggagccctccgccgagctggtggaggtgcccctggcgc

SEQ ID NO: 67483 - DNA, 590 bp, Triticum aestivum
  Clone ID: PAT_TA_67483
gttcacctcacctgcccggactgcgcccccgcctccctccccaccgccgtgctccctttgccttcgggtcgctcccctctgtggttgtacgacgcccgccgcccgcgcaacctcccttcaccccgctcgacgtcgtcctgcccgtccgcctctcctatggcgcacggcacctgccgcctgacccgcccttccaccatctcctgtgtcgccggcagaacctcacttcgcgctgctcgccatcggattggcccgcccgtgcgcctctcctacgacgccggcctccagctccgccctcctccatctcctatggtgcacgacgcccgccgccggccccaccctttggcatctcctatggcgcgcggcgtccgtccgtcggcctctcttgtggctaacggctgttgctgctcgatgtctcgaacaacgctacagagtggccctgccacggcttcatcatatacctcatcggtctttgcattttcaatgatccatcccttgagccatatgatctgtcagatgatgacactaatttacagaagaatttcacacatctaagtgatcttgcagctgcactgcgaaaacatgaccatcgt

SEQ ID NO: 67484 - DNA, 535 bp, Triticum aestivum
  unsure (1)..(535): unsure at all n locations
  Clone ID: PAT_TA_67484
atcatcccatcccccagtcataaacccaagtcggactcgccttcctcctccccaactactcctctcctccgcgcatcgcatcgcaccgggggtncacctgagatcacatacacaatggtgaaggctgtggctgtgcttaccggcagtgagggtgtcaagggcaccatcttcttcacccaggagggagatggcccgaccaccgtgacgggaagcgtcactggactcaaggaagggctccacggcttccacgtgcacgctcttggtgacaccaccaacggctgcatgtcaactggaccacacttcaaccctgctggtcatgtgcatggggcaccagaagatgaaatccgccatgctggtgatcttggaaatgtgacagctggagcggatggtgttgctaacatcaatgttactgactgccatatcccccttactggaccaaattcaattgttggccgtgctgttgtcgtccacggtgacgctgatgatcttggcaagggtggacatgagcttagcaagagcactggaaacgctggtg

SEQ ID NO: 67485 - DNA, 404 bp, Triticum aestivum
  Clone ID: PAT_TA_67485
agttttgttgctgttcactgtttgtggaatgtagaagtaaaacagccgatgagtgaagtgtgggattggaacatgtatggaaccaaactgaagtttcatggatggtttattaacactgccaatgaggatggtgacggaggtgaggatggtgacggaggtgaggatgatgcttcatttgcctcggagcattccgatgatgaagatttgacggaggtgtcaattttacgtgcggtgcaagtgttggccattcgtgcaaactttcgtattagccgtatggacgcccatgactggtaccaaagttttgtcatctatgtggcgctcgagggggaagtacaagaggaaggaaaggatttggtactcgctggaccatgtgggatactacaggcttacggtgccttttgctt

SEQ ID NO: 67486 - DNA, 586 bp, Triticum aestivum
  Clone ID: PAT_TA_67486
cgtcttcgtactcgcctctctccgcgcatcctagccttcgccctcctccttccccatttcgccagcggcgcagcccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcatgtcccccgtgctgtctttgtagatctcgagcccactgtgattgatgaggtgaggactggtgcttaccgccagctcttccaccctgagcagcttatcagtggcaaggaggatgcagccaacaacttcgcccgtggtcattacaccattggcaaggagattgttgatctgtgccttgaccgtatcaggaagctttcagacaactgcactggtctccagggattccttgtattcaacgctgttggaggtggaactggctctggccttggctcgcttctcctggagcgcctctctgttgactatggaa

SEQ ID NO: 67487 - DNA, 561 bp, Triticum aestivum
  Clone ID: PAT_TA_67487
cactacactcaaacttatactattgaatggcaatcagctctctggtttcctaccagatgagattggcaaccttcagaacttgaacaggttacaaattgaccaaaaccaaatactgggaccgataccgaagtcatttgccaacttaagacatgtgaaacatctccacatgaacaataattcattaagtgggaaaattccatctgaattgtggagaatcccattacttcttcacctgcttgttgataacaacaatttgtctggacctcttcctacagaattagcaaaggcacctgctttgaaaatatttcaggctgacaacaataacttcagtggaagttccatccctgctacatacagcaacataaaaacactgttaaagctgagtcttaggaactgcaacttgcagggcgctattcctgatctgagtgccatatctgaacttggatatttggatcttagctggaacaaactgacaggaccaataccaactaatcagcttgcatcaaatatcactactcttgatttgtcacacaacatgcttaatggaactgtcccgttgaa

SEQ ID NO: 67488 - DNA, 398 bp, Triticum aestivum
  Clone ID: PAT_TA_67488
tacggcacaatacgcgtctgacagaggggcaaggtggacggaggggtgcacggcgtcgcctgtgcatgcctgagccgtggctcgagcttgtcgcaggcgtcctgatccgtggatcaggtacggtgctttctgctagcgccggcagtgcccgaactaaatgcagtagttgggtcagtcgctggttacgggggtgaagttggatttgcctctcgtcccggtcggtgaagaggtggagatatttactccggcgacggcgactgggcggtgcagcgacctcggacaggctccggcgaccatggagttcttactgcagccgctaaacagaacattcctggaagaggtgaatgataacaacggggcaatggagcccgtgcggttcccagtatccgcggtggctg

SEQ ID NO: 67489 - DNA, 544 bp, Triticum aestivum
  Clone ID: PAT_TA_67489
tttgacattttccgcccaccaccaccggagggagcgagctccagccatggccgccaagtgctacccgacggtcagcgacgagtacctggcggcggtcgccaaggccaagcgcaagctccgcggcttcatcgccgagaagaactgcgcgcccctcatgctccgcctcgcgtggcactcggccgggaccttcgacgtggccaccaagaccggcggccccttcggcaccatgaagtgccccgcggagctcgcgcacggcgccaacgccggcctcgacatcgccgtcaggctgctcgagcccatcaaggagcagttccccatcctctcctacgccgacttctaccagctcgctggagtcgtcgccgtcgaggtgaccggcgggcctgaggtccccttccacccggggagacaggacaagcccgagcctcctccagaaggccgtcttcctgatgctacccaaggctctgaccacctcaggcaggtgttttccactcagatgggtttgagtgaccaggacattgttgctctttctggtggtcacaccctg

SEQ ID NO: 67490 - DNA, 207 bp, Triticum aestivum
  Clone ID: PAT_TA_67490
ggacaaaagctagatggacacttatttgcggacgcacgaagtatatacatgcctaaaaacctcagtgcttgcctatagtctttttcagtgatgacagtaaaattagcgcgcactcaaacacatactccctccgtcccatagtataagacgtttttgcaagctatattagctttagaaaacctcttatattatgggatgggatgagtg

SEQ ID NO: 67491 - DNA, 396 bp, Triticum aestivum
  Clone ID: PAT_TA_67491
ccggcccgcccgcgccggtgccgtctcgcgtgccgtcaccgacgccgtctccgccgccctcaaggcacatcctgggccattccccttcgtcagcctcacctgcagcttcatggacgccacagaccgccgcgtgctcgcccgctggttccagatcctcgccaccaagggcgtcgacgagctcgtcttcgtcaatcgcccctggccccttcccggcctgcccctcccatcctcgctcttcagctgcgcctccctctcccggctctgccttggcgcctgggtgttcccggacaccaccgccctcccacgcggggccggcttccccaaccttcgggagcttgtgctaggctgcgtcgtcatgaaggacaaagacctggagttcttgcttgccgtgagccc

SEQ ID NO: 67492 - DNA, 628 bp, Triticum aestivum
  Clone ID: PAT_TA_67492
gggtttgacactaacctctgatgactatgtcgaatgcttgtactgaagtatttgagcctccgaagaacagaggttgcgaagattccctccaagattgagaagcttcagtatctagaaactcttgatgtaagggagacaaatgttggcgtcctgcccaaagctttcggccagctccaacggctccgcagcatgttcggagggagtaaaaacccacggaaggcgttaaaattgcctcaagagaaaaataaggtgcaaatgaaagcacttcgtatactgtcagggattgagatcaccgagcgctcaacaggtgtagcaagcctccatcagctcaccgggctaaagaaacttgccatttacaagctgaacatagagaaggatggaccgacctccacacaattgcgctcctctattgggtatctctgcagctgcggcctgcagactctagcaatcaatgatgagagttctggttttatcaacacactggattccatgcccgctcctccaagatacctcatcgccctcgagctgtcgggaaaattggaaagagctccaaagtggactgagaatctcaaaactctatacaagctaaccctttccgtgacagttctccgtgctgatactttggagc

SEQ ID NO: 67493 - DNA, 265 bp, Triticum aestivum
  Clone ID: PAT_TA_67493
ccgccgccgcccgcccgccggccgccacagccgaccgtcggttcgaccgcggccgccggacccttgccggggcggaggcacatgcggcggccgcatccccgatgttgaccgcgacccagctcctgctcccggccctcctcctcgtcgccggcgtcgcgggcggggctccgtcgctggagttccaccaccggttctccgcgcgcgtgcggcggtgggcggacgcccgcggccacgagctccccgggggctggccgccgcccggcgg

SEQ ID NO: 67494 - DNA, 438 bp, Triticum aestivum
  Clone ID: PAT_TA_67494
tgtcgctgtttaatagccgctaacgactccgttaactagccactgaggcgctgactactgggaccccacctaattaagttagttaaaccctctatttacggttagtttaattcacgtggcaaatcaattctctcatcaactttgactgcttcaagcaagctacaaactcaaaacgaaaatttccttacaactgcggtgcacatggctgcacagaatctggaagttcaattgtgaattgtgatggaaaggaggcaagaaactgtcaataaacacaagaaatgtgctggtaagcatgaaccggatggcgttagagttgcaaattttccatgttacctccgagtttgttggcccatcgatgctggaaaccggtagaacatagacccgaagttatatgaatagagtggagatgacgcggagtttaactaacgtattttaata

SEQ ID NO: 67495 - DNA, 543 bp, Triticum aestivum
  Clone ID: PAT_TA_67495
ctgctgttccaggaagtggacagcttctttaaagatggtatggaagttctggattgcatgtctgaagtatcgccaagagaagaaattgtagaatcatatcctattggatctgaaacagtatctaattctggagacgaggtgaagctaattcatactgaaaatacatcgactgatcactccacagagcgctcttcacagaacttgtctgctcaaggtacttcaggtattcagctgccagttgataactcttgcttggtaaattcagtatgctctgtacctggttatcagaatgatctggctgttactaatgtgaatggcatgctcaagtccattgctgaagacaactgcagtaaaggcattttagttaagggcagtgcgttggattcttcctgtgaggcgaggcctgaacaacaagaggaaatctgcaacagagagagtgccactgaggttccaacaaattatcaagtgtctacaagtcaggagcatgtcacattactaatggatcaagtgtcttctaccaagaatccattcaatatagatgac

SEQ ID NO: 67496 - DNA, 196 bp, Triticum aestivum
  Clone ID: PAT_TA_67496
agcgacagcgcagcaggcagaggcagcagcggacgggaggaaccgggctccccctccccccctccgctcctcgtccctccctcccacgccgccgatcggccgatcgggaggaaggaagggggccgatcgggaggcgctgcgccggacgcacggacggcgctctgggctgaagccagggagacagtttcatagccgg

SEQ ID NO: 67497 - DNA, 294 bp, Triticum aestivum
  Clone ID: PAT_TA_67497
caatgccatgttcaccttcggtgactcgatggatgagacaggcaacatatgcgttggcagcagcaacaagacggagttgaacgtgctcacctgcacccacccgccgtacggcgaaacctacttcggaaggccgtcttgccggtggtgtgacggccgcgtggttgttgacttcttcggttgcaaaggatacgtgaggaaatcgctcttcatgttcggtgcatacggcggaaacgactacaacgtgcagctgcttgaacgtggtttgacaccggagcaggcaatgaactacacccc

SEQ ID NO: 67498 - DNA, 506 bp, Triticum aestivum
  Clone ID: PAT_TA_67498
gctcggtcctctctaggttcctcgcccgccgccgtcccccgcctccctgctccgctgttgcccctccctccgcctgcctcgcccctgctctagggtttgccgcccgccgccctgctccactgttgcccgtccctctgcctgcctcacccccctcccctacactaacccctgcccgatctggatctggatgatggagctcgcactggaccacgctggtctacctgctggcatgctccatggaggccgtggcaagcagccgcgactggagtgtgcccgtcgaggcgccgtcgcagatgtggtggctgcacgtcggaaacactttccaagaggacaacagccgcggcggcctggacctgcacctgcacacgtcagcctgctcctacgactggctacaactggaagaagaagttggacctttcgttcaaacttattgtcaagtttcagcagatggcaattgaactcgacatgagaggagtagcatgccggagatgctccgtgaagagact

SEQ ID NO: 67499 - DNA, 306 bp, Triticum aestivum
  Clone ID: PAT_TA_67499
ccgtcccccgctgcccggacgcgccggcggcggtcgccctcctcgcccctaccggcgcccggccggccgcctttcgctccgacctcccaccgccccacgcgcctgctccctctgcccctccccccggcctgcctcgcgtccgccatctgcaccagcacccgcgcggggccgatcccgccgtccgcaggagcgcgtcgccggtgcccgcgccggcggagctcggggaggccgcgtccaggagcagagaggcggcgttgggcgtagtttcgcgcagggatccccgcggccttagctactgtcagaaag

SEQ ID NO: 67500 - DNA, 280 bp, Triticum aestivum
  Clone ID: PAT_TA_67500
cggctttggcccggcggcagtggacttgcactccttcctgcgtccatggtcggccgtcgtggctgcggatccggcgcgccacggtggttgcgctctttccggcacctttggctcgttggttcctcggaatctcctcaccatcaccgtgctggtgtccttggttggccgtccatcccggcgcatctttgctctcggcctgcttcgggagctgcgtcctcttccagctccttggatttgcctgtgctctgctactccggtcccggtggccttgatctgcgct

SEQ ID NO: 67501 - DNA, 282 bp, Triticum aestivum
  Clone ID: PAT_TA_67501
acgcgtccaatgtctcccctgcggcaggtcttctaaggactttgctgatgtgcacaggcttgtcatgcatgcttacaacccaccaaatgcagattcatttgttgatcatcttgggttacacaaagcattgtgtgtccttaaaggatggtattatacaaaagtgcctggtaactctaaggcataccagtcattacctcctgaccttgatctagcaaatagggaggaccttattatgtggcctccaactgttataattcgtaacactaccactgggaggaacaa

SEQ ID NO: 67502 - DNA, 229 bp, Triticum aestivum
  Clone ID: PAT_TA_67502
aacattaatttacaatgcaatcaagtgaaggttcagactaacagtcaaaatgtctagcgacacatttcagagcaggaaatcaaaggaaaaccgcctcagaaatgggacctgcacttacagatgggagaaacagaaaagaaggtgcagagatgagcgcatatgtaccgttgatccactttttggggggctggaaatggaaggcggtcctgtacttgctgctcacgatgga

SEQ ID NO: 67503 - DNA, 384 bp, Triticum aestivum
  Clone ID: PAT_TA_67503
catgcaccgcacttccttcaagcatcaagcgcgtcttttacatgtcaagtgaaggttgcaacctattgcatgaggtgtttcctgaagctaaccatacagttttggagcagctaagtaaggtggattgcattgtatatgcgatggggtcgctatttacatcagtttgtccatcactggtactgcgtggcattggtgagactatagcatcaaggtccattcccaaggtacttcttttaaatggatcacatgatagagaaactattgggctgtctgcttctggctttgtgactgcaattacggattctctaaatcggacatatggtgatcctgacaaaagtctaaagtatcatcccaaagactatgttaatgccatattggttcctg

SEQ ID NO: 67504 - DNA, 616 bp, Triticum aestivum
  Clone ID: PAT_TA_67504
cgtcacctgcacccttatcccaccggcgctgccacccaccaccgcctctccgccactgcgctctggccctttccctccattgctcctgctctccctgcatctgctggctactggatccactcatccgccaggttgcagcaagcaagcaagcatagacaagcaaagacgacaatcatggacatccctgacaaaagctctttggacatggacaaaactaccagtgtgttcagcaatcaaatcttgatgggaacgagcatggatccaacttgtgcgttcagcaatcaaatcttgatgggaacgagcatggatccaacttgtgcgttcagcaatcaaatcttgatgggaacgagcatggatccaacttgtgcgctctccggagcaacaactcctccagatggactctctgatgcggagcatcccaagtcctaccaagtgccaagtagactcatgacacgagcacgtgcaagagctctcgaatcagaggtgacatcactcctcttgcaactcccttttgaatcatatgagacatggctactacctcaaacagagacactttgcatacttaggtaccaaggagttagccatggagaagctaaggagcaagggggatcggaag

SEQ ID NO: 67505 - DNA, 642 bp, Triticum aestivum
  Clone ID: PAT_TA_67505
accccaaaaccctcgcagcaaacgtcagcgaggatccccacccctacctaagccctagacccctcaccggcgaccatgcccgccgccgccgccgccgcgcccgggacggccgtggcttcctacaccgactacatccccgactccgtcaagagcttcgtctccgacctctaccgctccatccgcggcggcgacgtggtcgggaccgacaagctgtacgagggcgacttccgccgcctctccgcccgcgtctaccgcgacaagccctggccgcccgccaaggccgtcgcgtcctactgcgacgacgaccacgtcttcctcctcctctacagcgagctcacgtcccgccacgcccacgcgcgcctcccaggcctcaccctcacgcacggcgccgactcctgggacacctactgctccctcttcaccgtcgtcctccagaacgtcctcaccatgcagctgcccaaccagtggctctgggacatggtcgatgggttcgtgtcccagttccagagattctgcgagtaccgcaccaaactcgaggacaagaccgaggaggagatcagcctactcaagcggttcgaccaggcatggagtgtgtatggggtttttaattacttgaaggcactggtggagaattcgatgatc

SEQ ID NO: 67506 - DNA, 512 bp, Triticum aestivum
  Clone ID: PAT_TA_67506
cttctttggtgacatgctgacgcaattgcgcgggattatgatttcatcgacgtgctacgttaataattcccaaacaatcctggtctacgagattataatttcgtcccgctctcaatcaatgttcactcttaattttctcttcaattatagcgcgtcaaaattttgccttcaattattgcaattcttaccaaaagcgttcacgttttcccttttcttcccatataagcgagcgtcaaacttgcaatcttcagatgattattgccctccaagatctcattgctccacaagcgtttcaggccagtgagcttctccaagaaatcaaatccttcctcctggtggcaccgccgcgcgacgggacgatgaagcacacgacgtcggactcggacgtgacgagcctggcgaccacgtcgccgacgcggtccccgaagcgggcggcctactacgtcgtcagcccgtcgcgcgactcgcgggacgacggcgacaagtgctcgtccacgcaggccacccccgtg

SEQ ID NO: 67507 - DNA, 436 bp, Triticum aestivum
  Clone ID: PAT_TA_67507
tgagtgagtgacctgggagcgctctcggctgtcgctctcgagcccgcattaatacgcgtgccattactagtaggagtactgctgcgctgaaactccagccccttcccctccccctccctgcccgccgctgccatcccgatccggcgatccggccaagaacggaccaatggcgtcggcgcgccgcctgctgcaaacctacccgggccagttccaggccgccgagccgcccgacgccctcggccccgactccgacgtcgtcgtcatcctcgccgcgctgctctgcgcgctcctctgcgtcgtcggcctcgccgccgtcaccggctgcgcgcgctcccgccgcgacgccggcggcgccagatccgccgcctcctcctccggccccggcgcgagcaaggggctcaagaagagggcgctcatggcgctgcccaagctggcg

SEQ ID NO: 67508 - DNA, 407 bp, Triticum aestivum
  Clone ID: PAT_TA_67508
actggcgccatcttccgctagcctcgagctcgcaccggttcgccctgccgctggtgctatgctccccatcggcttacatgttgtcatccatagcgcctaccacaccacgacctgcagatggagaagacctcggctggcaagtaaaggaggcctccacctgcaggtctacagtagatgtgtccacgtaactctggcgcgtacttgtgccggcttcctactggttgaaagatcgcaacacgggtcggcatcaacatgtgagtcgtactgcagtcctaattgagcctcccttgtcttcgtcattgcttgcggcggtgaccaggcctgcaatcgaacggctgcttggccgtaagatcagcacaacagcatgctgatggcatctattaccatgttctgatgggaaaagcagc

SEQ ID NO: 67509 - DNA, 255 bp, Triticum aestivum
  Clone ID: PAT_TA_67509
agtcccacaaacaattggcaatgacatactactgatggacaatacatcttggatttgatactgcagtggaggcagcacaaagagctatcaactctgcatatattgaggcacattctgcatttcatggcatcggattggtgaagctgatgggaagaagcagcggatttatcacaatgcatgcttccctgtcaagcgggcaggtcgacatttgcctgatacctgaggtaccattcacccttgatggaccgaatggag

SEQ ID NO: 67510 - DNA, 167 bp, Triticum aestivum
  Clone ID: PAT_TA_67510
cgccgtcacccccgttcccgtccaccggcggccatggacccgcaagtgaccctccacaccaggaggagccgccggccaagaccccgagacgctggatgttggctcaaatctgctgctctgcaccctgtacgacttcctcccagccccgcccgtctcccccaccgccg

SEQ ID NO: 67511 - DNA, 386 bp, Triticum aestivum
  Clone ID: PAT_TA_67511
ctcgtcccctccctcgcccaccgccaccagcggggacgagccgccgcctcgcacgaggaagcccggcacgaagcgtctcgtcctcaccgcctcggtcctcctctccttcctcgtcggtactaccccccacctccccaaatctccatagttctaggcctttttttttctcttctcttcttcgtgtaacccgcgcgcatgtggctttctctctccgtaggactgcccttgctgctcaaatccaccgagatccaccggtcgccgctgccctccgatgcaatcgccgacctgtccctccgcctccagtcgcaccctccctccttcccctgcggtctccacgcggtcttcctccgctccggccctggctcccccgtcgcctcacttgccga

SEQ ID NO: 67512 - DNA, 346 bp, Triticum aestivum
  Clone ID: PAT_TA_67512
tctaccttcctcctctctctactctctctccacacgtcctcatccatcactcaccaccatgattctgccccaacacgtcccctctaatcgcgacgacaaattcgggacgagaggatgaggtcaccggtggcatgctcatgggacgagttagccatggccttccagctcactgacgatgttgcatccggccatcgcgattgctggaattccatgcagaaatgctggaaccggcaacctatggtgctggaaccagcagtcctcgcgtgctttcaacaacacttctacgatgcagagctgcaaccggcacatggaaatgctggaaccaatgtgattttttgcttccact

SEQ ID NO: 67513 - DNA, 430 bp, Triticum aestivum
  Clone ID: PAT_TA_67513
ggtgaggggactcatggcgatggcatctgtggcggctgcgacttcctgcggcggagcggcgatggaagccgatggcctgtatttcctcatggatctagttgaccgatcagaacagagctgtggagatggaaaagttgaccgggattaaatccgtaagatggacttcaagctaatgagatacagtacaagattgagtggctaaaaaaaggcaaacccatggatctaccattatgtcccatatggccattcagtcgcagctccagaaccaggacacgcccacggtatacgcacgtacagctcgatcgcaatggcgtcgctcgtcgccgtccagccggtcgccgtgcggggcctggccggcagctccatctccggccgcaagctcgccgtccggcccgcctccgccgtcgtctcccgctccacccgcatggct

SEQ ID NO: 67514 - DNA, 530 bp, Triticum aestivum
  Clone ID: PAT_TA_67514
gactagtacatgttccaagtaaatcagttctagtgctagtactactgctactctagctgcaagatcttgttcttgttctcatggaggtccgtagtgctagttctagttcttgtactctacttgttattgcgccctcgcctgcggtgccgttggcactggttggttcccctcacacaagcatagcatcatctcgctctgtgaatgattaacccctgttctttgaagcggcgttgtgggataggcaccatgctaaaacttgcctaaacattttccaacccaaagatagaaagattgtgtgtttcagtttctttatcggtttggaaacacccacaaagttctttatgtataaaaagcagggcagaaatgcatttttctctctctgaaaaagtttcagtttcacaaacttgtttagtcagtccctagggaaaaggaaaaggattgattgatctcctgcccatacgcgtcaacgatctgtggcaacacagccacaggatgcctcggtgaatcttgagcccacgggagagctccac

SEQ ID NO: 67515 - DNA, 427 bp, Triticum aestivum
  Clone ID: PAT_TA_67515
tcgtgtaatttacttgtttacattagaagatacggttgcatgcatggtggacagtctctaggcacttcaaaattatggttttaaaagcagacacatctagtacaattctgctcccagaaatttctatggttacctggaagtttgtggagttttctccttatttctttgacacttgtataattgatgatgttgtaggacggacatccaccacttggttggtcggacactatggcataccttgttctaccaattcttctggttatttcgcaatacgtatctgctcagatagtgcaatcatcacagagcaatgatcctagccagcaaggtgcacaagctgcagtgaagttcctgcctttgctaattggttattttgctctttctgttccttctggattgagtctatattggtgagtatacactgtagaaa

SEQ ID NO: 67516 - DNA, 329 bp, Triticum aestivum
  Clone ID: PAT_TA_67516
tgccaatgagcgcacctcaaacatggtctgtcagtcagttgaaagaatggattgcggcaagtttaggtcttgatactgaaacacacaccgtcagtgttcatgcattgtggacacggtcaagtacaataatttacttttatttgaggccaatagagcgagactccgattgggtgcggtggttacaaggttgtgaacgaatgggatgcaatcctattgctttagtgcttcccgtcgtgaatggggtcactgcacatgaaggccaaggtggcaacgatcctgagcagagcattgtatgtaggcggctatctatgtcaaatgctggagatgat

SEQ ID NO: 67517 - DNA, 604 bp, Triticum aestivum
  Clone ID: PAT_TA_67517
ggggtcaatctatgttgtttactgctctaatcaagctattgctaggattccatgtttcctacattgtattatactgatcattagtaattcaacctacattgtattatactggtcattagttgaatgttgattctgtgatgatcttaatacatccatggctgttgaggaaatagggaaaatgtataaactggtgaaatatcactcattaacctcctcttagatttgagctaagatcatatgggttcggccgtgcatgtccatacacagtgcatcgggttaatgtgcctgaagcgtaaggactcatgacatattgacgaagtgcacatgttgagttaaaaatgtgtacatttgttttttctgttacgaaacattcgacgatgttttgctttgatcttaatcaaaatgctacagaagcaagtcaaggtttagttactgtaattttacttactgctattccactctgttctctacaaagaaaaataaattatggataaattgcagtgataagctatcaataagagacgtacatttacttatattgctcaatattcaattgatcgactagtttttagttacaaaagtgtgatgtttcaaaactgaaaaa

SEQ ID NO: 67518 - DNA, 308 bp, Triticum aestivum
  Clone ID: PAT_TA_67518
caatagactgcacagaatcatgtgttcagaagtcttggtcctataaatatcctagttattaacatgtgttcagaagacggagcaacttcacatgctttttgcatggctgctgcatgcatttttgatgggcgtctttccttccttaatctctggggcatgtatccttagatccccagcctcttgtacatatctgttagtgagaaatcgaacatacattgtacagatccgctttgccgcccttgcaactccagtcagtgctttttttgcattttttttctcccttctttttgagagatggacatctagtc

SEQ ID NO: 67519 - DNA, 485 bp, Triticum aestivum
  Clone ID: PAT_TA_67519
gcggcgcgcagtgcatgctcttttcgtctgcccttcctcctcgcgcttgcaaagtttgatccacttctcggccgctctccttctccagatcagccgcgctgaataatcataaggccgcctcgctattcgtttttacctcctcgccctctttggcgatggataaggactctcttaagtctactttggaagaggttcgcaaatcagtcgtccgaatatcttttgactggaagagagaagagaatatggagaatatggttattgctggccttgttacctccgtcgttgatgaattagctacaataatagcaaatcctgtcttctttaggagatcaaatgagttctctgtgcgtcttccacagaatgggggatatggagaattaattaagatctcgtgttctttggttaaatatccgaccaataattttttcacatttcttcttgagctgaaaggaaatgcctacagaaaacctgtcaactttgaactt

SEQ ID NO: 67520 - DNA, 227 bp, Triticum aestivum
  Clone ID: PAT_TA_67520
ggggttccgccgggcggatttgtgagaggggtgcttggttttttggtcctggtgttgcgggtgcgggggagatgagctcctcgtcgggggccagcctcggcggccagccgccgcccgccgcgccgccggaggaagagaagaagaacctcaactctgttctgtggcacgcctgcgccggcccgctcgtctgcctccccaccctcggcacgcgcgtcgtctacttcccg

SEQ ID NO: 67521 - DNA, 287 bp, Triticum aestivum
  Clone ID: PAT_TA_67521
aggaagttcgccaccaacgaccgcggcaaggggcgtcccggccaatccccgtcggcggggaaggcgaaaatgcgcggcggctggccgacggatgaggactctgacgactgggaggccgccttccgggagttcgtggccgccgacgacggcgacgtcctcaatgagccgctccccacaggtatcatggcatcctgcgagctataccgctcgccggccatggcgaggccgaagcggcgcagggccagccctagccacccgtaccgcggcatccggcagcgggcgtgggg

SEQ ID NO: 67522 - DNA, 294 bp, Triticum aestivum
  Clone ID: PAT_TA_67522
gcggtgaggagcatggcaggtgtccaacttgacctcctcagccacagcaacaacaagggtggccgtggcgacaagggaggagacaacaaccagcagagcaatgagatcgctaagtctctgatcccgccacttcctgctcgattcgcttggctcctgcgctgatttctctttgttttcccaggtttgttgtggtggcagaatggcgcatagcaactgggaagcggactacgtctacggacatgatgcgtgatgttcacatccatcactactatttgctcaagtggatcatccaaa

SEQ ID NO: 67523 - DNA, 161 bp, Triticum aestivum
  Clone ID: PAT_TA_67523
gggttgctgctgagtgcaccttaacaactagaactttcagtttccaagtttgaactagctcaccaccaaacatggattcgggagacagtggtgcaggacacaaagcacctaatgaagctgaattatggcaccctctgagggtgagcatttgaaggttgatg

SEQ ID NO: 67524 - DNA, 319 bp, Triticum aestivum
  Clone ID: PAT_TA_67524
tgcaaaagcgtgctagaggacgcaggaattagctagcgtttgtgtttgtcagttgaaggatgttagatgcttaagcgtttatcgcctctctggttcataggtaaaacaaaggaaacacgtagggagaaaaggatgtcctttaaaaattcctggtgtgtgagatggttgtattctttttagcatggtaacattctatttagacttttttttgtcttgtttaaatacaattcgactatttagtttattaatattcttttgtttttgtcacttttttcttcttattcatgcaccaaacacgcatgttctcaaaatttacgtg

SEQ ID NO: 67525 - DNA, 573 bp, Triticum aestivum
  Clone ID: PAT_TA_67525
aaactcacgccaaccccacccgagctcccaaccccacccgaagcggccgccatggcccccaaggcagacaagaagccggccgccgagaacaaggtggagaaggcggcggagaagaccccggcgggcaagaagcccaaggcagagaagcggctgccggcgggcaagacggcgtccaaggaggccggcggcgaggcgaagacgaggggccggaagaagggcagcaaggccaagaagggcgtggagacttacaagatctacatcttcaaggtgctgaagcaggtccaccccgacatcggcatctcctccaaggccatgtccatcatgaactccttcatcaacgacatcttcgagaagctcgccggcgagtccgccaagctcgcccgttacaacaagaagcccaccatcacctcccgggagatccagacctccgtccgcctcgtcctccccggcgagctcgccaagcacgccgtctccgagggcaccaaggccgtgaccaagttcacatcctgctatactgaccctgcgtcacttgctgtcacctgcttgtggacgctgactctgcttatgtatctg

SEQ ID NO: 67526 - DNA, 209 bp, Triticum aestivum
  Clone ID: PAT_TA_67526
acgcggggttcgcctggctggagatctgggccggtggccgacggacatggtcggggaagaaagatgtgagtgtcagcttgtgggcttcccgccgccattcactctacgacgaggtcaagcgcgagtaggcgaggcttctggacaaggtggctatcacggggatggccgttggccgcggcggttacgacggtcgcggtgagcgcgagcct

SEQ ID NO: 67527 - DNA, 387 bp, Triticum aestivum
  Clone ID: PAT_TA_67527
gcaagtgctctggcaggtcgcgcggttcctgccgcgccgacttcctccacccggccgcggccgcctcggcggcggccgcgctccacgggcgcgtcttcgacgggcaccactgcgtcgcctcgctctcctgtccgcccgagctccgccgcttcggtgccgattccgacgcctcggctccggccacggccccaaccccgaaccccacccaaggccgcggcgggagcgcgagcagcgtgacaacagcccggggcaaggtggggtctttgggcgatgggtcggctgtgggacccatggctccccggccgcggcagtacgctgcgatgatcggaggcggcggcgggttcccgtcgtctattgggcagtacaatgcggggatgggtactgatg

SEQ ID NO: 67528 - DNA, 301 bp, Triticum aestivum
  Clone ID: PAT_TA_67528
cctcctccctgcccccctgcaacgctaccgccacctgccccgtcctccgtcgccgcctcccctcccctcccctacccttccctcagccgccggccaccactccgcgcctctccctaccctctatttcacggcgcgccgccccgggggggggggggctgccccgattggaggccgtcagcatggggagacaggggggggacggccatcgacactttctacctcacggaccagcagctgcgcgactcgccgtcccggaaggatgggatccacgaggccgccgagacgaccctccgcgtctacg

SEQ ID NO: 67529 - DNA, 424 bp, Triticum aestivum
  Clone ID: PAT_TA_67529
ggccgtcgtcctcgccccaactaacccccgcgacgagtaccagcactggtacaaggacatgaggcacagcacgcgggtgagcgacgcggagggccacccggcgttcgcgctggtgaacaaggccaccgggctggccgtcaagcactcgctcggccagtcccaccccgtcaagctcatcccctacaacccggagtacctggacgagtcggtgctatggacggagagcaacgacgtcggcaagggcttccgctgcatccgcatggtcaacaacctcaacctcagcttcgacgccctccacggcgacaaggaccacggcggcgtgcacgacggcaccggcgtcgtgctctgggagttctgcaagggagagaaccagagctggaagatcctgccgtggggcgctgacggcgggtacgggtacgggtac

SEQ ID NO: 67530 - DNA, 655 bp, Triticum aestivum
  Clone ID: PAT_TA_67530
ccaagccaagacgtaaacgcaaaggctggccatgctcgcggacgagctagagatgaagcgcggctgcgaccaccccgagtcgtccaaaggcaaccgaccattctgcatcttccacaatgtccatagccacaacaccaacgactaccaggatctcaaggccctctgtgatgggcgcctcagtcgacaccccgagtgcaatgatcgaggctacggtcgtggaggtggccgaggtggaggacgctgggacggacgcgaccatcgccaggagtggcgcgaccatcctcgggaggaccgttggtagggccaacctcgcaagggtgcttggagggagcagcctcgcaaggagcgcccttagggcaatgccggtcttcctccactgcctccaccaccaagaaggaacaaagatcatcaccaggatgagttggttgggggcttccaggagcctcaagtcatcgcctacatcctgggtggctcacaggcccctgcttctcacaacatcttcaagtagtatgcacgcgaggtgaatccagcactccccaagcccaaagcaactcaccctctcagctggtccaaatgtgccatcaacttcagctgcttggaccaactcaagtgcacgggcactgccggcgtgctccccatgttctgctctcccatt

SEQ ID NO: 67531 - DNA, 289 bp, Triticum aestivum
  Clone ID: PAT_TA_67531
cccgtgttctgtgcccaccttctgcaacctcctccctccctcatggcggaccacctgaccgacaaccatatcgccgagttcaacgaggccttcaccctcttccacaatgcatggcgactgttgcatcaccaccaaggagctctgaaccgctatgctgtccctctggcagaaccccacggaggcagagctgcaggacatgatcaacgaggttgacgcggacaggaacggcaccatcgacttcccggagttcctgaacctgatggcgaggaagatgaaggacactgactcg

SEQ ID NO: 67532 - DNA, 363 bp, Triticum aestivum
  Clone ID: PAT_TA_67532
gtctgccctctctcgcttcctccgtcatcatgcttggcctctcctccccccatccccatccccatctccatccatacacagcagcagcgtcgccacaggggatacacgaggcaccgcccccgcgcacgatatctgcttcgccgtcaggggggatccgcctttgccggtctcctcctttctcctgcgccaccgtaaactaatcccatttcgtggctgctgctggtgggcggcggaatccaattcgagagcatcgtgttctgaacgggaagtattgatttctttccgctgccgtccccccattcgtgatcttggtatctttcttggttgggagtgttgatttggaggagagggtgttcttggggc

SEQ ID NO: 67533 - DNA, 540 bp, Triticum aestivum
  Clone ID: PAT_TA_67533
ggcggcgccaattggaccctgatctcagcgccagggcagtggtcgccgtatcgatgtgctccccgagcttgggccattgtcttgtatctcctcccatcctagcctaactgactgaatctggatccaaagatttcatcggcagtcgttgagtcgtcatggtctaggtatggtcgacctcctcttcaagtttggtcactggctcctacttcatgcgcccatgagcaccaggtccgcatcttgcctctctcgaatctggtcacctggccgcatccaccccctggtgacatccctaagtacttttgataaacaggagtttgtttgttttgacaagagtgcatcagaatttgtgtgttaggagtttggcgaatatctttcagcgaatcaattgtccttctgtaatgagagcataacgaaatgactatgttttgagaaataaaacttattatgctataaggtcttataatgctagaacaagtcgatacactatgtttctgaaatcagtagcaaaagtatggtaggtaattttgttgtgggagcaga

SEQ ID NO: 67534 - DNA, 258 bp, Triticum aestivum
  Clone ID: PAT_TA_67534
cacactcccgccccacccccaccgacagcagtaatgaaggccctcgccggcgacagcaacgcctccgcgccgcttctgcaggaggccaagatcagcatccccgcctcctccacgggcggggccgcggaggcggcgctcctcgggaagggccggtacaatgtgtgggccctcgccgccatcgcgctcctctcgctctggtccatgtccgccgcctccgtctccctccgctggtcggccggcgacctggcagccgttatt

SEQ ID NO: 67535 - DNA, 539 bp, Triticum aestivum
  Clone ID: PAT_TA_67535
ttttttttttttttttttatttaagcgtctgcgtttgtactatatttctcggaaatgaaaattggtagcattgtagttgagtacctataagattgtgattgcaaattacagaggtctccatagaaacgcgctattcggcatatgatgatagcaaactactaagatcttataggtaccaatcatcttgctcgtcatcctcattttctgaatcttcttgcccataacgagagagatgttcagagtctgagtccgacatctgtgactctagttcttctcgttcctctctatgtctcgacgggttttctccgtattttttcgatagcctattcatccatgcttcctgtgattcttcttgtccttgttcctcatttggttcttctagctcaaatactactttacggatgtgagaaaccttatatgcatcctccctgcgggacctacggaccagacctgaagatccagaaatgtacagttcctccaaggcagtaaggtttcttatgctttcaggcaaagatgtgatgttgggacagtctctgatg

SEQ ID NO: 67536 - DNA, 330 bp, Triticum aestivum
  Clone ID: PAT_TA_67536
acgaggctttctatggagacaaccatagggcgatgttcaagtacgctacggaagctgatccctcgcgattgattcactacgagggagacgagcaggccgagactacacacatgtacagttatgtgtaccccacagtcgaacgcctcatcaagtacgccaaggatgaaggtgtcaaggatggcaagttcgagaagcccatcgtgctctgcgagtacggtcacgctatgggtaacggtcccggctggctcgaggactacgagcaagccttccgtgactacccccgtctccaaggtggctttatctgggagtgggccaaccacggtttgtgga

SEQ ID NO: 67537 - DNA, 460 bp, Triticum aestivum
  Clone ID: PAT_TA_67537
agctcaacgagttcggcgaggcactcaccaagatcatcggcctcatatgcatcctcgtgtggctcatcaatgtcaagtacttcttgatcttagagctcgacggatgggtgcccaggaacatacgcttttcgtttgagaagtgcacatactactttgagatcgccgtggcgcttgctgtcgccgccatacccgaaggattgcctgccatgatcaccacctgcctcgccctcggaaccaggaagatggccgccaagaatgcgctcgtgagaaagcttcccagtgtggagactccgggctgcaccaccgtgatctgctctgacaagactgggacactgaccaccaaccagatgtcagtctcaaagctcgctgcgatcggtgatgccccagggaaagttaggagcttcaaggtggacgacacgtcgcatgatccccgtgattgcaaaatttactactggcctgc

SEQ ID NO: 67538 - DNA, 599 bp, Triticum aestivum
  Clone ID: PAT_TA_67538
tagctggtagtttatttactcgtgtgtttacagttcgcggtgtcattctttgaccgaaatggttgttttgtgctgatgtgatgtagatatggatatctgctggtatttcgttaggtcttttaaccattctagatttgtaatttagtggtttccatactgttttgttgaacaccaggagctttagtactgttgtatggagttgctacatatacgtataggtagctgtagagcattgctgaagcctctatgtctgctgttttcgtaaatgcaataaattcgactgaatgttcaactgctaacttgcaatttattccttctcaagcttaaaaatgtgacaaactactaatgcctggccaaaaaaaaatcaatttaattattcaagtataggtgttcactaaacagtagaaactaaatgaactttggaagtactgtattactttttatagtgtcatgttgctaacttgctctttagagttcccctttgtgcggataatttgcactttggaacttgcatcactgtgattttgcgatagctagtctgttacttttgtgatcaaatatacctttttagaaagtgtaattttcttaatgtgctatct

SEQ ID NO: 67539 - DNA, 379 bp, Triticum aestivum
  Clone ID: PAT_TA_67539
cggcaaaatatctcacgagccttggtcgcctccagtttcccttccctgtctccaatctctcttgacctaccgccgtcgcctcttggttattgatgttgccgctccgatgaagatcaccgtgccgctgttgcttagatccctggagagaaggggaacagtagctgcgccaggcggcatgcctcgtccgagccgcgtggtggccgacacatcggcggtttcatagccggtcctgggcggtgcctcgtcagcgtcgtggatggcttgggcagcgccttggcatccaagaggggcgaagtgagctgaccagcatgcgtggggtgcaaaggccacgagcaggaaggagatgcgttggaggtgatggaggaggaagttggaggcg

SEQ ID NO: 67540 - DNA, 190 bp, Triticum aestivum
  Clone ID: PAT_TA_67540
tccaattatccccccagataatggacgtgcacatcagcacaacactggagctcaacctggagtcacctgcactggtactccaagttcagaggagcaccactgagaacgtgaacatgcgtttttcaaactgagctgctgttcgctgcttccttattgggagatcatttgcttatcctccatgaacactttg

SEQ ID NO: 67541 - DNA, 611 bp, Triticum aestivum
  Clone ID: PAT_TA_67541
acgatgtggtatctatggaggcaatagccctgagtgggttgtcagtatgcaggcctgcaatgcccatggcatttactgtgttccattgtatgacacacttggtgctggggcaatagaatttatattgtgccatgcagaggtcgaaattgcttttgtggaggagaagaagattggagaggtactcaagacattaccaaacgcgaccaaatttttgaagaccatcgtgagctttggtaaggtcagccctgatgagaaggaaaaggttgagcagaacggattgtctatctactcatggtccgagtttgtgcttaagggagatggggctgaagagaagtatgaactccctccaaaggataaggctgacatatgcacgataatgtataccagtggaacaactggtgatccaaagggagttttaatctctaataagagtattatcaccattgtttcagcagtggatgagttccttcacaattcaaatgaacagattcctgaggatgatgtttgcatttcttatcttccgcttgcccacatatttgaccgtgtgattgaggaagtgttcattcaccacggggcctcaattggattttggcgtggagatgtcaaactct

SEQ ID NO: 67542 - DNA, 516 bp, Triticum aestivum
  Clone ID: PAT_TA_67542
ttgcacatgactggcatggcggtggcgcggctcgccgtggccctcctactgctggcgacgggctgtgcggggcgcgacttcgccgtcggcggccgcgccggatggacggcgaaccctgccgagccgttcaaccactgggccgagcgcaatcgcttccaggtcaacgaccgtctcgtgtctaggtacaaagggcaagaagactctgtgctggtggtgagcccgagccactacgacgcatgcaacaccagcgaccccttcatgcgcctcggcggcggcgaatccggcttcgtcctctcctactccggcccctacttcttcattagcggcgacgccggacgctgtcaggccggcgagcgcctcatcgtcgtcgtcctcgccgtgcgtaccccttcgcctgctccttcaacaccgtcgccaccacccctgtcacccccctcgtcgccgcctcccgctccggcagctgcggggaattcttctacgtcgccaccaccggcgctagcgccgccggctgcggga

SEQ ID NO: 67543 - DNA, 606 bp, Triticum aestivum
  Clone ID: PAT_TA_67543
catcaacgccaaccacgtcggcatcgacatcaacgggctgcagtccctacggtcatacaacgccggctactacgatgacgagagcggcgacttccgaggcatgaagctcatcagccgcgaggccatgcaagtgtggattgattaccacggggagaggaaggagatcaacgtgacactggctcccttcgacatgggcaagcctgctaggccactcctctcggccagctacgacctctccacggtgctcactgagctggtgtatctcgggttctcagcggcgaccggtcgtgtcaactcgcggcatttcgttctcggttggagcttgggcgtgagcagacaagctccggccatcgacatggccaagctgcccaagttgcctcgggttggccccaagcctcggtccaaggtcctggacatcgttctaccaatagttacggccacatttgtacttggtttgggtggtatccttgtcctggtcatgcggaggagatcaaggtacgctgaactgcgggaagattgggaggttgagttcggaccacaccgcttcttgtacaaggatttattccgtgcaactgacggattcaaggacaagcatctacttggcgc

SEQ ID NO: 67544 - DNA, 565 bp, Triticum aestivum
  Clone ID: PAT_TA_67544
gtaacgagtgtggcaagaagttctcccgagcgataacttggcccagcatgcccgaaccccggcagcggtgccatcgtcatgaacttgatcgatgatgactcgcatgcctacgatgcctctatggtatctgccgacgactatagtaattacggcaaggtcctcttccatatcgcctccgaggttcctggcagtgccagcgagctttcttcggacgagggaagcaaccaggacaagaagaagcgcaagcgctccgactaaatggtttcaacactattcaatatctaacatgatcaagagagccagtcgactgtcttgacatatgccgaaacgacgctgacgaccttcttcttcttcggccatccgcattcacttgacggtggcatttgggtcacggaacatttttccatttgggttgcaacaacaacaaccttgggttaaagggaaccataaaagagtgcaagcgataatgatagcatttacaagtcgtcactataacctgtatcaacaatatccacagcttcctctacgcatgacgacaacagggaggacatttgatttttatcga

SEQ ID NO: 67545 - DNA, 537 bp, Triticum aestivum
  Clone ID: PAT_TA_67545
gcagacaagaagccggcggccgagagcaaggtggagaatgcggccgagaagacccccgcgggcaagaagcccaaggccgagaagcggctgccggcgggcaatacggcgtccaatgaggccggcggcgagggcaagacccggggccgcaagaagggcagcaaggcgaagaagggcgtggagacgtacaagatctacatcttcaaggtgctgaagcaggtgcaccccgacatcggcatctcctccaaggccatgtccatcatgaactccttcatcaacgacatcttcgagaagctcgccggggagtcggccaagctcgcccgctacaacaagaagcccaccatcacgtcccgggagatccagacctccgtccgcctcgtcctccccggggagctcgccaagcacgccgtctccgagggcaccaaggccgtcaccaagttcacctcctcctagactgacgacgcgccgcttgttgtgacagatgtggccgtctgctgtatctgtagtcgctgttgactctgcttatctccatctgcaagt

SEQ ID NO: 67546 - DNA, 474 bp, Triticum aestivum
  Clone ID: PAT_TA_67546
cacagtagcactagcttgagctagccaccttctgccactccgggcattttcttgcatccacgaaggcaatggccactgctgatgtccagaacccggcggtcgcgctgacggaggaggcgcccgcggtggagacacccctggtcgccgaggaggtcgcgaagacggaggaggcccccacgccggcggtggccgaagtcgaagcgcctgctgcccccgtcgaggttgaggagactaaggaggaggcgccggccgccgctgagacggaggagaccaaggagcccgagcccgcagctgcggccgagccggaggccgaggcgccagccgtggtcgagacagagaccaaggaggccgtggctgaggcagagccggcggtggtcgaggaggtgaaggaggaggcggcgcctgctgccgagccggaggttgcggccgtcgccgaggaagcaccggctgctgcggaggaggcacccgcggccg

SEQ ID NO: 67547 - DNA, 484 bp, Triticum aestivum
  Clone ID: PAT_TA_67547
ttttttttttttttttttctatcaagttgcaacaacagatccatttccatcatcacagtacaaagacctaaaagacatccaccaaattattacgtatactttctaacgtatctccgcccaactggtaatcaattctacctgtctagtctctccaagcttttttttacaggagcaaaaccaatgctcaaaacccgcaaccgtatgcaatcgattctatcatatctatccaagttactttacacgagcaaaaggatgctcaaaacccatggggggtttgtgttgttgtgtgctgtacatccatcacaaaacaaaacaaaattgctcaggcgtgagtttgacaggccaactttcgagacctggaagagcaacaagggtgccaactcttgaaacctggaagagcaaatatacttcttgaagggtgccaactcttgaaacctgttaagtgtctcaagggaatgaaaaataaatcccagcacgggaaagc

SEQ ID NO: 67548 - DNA, 613 bp, Triticum aestivum
  unsure (1)..(613): unsure at all n locations
  Clone ID: PAT_TA_67548
ttggtgcatccctcatcttggagacaccaagggtcgtacacctattgatcttctctctggccctgtatcacaggctaatggggattctcccaattcagttgcaacggaagtcttcagttggggaagtggaacaaactatcaactgggaactggcaatgcccacatacaaaaactaccttgcaaagtagatgccttgcatgggtcatacatcaaaactgttgctgcatcaaagttccatagtgtagcagtcagttctgatggtgaattatacacttggggatttggtcgaggtggtcgtctcggacatccggatattcagagtggccagacgacagctgtgattacccctcgcctagtgacagtcggattaggccgtaaaaaggtgaatgttgtggctgctgcgaaacatcacacagtgattgctacatcagctggggaattgtttacctgnggatcaaacagagagggtcagcttggttacccttctgtcgatacccaaccaacaccaaggcgtgttagttcactcaagcaaaggataattgcagtagccgctgcaaacaagcactcagcagcagttgccgatactggcgaagtgttcacatggggttccaat

SEQ ID NO: 67549 - DNA, 483 bp, Triticum aestivum
  Clone ID: PAT_TA_67549
ccaaattggtaggactagggttcctaccggctctactccttaggttataagggcagaacagcggagattgagggcgaggacgcgagctccggcgcgttggcgccgtcgcgaggaaggaggatggcggcggcggctagggctccggctcctctgggagccgggcaatagagataatattcttcttattgcttgattccaaaaagagtcttacagcctatatttataacctagataacttgcatgagaattaacctaagataacttgcataagaattaatctaagataacttgtgggctaagattgcccggtgggcctagctaaaccggccataacactaagttttttattaagctaacactgtcgtaatttttgcatttacttgactggtgtgcaagtcagttatccgtgcacatataacgtcttgggataaaaaatacttgtgtcttaagaacatcgtgagtaataagcaaagtttgaatgtc

SEQ ID NO: 67550 - DNA, 368 bp, Triticum aestivum
  Clone ID: PAT_TA_67550
cttgggggagggcagaagtggcggtgaacggctgtccaagtactcgacgcagggcctggacgagttcaagaacgaggtggtgctcatcgccaagctccagcacgtgaacctcgtcaggctcttgggctgctgcgtccatggagaggagaggatcctggtgtacgattactatggagaacaagagcctggacatgctcctcttcgataaggctcgatcggcgcaactggactggccgaagcggtttgacatcgtactgggcgtcgcacgggggctcctgtacctgcaccaggactcgaggttcaaggtcatccaccgggacctcaaggccggcaacatcctcctcgacggcgacatgaaccccaagatc

SEQ ID NO: 67551 - DNA, 190 bp, Triticum aestivum
  unsure (1)..(190): unsure at all n locations
  Clone ID: PAT_TA_67551
caaacttgctaaatggaatgaatgattcttttgggtctccgcatggttgtttggaccagtggaagttggtcagtaagtgattcttagttagctcatgtgaatatgtgattgttctatgatgtatgtaacattcacgttggtgaggagcaattcagattactagatnaaaaaaattaaaaaaaaaaaaaaa

SEQ ID NO: 67552 - DNA, 613 bp, Triticum aestivum
  unsure (1)..(613): unsure at all n locations
  Clone ID: PAT_TA_67552
tagtcgatgaacatgacaatgtcattggccacgagtctaagtataactgtacgtgttaatcatttccttcatgtctttgtgattgtgttccgtaatacctcattttatcatccatgctgtctgcaatattatcttcatattcggttagatagctattgtgtgtttgacaacatccattgagctgctaaaaatttcttggggttgccatcaacaatgaatcttttgttagttggatgggtactcgagtttggcttaactttttctatgacctctggcccatggaagggggtttgtgccaaggtactanggaattgcattggatcatactattccaatttccaagcagtctccaacatttttttttaatcctgaccaatagggtaatgaagatggcttcaagtactatttttactagtaggttgtatgtgctttgcacgtgaattgtgtgagagggagaaattctgtacaaaatatatatagactttaaaaatagctggtcacaagtctttcaccttgaacgaaaattcacaaggtaatcataaatgaaaacttttttgttcaagagatataaaaattggagcaagaaaatgtatggaagagtctagaatagaat

SEQ ID NO: 67553 - DNA, 553 bp, Triticum aestivum
  Clone ID: PAT_TA_67553
tacgaggttgcgaaactgaagccctgtcgccaaacgagatgatctcgatggtgaggaaagattttatttaaagaaagtttcacacgaaaaagtcaaactatgtcccgattggaaggcgaggagtatttgggggtgtaattctgaacatgcatttgcactggaagaaacatgatactgtcaaggtcatctgtaagccgtgggggccagggcaaatccaggagtatgcaaatgagatagctcgggtgagtggtggtgtccctattaatgttattggaaatgacaccatagtcttctaccgaggaaaggactatgttcagccagaagtcatgtcaccaattgatacactgtcaaagaaaaaggcacttgaaaaatcaaaatatgaacaatcactggagacagttcggcgtttcatcgcaatctctgaaaaggagctcgaactatactatcggcatgttgcactctatggaaaaccacaaccccagaatgctgatctggtccatggtggtggtagcccggcttcttcaccggaaatggaggaattgaatcatggaaa

SEQ ID NO: 67554 - DNA, 343 bp, Triticum aestivum
  Clone ID: PAT_TA_67554
cgcccgcccaacgccgacacggcaccacaacaccccgtcacagcggcgcgcctccgcctccgagccaccccccgcgcggcggccacccgcagccaccccgtcctcatcctcgttgcgcggccgagggagagatgcggcggtcgtcgagcggggcgcgcgtgtcggagggcggcgacgcgttctcgtcgggccaccgcggcgacggcacggcgctcccgacgttcgacccgcagtcggcggcgggccggcgggaggcggcgcggacccgggcgctggggcgcgccgtgcactgcatcccgctgttgctgctgctctgcgccctcgtgctctggctctccgccgc

SEQ ID NO: 67555 - DNA, 527 bp, Triticum aestivum
  Clone ID: PAT_TA_67555
tatggctgtgcgtctgtttagtcgctgcaatccgcgagtagatcgagttgtaggctccttttcgcggtgattcgtgctgttctcgtccgtagttcgaaggattcgagcatgcttctgtttcatctccgtgctctgctgtttcagccatgggtaaggagaagactcacatcaacatcgtggtcattggccatgtcgactccggcaagtcgaccaccactggccatctgatctacaagcttggaggtattgacaagcgtgtgatcgagaggttcgagaaggaagccgctgagatgaacaagcggtcgttcaagtacgcctgggtgcttgacaagctgaaggccgagcgtgagaggggtatcaccattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaagctggtatc

SEQ ID NO: 67556 - DNA, 332 bp, Triticum aestivum
  Clone ID: PAT_TA_67556
aggaataatgcggtgacccgctccgtcaaagccgggcttcacttccccgtcggccgcatcgggcgctacctcaagaatggcctctacgcccatcgcgtcggctccggcgcccccgtctacctcgccgccgtcctcgagtacctcaccgttgaggtgttggagcttgcgggcaacgcggccaaggacaacaagaagacccacatcatcccgctccacctgctgctcgccgtcctcaacgatcaggagcttggcaagctgctcgccggcgtcaccatcgcccacggcggcgtgatccccaacatcaactccgtgctgctccccaagaagtcccc

SEQ ID NO: 67557 - DNA, 267 bp, Triticum aestivum
  Clone ID: PAT_TA_67557
gttttgggcattccatgcctctgctccttttgcctgggcatagcaacgtccatcctatcaaacttattctccctccttccttccgtgtttctctctctctcttcctctcttctcacgcttctctctcccccattcttttgcgcaatgcagggattgcggcaagcaggtttatctgggaggattcgacactgcgggggcggcggctcgggcgtacgatcgggcggcgatcaagttccgcggcgtggaggccgacatcaacttcagcct

SEQ ID NO: 67558 - DNA, 290 bp, Triticum aestivum
  Clone ID: PAT_TA_67558
ttctccctctccctctccttccaacctccacagggtaaatccgcaggcgagcaaaaagaagctcgctccgtctaaaaggtgcagcgacagccgagaggccggagaggaaggcgaggagcgcggtgagcagcaggaggcggcggcggcgcgcgcagagatagcggaaaaggatcgtgctttagggcgtgaaggatggcctcgtgggcggcgtcttcgttgccggcgccgggaggatcggtgatcaccttggccgcctcatcggcggggggcaacggcgccggcggggtgtg

SEQ ID NO: 67559 - DNA, 488 bp, Triticum aestivum
  unsure (1)..(488): unsure at all n locations
  Clone ID: PAT_TA_67559
tgtgcatcagctgaccctagcgacactgagactgcggcttctcatgatgacgatatatctgatctatctggaatgagagacagactgaagggcgtgcttacacattatgaaggtatattaaaatgtgcaacaacctgggtttacccacccttcttggaagaaggcctccataccattgaagtcgggttgtgtgaagtactacgtgactgaagtaaagcctggattcaatgaatttgccctgaagaatgtcctangggactttgatgagcataggatcttgggagaaacactgttacatcacatccagtgcccacgaaaggaaatagacttcatggatgagatccctgaagccccgccaagagcaactaatgtcgcccctcaaccggtgacactctccttgccacaacagctctcgcatgcttcccccaaggaacctaatactcgtaatccgacggctgatgcatcaacctgtgatcaacccacccgac

SEQ ID NO: 67560 - DNA, 312 bp, Triticum aestivum
  Clone ID: PAT_TA_67560
agtctgtttttttttttttttttttttcaagcacgaatcctttattattgcatgtagagagcctcttaatttacttatgttgtaatgcatagactcatagcaatcgcaccgatcgagcatgcacgagatgacatatgcctaatttttttttcgcgaaaggacatatgcctaaatttgtatatcggtgcagttcttgtagggggggggtacggtcacgtagcagcggcctctgtcataaccctctttctgggggaccacattgcaggtgccgtgctttacacacatgttgccatcccaggtttggctaccatg

SEQ ID NO: 67561 - DNA, 508 bp, Triticum aestivum
  Clone ID: PAT_TA_67561
atggtttgccagtttgtctgagccctgttgaccgcgagagcaggggaagcggcatcagtatgtatgtctggaaggagttcaagaagggagggggttgttacatgcaatgaaagggtttgttccgacaacctgacgggagataggttgacattcaaggcaaacaaacatacatacactgtgaagtgtcacaaggggcgcaagcagagtgcattgtatgggagagggtggagaaagtttgttgcacacaacaagctggggaagggtcagatggttttgttctacttggaccaacattcaccaagggcggttgtttgcgtggtctagtttggaaacactgaagatgttagggggaggatcaagttgttttctgaaaccctaactttatagttgactatcttcctctcgcttagcatcagatccccatttctccatgcacattacctttttaaaatgttattttgtagccattattttttagtaaagcatagtttccattttgtcgattttt

SEQ ID NO: 67562 - DNA, 513 bp, Triticum aestivum
  Clone ID: PAT_TA_67562
aggcgctgacggcgcacgtgaacgccggccgccacggcgacgcgctcgcctggtttgcccacatggcctccgacccggcgctcccgccgctcgccgacccgtcctgcacgtacgccctcccgctcgcgctcgagtccgccgccgcgctccgcctgccctcgtccgccgccgccgcccccatacacgcgctcgcgcgcaagtgccgtggcctcctcagcaaccccttcgtcgcctccgcactcgtcgtctcctatggtgcatgtgccggctcctcccccgagtccgcgcgccgcctgttcgacaaattgcctggccgcaccgccgtcgtctggagcgccatgatctccgtctacgtcaggtcaggggacgtcgcctcggccgcgcgggctctctgcgagatggacgtcgtgccgactgcctcctgcttcgtctcggtgattgcggcggtggcggagtctggggaccgtcccgcccgggccgtctatctctaccggcggatgcatgggatgggcg

SEQ ID NO: 67563 - DNA, 562 bp, Triticum aestivum
  Clone ID: PAT_TA_67563
gaggctccctcgatcccctccatcctcatgccgccgcctcgcatcgccagggagaggagctcccctgcgctcgttccccatctcccatcgcccctctccctcatcccctcctatgcgcggcctcccagccccacacgcagcgctgcgctcgccttgccttggcgtccgtgcctcctgccctttggtcgcctctccatggcgcggcgcccgaccccgtgaccttgccgccgtccctgccggagttcctcgtctccaccacctgatccgaccggcctccgccgtcctcgcccgttcccggccggatcccgccagcagggtcccgttcccgtctccggcacctcaagacccacgcccgagccctctgctcgagcaggagctccgcctccttgcttcgcgccaaggccgacgccagccacttcgccttcgcctcctgctaccggcgcaccatcgtacctccgctgaccggcgaccctctgcatccaccggcacgcctgcatgcctcgctgctggtctcgtgcagagcccctcctcctcacggccatggcgcccatcggtgcccgca

SEQ ID NO: 67564 - DNA, 560 bp, Triticum aestivum
  Clone ID: PAT_TA_67564
gaatccgcacgaggataagatctaatggtccttaatctttcgatgtttgacgcaacaaaccacgcatccagtgtttaacacttcaagccatccatcgataaaactgccccgctgttcagaaaaaacaaacaacgcacgcctccacgtcctctggcacgacctcgacctctcgcccctgctcctcctcccccgccgttcgccctctgcccgttcctcgccgcacctcccgagcctcccgccgctcctccattcctccggagccgcctgccacgcccttcgccgcgggatccccttcgtcgcgagagccgccgtcgagcccgtccatcgcgcccgagccgccccggagccgcccttcgccgtggcccgcaggtcgccgagccgcccttcgacgcggcccgcaggttccccagccgccgccctggagccacccttcgccgcaagtcgccgccgccggagccgcccttcgccacatgtctcctcccttctagccgccctgccctcaccgctcttgtcttcaagcccaagatcaagttattattgaggacaaatgaaggggtgca

SEQ ID NO: 67565 - DNA, 567 bp, Triticum aestivum
  Clone ID: PAT_TA_67565
gaatcggccgagggtgacttgtgcggcgacggtgacctctgttcccctcctccctctactccccttctggtcgcccgacgagctgcccctccatccctcgcagttcgccggctcatgcgtgcagtccactgtgggcaacagctgaccaccatcaccgatgatggagtccacacgcatgccgtacacttgtcatggtcaaagtgtgcggcttgcagtttggcacaagagggtatgcagtgcagttcagttcttcgctgggccgatgtacctctcactccatcctatgcgttcatctctactccttgcatgcagtgcaattttttgttcatttgcagcttcagttagtttcagtgagctcttgtgcgatttgaatctcctgcagggaaagagcagtagcaagcatgtggtaatgtggttcaatctgccatgtatatatgacttgattgcaatttactttttggccagattcgctataacgcgctggctggccaccttccgtagcctcgtcgcgtcctgcaccgaccggaggagccgcgtcctgcaaccgtgctcccatcttcctcccct

SEQ ID NO: 67566 - DNA, 519 bp, Triticum aestivum
  Clone ID: PAT_TA_67566
gaatcggcacgaggctcctccatacgcattccctcctctgcttcttctttctcaaatcacttcatccatggcatctcatgctccacgcagagacggcgtgtacagccgtcgattttttgttgccatgctcggcccaacctctcccatgtcgcagtgtaggccatgttcgccaccaccgtggttccggcatgattttttgctgcataatttttgctggaaccgcaatttgtttctgctggaagcatctttcgtttttgcagcatattgagaggatgctggtgccttcgttgtatgattttttgctacatccatttttcttgcttgaaccgctccattttttcctggaagcagagctcggctttgctacaatgctagtacggtggctgccaagcattttgctgcatcgatttttttggctggaactagcaattagttttgctacatccagccgaaaagcagagctggaactggtgagatttttgtctaagaccattggcggcagcgttttgctggaactgt

SEQ ID NO: 67567 - DNA, 450 bp, Triticum aestivum
  unsure (1)..(450): unsure at all n locations
  Clone ID: PAT_TA_67567
cggcacgaggatccagtttacgcatccatttggccaagctagttggttgcacgtgaatgaaaataggccacgattgcagcgagagatgcgttgctgattagtagtatgcgtttgtcatgagcgtctcccttctatttttttctttcattgggacatgagcgtctcccttttataggtatttgactgttagacaatntatatacatgtccatgcatgggtctgttgaatnttttcctagagttcaaagtgatcccttggtatgcgtttgtatttctatgaaatatgatcctgctgtnttttaggaaaaatattatggtgtcataagtctagatgcttttgctggtatccaggtctttgttggcacggctgcacctctttggttacctggcatggcaatgcaacataagtctacatggtatggttgtacataacatgatgatagaacataaa

SEQ ID NO: 67568 - DNA, 591 bp, Triticum aestivum
  Clone ID: PAT_TA_67568
gagggcagaagtcaggcatcttttcagttcctgaaagctgtgctccattgtggagtccattcgaacttcttatctttcttgaggagttcggttagaggtttggcaactttggagaagttctcgacaaagcgacgacaatagctcgctaagcccagaaaactccgaacttgcttgaccgattcaggtggagtccaatcaaggacggcttgaactcgctcagggttaacagcaatacctttaccagatattacatgacccagataggtcacttctgacaaccagaattcacattttgaaaatttggcataaaggcgatgctctcgaagtttcttcaacactagccttaaatgttcggcatgttcttcctcgttcttggagtagatgagtatgtcatcgagataaaccacgacgaatttatccaaatactccatgaagattgagttcattaaccgagaaaaggtggctggagcgttggttagaccgaaggacatgacggtgtactcgtattggccataacgagtaacaaaggccgttttaggaatgtccctgtttctgattttgatttgatggtagcccaacctcaaatccatc

SEQ ID NO: 67569 - DNA, 202 bp, Triticum aestivum
  Clone ID: PAT_TA_67569
atagatgcagttcatgatccatacctcttcttgttgaggaggaactaatagttggatgccagcaacaaactgcgccaccattactccctccagccatctgcgccggtgccgcttgtcctcaaatacaagcaaagaagcgcgcgccggttcatcggagacagagaagggatgttccggtgcagtacatgaagtgtctgttccg

SEQ ID NO: 67570 - DNA, 619 bp, Triticum aestivum
  Clone ID: PAT_TA_67570
cagcctcctcagtcctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagctccggcgggttcgagacggccggggagaccggcggctgcgactgcaccacctgcaagtgcggcaccgcgtgcggctgctcctgctgcagctgcaactgagccggcgcccaggaggccggccggcagaggcgagcacgaggatgaggaggacaagcaagcaagcaccatcaccaccagttcaccaccacccagcgtatcatcaccagccgccgcatgcgctcgcgggcgcgcgcgctgaataaaataaaaccaccgttcgtgttccgtagttctgtatgcccctgtcgcgtgtgttcgaccagtactgtccttcctcgtgcctccacttctaatgaatatatggcgcctcaactttgaatgatcttaaaaaaaaaaaaaaaaaaactcgagggggggccc

SEQ ID NO: 67571 - DNA, 596 bp, Triticum aestivum
  Clone ID: PAT_TA_67571
gggcctcctcagtcctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagctccggcgggttcgagacggccggggagaccggcggctgcgactgcaccacctgcaagtgcggcaccgcgtgcggctgctcctgctgcagctgcaactgagccggcgcccaggaggccggccggcagaggcgagcacgaggatgaggaggacaagcaagcaagcaccatcaccaccagttcaccaccacccagcgtatcatcaccagccgccgcatgcgctcgcgggcgcgcgcgctgaataaaataaaaccaccgttcgtgttccgtagttctgtatgcccctgtcgcgtgtgttcgaccagtactgtccttcctcgtgcctccacttctaatgaatatatggcgcctcaactttgaaaaaaaaaaaaaaaaaaaa

SEQ ID NO: 67572 - DNA, 598 bp, Triticum aestivum
  Clone ID: PAT_TA_67572
cttccctacctcgggctcaaatcacccacgctgcctcagactcgagctcgagcccgtcggagaagctcctcctcgcccaccgtcgctccgatcgatccatcgtcatgtctcccgtggtcgtcgacccatccagggcctcggcgtgcggtctttgatccgagcgacgccggcacatacgatcgacggcgcgcctccccttcaccgcaagcggcatgaggcgttgaccggtcggagcggccgggggcgctgtgctggctcgatgtcgcggcgccacggacggttcaaccacgacggcgaccaaggcgctcggccggccgcggcgccggcggtggtcgaccacgcggactgcacggcgcagtcgtgccggtcgtgcgtggcggtgtcgctggcggactgcatcgcgctgggctgctgcccgtgcgcggtggtgagcctgctggggctggcgctcgtcaaggccccgctcgccgtaggccgccgctgcgtgcagcggctgcgccggcggcatgggaagctgcagcacaagaagcgcgtgcgcgacatggacctcgcgggcggccgccctggccctagcgccgctggcgccaagtgtgcgggc

SEQ ID NO: 67573 - DNA, 257 bp, Triticum aestivum
  Clone ID: PAT_TA_67573
cgagggcctgttcttcttcctgttgttgtctcaccgcagcaaggagcagtcagcatcgagagagcaacaatggcgatggcgtcgtcgagcgggctgaggagctgcagcgccgtgggcgtaccgagcctgcttgcgccttcatcccggtccggccgctccgggctgccgttctgcgcctacgccaccacctccggccgcgtcaccatgtccgccgagtggttccccggccagccccgccccgcccacctcgacggctc

SEQ ID NO: 67574 - DNA, 255 bp, Triticum aestivum
  Clone ID: PAT_TA_67574
ctcaacatgacggccgccgccctactgaccttcctgagtccacaggtgctgcgtgggatacgcgtggcgcctcgctctacagctggctttaccaggcacagaggcacctttgcacgaaggacagggaaggccatcgagcctcaacttctgaaggcagacccgactctgaaccttaatacctcgcatcctctgatcaccgacagcgccattcgtcctgagacatctacagccacaacgacagcgacagcgcaagag

SEQ ID NO: 67575 - DNA, 519 bp, Triticum aestivum
  Clone ID: PAT_TA_67575
ccttccaggggctcaagtccacagccggtctccccgttagccgccgctccagcgccagcctcggcagcgtaagcaatggcggaaggatcaggtgcatgcaggtgtggccaatagatggcatcaagaagttcgagaccttgtcttacttgccacccctctccacggaagccctcctgaagcaggtcgactacctgatccgctccaagtgggtgccctgcctcgatttcagcaaggttggctacgtcttccgtgatcacaacagctcccccgggtactacgacggtcgatactggacaatgtggatgctgcccatgtgtgggtgcaccgacgccacactggtgctcaacgaggtggaggaggtcaagaatgagtaccctgacgcctatgtccgtgtcatcggcttcgacaacctgcgccaggtgcagtgcgtcagcttcatcgccttcaggccaccgggttgcgacgagtccggcaaggcctaaactacgagttgaaacaatggcctatctcgtatgaagg

SEQ ID NO: 67576 - DNA, 246 bp, Triticum aestivum
  Clone ID: PAT_TA_67576
cgctgccgcatcccctcctacctcgccaccgccgctgccctcctccttgccttcctcctcccgccgctggccgcttcccagtggcagaactgcggcaagaacggcaacttcaaccagaacagcacctaccaggctaacatccaggccctctccgttacccttcccaagaacgcctcctcctcgcggacgctattcgcggccgacagcgtgggcaccgttccggacatcgtctacgcactcgcgctc

SEQ ID NO: 67577 - DNA, 384 bp, Triticum aestivum
  Clone ID: PAT_TA_67577
aataggttagggctcaaatatgtttttgcaaaacaccacctgattcacaaagtggagtgaatggtttgctattctccccatctccctctctctggtctccggtctctatcagttgcatttggtggcattaattctcgcgatagcctctagaactgcactgcatgaccgcccaatagcaactttcagaccacaaaatcatggaatcaaaacacaactttcaatcatagttacgttcacatggaagaaattaagcaacatacgtgtggaataagagtaccggtcagaagccgggtgggaaacacgcgtaggagagcatccagcagagttgatcacgcgtgaggaacgagggctagtattcatgtattggaagcaaccttgactttt

SEQ ID NO: 67578 - DNA, 216 bp, Triticum aestivum
  Clone ID: PAT_TA_67578
ccggaaaaccgattcatctcatgtcaaaactgcaacatcaggccttgcatagacgacaagtaactactgtactaactatcagcaagccgaggactacgttacactaaaataggaggccttcaatcttgacccgacactaccaaaactcaacaacaatgctacatgggtaaaagacgagagaaaaaaaaaagagaggccgccattgcgaccaaacac

SEQ ID NO: 67579 - DNA, 310 bp, Triticum aestivum
  Clone ID: PAT_TA_67579
tttcttatgactctgaacgttccccaagggtgtggcgaagaaacggcacttctcaaagttggctgtgtctacaaagatccgctgatgaaggagaccatcaacatggctgaggtgcaggtgaagatctccaggccggcattcgtgtcggtgcaaaccgtgtcgatccaggtggaccggcagaagaaccgtcttcatgcagccgaggtgatggccgcagcaaggttctccgcggagcgtggcgagctggcacacgctgtctcactgctcgaggactgccggagaatgatcatgggatcagcgtcggggcagt

SEQ ID NO: 67580 - DNA, 383 bp, Triticum aestivum
  Clone ID: PAT_TA_67580
gaatcaggcccttctccagatgcaagacattcattcttccgtgagcgccctgcagtactacagtggtgtccaacctagcataaggggaaggcatgtttacatgcaattttcatcccatcaagaacttaccaccgaccagagctctcatagccggaattctgatcaggaatcagaacccaaccgaatccttctagctactgtccaccacgtgctctatcctataacggtggagattctgcatcaagttttcaaagcatatggatatgtggagaagattgtcaaatttcagaagtcagctggctttcaggccctcatccagtatcaatcgcgtcatgaggctgtggaagcacttgctgctttgcatggaaggaacatatatgatg

SEQ ID NO: 67581 - DNA, 281 bp, Triticum aestivum
  Clone ID: PAT_TA_67581
ctgagtatatggaacatcccaccataacttttgtctgagaagaaacatcccgtcagaatgatttgagccaacctaatggaatcctgtggtggtcctgacagaagcaatctgggctggaatgggcctatggagaggacacagcaggcttgttgcccagcacaagctttattcattcacccagtacatcgaaacagcgaccagtttggtatccgttccctcctcgtactgctactgtaggagcatagtccgcaggccagtgtacgtacatgttcttcaaatcc

SEQ ID NO: 67582 - DNA, 373 bp, Triticum aestivum
  Clone ID: PAT_TA_67582
acactctgctctcaccgttccagcaaacacacgcacaaacttgagtcggcggcagaaccagtcatgaacggcttctactcgtccatcgcccacggcctcgacgcgctccacgccacactggcctcgtcgccagacgccgccttcatgtcggcgcccttcctgcagcaggccgcggcgctgctccggtcgctgcactcccagctcgtccacctcgtgcagcgcctccacctgccgccaggggagagctggctcgacgagtacatggacgagacctcccgcctctgggaggcctgccaggtcgtcaaggccggcgcctccgccctcgacacctactgcgcctccgcggcacgcatcgacgccgcgctggacgact

SEQ ID NO: 67583 - DNA, 362 bp, Triticum aestivum
  Clone ID: PAT_TA_67583
tgatctttcttccttccgctttcttttcgtgtgtagggtgcctgtggctgctttgtcgtgcgtccgtgcggctgtttgttccttcttttcagagaaatcgcactaatcggttcgtcgtcagatttgccttgctgtttcatttactcaaaggatcatctttctcttcagtattttcaggttaactatactgaagagaacctgctcgactacattgatccaaacaatgatacactcatggtgagacttgccgatgaccatttggtcgccaagtgtcgcatcatggtagcaactgacaagagggccactataaccaccaactggtctgagtttcgtcgtcgcgccaacattcgtgaaggagatgt

SEQ ID NO: 67584 - DNA, 400 bp, Triticum aestivum
  Clone ID: PAT_TA_67584
gagagatcttgttggcattaccggaacaagggatcaagagataatagagctgctgtcggagggggacgacatgtccaagaaaaagttgaagatcatctctgttgttggatttggaggattgggcaagacaactcttgtcaaaacagtttatgacaagatcaagggagatttcaactgcagggcttttgttcctgtcggtcgaaatgctaatgcgaaggaggttttcatggacatcctgcacgagcttgatcctgaaaaggacaaaggtcagctcaccatgttgaatgaaagacaactcattgacaaaatccaactgcgtctcgagaacaagaggtacgtacatatctcacatgccactcacttaatgatggtaaccagctaattcctttgagatggtagc

SEQ ID NO: 67585 - DNA, 503 bp, Triticum aestivum
  unsure (1)..(503): unsure at all n locations
  Clone ID: PAT_TA_67585
ggtccctgactttcaaagaggtgcacctccaaatactcctaaggagaagttcaacaagattcactcctccaaacgcaattgcatagagagaacctttggagtgtggaaaatgaaatggcaaattctcctcaagatgccaaactactcattccaaacacagatgaagatagttgcagctactatgacattgcacaactatgttcgcctccatgacaaagatgatatccacttcgttcgatgtgaaagggatccggattatgttccaacaattccggatagatataagaagtatgctattccttcaagtgcatcagatgcttcaacttcggangcaagtgtcctgacatggataggtttaggaatgaactagctaccgccattgctcttggttggtgaaatcatggtcatgttgttatatatctgtacccgttttganttgccaaccgaatccaanttgaaaaaacctttgttcttgctttggtcttngggcaaaaaaaaaaaaa

SEQ ID NO: 67586 - DNA, 199 bp, Triticum aestivum
  Clone ID: PAT_TA_67586
gtccacacgggatagagcgcgggaaaagtttgttaggagaaatggagtaggagtttggaaaacaaagacaaccgaagacgcggatgtcggagtaatttggatgagagagaaataaagagaagtaaggagtagtttgtgggttaactttagatggacgaatattgagtaaatatgtggccgtgtggacaaaaaaaaaaaa

SEQ ID NO: 67587 - DNA, 229 bp, Triticum aestivum
  Clone ID: PAT_TA_67587
gtcccaaagttacggatctattttgccgacttcccttatctacattattctattgaccagaggctgatcaccttggggacctgatgcggatattggtacggctgggtacaagactttttcaatcccttggtttttcaaggatcctcaaggacgcaccagacttcacagaggtgtaaagctctaccagtcattaaaccctatctccgaataattcgcttccagggtttca

SEQ ID NO: 67588 - DNA, 293 bp, Triticum aestivum
  unsure (1)..(293): unsure at all n locations
  Clone ID: PAT_TA_67588
gtgccgttcaacatgtacataaaagcaggatacgacattgttcagactgacagtatccttgtttggctgagcctccagaagcgcaagcacttgatgcgcaaggaattaccgcaagtttctgttggtagtgatgtacaaccttagaattttgaggggctgaacatgccatancaccatcaggtaaacataagttgaatcttgtgtgtaaatcttatgcttctagttagccctaattgacntgtgcatatntactactgtattccccntgtcaactgggcaaaaaaaaaaaaaaa

SEQ ID NO: 67589 - DNA, 602 bp, Triticum aestivum
  unsure (1)..(602): unsure at all n locations
  Clone ID: PAT_TA_67589
attcggcacgagggcagcgcggcgcggcgcgcgcagnagnagagatcctcctcgcatcgccatcattctccaatctacctgctctgctccccgcggattcctctgcgctctcggccgccgccgcctcctcttccgtgggtcgcaccgcgcacgacgatcctcctcgccgcaacgcgcgcgcgcttcacggttctgtgatctataccattggcctcagggaagatcctaagagagaggataacttacattttttaattcaggttaagtaaaattacccacggggggcaaatggctgcaatcatgttatgcacgtgcagcggggaccaatcgaagtttgaagagatgccccgatcaccggaatctctcgcaacacgggatttctcggcaagtggttcttgttcgagaccaggaaaacgagaagcaacgcctgatgatagccaagtgaatgaagtggaatcggacttaagagagactctttcgctaaattatgaggaggcccgggcattgctgggtagactggagtatcagagaggaaactttgatgcggcattgcaagtccttcagggcattgatataagaagcctcaaaccacgaatgaccag

SEQ ID NO: 67590 - DNA, 616 bp, Triticum aestivum
  Clone ID: PAT_TA_67590
ggttctttctcccccaaatccccaaatccagcctcagcctcactccaaggaagccaaaccctaagcagcggcgacgcggtgttcgtcgaggacgacggcatcggtggcgcggccatgaaggaggagagcggctgcagcggcgagaagcggcgggcagaatgggcatcgcttcagccggagctcgtccagctcatcgccgaccgcgtcctctccaccagcggcgtcgacgagtacatgggcatgagggccgtctgccccgcctggcgctctgccgtggccaagccgtctcctcgtcctcggggccagggatctcccgcatgctgctcgtctcctcaacccattgacaggtgacatgcttccctttgcagcgccgataccaccggaagattgggtggagactgcaattgttgttggctttgaaccaactattatcttcgctttcgaaccagcctacggcaaataccaatatatcccagcttattgttctttggggcgaggtggtgacgcggtttactctgctgatcccatgggccagctccgtgcggtcaggtttcatgatgctgcttccaaccaggatgccctgttctacctccggagcatggtcacctatgcggac

SEQ ID NO: 67591 - DNA, 532 bp, Triticum aestivum
  Clone ID: PAT_TA_67591
gggagaaagatggcaggaaggaagggcggcgacaggaagaaggcggttacccgctccgtgaaggccgggctccagttccccgtgggccgcatcgggcgctacctcaagaagggccgctacgcccagcgcgtcggctccggcgcccccgtctacctcgccgccgtcctcgagtacctcgccgccgaggtcctggagcttgcaggcaacgctgccaaagacaacaagaagacacgcatcatcccccgccacctgcttctcgccgtccgcaacgaccaggagctcggcaggctgctcgctggcgtgaccatcgcccacggcggcgtgatccccaacatcaactccgtgctgctccccaagaagtccgccgccgccgagaaggaggccaagtcgcccaagaagaaggccgccacaaagtcccccaagaagaaggccgtcgccaccaaggagtaggcgccccgtagcctagcctgctccttgattcagggagaagatgatgagacttttgattgattggatcatgtgtatctaattg

SEQ ID NO: 67592 - DNA, 122 bp, Triticum aestivum
  unsure (1)..(122): unsure at all n locations
  Clone ID: PAT_TA_67592
cgcccccggngtgggcaagcgaaccatcctntcccggttgattgggacggaagtgccggacacatncnatttgtngncaggtgtgctntgtcaggggtggaaaattgacacgaagtactact

SEQ ID NO: 67593 - DNA, 567 bp, Triticum aestivum
  Clone ID: PAT_TA_67593
agccgccgcagcatccatggcccccaaggcagccgagaagaagccggtggagaagacccccgcggggaagaagcccaaggcggagaagaaggtgccggcgtccaaggagggcggggacaagaaggggaagaagaaggccaagaagagcgtggagacgtacaagatctacatcttcaaggtgctcaagcaggtgcaccccgacatcggcatctcctccaaggccatgtccatcatgaactccttcatcaacgacatctttgagaagctcgccggcgagtccgccaagctcgcgcggtacaacaagaagcccaccatcacgtcccgggagatccagacctccgtccgcctcgtcctccccggcgagctcgccaagcatgctgtctccgagggcaccaaggccgtcaccaagttcacctcatcctaggctcctcttgtgttgattcttgtgtttctttcctcttcctcgtctgatgaattctgtagctagctgtgtgtgttctgacagtgtcatcttgtaacaatggtgctgcctgaataaatagtcgtgttgctgcttgaaaaaaaaaa

SEQ ID NO: 67594 - DNA, 615 bp, Triticum aestivum
  Clone ID: PAT_TA_67594
cacgagggtttatttacacaacaaacaaaccttttccgctgaatttgcaatattaaattaatattttatttgtcccgacttcaggagtgggaggtttatttgaagcagttgtggagaaaggtggcgatgccagaaattacgatacaaaccaacgtttcaagcgacaaaatcgcttcggatttacaagagatagtggttgaacttgtatcgcagcatctcaacaaaccgaaagcaaatatatgcgtcactgtgttaacagatctatggatgtcatttggtgaaagtgaagagccgtgtgcttgctgtacagtcacttctatgtgtagacttcaacgcagaaacctgcgaaaagcttgcagcgcttttgatgcctcctcttcaaaaagcgttaggagtttctggaacccgtttttacctacagtttcacgaaataactgcaggaataatgggcttccagggtacaactgttaaagtagttcgtgaaagaaagcagagttcttagtgtttaaatttagccatcgagttacattggtaattgttataaacacactaattgtgtcgtattttagtggtgtctttttttaattttctgtaacttttgttcttactaaaggt

SEQ ID NO: 67595 - DNA, 346 bp, Triticum aestivum
  unsure (1)..(346): unsure at all n locations
  Clone ID: PAT_TA_67595
ttcggcacgaggctcgagtttctttattttttaacaaatttcatggcttagcatcttatgtgttccatctaactctacctgcaatttatatctactccaagtacaccacattcagaattgatatacagcctacagttagatcagttcagattttgccatgacaatattaccggtattattcatgattcctacgttgtgtatatcactgtagaatactacctctattccagaatatggttgtatatagcaaaatagttgtataagtcttttaaatttatgttcttctgtaaaaaaaaaaaaaaaaaaaaaaaaaaaaaaaaaaaaaaaaaaaaaancnnaaaaaaaa

SEQ ID NO: 67596 - DNA, 230 bp, Triticum aestivum
  unsure (1)..(230): unsure at all n locations
  Clone ID: PAT_TA_67596
atcgcccccttcccccgcccgncccgctcgccgtggncttcgccgatgaccgcggccctgcgcagcacagcgccgagctcgngaganngagaggagaggagccgncacccaacccaacccatncaaccanggagcccgtccnatcccactccccacgacgtctcccctcccatctctctcacacncacctcgccgccggncatggccgcccccatnctctcctcccctcc

SEQ ID NO: 67597 - DNA, 596 bp, Triticum aestivum
  unsure (1)..(596): unsure at all n locations
  Clone ID: PAT_TA_67597
gcaggnattcggatgaggagctcggnggatcacttcctgaacttgcactcagcacacaagattatctttcactgcgagaaacctcgagccagttgctggatggccacagaacgtacctcaaaccacaaaaggactgccgtgtcctcattggtggtttccggtgtccagatgctctcccgacagcattacgaagtgaggaacaactctcagaattggttcgtgaatgtccagataactccatcatccaggaaaagatgaagattctcagtaagcattatgtgctcttccgaagaactcgccaagatggcagctgcttttacagagcttttctgtcttcctacatggagatccttcgacaaatgcaagataaacaagctgaggttactcgtcttatggaatgtttcgaaatgtatacagatagattctctcgtcttaagtgggacgaagcatacttcttaaatcctgaaaaatacttctcaagtgttgtttctgagctcaatgaggttctcaacgtcattgcagcaggttgtacttctgaatggctgtaccagagaagcctgcaggagtccttttcaggcaggattatatctttcctt

SEQ ID NO: 67598 - DNA, 622 bp, Triticum aestivum
  Clone ID: PAT_TA_67598
gcggaaacgtactgaaagagctaaattctactctggttcatgtttgcgttaactatgcagtaacatgtgtgaagcttgaaccaatggccaactaccggtaaattatgatatatggcacaaaaatgttggctaacagcattatatataactatgacttcatttcagagtttaccaccagaatgtatctccactacactcttaagtgccaagagtaacaaaagcaactaactttgtcatttttaacttaacgaattatatggtaacctgatacaccattaaacattgcctgacatatggatagcatggcgagtcacggccatcactactaacttgatatatctaacatccacatatagccagattggtgccagtaatgtttaggattatgacaaaaatgatacaaggtgacgatactatggatggtagatcaagtgccaacctgataggagcaagaactcaaaaccgtcaggagattgatgagtgtacctaggttttgggtatacaggtgggctttagtggtatccctcatgtgtgttgtttgggcctgtagacctacaaagttagggcccaggatgtcacctaagcctgctatctccttttaaaaaaaagggggggcccggta

SEQ ID NO: 67599 - DNA, 606 bp, Triticum aestivum
  Clone ID: PAT_TA_67599
accccggctccaatggcggcgaaggaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggtgtcaagatggagttgattgatgccgcatttccacttctcaagggagttgttgcaacaactgatgttgttgaggcctgcactggtgtgaatgttgcggttatggttggtggattccccaggaaggaaggaatggaaaggaaggatgttatgacgaaaaatgtttcaatctacaaagctcaagcatctgctcttgaagctcatgcagcccccaattgcaaggttctggttgttgccaacccagcaaacaccaatgctctcatcctgaaggagtttgctccatctatccctgagaagaacatcagttgtttgacccgcctagaccacaacagggcactcggtcagatttctgagagacttggtgtccaagtttctgacgtgaagaatgctattatctggggtaatcactcgtccagtcagtaccctgatgttaac

SEQ ID NO: 67600 - DNA, 612 bp, Triticum aestivum
  unsure (1)..(612): unsure at all n locations
  Clone ID: PAT_TA_67600
attcggcacgaggcgagnacttcctaggtgcgccgccgtgcgaggctgctggctgccggccaccacggccagccaagaagtacaaaagcgtctctgacgagcacggcggtaccgccttgcctagatctcttatctctgaggttggcgccgcctcgttcgtcgtctccgccatcgccgttgtacagctgccgccgtgccaaaccatacctgacagttttccgtcgccctgactgggaaacactaagcagatcaggttgggatagattaaattcagaacgaagatgtgctccatgatccgaaggtttgtccatctaattgttcacgatgtcaagggtggggctggtggtggtggttacgccctgcggaacattgataccaagccgctctttgcgggtattggtggtggcagcacgagtatggcagtcactactcgattaccacgcccagctgccttctttgagtctgctaacacggacaataacaatcacacagagtttttcctcctcggcagcaaaattgttagtgtcaacatgaaccggcgcacagtcttgtatgacagtttgacttcgggtatatctggtggacctgacctgcggcattgtaagttcgtcc

SEQ ID NO: 67601 - DNA, 557 bp, Triticum aestivum
  unsure (1)..(557): unsure at all n locations
  Clone ID: PAT_TA_67601
gcccgcatctcgagtagtttccagctcgccgganaagcagcaagcaggatggccggaaggaagggcggcgacaggaagaagtcggtgaccaggtccgtcaaggctgggctccagttccccgtcggccgcatcgggcgctacctcaagaagggccgctacgcgcagcgcgtcggctctggcgcccccgtctacctcgccgccgtcctcgagtacctcgccgccgaggtgttggagctggccggcaacgctgccaaggacaacaagaagacccgcatcatcccgcgccacctgctgctcgccgtccgcaacgaccaggagctcggcaggctgctcgccggcgtcaccatcgcccacggcggcgtgatccccaacatcaactccgtgcttctccccaagaagtcccccgccgccgccgagaaggaggccaagtcgcccaagaagaagaccaccaccaagtcccccaagaagaaggtcgccaccaaggagtagaattccgcatagcatagccattgttgcttagatccatttctcatggacaagatgagcagtcttttggt

SEQ ID NO: 67602 - DNA, 590 bp, Triticum aestivum
  unsure (1)..(590): unsure at all n locations
  Clone ID: PAT_TA_67602
catgtcaggnaaggatttttcaaatttgagagtgtatgccattgatgtggatgaggctgatgaacttgatgatgcattaagtgcaactagactacctgatggtaggataaaggtctggatacatgtagctgacccaacatgctttcttcaaccccggagcatccttgacagggaagcaatgcacagaggaacctccatatttttaccaactgccacctttccgatgttcccagagaggcttgccatgaatgctatgagtttgcaacagggtacagattgtagatctgtaagcgtatctgtgattttgcatccagatggaagtattgcagaatattcgatagagaactcagtaatcaaacctacctacatgttaacatatgagggtgcaactgaattgctgtacatgaatctggaagaagaggaagacctgaggattcttcaagaagctgcttcaattcgtgcacaatggcgtcgtagcccagggttcaatcgacactgctatgatagaacctcgtatcaaggtggcaaatcctgatgatcctgaaccaaacattaatttatatgttgaagatcaaaccaacccagcaatg

SEQ ID NO: 67603 - DNA, 481 bp, Triticum aestivum
  Clone ID: PAT_TA_67603
gctgcagagtatcacctcgtcgacgtatttgaaagggcaaatcactgtgccatccatgcaaagcgtgttaccgtcagtaagttctcactgaatgaaaacttcctttcttttacaatattatgcagaaggaaacatgccagttatgaaagagtttcaattacaagatcacctttgctttcatttgatgtggtatctagttttgatgttgtttcaaggttcaagaattctaatgattaatgataggatccacaattgttatatctctgcagctcctcgtatctgacgaacaaacatgtcaaacaattcattaaaaaatgaagatgtcaaacaaacagtatatgcactgcatattggatatcaaacctggttactacagcaggaagttcagggttgattatttcttatctgaaggataaacattgtatcaaatcagaattttatttgtaagttgcattttttgtttactcataaaacttggaaa

SEQ ID NO: 67604 - DNA, 564 bp, Triticum aestivum
  unsure (1)..(564): unsure at all n locations
  Clone ID: PAT_TA_67604
gcgcagcatccatggcacccaaggnccgccgagnaagaagccggtggagaagacccccgcgggcaagaagcccaaggcggagaagaaggtgccggcgtccaaggagggcggcgacaagaaggggaagaagaaggccaagaagagcgtggagacgtacaagatctacatcttcaaggtgctcaagcaggtgcaccccgacatcggcatctcctccaaggccatgtccatcatgaactccttcatcaacgacatcttcgagaagctcgccggcgagtccgccaagctcgcgaggtacaacaagaagcccaccatcacgtcccgcgagatccagacctccgtccgcctcgtcctccccggcgagctcgccaagcatgccgtctccgagggcaccaaggccgtcaccaagttcacctcgtcctaggctcctcgtgcgttgagtcttgtgtttctttcttcttcctcgtctgaggaactctgtaggtagctgtgtgttttctgacagtgtcatgttgtaacaatggtgctgctgaataaatagtcatgttgctgcttggaaaaaaaaaa

SEQ ID NO: 67605 - DNA, 422 bp, Triticum aestivum
  Clone ID: PAT_TA_67605
ggccatggtatgcgtagtgggagaggcggtatgccaccatggcttatgggtggattggacatgcataattcagcagcatggggtctcaatgctggagcatctggatggggtcatcagggtgatactggagtcagtacttcatcacttatgccaggggcacaaactgctggcccaagttccaagggaggagctgatattcagcctctgcagattgatgagagtgtaagttttaatgatattggaggtttgtctgagtacattgatgctttaaaggaaatggtgttcttccctttgctgtatccagatttttttgcaaactatcacataactcctcctcggggagttcttctctgtggacctcctggtacagggaagacattgattgcccgtgcattagcttgtgctgcctctaaagctggcca

SEQ ID NO: 67606 - DNA, 119 bp, Triticum aestivum
  unsure (1)..(119): unsure at all n locations
  Clone ID: PAT_TA_67606
tgctgaancacttaagatgganatcattcccaaccctaaggaagntgatggcgtgaaagtcctgcanntagaaaccgcanctggagcancgatcaggttctttgagaaggcaatcgnca

SEQ ID NO: 67607 - DNA, 612 bp, Triticum aestivum
  unsure (1)..(612): unsure at all n locations
  Clone ID: PAT_TA_67607
gggaacaggggcagggnagctacaaacaatgcgccgaaacataggaaaacagattcacctgtgcagagatggaggccagtctcaacacaagcatcttccccaaaagctcaccttgatgacctatccaattccgcaaggaagcaaacggtggggacttccatcagtgatagtgagaatttggcatcggatgaaaacactatggaggtaatgggagaaaaatatccctcttctgttgaggtagatgttcctctaatgcgttttctcaaaggaaaaggtggatctgtgcagaagcagattgaacaggagactggagttaaaatcattttcccatctgcaaaggaggaaacacttgttgccctcgaaggcaaaagtgctgaaagtattagaaaagcatcagagaggatttcaaagatccttgaagaggctgttcaaagtccaatgctagattactcgcatttcatatcacttccgttggccatccacccggctcttgtcgagaagctaaataacttccagaggtcgatcctcggggcgtctgcatctaatgtggatagtgataaggatgaaagcctaagcgaaggttctatggaagaaattgatgaagcagcgaac

SEQ ID NO: 67608 - DNA, 932 bp, Triticum aestivum
  unsure (1)..(932): unsure at all n locations
  Clone ID: PAT_TA_67608
cgagggtccaccctccaccttgtcctgcgtctgcgtggtggcatgcagatcttcgtgaagaccctcaccggcaagaccatcactcttgaggtggagagctccgacaccatcgacaacgtcaaggccaagatccaggacaaggagggcattcctccggaccagcagcgtctcatcttcgctggcaagcagcttgaggatggccgtaccctcgctgactacaacatccagaaggagtccacccttcacctggtgctccgcctccgtggtggtatgcagatttttgtgaagaccctcaccggcaagaccatcacccttgaggttgagagctctgacaccatcgacaacgtcaaggccaagatccaggacaaggagggcattcccccggaccagcagcgcctgatctttgctggcaagcagctggaggatggccgtaccctcgccgactacaacatccagaaggagtccaccctccaccttgtcctgcgcctgcgtggtggcatgcaaatcttcgtgaagaccctcaccgggaagaccatcactctggaggttgagagctccgacaccatcgacaacgtcaaggccaagatccaggacaaggagggcattcccccggaccagcagcgcctgatctttgctggcaagcagctggaggatgggcgtaccctcgccgactacaatattcagaangagtccacccttcaccttgtgctgcgcctgcgtggnggcatgcaaatcttcctgaagaccctcaccggcaagancatcaccctggagggtgngagctccgacccatcgacaatgttnagggccagatccaggcaaggngggatttccccggaccacagngcctgatntttnttggcancaactggnggaaggtcngacccttgcggactacaacatncanaaggggnccccctcccctggnncnc

SEQ ID NO: 67609 - DNA, 611 bp, Triticum aestivum
  unsure (1)..(611): unsure at all n locations
  Clone ID: PAT_TA_67609
ggtnatatgcttgtctcaaagattaagcctgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagccgcggtatctacgtcagcgacaagggcgccatcaaggaggagtagagtgcgaaaacc

SEQ ID NO: 67610 - DNA, 485 bp, Triticum aestivum
  unsure (1)..(485): unsure at all n locations
  Clone ID: PAT_TA_67610
gaggcggctgccggcgcaagccttttggtggcgacggcgacgtgctgagcgcagggtgccctgccacgcgcacgtccatgggcgcaaccatcgatggctgttgcaggcactgcttttcgcgcgccgtccgggagacgacggcgtcgccggcgtcgggatccagaaggggagcaccggcgcggcgtcatgaggtcgccgtttttataccgtttggcgaaagaatggtgggagttccactcagtggcagatggagaatgagccattcttgctggattctgggtccttgatcaagggtgctgtgggtaggcacttgctcctatattatgtcggaagctcgncagtcaagcaaggntgntacacgcgggacgnnnacacatttcanntngagagggtgtgtggttcatgtcctgactcgtcagaagcatattgnaacttaccaccatngnnattatnnnnnncnncngngnnnngngctnncnnntntg

SEQ ID NO: 67611 - DNA, 494 bp, Triticum aestivum
  Clone ID: PAT_TA_67611
ttcggcacgaggggcagagggaggtggagagtgtgcgcagccagcacgccgcggatttggagacgctggtcaccaccacggaggagctcgagaggttcaggcgcgagctctcgatggccaacgaggccaagaaggccgcgcttggccacgcagacgatgccatgaagatcgccgaggtcaatgcggacaaggtggagatcctctccggcgaagtcacccgcttgaaaggattgcttgattccagtgcggcggttgaggagagtagaaaccgtgaaagggaggagtttgtgaagaatctggaatctgagatttcagttctcaaaggcaaactagaggaggcaagagttcttgaggagaggttggccgacatggagaaactgaccgaggagcttaaaacacagttggctgatgcaaagaaggcccagtcagaagtccatcagcagtttgaggaatggaagaacaaggctggatcacttgaaatggaactggaggag

SEQ ID NO: 67612 - DNA, 188 bp, Triticum aestivum
  unsure (1)..(188): unsure at all n locations
  Clone ID: PAT_TA_67612
gtttctgttgaaattccgtcgcagtttccctgttttatctgtgaacctgtataaacagagtaccgccatttagagtcagtattccgtttatcgcatatatataggcaatgttatttacgaaaaaaaaaaaaaaaaaaaaaaaaaaaaaaaaaaaaaaaaaaaaaaaaaanggggggggnannnaaaaa

SEQ ID NO: 67613 - DNA, 877 bp, Triticum aestivum
  unsure (1)..(877): unsure at all n locations
  Clone ID: PAT_TA_67613
ctctctcgtcctcctccgcaagatgcagatcttcgtgaagacccttaccggcaagaccatcacccttgaggtcgagtcctctgacaccatcgacaacgtcaaggcaaagatccaggacaaggagggcatccccccggaccagcagcgtctcatctttgctggcaagcagctcgaggatggccgcacccttgcggactacaacatccagaaggagtccaccctccacctggtgctcaggctccgtggtggcatgcagatcttcgtcaagaccctcacgggcaagaccatcacactggaggttgagtcctcggacaccatcgataacgtgaaggccaagatccaggacaaggagggcatccctccggaccagcagcgcctgatctttgctggcaagcagcttgaggatggccgtaccctggctgactacaacatccagaaggagtccacccttcacctggtgctgaggctccgtggtggcatgcagatatttgtgaagaccctcaccggcaagaccatcaccctggaggtggagtcatctgacaccatcgacaacgtcaaggcgaagatccaggacaaggagggcattcccccggaccagcagcgtcttatctttgctggcaaacagctcgaggatgggcgcacccttgcggactacaacattcagaaagagtccacccttcacttggtgctcaggctccgnggngggatgcagatttttgtcaagaccctgaccggcaagaacatcaccctggaggtcgagtcgtctgacaccattggcaatgggaaggncaagatncaggacagggngggatttccccggaccacagnggtttattttngttggaagcaanttgnggatgggccgcncccttgngga

SEQ ID NO: 67614 - DNA, 270 bp, Triticum aestivum
  unsure (1)..(270): unsure at all n locations
  Clone ID: PAT_TA_67614
tcggcacgagggaaacaganaagctccctctcctgccctcgatttgtgttgtggtttggcagctttgggccagtttcccggttaccagacttgcgtcatggcagagaggcataaccagccaggtgttcttgagaaattctttctcgcgggaggagtttcagtgatatcaaagtctgctgcggctccattcgaaagggtgaagctcctgctgcaataccaagaggagcttgtgaggcttggtattcttcctgagccattcaaggggattac

SEQ ID NO: 67615 - DNA, 262 bp, Triticum aestivum
  unsure (1)..(262): unsure at all n locations
  Clone ID: PAT_TA_67615
tcgcccgccgccaccctgtcgccgaccccgtcgctcccccgcccaacccacgcngtcacagcccaccaccaacagcaatactactactactagtaaacaccgaggaggatctccagagagattaatcgctccctccctccctcgcggcgtttcttggatttggctccggaggaggaatccggagcgccccgtccgcgtctctcgatcgaatcgccggccccgtcgcttncgcggagctcccccgatcccgtcgcccggtgcg

SEQ ID NO: 67616 - DNA, 466 bp, Triticum aestivum
  unsure (1)..(466): unsure at all n locations
  Clone ID: PAT_TA_67616
tgcaggnaattcggcacgaggacacctcgatcctgcccccaacctccgcactccttgccccaacacctccgactctcgcgcgcgtggccgacatcgccgttcgtgctgtctccaccccgcccgcaatctttggccatcggggtttgagtcctagacaaagaagaatcccctagagagagctgttgtcctgcgcgagtagcagatggcgaggataaagccgaaacagttgctaattcagagcaagacgaagaagggtccatcgcgaatcagttattctagcatcatcacctggaacctgatcgtcgtcttggttgtgctatctctctatgcaacttacaggcattggcatcacaggccggccttcgaggctgaaatggatcttcctcgggctgagaatatagaaagatctgaggattcaacaaaaataagtaccccaagctacgtgataatggacactttgaaaggc

SEQ ID NO: 67617 - DNA, 387 bp, Triticum aestivum
  Clone ID: PAT_TA_67617
gccagattcgcgcaccaaatggcggaaacggaagcgaaactccgacgcccttcccttgccgtcagccgcggccgaccactcggacgactccgactccgctgccgacaatgatgacgacgacacggccgttccatcgcccgcggtcgacaatgccgacgacgaaatactggccggtgccgcggccagggaccccgtgcccgacctccgtgaggcagagctgctctcctcggccgaggtcatctccgccttccctgccgccacccgccgcacagtcaaccggccgcatccgtcggtcatggccgtcgttgcagctgagcgatctgcgtatgtgggtgatgtctccgccgccgcgccaccggtattggagaacatctcgcatgggcagct

SEQ ID NO: 67618 - DNA, 463 bp, Triticum aestivum
  Clone ID: PAT_TA_67618
gaggagggaggagagggaacccggcgaggtttcaagcggaagtggctcggaagagtctcgtgggtgtccgctcaaggcaagggaacctggtgtgaatggtgttgctggggtcagcagggagggcggggtgccatccccaactaagaagcgaaaatactcgcctattattttggacaggaatggttcaaagcctcgtgtccaagattttgcgagtagcatgaaagatgtaggcactgtggttgccaacctcccagatgttggcaacccgagcagcattgatttggatgcatcggttgatgtacaaaatgttgaaagattacaggagcactgcaatgatagggttattatggaggaggatgaggaggaggatgcttatccaacaatgataaacattaggacttcacgatgggcagatgctgatgacgaggaagaaattgtgtcgaagaagaagaaaagcgtgtca

SEQ ID NO: 67619 - DNA, 427 bp, Triticum aestivum
  unsure (1)..(427): unsure at all n locations
  Clone ID: PAT_TA_67619
ggnctgcaggnaattcggcacgagggcgcccatcccacctaacctcctccttccccgcgcctccctccccatggctccttccccgcgcctccctccccatggctccttccccgcgcggtcgcgccgcacttcctcccagcaccggagcgccccctgtcctcatcaccttgacccacctccttccaccgagctcgttccggccaccccgcacccagccagcgatggatctgagcaccccctgcccagccggcgacggatcttggctcttcccccacgaacctcctcccaatctcgcgtcgttcacctggcgcggagctagactgctcctcccatggtgttcggcggagggcggacgacggcgagctgcacctccgtcgcggccagcggcgagggcccccgagcgctcctcctggggttcccgtcgttc

SEQ ID NO: 67620 - DNA, 274 bp, Triticum aestivum
  Clone ID: PAT_TA_67620
gcttcagtgtcacgacgccgaaacttgtcctcttaaatgacttcagtgcttcgcaaacagctcaggcgatcacttctgccttccttgtgcgtgagttctcggtgaatgtttcttcaggatcctccttggacctcaccttcgccccatctgcacatcgcaatggttcttacgcatttgtgaacggcattgagattgtgcccactcctgacatcttcacagcacctgacacaagaaatgtcggtgataacacagccccattctcattcgacactag

SEQ ID NO: 67621 - DNA, 511 bp, Triticum aestivum
  unsure (1)..(511): unsure at all n locations
  Clone ID: PAT_TA_67621
ggnctgcaggnaattcggcacgagggttcccgagnccgtccgctcctttcccgcaaaggccgcaagaacccctttcccccgcagccgccgcaaccttcttaccgtccttctccaccccgcgtccccgctgcctcctctccctcttccgcgggaccagatgaagcggacaagagcggcggctcgcccgaccaccgttctaccccggtgcttgtccgagccgagcggtcgatccgctagctctcccagcccccgcggcttcgtcatctgctcctccattgacggcagctggggattgcaaatgtcagcgagaaaggccatccatcgtccgagcacaccgacgtctccctctcccttcttctggtggcacctacttatgcgagctccttcttccaatcccttgcgttgcctgtcttcctgctccttcagctcctccttctcacagcatgtattttctatttgttttgcaattatactccatggtcccatggatctggaagtagacattttagtg

SEQ ID NO: 67622 - DNA, 594 bp, Triticum aestivum
  unsure (1)..(594): unsure at all n locations
  Clone ID: PAT_TA_67622
ggnctgcaggnaattcggcacgaggcgccacttggtttcttcgagcggatatccacctgtgacgtgtccttaaggaagcggcagcagcgcgacaacgccgccatggcctcctccgaccctgcgctgccgcctccgcttcttttgctgccaccaccggtgccggagcaggcgctcgtcccaccgccggccagagccaacccgaggcccacagtgttggacggcgtcctgagtctgctcaggtccggggagtcgttcattcgcggagccttccggggcaactcccgacgtgcgtctcctccatggccgccgacgtctcagcagcagcaacagcagccgccgccgcagcagcaccaccgcaaccaccctggtgaaatcatgaagcggctgcagcgcgagacgttccctgatgtgatgaggctcatggacaagcacgagcagatcgaccgcatcctttccatgtacaggagcggcaaggggttccacttcccggagctccccgtccgggtgaaggtcgcgcttgacgcggtcggggcgctgctcctcgtcaacgacgaggagttcgaccacgccagggagatcctcggcaaggcgggg

SEQ ID NO: 67623 - DNA, 567 bp, Triticum aestivum
  Clone ID: PAT_TA_67623
gcggcgcctcagtgctgccgatgaccgaatattacagattttccggctcgttgtggtcgagctgagagacatcgcagcatcactggaccagcttctgccactgctggatctcagaccgtaccatgtcgagaactatgagctgtggctgctcaagttgaggaatctggctcgatatatcgggaaccacctcgataagtacgagcgtttcatcacaagaaaagaacaggaaacgtatgtgcgaactgcctgcttccgttgtgattcagagttccggttaccgcatccggatgtaacgcgactcatcgaggaagagctttcctggatcaacggacaaccttacaggtacgagcatcttatgttggccggagatgacgatagtatccccttaagtgggatgccgcagctgcaaccctacgcgacggaggccgggaccgttgcacgcggggaccttcttgttggcatcgagagcaccagaaagaagctgctcaggtggttcacgcccgcccaggaagacaacatggctctcagtatcgtgtccatggttggacccgctggggtggggaaaac

SEQ ID NO: 67624 - DNA, 615 bp, Triticum aestivum
  Clone ID: PAT_TA_67624
gccccagtccccccaccgtccgcatccatggcgcccaaggccgagaagaagccggcggcgaagaagcccgcggaggaggagcccgcggcggagaaggccgagaagactcccgccgggaagaagcccaaggccgagaagcggctgccggcggggaagtcggccgccaaggagggcggcgacaagaagggcaagaagaaggccaagaagagcgtggagacgtacaagatctacatcttcaaggtgctgaagcaggtgcaccccgacatcggcatctcctccaaggccatgtccatcatgaactccttcatcaacgacatcttcgagaagctcgccggcgaggccgccaagctggcgcggtacaacaagaagccaaccatcacgtcccgggagatccagacctccgtccgcctcgtcctccccggcgagctcgccaagcacgccgtctccgagggcaccaaggctgtcaccaagttcacctcctcttaggctgttcgtcttcctgtgtctcgtagttagctgttcgggtgtgtttgtggccgtgttatcctgtaagaatcgcaccgcgatgtttctgtatctcgagaaatggtaatggtgcctgcctcaaaaaaaaaa

SEQ ID NO: 67625 - DNA, 167 bp, Triticum aestivum
  Clone ID: PAT_TA_67625
acccatttcataattacactgctcgtgcgaagtatagaaaagttctagctggagcacaccgaagggccaaagaaacaagcacaacagcgcattccatcccctccgaaatggttgcggacaaaagcacttctggagatggaaccacttctgatatagatgaggaatac

SEQ ID NO: 67626 - DNA, 109 bp, Triticum aestivum
  Clone ID: PAT_TA_67626
gctcgaaatctcatgtgatgtttcatgtaatctggaatcggaacttgaaaccatatgtgcacactcaatttagtaatttaactatgcccttttgaagttaaaaaaaaaa

SEQ ID NO: 67627 - DNA, 615 bp, Triticum aestivum
  Clone ID: PAT_TA_67627
ggaagaagccgcaccggcgtacattctgtggtgcaaagaccagtgggccgagatcaagaagagccccgatgcagacttcaaggaggtctcgaacgctctgggcgccaaatggaagaccctgagcaacgaggagaagcagccctacgaggagaggtaccggcaggagaaggaggcctacctacaggtggttggccaggagaagcgcgaggcggaggcgatgaagctgctcgacgaagagcagatgcgctggacggcgaaagagctgctggagcagtacctcgcaggagaggcgtgcagcgctggccgccgagaagaagagtgtccctgagattggcaagatcacaggggaagagtggaagggcatgacggaggctcagaaggttccttacgaggaggttgcgaggaagcagaaggaggaataccagaagcagatggaggtgtataagcagaagaagctggaggaaaatgcgagcttagagaaggaagaagaggagcagaagaaaatcctcaagcaggaggctctgcagcttctcaggaagaaggagaaggcagacaacatcatcaagaaaaccaaagagaagcgtcagaagaagaagcagcagcagaacgccgacc

SEQ ID NO: 67628 - DNA, 586 bp, Triticum aestivum
  unsure (1)..(586): unsure at all n locations
  Clone ID: PAT_TA_67628
attcggcacgaggcttcttcnaccctagcccccttgcttcctccccccctccccttcccgcttccgcttccgcttccaagcaccctcaccacccgcggtccacgcccatcggatcccgagccaccatcccgcaagaatacctcttcgcgcccagtagcttcgttgtctgagggggagtcatggaggacggcagcggcggcgccggcggtgaggggagcacgagcggggggaggttcccgatactgcaggcgaaccgggacccggagtcgaactgggaggtggacgtcgccaagagcctcgaggagtacctcctcaagatctgctcaggcgagatctccgccgaagacggggcccacagcttcaacttcgccgaagctgcgctattgctccaaggttcagttcaagtttacagccgcaaggtggagtacctgtactcattggtgctacatgcgctggaatttctctcgcaaaataagcaagatcaacaagaaaagggatctgctgaagctaacgaaaatggtcctagcactactgtcaacaaagaagatgatatgtttatgggtttagatgatgtcccagcggaaac

SEQ ID NO: 67629 - DNA, 707 bp, Triticum aestivum
  unsure (1)..(707): unsure at all n locations
  Clone ID: PAT_TA_67629
tctgcaggnaattcggcacgaggcacaaatgttaagagttacgagttcactattaattacataaaggaaggattattgaatgtggcccctctttgcaataggggagatggcatgagtgtgttggacaaagcttcaagcgttgctaggtcaaatgcaacaagcaaaatcaggggagatatgagcatgaacatgccagctgatgcacaagaattttcagaactccgtcacattcatatggcaaaatgcacaaggtctgaaagttcgtgcatgaatggaggtgatgctaacgaaggtgaaagttcagagtcaatgaacgatgtattctcacctgatagaagtcaccatgagttatccgcaccacctccaaagaggttgaaaggcagacctacaacagcaagagagaaggcgccttatgagaagaatgttaagagatcgagattctgcaagatttgaaggggcgaaggacacaaatgcacaacatgtccaatgagaggtgatgcatcggttaaaccgcgaaaacaatctacttgcacaaattgtggtgtagcagggcatcgacggaaaaattgcggcaagaaggcagtgttcaacgacaagattgttatggaatgaatcatgaagtgttgaaccagaataatgaaaaaagtacattggcatttgcaacatgtatctgcgatgaaacagtctcttttgaataattcatgttg

SEQ ID NO: 67630 - DNA, 682 bp, Triticum aestivum
  Clone ID: PAT_TA_67630
gcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggattgctaacagagaagagtgccctgccccgcggaggaaaattagtagccagcaagaacgcggatcatgaaggcgcccggtcggtagatttctttgatccatcttgtttgttcaccttgctgtatagaaagatgagagatgagcgatcggaaccgatgcattctgagttagtagtgat

SEQ ID NO: 67631 - DNA, 375 bp, Triticum aestivum
  unsure (1)..(375): unsure at all n locations
  Clone ID: PAT_TA_67631
aggcaattttcccatggtattagagcggttagtctgatgacgccgatcctaggacttctcaccacttccgcagcgcgctgcccctgaggagattaatctcttctcctctggggtgcgatacccgatcaatcaaagagattgattttctagtttagattagatcaatttcgaaattttctctagtagatttttttagccaccaaataatccttttgatcctcaaacatccggcgcaatcgcagcagcgctagcatcgcagaagcgcgatctgatagagtagtcctccagcccaacaccgtcttcaagcttcagtagatccggcatcggaaggtgtgcaagggtgcacgactgacgcaccacgtaccacgggcggnc

SEQ ID NO: 67632 - DNA, 453 bp, Triticum aestivum
  Clone ID: PAT_TA_67632
cgagggtccgggcgcggcaagggaggcaaggggctgggcaagggcggcgccaagcgccaccggaaggtcctccgcgacaacatccagggcatcaccaagccggcgatccggaggctggcgaggaggggcggcgtgaagcgcatctccggcctcatctacgaggagacccgcggcgtcctcaagatcttcctcgagaacgtcatccgcgacgccgtcacctacaccgagcacgcccgccgcaagaccgtcacagccatggacgtcgtctacgcgctcaagcgccagggccgcaccctctacggcttcggaggctagtagatacgtggtgtgctctgctggtggcggccgtgtttttctgtgttatatgtgccgtggtggatgggatgtacttctctgtcgtgcgtttgtgttcactagtctgcaataccattatccgttcaatgaaaaaaaaaa

SEQ ID NO: 67633 - DNA, 211 bp, Triticum aestivum
  unsure (1)..(211): unsure at all n locations
  Clone ID: PAT_TA_67633
cctgctgggtggtgcagaagccggggaaggcactggtgcagtgaagttttgtctcttgactctgcagcgaggctcgntgttgcnaagctcctgggggtgttgtgcaggtggtgccgntgagctggagaccttnctgtaatgtccatttttcacacgggttcttgtactgctgaaatttaatanattgttgttgtttcgcgcaaaaaaaaaa

SEQ ID NO: 67634 - DNA, 633 bp, Triticum aestivum
  Clone ID: PAT_TA_67634
atggtgcacataacaacaacttgggggtggtgatggcggccgcagtggtggcgatgctgacgtcgccgctccttgctggagcagaagtttctccggtggaggcgcaagggatgcccgactgcgacatcacctgtggcaacatgagcgtgccgtacccgttcggcatgggcccagcccggtgctactggccggggttcaacctcacctgcgaccgcgcaagcaacccgccgcggttgctgctcggcgacggcacccttcaagtccaagagttgtccctcatcccgacatttgtggccgtcatacgcatcggcgacataaaagtcgacgacctcggtgacggcacactcggtagtggtcttacgaccgatggcccctatgcaatttcatccaaccagtttatcctggtgggctgcaacgttcatgcgacgctcaagaacggcgacgtgaccatgagcagttgttattctcgctgcaaaaatggtgatggactctcccaggcgcggaacacactcgaagcaggcatgcaatgctctggcaatggctgctgccagtcggacattatcttcaaccctgcagaggtagcagaaaggcttgtcaacagcacgtcctacgacgtgcatctcaaatggttcg

SEQ ID NO: 67635 - DNA, 110 bp, Triticum aestivum
  Clone ID: PAT_TA_67635
atgagtgttgcagccttgcagatctgggaagctacatcgacaaaaagacatcaagccatatacccatattcaggtgcttttgtccctgtattgactgttcttctgcaatg

SEQ ID NO: 67636 - DNA, 640 bp, Triticum aestivum
  unsure (1)..(640): unsure at all n locations
  Clone ID: PAT_TA_67636
acgagggtttcctcgccctcacagnaacaccgtctcgccgccgccgaaacccctccttgcccccgttctctgcgcgccaggtcgacacattcctcgatctcagccaccggcggcgccggctccgcggtgcccaattcctcaaaccctagagccaaatcccccatttggccgcgcctaacagagccggatttactcggcgctggctggtgcgagcggcgaatcgagtcccctcccgtgcgctgctccgcatgtcgcaccgcgtgtacgcatgaactcgtccatggacgagatcaacctgctacggcagcaccagcgacaccagcagcaccacctgtcggtgcgcggcatcggtgaggagatcgacctcgagatcgaccagtgtgaagatcccactttctcgggcgccgcactcgagggcgtgacctgccatcaccctcaagaccccgttgtccctgccgatgaccacaagagcttcctcatcccgtgctcgcagcctggcgcagtggacggccaaccgcagcccacgccaccgcaagcagaggaacgggcagggatgctgaggctgtcggcgcataccaagaagaagaagaagaaggtggtcaagaaatggcgggatgagtgggcggacacatacaagtgg

SEQ ID NO: 67637 - DNA, 664 bp, Triticum aestivum
  unsure (1)..(664): unsure at all n locations
  Clone ID: PAT_TA_67637
tgaagtactagtgttgctggtgacagtgccggnaccaagcaccaatgcttcaaacaatactgccattatgggtggtttaaaggaggatgtggacaacacagttgaccctgattttgacgatgacactttggataacttcggggaagtagaccgtgtttctgaggaagatgagtacgataagtttgatgactgggatatccagcctggagcggaagcttctttaccatggctgcagaagactgacgctgaagtgtcatataatagtagaacacccatcccaatcttggttgatgaaaaatacaacacatttaaacagttcgatactgttgatgatcatagtgatcattattattcgaaaccagagttgtggaaagctcaggtagtgaacgagccatcaaatgactgggtgatgcgcattcaacatgagtgtgaagtcttaggaaaagacttgccaggtagtatattcgtgagggcatacaaggatagaatggaccttcttagagctgtcatcatgggaccagcatacactccttaccatgatgggctgtttttcttcgacatttacttccctcctcattatccaaatacacctccacttgtgaactaccgttctggtgggttgcggcttaataaaaacatgtatccttgtgggaaggtatgcctt

SEQ ID NO: 67638 - DNA, 567 bp, Triticum aestivum
  Clone ID: PAT_TA_67638
gcacgaggcagcgatggcgcccaaggcggtagaagaagccggcggcgaagaagcccgcggaggaggagcccgcgacggagaaggccgagaagccccccgccgcgaagaagcccaaggccgagaagcggctgcccgcgggcaagaccgcctccaaggagggcggcggcgagaagaggggccggaagaagggcaagaagagcgtcgagacctacaagatctacatcttcaaggtgctcaagcaggtgcaccccgacatcggcatctcctccaaggccatgtccatcatgaactccttcatcaacgacatcttcgagaagctcgccggggaggccgccaagctcgcccgctacaacaagaagcccacgatcacctcccgcgagatccagacctccgtccgcctcgtcctccccggagagctcgccaagcacgccgtctctgagggcaccaaggccgtcaccaagttcacctcctcttagattcagtctctggcagctgtagttgggtgctgtttgcccagaattagtgttgctcaatggaaatcggtggaatatcgtttagtttgtagtt

SEQ ID NO: 67639 - DNA, 493 bp, Triticum aestivum
  Clone ID: PAT_TA_67639
agcccactgagcagaaggagaaggagttcctgtcggagctagggatccaggtgcatgtctgccacccgaacacggccgacctgctcggatgctgcgtcgagaacgggctctacctggtcttcgagctctgcgcgaacgggacgctcgcatcggcgctccacgggaacagtgggaaggtccttgagtggcctctgcggcagaagatcgcggtgggtgtcgcgaggggtttgcagtatctgcacatgttctgcaggcaccggatcatccaccgcgacatcaaggccgctaatatcctcctcggcgatgattctgaacctcagatttctgactttgggctggcaaagtggcttccaaaacaatggacccatcactctgtcgtacccatagagggcacatttgggtatttggcgccagaatacttcatgcacggcatcgtcgatgaaaagacagatatatttgccttcggagttcttctgctagagatcgtcaccgg

SEQ ID NO: 67640 - DNA, 544 bp, Triticum aestivum
  Clone ID: PAT_TA_67640
gcgcacgcctcctcgccctcctcctccggccccgccgccgccgccgcctcgccacagggttagggttcgctcgccccctcctcccccctccccggtttgatctgttccgttcggcgctcgattcggcgtctcctctgtcgatccgcgtgggttttgttctcgacgaaggagttctgtgtggctcttccgccctgtgcggcgatcgacggaagggggccgtgttctgtgatgctcgcggcgccgttcggtggttggtccgttttgggtagaagtctttgcgtgttgttttctccttttctgttccttctgggtggaaatgattagatttaccttttttttcaaattaaagccgtccggattagatgaatcacgcggtgcggctggcgcacgttgtgttcgatttaccatctctcgggagaaattttcggttttcgagatttgaattcggtgccctgttcctcgtctggaccgtcggcgaaatggaagtaataagtggctcttggtagcggtggttggggagaagtcgcttttgacatgttgattt

SEQ ID NO: 67641 - DNA, 649 bp, Triticum aestivum
  Clone ID: PAT_TA_67641
tggggcttaattgtgcatggtttttgatctgacagttggtgcgtaggtgtatcctgagcagagctatcccactgtgtgttctttagtccatcagagtttgggttgtgaactgcctgtatttgtttctctgatttaaagtacgtctacagcccttgaagacattctgtaatggtagctagataatttttttcttactaatatatacgtctacagctttccctgtaacagcagcgacagcagcctattacttcacagtaaacacatttatctgattatgaggttttagatgtgttttacatgtttgtcaaattactgcgcttactgttagaacactcaatactgcacccaaaaaaacaacgtactgatagttggtgcctcgacacacggtagctaattcatacataatttctactgatccatctagacttctcctatgttatgtttttttgttatttcctagatacacatactgtaatcttaaggaccggtgatgcatgagggagatcccaattttttcatcactactaattttaccatctccactgatatatcaacatgacatagtggagtttctcaatttcccttggagagtttgtgcttagtatcaatcttatgtcagactagcaatattatgtaataacatgtatag

SEQ ID NO: 67642 - DNA, 597 bp, Triticum aestivum
  Clone ID: PAT_TA_67642
ttgacgcaaatcacccgatcgatccacatccgcttctatctatggcgacgtcgactccggcgtcgtggtcagaactcccgccggacgtgctaggcctggtcatcaaccgactggtttccttaccgcgccgcgcctcgctgtggtcacgactccgacggcacctgggtttccgcgctcgcttcagagaatggccgcgagtccgacggtttcttgatttcatcgctggctttggcttcaagaaggtgcggcgtgaccggcactgggtctctttcgaccgcgctcgcttccgcatggtgtgtcgttcgtggcatcgagctatgcgccgacacattgcggcttcacgacaggtaccctggattgtcatgtcagatggctcgttcttcacaccttcggatcctgttggcacctccccttcccggctccccaccttgcccagcaatacaacatgcattgcctcctgcgacgattggctcgccctcgacctcatcgatgacgacaagatgcatagctactcattgcacaatccgttcactggcaccaccgtgttgctccccgagctggatgctatcatcggcaatgtttccaagattttcaagg

SEQ ID NO: 67643 - DNA, 552 bp, Triticum aestivum
  unsure (1)..(552): unsure at all n locations
  Clone ID: PAT_TA_67643
ttgggttgttggnngcngacagtttgttcgaatggtgcccgatcgacgggatactatgtgctattatcgaatatttatgctagggctggacgatgggcagatgttacctcggtgagaagtgtcatggcaagcaaaggtatcaagaaattgcctggtgctagcaatgttgagataggagatcaggtccacacatttcatgttggtgatagatctcatccacaatccgaaatgatctacaaaaagttggatgagttgttaggaaggatcaggggaatgggttataacccaggagttgagggtacacttcatgatgttgaagaggaagagaaggagggccatctttcagtgcacagtgaaaaattggctattgcgtttgttcttataaacactagtccagggacacccattagaataacaatgaatctcagaacgtgtagtgattgccatcatgctgcaaaactcatttcagctatcacagatagagagattatccttaaagacgtcaacaggttccaccatatagtacaaggagtgtgctcatgtggggactat

SEQ ID NO: 67644 - DNA, 276 bp, Triticum aestivum
  unsure (1)..(276): unsure at all n locations
  Clone ID: PAT_TA_67644
agaaggagaggatgcgcgccttcgccgagaagcaggggtggcgcatcaaccgcgacgacggcggcgccctcgagcgcttctgcctcgagatcggcgtcaagcggaacgtcctcaaggtctggatgcacaaccacaagcaccagctcgcctcgcccacctccaccgcggccggtatgggcatgggcatggggatgggcatnggcatcaacccaggagtcctcggcactggcactgggaccggcgctggcgctggcgctggcgttggcgttggagcgg

SEQ ID NO: 67645 - DNA, 307 bp, Triticum aestivum
  unsure (1)..(307): unsure at all n locations
  Clone ID: PAT_TA_67645
tgatgttcccattaccagggggtgcggcgatggcgctggctccacggccaagcagcttccacgggcgcaacgaccgccggcggcaccgcgaccgccataaccttcagcttccagccctccgatcctcctgtgaacggcggcctctcccaccaccatagcctcctaggttacagccccctcgtactagaccacccaaccaccactacttnctcctccaccatgccctaccgccgctcccacacttnaccacatccatgctcatgccggagccatccatactgcaaggtcatcccctncacatccatgg

SEQ ID NO: 67646 - DNA, 138 bp, Triticum aestivum
  unsure (1)..(138): unsure at all n locations
  Clone ID: PAT_TA_67646
cgttgtcgttgtttcatgagttgatggcggcaggcatcgtgtatgtagttggcagcagtgtgatgttacaancctctgtaagaattgtgctgcttgcggccctgaagaaatagtgatgttgctgtttgaaaaaaaaaa

SEQ ID NO: 67647 - DNA, 547 bp, Triticum aestivum
  unsure (1)..(547): unsure at all n locations
  Clone ID: PAT_TA_67647
tgcaggnaattcggcacgaggttgttgtttgccttgatacctgtgtgtctgcttctgggaagacacttgttgtaactgggagcaaagataatactgtaagattgtgggatatggaaaagagaagctgtattggtactggtaaaggccatctaggagctattggttgtgttgctttctcaaagaagtcaaagaacttttttgttagtggtagcagtgaccgaacaatcaaggtttggacctgggatgatacactcattgatgctggcggtgaagttcctctcaaagcaaaggctggtgtagctgcacatgataaagatattaattctctgtctgtctcacctaatgacggccttgtttgcagtggttcggaggaccgaactgcaagcatatggaaactccctaacctagtgtcatcggttgtccttaaagggcataaaaggggcatttggtcagttgagttttcccctgttgaacaatgtgtcataacatcatctggtgacaaaactgtcaaaatatggcatgttgctgatggctcatgcctgaagac

SEQ ID NO: 67648 - DNA, 198 bp, Triticum aestivum
  Clone ID: PAT_TA_67648
aggcaaatcacacagagagcgccgccgtcccaatattccggcgaaccccaaagcgagcgagcgattcccaggagaggagaggaggcggagatggccaagggcgaggggccggcgatcggcatcgacctcgggacgacctactcctgcgtcggcgtgtggcagcatgaccgcgtcgagatcatcgccaacgaccagggc

SEQ ID NO: 67649 - DNA, 321 bp, Triticum aestivum
  unsure (1)..(321): unsure at all n locations
  Clone ID: PAT_TA_67649
gcacgaggtcggggactcatctacgaggnaggacccgcggcgtgctcaaggatcttcctcgaggaacgtcatccgcgacgccgtcacctacaccgagcacgcccgacgcaagaccgtcaccgccatggacgtcgtctacgcgctcaagcgccagggccgcaccctctacggcttcggcggctaggcttttcctcgcccccctcccctgcagatatcccaaaagcttgatggaaccgcggcttgtttagctctctatttgctctgtagttcgaactgaatcgtggaacaaagtgcttcgcatatgttgctggaaaaaaaaaa

SEQ ID NO: 67650 - DNA, 628 bp, Triticum aestivum
  Clone ID: PAT_TA_67650
cacacatagtctccactgtagcccccaatccccacccatcttcccggagcagcgatggcccccaaggcggagaagaagccggcggcgaagaagcccgcggaggaggagcccgcggcggagaaggccgagaagacccctgccgggaagaagcccaaggccgagaagcggctgccggcgggcaagaagaccgcctccaaggagggcggcggcgagaagaggggccggaagaagggcaagaagagcgtggagacctacaagatctacatcttcaaggtgctgaagcaggtgcaccccgacatcggcatctcctccaaggccatgtccatcatgaactccttcatcaacgacatcttcgagaagctcgccggcgaggccgccaagctcgcccgctacaacaagaagcccaccatcacctcccgggagatccagacctccgtccgcctcgtcctccctggggagctcgccaagcacgccgtctccgagggcaccaaggcagtcaccaagttcacctcctcttagattccattgcctgtatctaaatagctgttcgccctggttatcaccaagtagaagtagtgctagtgcttgatgggagttgctgaatgtttgccgatgcttcgttcgctgt

SEQ ID NO: 67651 - DNA, 611 bp, Triticum aestivum
  unsure (1)..(611): unsure at all n locations
  Clone ID: PAT_TA_67651
ggnctgcaggnaattcggcacgaggccaaacccgacgccgtcctcgccttcctctccggcctcggcctctccggcgccgacgtcgccgccgtcgtcgccaaggaccccaagttcctctgtgccagcgtggagaaaaccctggcccccgtcgtcgctgggctcaccggcctgggcttctcgcattccgacatggcgcgcctcgcctcgctcaccggcgtcactttccgctgcaagtccatcatcgccgggctgcggtactgcttgcccctcttcgggtcctccgagaacctccttcaagccctagctccagcgggtggctccgttctcgggtccgacctcgagcgggtggtcaagcccaacgtctccttcctgcttgagtgcgggctaggtgcttgcgatattgccaagctctacgcatatacgctgtcgccgctcagcatcagcacggaacgcatccggacagcagtggcatgcgtcgatggtcttggtgtaccccgtggatctccgatgttcagacatgcgctacaagttgttgcattcgtcagcgaggagaaaatcaccgccaaagtggagggctttaagaaaaagttcaggtggtcggatgccgaggt

SEQ ID NO: 67652 - DNA, 187 bp, Triticum aestivum
  unsure (1)..(187): unsure at all n locations
  Clone ID: PAT_TA_67652
gggttaggatcgggaaagcgccggatgagacggagatgaacattgacaggaaaacaatgcttgaattgtctgtttgcgcttatgcggaagtgcacaaactgggggatggttggacatcgccgcaatgcatgcggtactaaaaggagcggatctttttagcctaacttcctctagattaaaactggnt

SEQ ID NO: 67653 - DNA, 541 bp, Triticum aestivum
  unsure (1)..(541): unsure at all n locations
  Clone ID: PAT_TA_67653
gcaggnaattcggcacgaggggagtttcttgcgcatcaaaggcagcagcagagtctccagaatgtcccttgagatctacctgattggcaattactcgcatgatattggcccgctggtccgtgacgccattgacaacggcatgataaaagaactggacctcaccattgcggacgacaaggattacgattgcaaaggtggagacatgctacggaaagcacgggacgtggacgggttcttcagcgcctatcctaatatacttccttgcctcacaaggctccagctttacaacctgcgctttgctgagggggatatacataacgtcttatttgattgctgcaagcagctgcagcaccttagtctggaacactgtgatgtcggcgactgctcggtgtggcaggtagactcgccgaattcggttctcagggttcttgaagtccgctattcctacttgaagaggcttgaggtgctctgccttcccaaactagagctgctcagttgggaggcgtggatgcactgtgagccccccttgcattttggttat

SEQ ID NO: 67654 - DNA, 939 bp, Triticum aestivum
  unsure (1)..(939): unsure at all n locations
  Clone ID: PAT_TA_67654
gcaacaaatccccacccaatnctcgtctccgatcgacccgaggctcgtcgaatccccaccgcctcaagatgcagatatttgtgaagacactcacgggcaagaccatcacccttgaggtggagtcgtctgacaccatcgacaatgtcaaggccaagatccaggacaaggagggcattccgccggaccagcagcgtctcatcttcgctggcaagcagcttgaggacgggaggacccttgctgactacaacatccagaaggagtccacccttcaccttgtcctgcgtttgcgtggtggcatgcagatcttcgtgaagaccctcaccggcaagaccatcactttggaggttgagagctctgacaccatcgacaacgtcaaggccaagatccaggacaaggagggcattcccccggaccagcagcgccttatctttgctggcaagcagctggaggatggccgcacccttgccgactacaacatccagaaggagtccaccctccacctggtgctgcgcctgcgtggtggcatgcagatcttcgtgaagacccttactggaaagaccatcactctggaggtggagagctccgacaccatcgacaacgtcaaggccaagatccaggataaggagggtattcccccggaccagcagcgtctcatcttcgctggcaagcagctggaggatggccgtacccttgctgactacaacatccagaaggagtccaccctncaccttgtcctgcgtctgcgtggtggcatgcagatctttcgtgaagaccctcactggggaagaccattactcttggaggttgagagctncgacaccatagacaacgtcaaggccaagatcaggacaaggagggcatttccccnggaccagcaangccttatnttnnttggcaagcagntggaggacgggcgtacctnngggactacaanatcca

SEQ ID NO: 67655 - DNA, 626 bp, Triticum aestivum
  Clone ID: PAT_TA_67655
acttgcaggtaatcctcatgggaacctctcgctccctcctcctcacccccccatggtgttgctagatggagaaatccccatccctctctctctctaactcgttttgatttcttgcatcttagatccgttaatccgttctgatgctcaccaagggcaacaagatcctccacctaggacaaatctaattaccaaggtatatccttatattttagctccagccatactcctgctttacaatacactgtccatataaatgctttcttatttttttcttatccacataaaatcggttggaggaagggtctgataggtttcatttcctatcccgatacatgcttggctctcccgatgtcctcatgatattaaaatttcgttttcccataggttcagtacaaagttctttaattgttagtgcatatatataatctaaagctcagtgcttattgttcttaatggatgctgtgtttataccttctgccaaccctttgggtttatcttgtggatctattctcatggagttggttgagctatccagcacatcactggctgaagcaatgttcgagaaactcggtctccctaaaccagtgtactttgtgcatcatctttcacaaaatcgatttagaaca

SEQ ID NO: 67656 - DNA, 606 bp, Triticum aestivum
  unsure (1)..(606): unsure at all n locations
  Clone ID: PAT_TA_67656
cctcgtgtcgaacctgatcctatcccagccagtccactgatcccagagaatgtgaacccagatccccttcccctgattgtagtgaccatagttcctccttcaactaatgagagaactgatccctcaaccccaagggatgatagaaatgacaccacatttgatgaaagtacaaaccaaccaagaatgcctatactagagtttcatccaagtcaaattattgctgatccaggacttagaattcctatagaagattatgcccctgaaattagaagaagtgatgtgcgaagagcttatttgttgaacaaacgaaacaaagctgttgggcatacattcaagaacacaaaggatggtaaaatttggagatcctttcaacgtgcgtggctcgacaagtttgattggttggaatacagtgtggataaggaggctgcgttttgctttcattgctttcttttcaagaaaccatcccaggccattagatttggcaatgatgttttcatgaaagatggctacactcgttggaaaacaggtctagctagttttgaaaagcacgttggtggtcaatctagttaccacaacnttgctaggggagattgcgatgatttcaac

SEQ ID NO: 67657 - DNA, 948 bp, Triticum aestivum
  unsure (1)..(948): unsure at all n locations
  Clone ID: PAT_TA_67657
tcggcacgaggccccctccgattctcgccgngnaagtctccgattgaagcgaagcgaagccaaggctctctcctcctcctcctaagatgcagatcttcgtgaagacccttaccggcaagaccatcacccttgaggtcgagtcctctgacaccatcgacaacgtcaaggcaaagatccaggacaaggagggcatccccccggaccagcagcgtctcatctttgctggcaagcagctcgaggatggccgcacccttgcggactacaacatccagaaggagtccaccctccacctggttctcaggctccgtggtggtatgcagatatttgtcaagaccctcactggcaaaaccatcaccctcgaggttgagtcctcagacaccattgataatgtgaaggccaagatccaggacaaggagggtatcccaccggaccagcagcgtctcatctttgctggcaagcagctcgaggatggccgcacccttgcagactacaacatccagaaggagtccactctccacttggtgctcaggctccgtggtggtatgcagatcttcgtcaagaccctcaccggcaagaccatcaccctggaggttgagtcctcggacactatttgacaatgttaangccaagatccagggacaaggagggcatttnccccggaccagcagcgtcttatctttgccggccaagcagcttgaggatggcccgcacccttgccggattacaacatncaggaaggaatccaccctncaccttgtccttcncctttcgtggnggcatgcaaaatttttgtccagaaccctcaccggcaagaacattaccctggagggtgggtcctcgggcaccnttggccatgtgaaggccagntncanggacaaggaggggaatnccccngaacaannanccctgnnttttgccggccaagcagttcgnggatgtnccnccctt

SEQ ID NO: 67658 - DNA, 586 bp, Triticum aestivum
  Clone ID: PAT_TA_67658
cacgatcgaaatccctccaccaccatcctgcgagtcgtgcgcggttgcattgcactgtctcatgcattgcgctgcacaccgctagcaagaagcaagatcggtcgatctccctccgtcgaccccggccgatctcgtccggtgtgctttggcccggcgcctggcaggcaggcaggcatggggaaggagcaggcggcgccgtggcggctcaacgtcagcgacctccagttccagatgccggagcgggccaaggagccgccgcccttcgccagccgcgtcttcatgcgtggccacgggaaacaaaggaaaatcgcaaagtactacgagaagcaggagagtcttctcaaggatttcagcgagatggagagcatgaatgagctcggtttcttggatcagaacagtgctcctaccgaggaagagctgcggcaattggccaagggcgaaaagctggcgatcaacctgtccaacatcatcaacctggtgctgttcgtcgggaaagtcgtcgcttccgtcgagacccagtcgatggcagtgatcgcgtcgacgctggactcgctgctggatctcctctcagggttcatcctctggt

SEQ ID NO: 67659 - DNA, 592 bp, Triticum aestivum
  unsure (1)..(592): unsure at all n locations
  Clone ID: PAT_TA_67659
gtagtntatgcttgtctcaaagattaagcctgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatccctcctgcacccaggggagttccccagatcactgtctgctttgacatcgacgccaatggtatcctgaacgtgtctgctga

SEQ ID NO: 67660 - DNA, 233 bp, Triticum aestivum
  unsure (1)..(233): unsure at all n locations
  Clone ID: PAT_TA_67660
ccccgaccaaccatggcggcagcggctggagaggccccgcgggcgctgtcccagaaggagcaggacatacagatgatgctcgccgccgacgtccacctcggcaccaagaactgcgacttccagatggagcgctacgcctacaagcgccgctccgacggcatctacatcatcaatctgggcaagacatgggagaagctccagctcgcggcgagggttatcgtcgncatcgagaa

SEQ ID NO: 67661 - DNA, 472 bp, Triticum aestivum
  Clone ID: PAT_TA_67661
ggacagacgcgcgctctcgccgcccgcccctaatccatcctccttttgtcgatttttgaacaatcaaagcgcccccagtccgtcgatttctttctccccagcagcaaaaggagcaccagcagcctacggattgcggcgtgtgctcatcttcttcctccagctttgcgctgcgctgttcccacttcccacacccggaaccagaggaggaggagccgcaagcagagcctttccccgctcgcagtcgctggcagcacctcggcggaaacaatggagtgaaggaaggacacagcaggccgccgttgtgctcctcctctcctcctgcgcctgggctgggatgaggatccggtcggttttgaccccttgatactcgggagtcgggagggtgtctgctcaagatcgacggacgagcagcagcagcagctcgggttgcctagctgcttctctgctttgcttgcctccgtgggagtgaggt

SEQ ID NO: 67662 - DNA, 522 bp, Triticum aestivum
  Clone ID: PAT_TA_67662
gtgtctcctcactcgacctcccctgcctcctcacctgactggcacagataggacgatgtgcagtcaaagggagatggcggcgctcgatccgatctgtaggagagagaagatgagagggagagatagaaggaaggagagaatggatggtgtggtcttcatgacgcgtgtggaggagcaggagagaagatgggagagagagggagaggatcttgaggaagagtataggacaaggtgatctctctctctctctctctcatctgcctagattgatttcgtttccaggttataatttttacggggggcaaatgcttcagaaaatctgtgctgcatactggaatcatgttgttcaaggtaaaaccagcaaagttctctttgatgttctttacattagattaacctgtttcttgcaatatcccaattttttttgcctattttagtgcaatatttagaactgtactaaccacagattcagtttggaatttgaactatgtcccgtcgtttatgtttgagacactcgaacat

SEQ ID NO: 67663 - DNA, 512 bp, Triticum aestivum
  unsure (1)..(512): unsure at all n locations
  Clone ID: PAT_TA_67663
ggttatggccttaattnaaaattattttctttgccaatatatactaaagtggaaggctataattttagtggaacaaatacagatgaaaacatgatgtgatataccagtgacatgagcatgatgatgtttccattgtcaaaacggaaaaataataatatgcatataggataaaattgttcttatttgaatttagtgtaaatgtacatgtttacatgtgaatcgacgcattcacttatcatgtaacgagaatctgttatgggaagtatagcagcgtgtttcttaatgccgttgaatggttaatcggtcacataatcctatgaatcagttattttcctgattgatagccttttttcctatttaataactgaaacaactttcttggtcgtcattttggctttgtgaccgaaatgtgaagcacattatcgagacaaattagttctgaggtgatctttatctgaatttccagtgtcacagttgttcttgcatatcttatgaagaagcatcagatgagc

SEQ ID NO: 67664 - DNA, 373 bp, Triticum aestivum
  unsure (1)..(373): unsure at all n locations
  Clone ID: PAT_TA_67664
gaaaatgttagggttctgtgaagctggtctctgggacctaaggacttacattgtcagagaattgtccttgttgagtggaacatgtntggttaggtgggcttgagtgagcttacccattgcctggtttgccttgcaaaaacatgagttggtaattcgccccaatctcagtacactttttgagttgacccggctgatgagcgctcatgattcaagaaacaattgtttcaaaagggagggcaactattgcacacctacatgttataactaggtgcgacaatcatncagatggtctccaagtccacatcatctaatncttccaaatttcgcccagttgtncatgtctcgagcttgcntaanatcattaacactagat

SEQ ID NO: 67665 - DNA, 618 bp, Triticum aestivum
  Clone ID: PAT_TA_67665
acggtgcaatccccacaactcccacacatcctccggcgaaaccaaaccccagcccgccgcaccgtcagcacccatggcgcccaaggccgagaagaagccggcggcgaagaagcccgcggaggaggagcccgcggcggagaaggcggagaagacgcccgccgggaagaagcccaaggcggagaagcggctgccggcggggaagtccgccgccaaggagggcggcgacaagaagggcaagaagaaggccaagaagagcgtggagacgtacaagatctacatcttcaaggtgctgaagcaggttcaccccgacatcggcatctcctccaaggccatgtccatcatgaactccttcatcaacgacatcttcgagaagctcgccggcgaggccgccaagctggcgcggtacaacaagaagcccaccatcacgtcccgggagatccagacctccgtccgcctcgtcctccccggcgagctcgccaagcacgccgtctccgagggcaccaaggccgtcaccaagttcacctcctcgtagagtgctcctgctcctgtgtctcgtagttagctgtccgggtgtgtttgtggccgtgtaatcgtgtaagaatcgcaccgtgatgtttc

SEQ ID NO: 67666 - DNA, 469 bp, Triticum aestivum
  Clone ID: PAT_TA_67666
gcaaccttcccccgatctctctggtgccaggcgccagcgccgtgcatctctccccgctcctcgatctctcctagcaccgccgctccccgcttcccctacctcccggcgccgccatgcccacttcccttgcctcctggtgccgccgctcccctccaccccgcttcccctacctccaagtgccacagccccaacctccgcgtgcaaccaggctgcattccgccgtcgcctcttgctctggcgtgcctcccatcaccctggctccggaacgcctcccaccgccacacccccggccccggtgcacttcctgccatcgccttatctccagaagccgcggccacccgtgaccagcgacggcacaaacagctacagatccagtgggattcgcccccactcctgtccatagtcgcgtggctcgcggcaaaacagggccgccgagaagaacatctcccgtccggcaaggagcacctca

SEQ ID NO: 67667 - DNA, 353 bp, Triticum aestivum
  Clone ID: PAT_TA_67667
ggaaagcaggaaaattcaatagggagatgttccgttgcaaatccaggttgtgtcctcgagaagtgctcggtttgtatcacttgaagtgcctgcagaaaagtgcagttaatccgtttagagtgtgtcccatcaagaagcactcagtgtgtgtgcattgagatacaatgtgtgtagagtggggctacctgattcactttttcctcgtccggagtgattaaacagcgtgagtgatacttcttcctcaaaattatgacgagaacataaaaaagcaaaattacccatcgatagaatgtttataagatgaatttgacaccttgcatgaacgcaatcaccaagtatttctaaaaaaaaaa

SEQ ID NO: 67668 - DNA, 577 bp, Triticum aestivum
  unsure (1)..(577): unsure at all n locations
  Clone ID: PAT_TA_67668
ggcccgagncaggccatcccagcagctgtcgctgcccctctgtcctctctctcagctttttccttctccttctctctgtcactaatctttgttttctatatggaaggaagtcgccatggaacgatccccgctgccttggagctcgccccgcgttcggcccaccacctctctgtcggcctcgacctcctccgcctcgatccgtccgccccgccgccggatccacgccggagctgccgtgtccgccgcccagaccaccaatcaagagtcacctcttgcatgtcgtgcggtcgggaggagggcgaccgagaggagcacccattcatctgccgcatgggccgccttggagctcgccttgccttcgggccgccacctctccgtcggcctcgtgctcctccgcctcgatccatccgccacaccgccggatccgccgcccagatcaccaaccaagtgccgcctcttgcctgtcctgtgacctggtcaaataacaaaactgcagggtcctttttgtaagaacgaatcgttttttgggattagccactttaaaataggaccgcgggtgaatttcagaaatagagag

SEQ ID NO: 67669 - DNA, 294 bp, Triticum aestivum
  Clone ID: PAT_TA_67669
gatggcagatgagaggagataagatcatgccaacgaacatatcaaacacacgagtggccgcctggttccagatctgccctcttcctctgtccaccacctcatccccacgcggccacgccatctccttcctcgatcctcacacacaaagagaaatgtagcaggcggctccatcacctgtcgcgtgcggcggaggccagcccagatccgcctcctccagcccatcctcttcgtcacgcacaacgggaaaggttaggtttgagctccgccaccccgtcacatgccgttgttcgtcgg

SEQ ID NO: 67670 - DNA, 621 bp, Triticum aestivum
  Clone ID: PAT_TA_67670
tcggcacgagggttaaggttatgcttgatagtgccatagacaccaaagttagcaaattcgatggtttgaaagaagtatcagccacagatttaagcacaaggttcagtgatgtaaagggggttgatgaagccaaagctgagctcgaagacatagttcactacctacgagatcccgatagtttcaaacgccttggtggcaagcttccaaagggtgttttgcttgtgggccaacctggcacagggaagacaatgctagcaaggtcggtagctggggaagccggcgtccctttcttctcgtgcagtggcagtgatttcgaagagatgtatgttggtgttggtgctaggagagtgagggagctcttcagtgcagcaaagaagcgatctccttgcatagtatttatcgatgaaattgatgcaattggtgggcgcagagacactgaaggtgtaccgtcacagaggccggctctgaaccagctgcttgttgagatggatggcttcaagcagaatgacgggattattgtgatcgcagcaacgaccttgccgcagtcactagatagtgctcttgtcaggcctggacgttttgactgtcaagttcatgtttcggttccagatgttgagggcc

SEQ ID NO: 67671 - DNA, 478 bp, Triticum aestivum
  Clone ID: PAT_TA_67671
gccggcctcctctccgccattgctgcccacctcccgctcctcccactaccactctaacctcacatccagaaccatccggttcagtccatagaaggggagggaatggctgcggtggcggaggatgtggaggcgttcctggcgatgtgcgcggtgttgggggatgcagcatacggtgcaaccaaggccatgctggagtggctcaacgcgccggccaagcgcgccgaggccaggcggctcctcggcaccgtgcgatgacgattcaccatcggcggccctgccgcaggcctcgagtgcttccgcatcagtggagaggccccaattcctccctaggtctgcacaccgacgccagccgccgcaaccggaaagcgctctccagccactgccatatgcctggtttctttaccttcttttacttttatggatttatagctagcaatagaggaccatagatggggaacaaattgaggaggtacgacgg

SEQ ID NO: 67672 - DNA, 569 bp, Triticum aestivum
  unsure (1)..(569): unsure at all n locations
  Clone ID: PAT_TA_67672
gcagntatttgtgaagcacactcacgggcaagnaccatcacccttgtaggtggagtcgtctgacaccatcgacaatgtcaaggccaagatccaggacaaggagggcattccgccggaccagcagcgtctcatcttcgctggcaagcagcttgaggacgggaggacccttgctgactacaacatccagaaggagtccacccttcaccttgtcctgcgtttgcgtggtggcatgcagatcttcgtgaagacccttaccggcaagaccatcactttggaggttgagagctctgacaccatcgacaacgtcaaggccaagatccaggacaaggagggcattcccccggaccagcagcgccttatctttgctggcaagcagctggaggatggccgnacccttgccgactacaacatccagaaggagtccaccctccacctggtgctgcgcctgcgtggtggcatgcagatcttcgtgaagacccttactggaaagaccatnactctggaggtggagagctccgacaccatncgacaacgttaaggccaagatccnggataaggagggtnttncc

SEQ ID NO: 67673 - DNA, 131 bp, Triticum aestivum
  unsure (1)..(131): unsure at all n locations
  Clone ID: PAT_TA_67673
cgtgctccgtggcaggcgcagntgctccgtggagatccgnctttttggaggtcaagtaacttcatggaagaatgaccatggcgaggagttgctttttgtcagnagcaaggccatcaagcctncaaaaccgt

SEQ ID NO: 67674 - DNA, 276 bp, Triticum aestivum
  unsure (1)..(276): unsure at all n locations
  Clone ID: PAT_TA_67674
agctagccaggctcgcttctgcccttggtagagaaatccatagcaacaagtcctgagaaaacagcacgaacaatcaagcaacagcttgctgctttagctccaacacttgaacaactgggcaagcagaaaaaggagagaataaataaatttgctgacataatgtcaagaatcgagcaaataaggggtgagattgctggcaatcttgagataggccagnaggtagcaataccacaaatcaatgaggatgacttgacagatgagaaacttcgggacttc

SEQ ID NO: 67675 - DNA, 560 bp, Triticum aestivum
  Clone ID: PAT_TA_67675
aattcggcacgaggagagcaaaaggggatcggggggtcagttatgcgccgccgcctcctgccgtgcgcccatctaacccctctcgccgtcgcaatttccgtcggatgcctcgaatgaggatccagtgctgcttgcgaacaggcgaccaaataagcagctccccttttgggagctgcagtctccaatcgaatcagcaagagcagcagcgatccgcaatcaagcggctcctctccgagctgcaaccggcaatccaagcaatcaagcggctcctccccgagccgcagtccgcaatcggagcggctcctttttttagtggctaatcgggaatcaaagcagtcctttccggattacaatcagaaacaggccctctttcgaattcagtctccgagtctccattggtggcgggaacccagcagctatatatactgcgtcgcccgtcaatcttcggagaagacgcgcagcagcaactgcctagacatcagttttcagactgaccggcggcaactcaggcgatggcgaggactagtcgccggcgacaggctgccaaattgatggccaaa

SEQ ID NO: 67676 - DNA, 511 bp, Triticum aestivum
  Clone ID: PAT_TA_67676
acatcaggagccgccatggctcccgagcctcgcaggtcagccatggcccctgcgcctcgcagggcggccatggccccccccttctctccctgccggggcggtgcgccgtcgcacagccaggtcccggatggatacacccatggccgtttcagtctgttcagatcggaggggttctttgcgcgagtcccccgcctgtctgggtaaactgaggcggcctatgggctgtcggagcccttgatggatgccgctgtgcgccgtctggatggcgcggcgcggcgcgctgcgacgagccaggattttgcgcatcagccaatggcgaacaacaagaagtctgctgcccgtactgaagctagggctccaccagttggtagaagggctggccttcgactagacgcacagaccgagcgttttgctgccgaagctgaggggaatggactcgcggttttctggggagttacggtgatgcttagagagcgtactgccaggttctttgaaccaaatttctgcattg

SEQ ID NO: 67677 - DNA, 622 bp, Triticum aestivum
  Clone ID: PAT_TA_67677
ttcggcacgagcttcaacaagttttttaatgcactctcggcaagtgtgcattgttcccccttttcccaatatatacaaggttacagaagccattcttgtaactgatactgtacagtttgtgtttgtttgatttcgttagctacacattgtattttattattctttacgtttcttgcagccacaaagtgtttacgtactccctccgctcctttttactctgcatataagaattgtctgaagtcaaacttcataaagtttcaccatatttatatgaaaaaatattaacatctataatgctaagtttatacaatatgaaaactaaagtcatgacgcatctaatgttgttgatttcacattctgaatgttggtatttttttctataaacttggtcaaaggtcacaaggtttgacttcagacaaatcttatatgcaaactaaaaaggaccggaagggggtattagtttcatttcctctgctagaaaccatattcgttccttctacattttctggtagctacagaaacgttatctttgtggcactcataaactaaggagagacacatattgacattacacaacgtgcagtttttattatttgtaaataagaattttagtacatcatcc

SEQ ID NO: 67678 - DNA, 287 bp, Triticum aestivum
  Clone ID: PAT_TA_67678
tgtctccggtggtttcccctccgacctcgtcgcataaaacattgaaatgcgacgaagcggccgattcagcgaaatgcgttttctttctttgttacctcggcacgttagagaaattacgcaaggttgacatcaacctacgagctgtcgtttggaattctacatttcttgaggaatacaacggcataggtgagattcgtgtgttctctaaagcacaagttgttgtgtcaggaaccaacatccaatattctccaacgtctgttgtaacggatgaggttgctacaagtgtt

SEQ ID NO: 67679 - DNA, 589 bp, Triticum aestivum
  unsure (1)..(589): unsure at all n locations
  Clone ID: PAT_TA_67679
tgcaggnaattcggcacgaggctngagatgttccagtcccctccgttttgctcatcctcttggcgctctccgtcgtcgtcacgcaggcgcccttcttccgggctcggcgcctgattagcgatgacggcggtggccgcgctacggcttgcaccaaggacgccgcctcctgtgactgcgattactctgatgggaaatgggtgaggagccgctccactgatgctatgccatacggggaggactgcccgttcctcgaccccggcttccgctgcgtgcaaaatgggcggaatgactcgtcctttcgacactggcgttggcaacctcgccgcggcagctgccacctccctaagttcaatgcgacggatatgctggagaggagccggaacggccggatcgtgttcgtcggtgactccattggccgcaaccagtgggagtccatgttgtgcatgctcgccgccgccgtgcctgccggttcgaggatatacgagcagttcggtaagcccctgagccggcacaaaggctatctatccatggtctttgcggactacaacctctccgtggagtactaccgtgcacccatgcttgtcatggt

SEQ ID NO: 67680 - DNA, 296 bp, Triticum aestivum
  unsure (1)..(296): unsure at all n locations
  Clone ID: PAT_TA_67680
ccgggtctgcaggcaattcggnacgaggcacaacacataccctaaacctaaccctcccacgccgccgccccggnatctgcgcgccgccgccccagatcagctcgtcgttcccctctcgccacggcatctcggaccctggcctcccttcccttatcccgcactcaaggaggagcagcaacatcccgctgacgagcagcaacgcctcccgccgtgctgagagtgaggagcagcaacaccgtccaccggnaagcagcagcagcgtcgtncgccagcgccagctggttcagaggagctgc

SEQ ID NO: 67681 - DNA, 247 bp, Triticum aestivum
  unsure (1)..(247): unsure at all n locations
  Clone ID: PAT_TA_67681
ggaaggaggcaagcaaagcccaaaaatcaacatccaatgctttctctatgtttgatcaaaacaaaattcaggaattcaaggaggctttctctatcatggaccagaaccgagatggttttatcaacaaaatcgacttgaaagatacatacgcagctttgggaatccgcgacgtnagcatggacaaacttgaagcaatggtcctggaagctncgtctgcaatcaactttaccgtnttnctcaacatgat

SEQ ID NO: 67682 - DNA, 573 bp, Triticum aestivum
  unsure (1)..(573): unsure at all n locations
  Clone ID: PAT_TA_67682
cggcacgagggttcccccctccggnatttcgccagcaccatcctctgcgacgtgggggtggtggtctgcgccgccgacgactgcgaccacctcggctgccatggcagccccttcctcgtgggctacgtgggcaccgactacaggagcgcccacgcctccgtcttctcttcggagacgaatagctggagccccgttgtctcttgcccccaccctgatgtcgagatcctgagaggccagcccaagccccttgttgggaatgccgtctacttcatctgcgagtaccacccggatgagagtttcattctgtgcttcgacctcttcagccggaaactgtcaaagttcgacgggccacccatccatcactataagtatgccctgatgaaaacagaggaaggcgtgctgggatgcgcgagtatggagggatctcggctttgcctgtggtcgacggagactggtcccgacggagctgtggcatggatggaaagcagggtcattgacctccacaagctgctctcttctaactcattcctccatgtgattggctttgaggatagagctggtgtctattatctg

SEQ ID NO: 67683 - DNA, 627 bp, Triticum aestivum
  Clone ID: PAT_TA_67683
ggcattgtgctgcaatgtcagatcttcgccaccggatcctgcctccaatttttctttcagaaagtcccaaggaggctggcttctgcctttggctattgcatccggatcctttttctcgaccaaaagcaagagacattctaggatgtgacttgataaatgagggtcgggatttatcggtgttagataaggcaccagctgctatcaatgaggaggacacagagtctggtttgttactgaattttctgtctcaactgaaagaagaaaaggagatgcatgctgccaagttatcagcagatcttgcaagcttgcagactgatattgtagaggctgagagaagacactcgtttaggatggggttcagtttagaggacatggatgtaccagcaagttctaatgatgtgccaggtacttcatcaaatgccctgagaggggcattgttgtcaggaggcaggtcaggcatatacgaggagagggtgatgaagaatttgcagcagcttgaaaatgcatattactccacgaggtccaccattgacacatctgagactaatgtaattaagcgttccgataatgatgctttgagggtccgtgaaaactttaaccacagtgatgccgatgctatgaatgggc

SEQ ID NO: 67684 - DNA, 486 bp, Triticum aestivum
  unsure (1)..(486): unsure at all n locations
  Clone ID: PAT_TA_67684
gaggaattcggcacgagggaagaggggttctgaatngactcgtcttcagactctgattatgtcatatcagaggaggaacttaaggatttgggggtgcctaggccccaagagaccatgccacagctgccttcgcccccagcacgaaggaccattgctcctaggagggtagacgagaagggaaaagagccagaggaggctttgaaacagatatgtggtatctgcctctcagaggagcagagagctacaatacagggtgtgcttaattgctgctcacactacttctgcttcgcgtgcatcctggagtggtcaaaggtggagtcgaggtgtccactgtgtaaacggcgtttcaacacaattaccaagtcatcagtggcagatctaggattggggttgaggaatgctcccgttagggtagaaaagcgcgatcaggtataccagcnccactgaagatgaaatgaggcgttggntngacccatacgaaaatgt

SEQ ID NO: 67685 - DNA, 600 bp, Triticum aestivum
  unsure (1)..(600): unsure at all n locations
  Clone ID: PAT_TA_67685
gcaggnaattcggcacgaggcctcgccattcacacagtccttcctctctccgacggacccgaggaccccgtcgcggttctagtctgccaacctccggcgagcgaaccggcgaagactaacgcgacgcagcgaggacgcaccccacctgctcgacggaatgctcccctaggaagcagctcaagaacagcgaagcaccgtccgcggcggagatggacgacgtccttcccatcgtcatctcgttcctgccggcgcacgaggcggtgcggacgtgcgtgctctccccacgctggcgccacttttggacatctgcgcccggtctccgcatcaccgccgtcggggacttcgggagcgccgataagttcaatcagttcgtagaccgcctgctcttcctccgtcgccactcagactgcccactggagtcatgtgagttcgatctggacgacagggagttcggtttcaactccatctcgtcctttcagcatgtgtatcgctggagcctgcagtctgctttagactgcaatgtccgggtccttcggtgcagtttcacggacaccaaccccaacttccgcatgcttcccgagcaactatctgaatatccag

SEQ ID NO: 67686 - DNA, 588 bp, Triticum aestivum
  Clone ID: PAT_TA_67686
agcccccaccaccgaagctcccaaccccacccgaagcggcagccatggcccccaaggcagacaagaagccggccgcggagaacaaggtcgagaaggcgacggagaagacccccgcgggcaagaagcccaaggccgagaagcggctgccggcgggcaagacggcgtccaaggaggccggcggcgagggcaagacccggggccgcaagaagggcagcaaggcgaagaagggcgtggagacgtacaagatctacatcttcaaggtgctgaagcaggtgcaccctgacatcggcatctcctccaaggccatgtccatcatgaactccttcatcaacgacatcttcgagaagctcgccggggagtccgccaagctggcccgctacaacaagaagcccaccatcacctcccgggagatccagacctccgtccgcctcgtcctccccggggagctcgccaagcacgccgtctccgagggcaccaaggccgtcaccaagttcacctcctcctagactgacgatgcgtcgcttgttgtgacagatgtggctgtctgatgtatctgcaagtagaagtagtagttcgtgtggtagaaga

SEQ ID NO: 67687 - DNA, 172 bp, Triticum aestivum
  Clone ID: PAT_TA_67687
gtgccgtcagaaaacaacggactttgcggtggcctgcaagcagcccggtgagaaggggccctgctcaacccacttctgccacacgtgcctgttcaacaggtacggcgagaacgcgaagcaggcggccaagaaggcgcgctgggcctgccccaaatgcaggggcatctgcaac

SEQ ID NO: 67688 - DNA, 278 bp, Triticum aestivum
  Clone ID: PAT_TA_67688
aggaattcggacgaggatttcgtccgtttttgtccgtttgggtccgcgtgggcagaaatgacagccaacacgcggacgtaaatccattttgtctgtctgctgtctgcgtggacgcaaatccgcccaaattatttgggccaggtttgcatccacacaggcaccagacggatgtgttgcgcgtccgctcggtgttcggctcggccccacgtgtcaaccacccaaccacccccgctggttcttttaaatgcacgcgtgccagggaccgggggggggggcac

SEQ ID NO: 67689 - DNA, 354 bp, Triticum aestivum
  unsure (1)..(354): unsure at all n locations
  Clone ID: PAT_TA_67689
cgaggctttcttacacgactgctgctgttcttcttctcctatcctgcttgcgcccgacctctgctgctccttcttctcttgcctcgctgctgctcctccacctgtgaactgctcctttgctgctgctcttcttctcccacgacctctgctgctccttctcttgcctcgctgctgctcccccacctgtgaacttcttccctgctgctgctctctcaacctcctgctgctgcttcttctcctatcctcacgctgatcctattccctttccttgctagtgttccttcactgaagaaaacaacttgatgctganctttacttgntgctgatcctgngctnanagtgaatncnaaacgg

SEQ ID NO: 67690 - DNA, 109 bp, Triticum aestivum
  unsure (1)..(109): unsure at all n locations
  Clone ID: PAT_TA_67690
aaacagctatagncnctaatgacttgtttcgttgattgaaatggaccaatgatacgattgtaaccactagttccattagggcatcctgcatttgctacggngaaatcgg

SEQ ID NO: 67691 - DNA, 629 bp, Triticum aestivum
  unsure (1)..(629): unsure at all n locations
  Clone ID: PAT_TA_67691
ggcgctgctgagttcctagccacccctcgccccggatcggacaaccaagggcgccgcctgctcccgttccccgtggtgcccggcggcgacggcgatggagaggaccggggagaaccggaggccggcggtggggaagcccgtgccaagcgtccgagagatggggaatcggaggccgctcaaggaactcaacaacctcgcgggggctcacccgtacccctgcgccgtcgccaagaagccgatgctagagaagagtcggagggatgagaagaagccagcattggtgacccatcgtcctatgacgaggaaactcgccctcttattggagaacagagaacaacttgaccatctggccaccgcagctgatgcagcaaaacccggagttgatccccaggatgagcccatcctggatgacaccgctgctgacactgatgaggagatcgagtcggtcgacgacgatactgacatggatgaggaagaacaggaggatattgtggatgatgtatccctcatggacatcgacagcggcgactctgggaatccgctggccgcaactgagtacgtcgaagagatttacaggttctacagagaaaatgagaaaatgagctgtgtgcgtnctgattacatgtcca

SEQ ID NO: 67692 - DNA, 535 bp, Triticum aestivum
  Clone ID: PAT_TA_67692
gcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagcccgcggtaatt

SEQ ID NO: 67693 - DNA, 579 bp, Triticum aestivum
  unsure (1)..(579): unsure at all n locations
  Clone ID: PAT_TA_67693
gtttttttacagccggggcctcgagggctcgaatacaagagctcgatnatagacgggtcagcgaaaaaaacaatatctgagtacagacataagttaaaaaagtttgccttcagaaggctagcacaaactgggatacagatcgaaagaggcgcaggcctcctgcctgggatcctcctaaactactcctggtcgttgtcagtgggctgcacgtagtagtaggcacttcccgagtagtagtagtcgtcatcaacggtggcgtctggctcctggactccaacgtctggttgctctggcaagaaggaggggtcatcttcgatcgatgtagtcgaacacacggacatcggcagcggtcttggtgtcgtgagtccggaggagcagatggcaaggccgggggtggtcggagcggtgcggatcgatggcgagatggcggcggccagacgaagaagacgatggcggcgttggcgatgcagcgccctggctcgagctggtgcccggaacggacgaagccagccgcgacggacctcctgggcgtgctcccgcacgccggagaggtcgatggccgcgacgatgacagcgagg

SEQ ID NO: 67694 - DNA, 509 bp, Triticum aestivum
  unsure (1)..(509): unsure at all n locations
  Clone ID: PAT_TA_67694
cgagggaatcctaaagttcttcttctcgatgaagcacgtctgctctcgacgctgagagcgaaaaggttgtccaagacgccttggatgcggcgagagccggcagaacctgcattgtcatcgcccatcgtttgtcgacggttaaaaatgctgacgtcatcgctgttattgagaatggttgtgtggttgaaagtggaactcacagcgagctattggctctcaatggatcttacttcagtcttgttaatgctcaattgcataataaaaagaacgagtaattagcttaaatacttaaattagacaattagtgcagagtactgtggggtaagatggatttgttaaaagtacagcaaaacaacctattgtctaagagtgtttnaaataattaaaaatgctcttttagggttgtgaggatgcggttatataattcagtaaatatttttcatttactacgaagtaatatggtaaaatagaattagggcaagtccatcttaccccacctattataggta

SEQ ID NO: 67695 - DNA, 663 bp, Triticum aestivum
  Clone ID: PAT_TA_67695
agatcgctcacaccatggggaccgtgttgccccaacaccaaggcaacgccgtcggggacaacgctatgcccgacctggagatcggtcaacccaccatggagatcgatcaatccaccataatcaacatactgcactccatgctaccctctgcctcgccaccggcggtagcacaactggggcgcgcgctgtgggggctgggctccctcacccttgtcctggccctcaccaccgtgctccacctgccggccgccggacctgtcttcgcccactacaaggcagcatactatgccatccttgcctttgttctctttgtcgcagtgccggtggagctggccactgccttctgcctgcccggccacggccgtgatggccgcctccgcgtcttcgcctggaatgctgttcttggaagttagtcttgtagcatttctacttcaaggaaatgaagccagcggttatgatgtccttggcattaatttgttacatctgcagctcaagaatccgttttgggctactccaaggaaaaataatggtcactgaggatgacttgtaaggaggaataaatttgttggttcgacaaaccactgaatggtacccaagcctaattgcaggggtcaccttttgtcactaagcaccacatgctacatgctaagtgaactgcattcc

SEQ ID NO: 67696 - DNA, 187 bp, Triticum aestivum
  unsure (1)..(187): unsure at all n locations
  Clone ID: PAT_TA_67696
aacggcanagntattgggctagtgctttctcagtgtggcacggataagaccaaaaatgatatcaagattggacttttagcctctcatgctcagaagattcgtgatgacctactagaggaaagcaagaaagaaatgaaggtagctgagcgctctgaggaaagcaagcagcatgaagaaggagctgaga

SEQ ID NO: 67697 - DNA, 480 bp, Triticum aestivum
  Clone ID: PAT_TA_67697
ggccgaggtggtgacatctagctcgtcggcggtgtgcgactgtggcggccgcaccatgagatcgtcgtcgggctctgagccgccgccgtccgttgtctccctcggcgacttcgtcggcccggcctcccgccacatcgtctccctcggcggcatgagatgtggtgaatggcgcagaggatgggggacaagtgcggggacatcccgcgtgggacgcaattcctgctcgtggagtccaaggccggcgccggcgaggaggaggtgtcgtacgtcgtgttcctcccgctcgtggagggcgtgttccgggccagcctccagggcggcggtgcgggcggcgataagttccagctctgcgttgagagtggagacgctggcacgctcgccagttccttctaccgcgtcctcttcgtgggcgccgcggagtctgaccctttcgccgccatcgccggcaccgtcgcggcggtctgcctcgggaaccttccg

SEQ ID NO: 67698 - DNA, 194 bp, Triticum aestivum
  Clone ID: PAT_TA_67698
cgctccctcagcctctgccttctcgttctccaacagtgcatccgctgctcccaccacgcctgcctctgcgcccgccagtggtttctccttggccacttcgcagcctgcctctgcgcccgccagtggtttctccttggccacttcgcaggctgcatctgctccgtcattgttctctaatactggtgcagctgcaa

SEQ ID NO: 67699 - DNA, 179 bp, Triticum aestivum
  unsure (1)..(179): unsure at all n locations
  Clone ID: PAT_TA_67699
aacctgtgcgcgcaccttagcgaccccttcggcaacaacctgctcaccgtcatctccggcgccgccgagnagggtgcccagcctgtgagctggccgttaattgcccgtccgccgccgtcggctgttgatgatcagctgcatgcgcgcgatgcatcatcatgtgctgtgtgaattttacc

SEQ ID NO: 67700 - DNA, 371 bp, Triticum aestivum
  unsure (1)..(371): unsure at all n locations
  Clone ID: PAT_TA_67700
ctatgtggccacanantgttgttcagtcactctgttacaacatattgctaaacatgaaaatctagcagtgtttaaatgttgtctgttgcttcctcagatgtttaagttagttcagagtagatatatgcatcaatattttattctttgcagaattagaactagaagaatgcttgctatgtggacaaaagttcttgttcagtcactctgttacaacatattgctaaacatgaaaatctagcagtgtttaaatgttgtctgttgcttcctctcttaatatgtctagctgaattgtacacataatctttcttatagagtgtaatagaatctttcttacatatagtatagttgaaaatcacatgtacagactagtg

SEQ ID NO: 67701 - DNA, 166 bp, Triticum aestivum
  Clone ID: PAT_TA_67701
catggcagttaagcctcgtaaggtgaacgaagctgtggtcagtggatggctctttttccgctatttagtcattggtgcttacgttggtcttgccactatagcggggttcgtttggtggtttgtttattctgaagatggtcctagattaccatactctgaattgatc

SEQ ID NO: 67702 - DNA, 467 bp, Triticum aestivum
  Clone ID: PAT_TA_67702
acatgtctacatcttacgatattgcagctgttgatataaaaaacaaaacccatatatatcaccaccaaaactatatgttgcaattcaagcacaacactaaggttcaccgacttgaaaccagaggaacaaatataccaaagttttccttcaatttttgtccatttgataatctaccagaaaaagatacttttgcaaaaccacttcaagatataataggagtcattagccatttgattatgcaagtcagacatgtacaaattaactcaggaaaatcaaaattcaaaacctagatgaacagacacaagaaatacgtctttggggccaccatggtgaaacatttgatgaagaagctgtactaaaaaaatcacaagaaggcattatagttggcatttttgcgggtctcacagcttggagctttctagctataaatgggaatctccggctctgcgacaacaactacctcaggt

SEQ ID NO: 67703 - DNA, 220 bp, Triticum aestivum
  unsure (1)..(220): unsure at all n locations
  Clone ID: PAT_TA_67703
gggggagggcgactccggccagcaccgctgtaaggttcctgctcgccattgccactccacgcttaaatccatgtttttttgcagcaccaccattgntgcgacgtgtcatctccctcaactccggccgtcgtcacacggcggagctgcgttgcaacgccaccggtgctaccagtggaggaggctgcggtgagcacatctgctgctgcgtgctgcttattgc

SEQ ID NO: 67704 - DNA, 387 bp, Triticum aestivum
  unsure (1)..(387): unsure at all n locations
  Clone ID: PAT_TA_67704
ggcggatgaacgcgctcacgccgccgtcgggggccagggcaagctcgccgcctgccgctacctcgtcgagaccgtcaggatggacgtcaacatgtgggactcctccccaagcaagaagacgcccctggagcacgccgtggacggcaacaacctgcccgccctcaggtacctcctcgaccatggcgccgacctcacccaggaagaggacgacggcgacactgttcttcatcacgctgcaaggagagggaggtgtgaaatagtaaagttgctgcttgctagaggagccgacgttaacggcngctcacaacacgggacaccactccatcttgctgctgttaaagggcatgagagcactgtggaggctctgttggaacaccatgcagatgt

SEQ ID NO: 67705 - DNA, 276 bp, Triticum aestivum
  unsure (1)..(276): unsure at all n locations
  Clone ID: PAT_TA_67705
ccattgccggcctncacccccgcatcgacgacgaggagccccgagtacccacgcctccctgccctcaggtctatgacaccgagaatgcaaaccagaaggagaagttcgaggcggacctcaagaaggagatcaagaagctgcagcactactaggactagatcaagacctggattcagtccagtgagatcaaggacaagaagataccttggtatgggatgaagtgaagagtgtggantnacttgaccttcggtacccgcgtgtgctctaccgaccgnc

SEQ ID NO: 67706 - DNA, 591 bp, Triticum aestivum
  unsure (1)..(591): unsure at all n locations
  Clone ID: PAT_TA_67706
aatccccccaaccccgatngccgaagcatcgatggcccccaaggcggagaagaagccggcggcgaagaagcccgcggaggaggagccgacgacggagaaggccgagaaggccccggcggcgaagaagcccaaggccgagaagcggctgccggcgggcaagaccgcctccaaggagggcggcgagaagaggggccgcaagaagggcaagaagagcgtggagacgtacaagatctacatcttcaaggtgctcaagcaggtccaccccgacatcggcatctcctccaaggccatgtccatcatgaactccttcatcaacgacatcttcgagaagctcgccggcgaggccgccaagctcgcccgctacaacaagaagcccaccatcacctcccgggagatccagacctccgtccgcctcgtcctccccggcgagctcgccaagcacgccgtctccgagggcaccaaggccgtcaccaagttcacctcctcgtagattgccatgttcgcatctcagaaactgtagtttgctgccgtgtatctaaaactagtgtttattgctgaatggaaattcgtggaatgctgttaaaaaaaaaa

SEQ ID NO: 67707 - DNA, 404 bp, Triticum aestivum
  unsure (1)..(404): unsure at all n locations
  Clone ID: PAT_TA_67707
tggcccactcctcaaaatgtactgaactcagaggttttttggggctcacaggctattacagaaagtttgtgcagggatatggcatcatttccaaaccactgactcaattactgaagaaacaagcttttatttggtcccctgaagctcagcaagcttttgagaaccttaagacagctatgatgactactcctgtgttagtactgcctgacttggagcaacaattttgcattgcaacagatgcatgtgctacaggaattggagctgtactcactcaaggaggccatcctgttgctttttatagcaaagctttgggcgtcaagaatcaatctctgtctatctacgaaaaggaatttctagcaattatgatggcggntgagaagtggagagcttatttgcagagaggt

SEQ ID NO: 67708 - DNA, 625 bp, Triticum aestivum
  Clone ID: PAT_TA_67708
gaagcgctaccagtggaaacaccctcatcggatatgcttgttgattccttcgggaggttccacaactacttgaggatctccttgactgaacgctgtaacttgagatgtcaatactgcatgcttgccttagtctagagacattaaatattagtttgaacacattggttcctgcaaattcggaggcaaagaaagtccactgaagaagctctctgtaactgctatttagtcttcaaacacacatgcctattatatcatggaggactattttagtgagcattgttaaatagtagtatatggaagatgtggcttcaactgtccgaaatttccactttgagctcacaagtagttatttctgtaagccattgttcttgttctctttcttttgtttagcccttttctgaactggcataggtttcgttggtaaccttcccctacaccacaacctatgttccataagcaagtttatttatactgcccaaaatttactaatatgggttggatcatgcatttgcaacttatagtgtttgttctttttattgtgctattaactcagcaccttacaaaagttgtgtctttgaaataatggtcaaactgctctctgcagtcctatcattaattatgattt

SEQ ID NO: 67709 - DNA, 431 bp, Triticum aestivum
  Clone ID: PAT_TA_67709
atgaactccttcatcaacgacatcttcgagaagcccaaggcggagaagcggctgccggcgggcaagacggcgtccaaggaggccggcggcgaggcgaagacgaggggccggaagaagggcagcaaggcgaagaagagcgtggagacgtacaagaagcccaccatcacctcccgggagatccagacctccgtccgcctcgtcctccccggggagctcgccaagcacgccgtctccgagggcaccaaggccgtcaccaagttcacctcctcctagattgcatctgcattgcttgtatctatctatctatctatctagtagcgactgtagctggttctgttacttcagtgcttatcgactctggttatctggaactacaaatgctgttagtgctgaatggggaattgattgatggatgattgccaaaaaaaaaa

SEQ ID NO: 67710 - DNA, 441 bp, Triticum aestivum
  unsure (1)..(441): unsure at all n locations
  Clone ID: PAT_TA_67710
tccgccgcgccntcccgcctcctcgtccccttcgtcccgccgctccctcgaccgttcctccctggccctgccgccgggtaccctgaccccaagccttcccacatcgcgcttcccggtccccaccccgctggcggcgctaccgcgctcctaggttacgcggccgcgccgccaccgctcctctgccattcctccaccggacgccgcgcctctcttgcccagggcacgatgatggcctggcggatgctgcggagaaaggatgtccacacaggccttgtgaatctggcctttcgcttggatcatggtggaacgaagcatttcgccactggaacattgggaaggctaccacagtttcgtccatggcaatggactccaaggtgctgctaactgtacggnctttaaacagtccactatcaggaattttcatgcaggtgtgtatatgtt

SEQ ID NO: 67711 - DNA, 615 bp, Triticum aestivum
  unsure (1)..(615): unsure at all n locations
  Clone ID: PAT_TA_67711
gcgcctccgttccccagcccgcgcccgcgagattcatcctcctccccattgctccctctccccagcttagccgcgccccaatcccctactggcctgctcgatgccttgagatcacttttccccaccggaaaccctcgccgccgccgccgccgccattaatttctacgcgcaagctccaatttcaggaggcccagaatgaggacggcgtcgatgtgcaccgcatctactgtgcggggcacgcacacgttcaagatcgccggctacagccttcacaagggcctcggcgtcggcaacttcatcccgtctgccaccttcgacatcggcggctacctctggcgcgtactgtactaccccgatggggagatggagatggagaatggggatcacgcctccgttttcctcgaccttgttagcgaggacaccgaggcgagggcgttcttcgaggtcaggttggtcgacaagactaacaagctgccgccttcggtggtgctctcccagaagacgccgtatgtgttcaacagcaatggacgtaggagctccgtgggcgacgacttcttgcaaccatcggcgtacctgctggacgacagccttgtgcttgagtgcgatgtcacagnt

SEQ ID NO: 67712 - DNA, 178 bp, Triticum aestivum
  Clone ID: PAT_TA_67712
ctactagttttgtaaataaatatcaacactcaagtatggtttggaagcaatctcttctcggctgctttggaaacatgggcctatgtgtcctcgcatgctgtgcctgcccactcgctattggtaaaaacgcgcgaagcggtcggtgaaccgaactcagtcctgtgggtgatttctgtct

SEQ ID NO: 67713 - DNA, 815 bp, Triticum aestivum
  unsure (1)..(815): unsure at all n locations
  Clone ID: PAT_TA_67713
aggaattcggtacgaggcgtgtctcttcttccttcctcctcccctcccctccgagcctgctataaaatccccgccccctcccgtctcttctccacacatccgatccaaatccagccccctccgatcgaagcgaagtcaaggctctttcgtcctcctcctcaagatgcagatctttgtgaagaccctcaccggcaagaccatcaccctcgaggttgagtcctcggacaccatcgacaacgtcaaggctaagatccaggacaaggagggcatccctccggatcagcagcgtctcatcttcgctggcaagcagctcgaggatggccgcaccctggctgactacaacatccagaaggaatccacactccacctggtgctcagactccgtggtggcatgcagatcttcgtcaagaccctgaccggcaagaccatcaccctggaggttgagtcctctgacaccatcgacaacgtcaaggccaagatccaggacaaggagggcattcccccggaccagcagcgtctnatttttgctggcaagcagctcgaggatggccgcacgctngctgactacaacatccagaaggaattcacactccacctggtgctcaggctccgtggtggcatgcagattttcgtcaagaccctgaccggcaagaccatnaccctggaggtcgagtcctttgacnccatcgacaacgtcaaggncaagatccangnacaaggagggcnttcccaccgggaccagcagcgnctnatntttgctggnaagcagctttgaggatggtccncacttttgttggactacaccatccagaagg

SEQ ID NO: 67714 - DNA, 305 bp, Triticum aestivum
  unsure (1)..(305): unsure at all n locations
  Clone ID: PAT_TA_67714
tgggcgtatttgtagcggttgattgtgctctagcacagtatttaatgatataaagatagctaaatttaacactaatacataaagattgaatataaagcaacgttgtatagcgaaaacaaaagcatgacaggaatagaatgcaggttcgctgctttcgtaacatctactttcccgtgattctaatcgngataataaaacaattacccagttgtgtgtatgccaggnnaggcaattgccacatgccaatgacgcgttttattgntttgctacacgtgtgnntngttatataaactttcactttcctg

SEQ ID NO: 67715 - DNA, 290 bp, Triticum aestivum
  Clone ID: PAT_TA_67715
ggttgaactttgggacattaaaaattcaaagaagataatgtgtttgcccaaaagatgcagtgctaatatgacaggtcaccctaccaagcaaaaaggtctatgcatggccgtgcaagctttcatcccgtgtgaatctggaggctatgttaatattttatcaagttatgaagatggaagcactctttggtgggatgtacgaaagcctgggtcacccttatcttcagtgaagtatcattcggaatcaggtgtgcagctttatccattgctattgacggtttatgcaccggtgg

SEQ ID NO: 67716 - DNA, 377 bp, Triticum aestivum
  unsure (1)..(377): unsure at all n locations
  Clone ID: PAT_TA_67716
gaggaattcggcacgaggttttttttgaacggcaatatatttaatatacgaacagcttcacctatacgacttatatttaaaaaagtctatattttaatatatacaagtgcatggtttaaaatacaaagcgtacttgaaacatatattcgtaagcacaccaatacagggtaacattgtctattgaagctggtataatacagtttaatacgatatagagaaaaatatgctaaagatctgtacactgttagacaagttttgaacttaaaaattgttgatttttggtgggtataatatatataatgacagctatgttaattaggtaactggttagttaggttaagactgattaaatagcagtntatgtggaggcattcngt

SEQ ID NO: 67717 - DNA, 309 bp, Triticum aestivum
  unsure (1)..(309): unsure at all n locations
  Clone ID: PAT_TA_67717
cgtccaactcgatcctcnaagatgggatgagtatgaaggaaagcagcgagcatanctgntcatcctctgtaatcgacgacgaagcttgtgcgaggaggggacccactgtcntggcgaggcttatgggtttggattncatgcccgcggcnagctcatctggaccctacccggccccttttaccgggcaacataccttccaagctattgcccatgatgagttgattggcagaagctatgttggcctttctagcccccataagatgccgagtagtcctattgaccggtttagaatggaagccctgcctncga

SEQ ID NO: 67718 - DNA, 323 bp, Triticum aestivum
  Clone ID: PAT_TA_67718
attcggcacgaggctcaccaccccgcctctcccacagctcgccgctggcagcctctcccctcccatgtgcttcccacagacctcaggcggatccccacccatccatctctctctcatgcaacttttctctctctgtcgggacacatctctgccgccacagatgccagccgattccggcgttctccggcgacagccgccaccgcgcaacaccttcccaagctcaccttgctccattgggtcttttcccccggcgggattcgccgctcctggccttcaactctcacccgcaacccttcatgtggctaggtttcaggcacggtggc

SEQ ID NO: 67719 - DNA, 422 bp, Triticum aestivum
  Clone ID: PAT_TA_67719
gctccccccctcctccttgacccgccgccgcttctcccaccccgaaagaaaaacacacacacagtagagagcttcagcttcccctgagagcgagagatggcggcgaagggcgacgggccggcgatcggcatcgacctcggcacgacctactcgtgcgtcggcgtgtggcagcacgaccgggtcgagatcatcgccaatgaccagggcaaccgcaccacgccgtcgtacgtcgccttcaccgactcggagcgcctcatcggtgacgccgccaagaaccaggtggcgatgaaccccatcaacaccgtcttcgatgccaagcgtctcattggccgtagattcaccgattctactgtccagagtgatattaagctgtggcccttcaaggttgttgctggacctggtgacaaagcccatgatcaacg

SEQ ID NO: 67720 - DNA, 656 bp, Triticum aestivum
  unsure (1)..(656): unsure at all n locations
  Clone ID: PAT_TA_67720
cgaggcaacaaatccccacccaatctcgtctccgatcgactccacgctcgtcgaatactcctcccccaccgcctcaagatgcagatctttgtgaagaccctcactggcaagaccatcaccctagaggttgagagctccgacaccatagacaacgtcaaggccaagatccaggacaaggagggcattcccccggaccagcagcgtctcatcttcgctggcaagcagctggaggatggccgtacccttgctgactacaacatccagaaggagtccaccctccaccttgtcctgcgtctgcgtggtggcatgcagatcttcgtgaagaccctcaccggcaagaccatcactcttgaggtggagagctccgacaccatcgacaacgtcaaggccaagatccaggacaaggagggcattnctccggaccagcagcgtctcatcttcgctggcaagcagcttgaggatggccgtaccctcgctgactacaacatccagaangagtccacccttttacctggtgctccgcctccgtggtgggatngcanatttttntgaagaccctcaccggttnatgatnntnntccctttgaggtngangagctntgacaccatnttacaacngttaggcccaagatccagggacaaaggaanggcattnc

SEQ ID NO: 67721 - DNA, 282 bp, Triticum aestivum
  unsure (1)..(282): unsure at all n locations
  Clone ID: PAT_TA_67721
tactctgcggctgcagaagaggctggccgccactgattgaaatgtggcaaaaacaagatctggttggatcctaacgaatcttcaatgatctcgaacgccaattccaggcagaatgttagaaagctaatcaaggatggtttgattatccgtaaaccggtcgccgttcattctcgtgctcgtgtaanaaaaaatacaatcgcgagaaggaaaggtcgtcacactggacgaggtaagcgaaagggtacagcaaatgcccgtatgcctgagaaagnggtatggatc

SEQ ID NO: 67722 - DNA, 466 bp, Triticum aestivum
  unsure (1)..(466): unsure at all n locations
  Clone ID: PAT_TA_67722
gggcacggnaacctacaaatccccacccaatctcgtctccgatcgactccacgctcgtcgaatactcctcccccaccgcctcaagatgcagatctttgtgaagaccctcactggcaagaccatcaccctagaggttgagagctccgacaccatagacaacgtcaaggccaagatccaggacaaggagggcattcccccggaccagcagcgtctcatcttcgctggcaagcagctggaggatggccgtacccttgctgactacaacatccagaaggagtccaccctccaccttgtcctgcgtctgcgtggtggcatgcagatcttcgtgaagaccctcaccggcaagaccattacttttgaggtggagagcttcgacaccattcgacaacgtcaagggcaagatncacggacaaggagggcattcctctcggaccagcagcgttcttcatttttntctggcaagcag

SEQ ID NO: 67723 - DNA, 452 bp, Triticum aestivum
  Clone ID: PAT_TA_67723
tgtccggccgcggcaagggaggcaaggggctcggcaagggaggcgcgaagcgccaccggaaggtgctgcgggacaacatccagggcatcaccaagccggcgatccggcggctggcccgtaggggcggcgtgaagcgcatctcggggctcatctacgaggagacccgcggtgtgctcaagatcttcctcgagaacgtcatccgcgatgccgtcacctacaccgagcacgcccgacgcaagaccgtcaccgccatggacgtcgtctacgcgctcaagcgccagggccgcaccctctacggattcggcggctaggccaccaccagatcagtagcctgatagtcgggtgtagtcgcagcatctcgctgctgtttgtcctgccttgtttgttctctggatgtacttctgtactaggatggaatggaaattgcagcagtttacccttgaaaaaaaaaa

SEQ ID NO: 67724 - DNA, 393 bp, Triticum aestivum
  Clone ID: PAT_TA_67724
gcgtggaactgcgacttccgccagtccgccaccctcacctccaccaacccaagctacggctcgtgtgtgttcaccggaggccaatgaaatggtgcaaccggagtatgcaccagaccacggcgcacaaaattccgccggccggccggtgcggcgagcgccatgattggatttggatcgaatcatcatcatcgaataaagccacgaatagtggtggtggtgcattagggatgcattgctgcattgcatacgcatcccccctgtttcattcaattccatttcatttatcctagcagcagagctgagcagatgcgtccgattctttttactcctagcagtagcagcagagttgccttgctgtgtacagtacgtgggtggtgtgtgcatgtgtaatta

SEQ ID NO: 67725 - DNA, 473 bp, Triticum aestivum
  Clone ID: PAT_TA_67725
ggagagaacggccccccgccacactcacccaaaccccacccgctcccttcccctccctccgccttctccaccctaccaaaccaaaccctagctagcggagcggaggcgcgagcgtcgagcggcgagcggcgaggagaggcccgatggcggacaagcttcgtgagctcactcacaggttccgggccgcgcgggccgacggcaggcttcggctcccctgggactgggagaagccgatgccgtaccgggtgttctactcgccaagtaaagggtgcatcaccgtaacagatccctatccggccagccgagaccccaacgaaggcaaccggcacagggacaagccaccaatgtcaacgcgcgtgaggcggggactccaggctattgaccaatggcttgagctaccagacctggcccgcaaggtgcttatcaagggcggtaagattgtgggcactggggtgacagcagttggtgtctgc

SEQ ID NO: 67726 - DNA, 289 bp, Triticum aestivum
  unsure (1)..(289): unsure at all n locations
  Clone ID: PAT_TA_67726
tcggcacgaggcgtccgcctgctctcccgccacaaacttccgcccgccgtctctgctcgcagatcgccgctgatggcgtctggatctacttcttccggctctgggagggggccttccggcggttctggtccccttgggaggggcctgatctcgtgcttgcacggcagcagctgccgcgccgaggacgcgcccgaccaggatttgcccctggccatcgacaagctcatcgtcggcttctacgaggaggcgntcagccggctcccctgcgacgccatgccggacctcctcc

SEQ ID NO: 67727 - DNA, 500 bp, Triticum aestivum
  unsure (1)..(500): unsure at all n locations
  Clone ID: PAT_TA_67727
tcggcacgagggcgggccgagnaagaagcgccaacgccgagtatggttacgacggtcctcgccgtgacggcttcagcagctccagcgccgccttcgttgggggctgcgcgcttcagcccggttgcaggacccgccgtcaattttagaccgcaagtttgtggactgagatgttggatggctgccaagatgaagctgcagaaggccctgaggagccacggatggcaagttcagagaaagctgggaattcgaggggacggtcaaattcctgactgcttcgaggttgcatcacggactggaaagataactcgtcggaatgtacaacctgctgatgaaactggaggtaataactcgatcgatgacaaaagttcaatgcatctgggactcaaccactctgaagctgatcgtcctgtactagaggaaggcgttgttctgtttgataactttgatgaccaacctgaaagtgtaccatctntttgcattgctgncattggagctactgg

SEQ ID NO: 67728 - DNA, 243 bp, Triticum aestivum
  unsure (1)..(243): unsure at all n locations
  Clone ID: PAT_TA_67728
ctgcggagcaggaccaggtcggcgggaagaaggggcgccgggcgagcaccaaatccaggggcgagaagggcttnatcgagggatgcctngncgnactgtgctgctgctggatctgcgagatgtgctgcgactaaccggccggccggcgaggccgatgctggctggcacaagacctcggngctatagtacccacgaggaggaggagcgtatgcgtatacagagagagaattgttcttaatttca

SEQ ID NO: 67729 - DNA, 306 bp, Triticum aestivum
  Clone ID: PAT_TA_67729
ggccgccgcatcctccctgctgctcgcccagtcgccccccgccgtcccgccggaaccccgctggctccatctggactgcgggtcccgccacggtgagtggcactggtggccctagctctcatggaggcaaagagtagcagcatcaagaaggaaacagaagcaatggaagaggcggagagggttgtcaagaagcagaatgtcaccatggcaatggaggtctttgactgccccgtctgctctacccctctgaggccccccgttttccagtgtgcccttgggcatttcgtctgttcaccttgccgggac

SEQ ID NO: 67730 - DNA, 382 bp, Triticum aestivum
  unsure (1)..(382): unsure at all n locations
  Clone ID: PAT_TA_67730
tcggcacgaggctcgatcgaagcgcccgcggcatgagatgagggccggagacagcaggatggaggccgaccgccaccaccacgagagggcggctgaggcgggcgcgggtcatcaccgccatgggaggaacaggcggcggtacccggacgacgacaggcagcggagctccccgttggtgtggatggcggtaatcctgtgcacgctgctggccatcggcatcatcgtggtgggcgccgcggtattcgccgtgtacctcatctacaagccccacatgccgtacatggtggtgaccaacgcgtacctncagcagctggactacagccccgccgacggcgtcatccgcgacatccaggtcagggccgacgtcctggccaggaacacc

SEQ ID NO: 67731 - DNA, 317 bp, Triticum aestivum
  unsure (1)..(317): unsure at all n locations
  Clone ID: PAT_TA_67731
gattaaaggtccccacttcgttttcggggttgggattgnggtttgtttcatccaccgatcgtcaggaatgtgggttaaatgtgagcggtcggccaacgtctgatatagtatacaagttccaggtgttgtgcagtggagtcccctttaaggttgcttctagatgtcaagtgcaaagcaggtgcttgatcctgcatttcaaggagctggccaaaaacctgggacagaaatatggcggattgaagattttaagccagttcctttgccaaagtcagattatggtaaattctactgtggagattcatatattgttctgcana

SEQ ID NO: 67732 - DNA, 401 bp, Triticum aestivum
  Clone ID: PAT_TA_67732
ttcggcacgagggtccgctcctcgatcttaaacagatttgttatctcctctcttccgttgcaggtagggtacacttgatgtttcatgtttggtgaaagaaaaggagcttcctatgttgatttcgggcaagacatacattctgccatgcattagtagatcaattgcttctctgtgtaggggaacgattagcgattgaatctctctgtctcgtttcttgattatccaattaatttaccctcatctatgcataaattggtccgattgagttatgccatttttctaataatctatattggttctacatatgactagaacaatatgatacgatgcacatcggtccgctttactggcagctatctttcaagatggaggggaggcacctcgtgtggacctgctcaatg

SEQ ID NO: 67733 - DNA, 437 bp, Triticum aestivum
  Clone ID: PAT_TA_67733
atggcaataggtggctatagatgcggtctgatggacggatggaatcgttctgggctcagaagtttgtcactagtgaactcctgaattacattgcaagcagatgcaactcattgaagagcattcggctcatcggtgcctattacttttgggatgatgaggacgtagtaattaagcttgcagctaaatgtccaatgctagaagagatagagtactctggtcagaagctgacatgggactttttcaaggggattggtgcagcgcgcccagcgctgaagcgtctaagagtctgtttgccgtggttcgattcagattcaatagagcgtgagatcaggatggaacagcgccaaaacgaccaggaggaagaggaggaggaggaggagccttatgaggcctgggaggcgagacacaatgaggaggccttcgccatagcaaagagc

SEQ ID NO: 67734 - DNA, 456 bp, Triticum aestivum
  unsure (1)..(456): unsure at all n locations
  Clone ID: PAT_TA_67734
cattgacccaagtcgccgccgggcgcctcccgcctccacgactacaggccctgcaccggctccccttcctttctcttgctccctggtcaccatatcccccgtcttcgctctcgcacggccggcgggacggtgcctgactcggatctagcttggcgaacctctgctgcgggaacgccgagcgccgagcagtcttgccgtattgtcccttgccgccggcgaagcggtggcctgaagacctgacccggcttgatccatcgacgcatcgggcttgaggtaactagtgttccagatccagtttgtgcttcgttgcctacacacgtacagggcgagatcttcagcagttccgaaaaagcctagaatgggggaccaaagtgtgctggngcggatagttaacggagacgaggacccgaaggatctgccattaccactgttacaaagcatcaccaatgatttctc

SEQ ID NO: 67735 - DNA, 147 bp, Triticum aestivum
  unsure (1)..(147): unsure at all n locations
  Clone ID: PAT_TA_67735
ctggtcctcctannangcgacgtgagctacgccaacctgtacctgaccaacggcaccgggaacggactgctactcctgctcgttcgccaagtccacccccatccacgagacgtaccagccgngctgggattactgggggaggtacat

SEQ ID NO: 67736 - DNA, 146 bp, Triticum aestivum
  unsure (1)..(146): unsure at all n locations
  Clone ID: PAT_TA_67736
ataagctaatctatctcttctttaaaataagatcatgtgcttctctgatccggttgtagtaagttgtacaaggccttagctggntgncaggaggaaccttcacctcatggctaaaacttgggtaaaactgtgggcatacaaaatac

SEQ ID NO: 67737 - DNA, 131 bp, Triticum aestivum
  unsure (1)..(131): unsure at all n locations
  Clone ID: PAT_TA_67737
cgcgcaggggcccggcgaaagggaagaaagcatgtacaccgccaggaaagaagatccagtaaggacangggcgtctgagccctccgagttcgaggacaccgtagcgcaggctttctttgacctggagaacg

SEQ ID NO: 67738 - DNA, 383 bp, Triticum aestivum
  unsure (1)..(383): unsure at all n locations
  Clone ID: PAT_TA_67738
cccgggcctgcaggaaattcggcacgaggcaccgtagcgccactgtgtggccaaattttcggtggtagtatcacgtacttgttccaaatattgtccgactttgcagtcccccggcaagctgcaataggccattggcacccagccaactgcagtatcctaccattgtactgngcttttatcacgtacttttatatcaccgcgattgcttgcgcaagttcgcgctttacgttttaacttcaatcaccgaacccttgtaccttattgnagcataaagtnccattgacctcacaccaacattgttccataatgttttaactcgttttttaatcgaattgcttgcttctaagtaatcgaacagagcaaactcacgttcccaccccgaa

SEQ ID NO: 67739 - DNA, 658 bp, Triticum aestivum
  unsure (1)..(658): unsure at all n locations
  Clone ID: PAT_TA_67739
gccgccgtccttcgcatccacgtcgcacccgcatccccgcccagnagccaccgccgcattcggtcaaaatcgggcagcacggcagccggcagccagatccaccatgatgcatccagatccaccgtgcccaagtcatggagcttgtccacaaggttcgaccagatccacgttgcccagggggacctgacggagaagggggagaaggaccatcgggaggtcttcatggcacgtttcatgtttcagatccttgcccacaaccggcgctgctccgaccctagtatatgggacaaggaggatccctgacctattcaacaagctcaaggaggagaaggagccctgcctacttaatggcgcgcttcatcaaaaccacgaccaagccagccctcaagcaaaggtacaatttcatacccaccaaatctcaacctgtactgtattttttgtttcttcatcatccagccgcgggtcttgcaattgtactgatatatatgtgtggttagactaaaactgaagcatccttcctttttggatcttcaattctgctatgaatgaatatgcagcagcaacccatctaagaaaaaacgacacatatccatgcagattactagcaccaagtggagtgcacattccagtaaaatcttatcagttaatgttcttgaca

SEQ ID NO: 67740 - DNA, 608 bp, Triticum aestivum
  Clone ID: PAT_TA_67740
ggaaacacccccgctccctctcccacctccgaagcagcagcagccatggcccccaaggcagacaagaagccggccgccgagagcaaggtcgagaaggcggcggagaagaccccggcaggcaagaagcccaaggccgagaagcgggtgccggcgggcaagacggcggccaaggagggcgccggcggcgagggcaagactcggggccggaagaagggcagcaaggccaagaagggcgtggagacgtacaagatctacatcttcaaggtgctgaagcaggtgcacccggacgtgggcatctcctccaaggccatgtccatcatgaactccttcatcaacgacatcttcgagaagctcgccggggagtcggccaagctggcgaggtacaacaagaagcccaccatcacctcccgggagatccagacctccgtccgcctcgtcctccccggcgagctcgccaagcacgccgtctccgagggcaccaaggccgtcaccaagttcacctcctcctaggctgaatctgaatgcgtcgccttgttgtagttggctgctgttgactctgcttatctctctcaagtagtggtagtagtagttgtgcactagatgattgc

SEQ ID NO: 67741 - DNA, 442 bp, Triticum aestivum
  unsure (1)..(442): unsure at all n locations
  Clone ID: PAT_TA_67741
gggtagttctccagttctgatattttgttgtcgtaatttccatacaataacataatttatttgcatcaccatccatgattttcttgctatttaatatatatctgattgcgtgcaaaacgttatggaattttgtctctaacatcgtttctttaatttgttgaagctttgtccgtaccattttgttcctcctggtttgcttattcctctaacagctatatacgacacaagatacggggagattgaggaaaagcagagtgaactgagaagaaatctgcacttcaggcttggtctgcccttggatcgtcctttgttacggacttctaatgcactaacttttggtgccatggaaatgcgagatagaagctcatctaaaagtggttcctcattgcttcgagatgtccacaaagaaatnccatctagtggtgtatctggaggaatcatg

SEQ ID NO: 67742 - DNA, 569 bp, Triticum aestivum
  Clone ID: PAT_TA_67742
gcccgcctctatccctcctcctcgcgtcaccacggcctccaccccggagcctcgccgccgcctgataatactcctccaccacgctagcccctccacctcaccttccttctttttgtcatctgcgcccgtcattgatgcctggttccagatcgggcgcgggttaggcgaggtcgatggtggggtgaatgggcaggggaggcgggcgacaagggcaggcaacagtcggcccgtcgcgatgtggtcaagctacagggaagagggaggaggtcggcgacagggtgaaggagcaggccggccctcatggaggcagcgctatcagccagctagggaggcggtccggctcgcctctgctatgccgtgagcagcggcgctacctcggcctcgagcctcacctcctctgccaatctcctgccgcgagacagtgccttcccacgttctcaatctggcgttaccgtgcatggtggtttcagatcgggcgcaggtcgcagccatggaagtaaggggcatggtggtttctgtgatgtgtatggaggagcggtggaaggtgaggatgacggacaggtgggaag

SEQ ID NO: 67743 - DNA, 457 bp, Triticum aestivum
  Clone ID: PAT_TA_67743
cttctacccgcccacggtgaaccacccgcgcatgtacgcgcacgtcaaggcggtggcgcgcgcgctgctgggcgacgccgggtaccgcgacgtgccgccgatgatgggcgccgaggacttctccttctactcccaggccgtccccgccgggttctactacgtgggcgtgcgcaacgagacgctggggtccgtgcacacgggccactccccctacttcatgatcgacgaggacgtgctccccaccggcgccgccgtccacgccgccatcgctgagaggtacctcgccggcggcgccgagcagcactccgacccgcggttcgccggaacaggagctgtgaactcgtgatcgaccgaccgggtccggctctgttggaactcatcgatcgaccggcgttgcggctgtgggctgagatccgcgagggcgccgggatcgaccacgtctcgtgcgcgcggaaac

SEQ ID NO: 67744 - DNA, 264 bp, Triticum aestivum
  unsure (1)..(264): unsure at all n locations
  Clone ID: PAT_TA_67744
ctccgcccgtgtcgggatccaggttggttaatcgcctctcccgaatccgagacgggcgagccgattggtttccgttcaggtgcaggtcatcttcctcctctctctcgaactgttcgtcttttttttttctctgngcgttgttngggngatggatggatggatctnttttttggnggcatgcgtataaactgcatganatgcanatnggngtaangatgaggggccgngactgcatgcttgngcatgcagtcgcacacacatcgc

SEQ ID NO: 67745 - DNA, 582 bp, Triticum aestivum
  Clone ID: PAT_TA_67745
gcacacacgatgcttccctccatcctttcaaaatcaagaaacgcgccgtcacccgccggacaccgccgccatctccgtcgtctcctctcctcttcgctcggcagggctacaaccttcccacccaccaccgccattgcactatcaccaccacctccaagcaccaactcccaccttgcttcttcccctcattcctaccaccgctacgcctccatcctccaatcctgcgtcgccgcgggttccctgcgcgccggcaggaagctccatggcaggctcctcgtctcgggcctcggccctgacacggtcttgtccaccaagctcgtcgacctgtacgctgcctgcggccatgttgggcaggcgcgccgcctgtttgacggaatgcccaagcggaacgtgttcctgtggaacgtgctgatcagggcctatgcgcgggaggggcctcgcgaggccgcggtgcagctctaccgagggatggcggagcacggcgtggagcctgataacttcacgtacccgctggtgctcaaggcgtgcgcggcgctcctggacctggagacagggagggaggtgcacgagcacatctcgggc

SEQ ID NO: 67746 - DNA, 583 bp, Triticum aestivum
  unsure (1)..(583): unsure at all n locations
  Clone ID: PAT_TA_67746
gagggcgacggccgcggccacctccttggtggagtggatggtgcctaaactctttgattccttgctggcaaagcacgagctccggaagagtctcaagatcgacatcaactacatcaagaacgagtttgctatgatttcggccgtcatccatgatgatgatcgccgcagcggctgctgtggcggccgtgaagatgtnaatatggtgtggatcaatatggtgcgtgaattggcgcacgccatagaggactgcatcgaccgcttcatgcaccgtgtgagggccgaccaagacactgggagagtgcgccaggctttccaccgggcaaagacgatgaaggcccggaacaagtttgctgcagagatccaacaactcaagaagagatcagaggatgtattcaagctgagagactcatacaacaatgctagcagcagcacctnctcaccaaggcagtcgttgtcgtctcagcagacagacacgccgacggnaattgaggacgacnaggatggcacccattcagaggcatccatcgccgtgcccgtgggtatggacacttncccgggacgagcttctggatctgatccagca

SEQ ID NO: 67747 - DNA, 630 bp, Triticum aestivum
  unsure (1)..(630): unsure at all n locations
  Clone ID: PAT_TA_67747
ggacccgtcgtccccttctatccctcccccaccgccggccgccgcccgctcgtcaccggaggcacgcggccgctgcgcagttcgccggtgaaaagatctgtttagcgaacttaagctggtggagatttcgcgagtcacgcgtcaaatttacctgctgcgtgccgatggacaactctcagagtcagccattacctcctggtgttggagcatggcagccgccaccttcaaatcatcctccacaatttcagcatcctccacaatttcagcatccctcacaatttcaacccactccacgcccacatgcttatccaacaccatatgacaccagacccaatggtggtaacaatcaaaatggagcaaacatgtactatgcaacacaaccttttcatcctagtccacatccacatgcttatccaacaccatacgacaccaggcccaataatggcaacaatcaaaatacagcaggaacgttctatgctacacaacctagcatgcctttcactcccgctcaaagtgctcctagtatcaccacagaagctgggaatggacaaccagatctcaaggcccatcagactgatcacgaggttgccaaccatanngcaaatgcagcaaacatcgaatctgctgtcc

SEQ ID NO: 67748 - DNA, 626 bp, Triticum aestivum
  Clone ID: PAT_TA_67748
agtgtgtgacgactgaggcacctgcgatctccgccaccgccggcggcggctagatgtggcacggctctcagcaggggcgccgcaccgacacagcaaccgccgttcgtccacgctggctgtctcctagagcgccgtcccgagtcactgcactacgcgcgccatcccgatccactccaccagtatccacgtgaacaagatgttctccgtggcgtcagtggtatcaagccttgcaacctccgttcttggaaaggctgcatcctttggtactgactgggctgttaatgagatcaagtcagcctggaacgcccaggaagagcttcgcaagttggaaaactcattgaaatttatctgtggtgttcttcgagatgctgaggacagggagtcagcttctcatgtccttcacgagtggctggactgtttgaaggatgcggtctatgacatagatgatcttttggacgatgcgtccaccgaagctctcatgttacatgttcataagggtttatctcgcattgagtctatgagccttctcgttactggtccattcaaattgagtcacaaaatagaacaagttcgtaaaaagcttgatgagatagcaaaggacagagggcaatttggtttaaatgagc

SEQ ID NO: 67749 - DNA, 564 bp, Triticum aestivum
  Clone ID: PAT_TA_67749
gctgctacgctgaaggatcaagaactcatcgccattgccgccagtcttcgtgctgcccgttcgacgaaatgcgccccaaggaatccaagcggtgggtgccggttaaccggccggccgtggcgtctcctgctgcgggcaacccgtccaacggaatgcccccgaaggtatcccagcggtgggtgccggttaaccggccggccgtgacgcctcctgctgcaggcaacccgtccgacggaatgcccccgaaggtagtgccggtgaaccgacccatggggacggggacggggacgtctcacggggcaggcaaaccgtcgaacgaaatcccccggaaggcatccaagcgatgggtgccggttaaccgtccggccgtgccgtctcctgctgcaggcaagccgtccgacggaatgcccccgaaggtagtgccggtgaaccgacccatggggacggggaagcctcgcggggcaggcaaaccatcgaaccaaatcccccggaaggtatccaagcaatgggtaccggttaaccgaccgccaactgtggggacacctcgcgtggcaggtgaaccct

SEQ ID NO: 67750 - DNA, 125 bp, Triticum aestivum
  Clone ID: PAT_TA_67750
acttttaaaatgaggttttacgttgattgcggcgatcgctatatcagtgtccgtaatagaaattgtctgctggccaagtttgcgttccgtcaggtccgagtacccgattgtggatatcctggaat

SEQ ID NO: 67751 - DNA, 602 bp, Triticum aestivum
  unsure (1)..(602): unsure at all n locations
  Clone ID: PAT_TA_67751
gacgaaatgcgcgctcgacaggnaaactttaattcaagaacgacagaagcagattgctatgagcaatgaggcagtgctgaaatcaaagaaagaacaagtgaagaaaaaggagcgatcacggaagattgctgctctctcattcgctgttgatgatgaagatgatgaccaggaggaagaggaagaaattgttctcccaaagaaaccaaaaaaaaatcctgatgtggacacaagttttctacctgatagagacagagagattcaagaaaaagaacttaaagaacagattcggaaagagtgggtggaaaaacaagaaagaatgaaaaatgaagaaatagagataacatacagttactgggatggatctggacatcgcagaaaagttaagatgaaaaagggaaacagtatccaacaatttcttatcaaatgtattgaacaacttagaactgacttcagtgaactgagaactgcaggcgtggagcacttaatgtatgtaaaggaagatttaattattccacaatattacacattttatgacttcataatgaccaaagcacgtggtaaaagtgggtcacttttccagtttgatgtccatgatgatgtta

SEQ ID NO: 67752 - DNA, 625 bp, Triticum aestivum
  Clone ID: PAT_TA_67752
attcggcacgagggtcaaatttgccccctccgcgccaatcctcctcatccacccccctcctcatacatacggcaatatccagattcgagaagcagagtagggttccagttccgaggccgagatctctgctcgccgccgccgctccctccgtctttcagtccatcccttctcaaggtcagcgcctccccggacggagcgggcggtcgccctcttcgagttcgacgccgaccgtcccgcggcttttcctcgatttacccggggccggggggtcttcaggttcagggacccttttaaccttcacttctctgagtagatttggctacaaataaggcactcaatctgtacactgtcatctggccacaatgtctgtagatttggctcacaaaatagtttcgactctcagaagatctgaaaggtgcaagaacacccgtgtaatatacaatgatgattatgaagaagattccgagactgagataactgattctgaagaagattccaagactcagataactgattctgaagaagttgcctctccttcaccctcggaacttaatgttgcttctgttgatgatggttccggtgaagaggattttttcagtgtgcctcgcaaggatcgaagagctcc

SEQ ID NO: 67753 - DNA, 500 bp, Triticum aestivum
  unsure (1)..(500): unsure at all n locations
  Clone ID: PAT_TA_67753
tgcaggnaattcggcacgaggagacaagtcaacctcaccgngnagaagcagagagaagggagaagatgtcggggcgcggtaagggaggaaaggggctcggcaagggcggggccaagcgccaccggaaggtgctccgggacaacatccagggcatcaccaagccggcgatccgtcgtctggcgcggcggggcggcgtgaagcgcatctcggggctcatctacgaggagacccgcggcgtgctcaagatcttcctcgagaacgtcatccgcgacgccgtcacctacaccgagcacgcccgccgcaagaccgtcactgccatggacgtcgtctacgcgctcaagcgccagggccgcaccctctacggcttcggcggctaggccaccgccagattagctagcctgtgtctagggttcgttgtccatgatgtaattgcagcatctcgctgttgtttgctatcttctgtagaatcgaatggaatggaaattgaactaaaaaaaaaa

SEQ ID NO: 67754 - DNA, 591 bp, Triticum aestivum
  Clone ID: PAT_TA_67754
ggcaaatcgcggagcagctcgccttcttccctcccgcgccgctccagagtcctgagggaggagtagggcattcgattctagcagtcgattctgtccttgagatccagaatcaagctaagcagcaactccagcgtgcagcaatggcggccgcggcagctgacgttctcctgccttccaagaggcaaaagaataaccccagttgtctgggaaccttgccagtccttccggccacggcaactgcagactggtcctcgctccagcccgacatagtccgccacatcgccaactccttcctcaccaccgacgacgtcgactgctacatggacttgcgcgccgtctgccacaactggcgctgcgccaccgacgaccccaaggacgacacttcagaccctcggttcctcccgtatcggtggatcatcctcaacgacgcctttcagagtggcacgcgtcgcctcttggtcaacaccagcactggccggttcctccacagggagctcccattgctccgcgactactatgtcataaccaccactctcaccggcttcttcatcctgactgataggagccctcctcatgccgctcgtgtattca

SEQ ID NO: 67755 - DNA, 517 bp, Triticum aestivum
  Clone ID: PAT_TA_67755
ggcggcggctgcgccgacgcaagccgatggaggcttgtcagcgtcttctccttccttcttctccaccggccgactgtccacatccttctcctcgtgcagtcgtgctcctacttcgcaccacttcttctatggcagcgctagagaaccagatactacgtgcttgtgagggccagccttttctactgcttttcggattgttgattctgaaatccattgattctgctttggttttcctccagttgaatgtaactctgctgtacgttttggttctgattggttcaaacctttttgaggaattttctgtcattttcttccaaatttcaaattttagtttgagattttcgtccgaattttttccgaaataccgaaattcgcccatttcgttctggcccggtaaaaaaccaaaaacgaaatccaaaatcttgatggtgatttggatccaagggctccgcggaggctggtgtttctgaaaatataataagaaccatagttgaaaatagaataaggttttttacca

SEQ ID NO: 67756 - DNA, 600 bp, Triticum aestivum
  Clone ID: PAT_TA_67756
agcaccaactcaccgaatccagagctcccgcctgtcatcccgccgtcgccccggcattagttccgctgtcctctacctcgtgcctccccgcccgcaggtcacgcacgacccctcgtgtttccccatctgcaccggtgacctcgacaccccatctgcaccggccttcgtctcggtatccctgctgttctgctcttcactctcggatacaacccacagcaatttaggtgaaattttgaggcatggaggatgaagaaaacatcgaggaagaacttttgctggtggagtcgcaactcaatggactacaagacaaaatcaagacattacttgatcagcaagaagaattgtatgagcgccaagcacagttgaaggctatgctggaaatatctaaaacttccagagatgcatcaaatagtgccccttcagttgctctggaagattggtctggaaagttctcatgggattctcaggctgatgacactcgattcaatgtatttggtatttcttcctacaggtcaaatcaacgagaaataattaactcaatcatgagtggaaaagatgttctggttataatggctgctggtggagggaagagtctgtgtt

SEQ ID NO: 67757 - DNA, 878 bp, Triticum aestivum
  unsure (1)..(878): unsure at all n locations
  Clone ID: PAT_TA_67757
ggaaccnacaaatcccacccaatctcgtctccgatcgactcgagagctcgtcgaatcctcctcccccatcgtctcaagatgcagatcttcgtgaagaccctcactggcaagaccatcactctggaggttgagagctctgacaccattgacaatgttaaggctaagatccaggacaaggagggcattcccccggaccagcagcgcctgatctttgctggcaagcagctggaggacggccgcaccctggccgactacaacatccagaaagagtccacccttcacctggtgctccgcctccgtggtggtatgcagatttttgtgaagaccctcaccggcaagaccatcactctggaggttgagagctctgacaccattgacaatgttaaggctaagatccaggacaaggagggcattcccccggaccagcagcgcctgatctttgctggcaagcagctggaggacggccgcaccctggccgactacaacatccagaaagagtccacccttcacctggtgctccgcctccgtggtggtatgcagatttttgtgaagaccctcaccggcaagaccatcactcttggaggttgagagctccgacaccattgacaatgttaaggccaagatccaggacaagganggcatttcccccggacagcagcgcctgattctttgntggcaagcagntgaagacggccgaaccctggncgactcaaaattcagaaggagtncanccnttcactgggggcttcgcctccgggggggatgcaaaattttnnggaaaacccnncccggaagaacattacccttggnggtgngangttccnccccatnnacaagtttagggccaaatccnggcaagggngggnntttcccnggac

SEQ ID NO: 67758 - DNA, 646 bp, Triticum aestivum
  unsure (1)..(646): unsure at all n locations
  Clone ID: PAT_TA_67758
gcacgagggacatagcaaggcattgacagactgagnagctctttcttgattctatgggtggtggtgcatggccgttcttagttggtggagcgatttgtctggtgctgcccaacctcaagggcaagctcaacgggatcgcgctccgggtgcccacccccaacgtgtccgtggtcgaccttgtggtgcaggtctccaagaagaccctcgccgaggaggtgaaccaggcgttccgcgacgccgccgccaacgagctcaagggcatcctcgacgtctgcgacgagccgctcgtgtccgtcgacttcaggtgctccgacgtgtcctccaccatcgacgcgtcgctcagcatggtcatgggagacgacatggtcaaggtcatcgcgtggtacgacaacgagtggggttactcccagagggtcgtcgacctcgccgacatcgtcgccaaccaatggaagtgaacgccggacggcggcattgccctgtgaagtgactcctctcgaaattttccccagccatcgtcacggatgatcgattctttgtaatgagaattcagagtatcgaactcccaacagcttcttttttttcctttcttttcttgttcttcttttttctttctctgatttttcagtgtccagacacggattataat

SEQ ID NO: 67759 - DNA, 650 bp, Triticum aestivum
  Clone ID: PAT_TA_67759
tcggcacgaggaccttaactgcgacggcggcggaagcggagatggagatggagacggagacggagacggagatggagagggagtccaggaaaaggcctagggtagcggcggcggcggcggaggacccttctctgggggcggcggcgtcggccgagtacgcggcgtggttggaagaaatggcggtgcatgaggcgaaggcggctgaattccggaagaacctgctggcgaatccattgacgcccgagcagttgcgggagcgcgaggaagccgcgtgggaaaagtacaacatcgagtcgtgggagagggctcgggacaactggatctggcatcctttcgaagccgtcacggagatcccttgcatgcgctttaccaacgacaatgtcaacgaccctaattatccacgccttgtccgcaccatgccaaccctgcagattgtttcagtccaggtgaaggatataaccggtgggttgcattggccactggatgtttatggttttgtcgctgtgcgtgatgtggtggatcgcaaacacattatggttttcgaccgtgaaagggatgactaccaaagaatcagcgagcaggattcctacctaacactgaccggtcctacccgtggtgttgtcatgacgattgatccttcgtatttggag

SEQ ID NO: 67760 - DNA, 527 bp, Triticum aestivum
  unsure (1)..(527): unsure at all n locations
  Clone ID: PAT_TA_67760
agccggtggagaagacccccgcggggnaagaagcccaaggcggagaagaaggtgccggcgtccaaggagggcggggacaagaaggggaagaagaaggccaagaagagcgtggagacgtacaagatctacatcttcaaggtgctcaagcaggtgcaccccgacatcggcatctcctccaaggccatgtccatcatgaactccttcatcaacgacatctttgagaagctcgccggcgagtccgccaagctcgcgcggtacaacaagaagcccaccatcacgtcccgggagatccagacctccgtccgcctcgtcctccccggcgagctcgccaagcatgctgtctccgagggcaccaaggccgtcaccaagttcacctcatcctaggctcctcttgtgttgattcttgtgtttctttcctcttcctcgtctgatgaattctgtagctagctgtgtgtgttctgacagtgtcatcttgtaacaatggtgctgcctgaataaatagtcgtgttgctgcttgnaaaaaaaaa

SEQ ID NO: 67761 - DNA, 597 bp, Triticum aestivum
  unsure (1)..(597): unsure at all n locations
  Clone ID: PAT_TA_67761
catggtccttctaccgnaagttcagttatggtgttgagctgggggtatatctgagccatttacttgtacatgtcccaacttttgtgcccaccagatcatgatttgctattggcttctctctgttattctgtttgtggaatttgtgctaggttctgttgatggcgatgatgagtaaggctcattagaggtgtactgagttcagatactatcgcttgtttttacgggtatggttttcggttagggttttttgtgactaggtggattgctttctgtgagcaaccatttcaatgctcaaatgtcacacaggggtgtaagggcatctccaacgcggatcaccaaggatacactatacagagtgggttgaccatatgatagacaagccaactctgagcctcccatttttattgataaatatgacctctctttctacaatttgtggttatttgcttatgtatattttggaatattctcaatctattaatgaactatagcagtattgggatctcactgtagtatatatatgttatcatctgtggaacttacaagatatgctcatagcaaactggattttgtgctattttacacttaaaaaaaaaa

SEQ ID NO: 67762 - DNA, 624 bp, Triticum aestivum
  unsure (1)..(624): unsure at all n locations
  Clone ID: PAT_TA_67762
ggctacctccttcctagnagtaaggcgtgttttgtttcgttaagacatgcatttgaccaataatggctacataaatacaaggttatatgacatgaaatttgtgtcactaggtttgtatttagaagtactttgttatgatggtgattttgtgtcacataaatcaaatattagaagagtaattcttgctcaaaagtcttgtcttaacaaaatgaaatacaccttattcatcagaacgaagcgagtaagtaacatcctctgaactgtttgttgagttgaagctactataggatccatcatttcctcttaatttcttgtgtatgaacccttaaatatgaaaatagcatgcctaagaaaaactcagaacagtaagcctgtaatgccgttgaagcttttggggtaccagtagttgatgatgctctgatgtgaatgggcaattgttcccaccacgtcttaatatatcttcacaaataaattccactactatatggccctcccagtcgtcaaggttccttctttttgatgttcttttgggttggtaacttttcaacgttgcaaggcatgcatattgtagtagtaacattgaatgtgaggctgattttatttctccaacacgtgtatttgttg

SEQ ID NO: 67763 - DNA, 655 bp, Triticum aestivum
  Clone ID: PAT_TA_67763
tgcaggcaattcggcacgaggcttgcgtctacagaagctaatggttcaggatggctgctttgtggagtggcgggaaatgatagcagatgcagctaggaagggctttgctggtggagttgccttccaatggaattcacataaaatattgactgagcaactgcggcaggaatggttggagaaagtccagcaaagaagatcaatgcctaggccgacaggtaatagaagagcgccaaaaactccagagcagaggagaaaaattgcagaagccattgctgcgaagtggttggatcgagaataccgtgaacgtgtttgcagtgcaattaatagctatcatggaacatcttctggatctaaagtaccgcgtaaacaaagaactccgagagaaccaggtgcaaagcgtgaaaaaaagaaatctattcaacacagagctgtcagcatggacgatgcacatgcaaaaactgctccggttaagagaaagaaaagtgcaactccttacaaagatcctatggcaggtgagaaactagagatgataacgaagattcgagcccaaaggacagcactggaaatagagaagaaagaggctattgaaagagccaggtcactcattgtagaagccgagaaagctgcaaatgctcttgagcctgttgcagcgaaa

SEQ ID NO: 67764 - DNA, 128 bp, Triticum aestivum
  Clone ID: PAT_TA_67764
ttctctactggccatcttgctgactatgtgcgttgtatttttgctggattgctaataataccagggtgtgccacctgtatgttgcatcaggagttaatgaaacctaaagaacttgcagaaaaaaaaaa

SEQ ID NO: 67765 - DNA, 414 bp, Triticum aestivum
  Clone ID: PAT_TA_67765
gagctccccgccgccgccgcctctcctctcctctcctctccttataggacggacggaggaagaatcaacagctccacccgcaggtacaaggagagcccatgattcaagggggcaccaggcttgctgcttgctcttgattctgattctgattctgaatccccgaagagatagagacagagacggatggaggagttcatcagtctcggcggcgacgaacctgagcctcgcgcctcggaagatctcgaccaaccccaagtccaagcccaagtcgatttgaatctgaatctgaatcacgcaccaccaccaaagacggagacggagcctctgccatcccaccaccagccacaagacagcggcgtcgtcgtcctcgaggaaggccagatcgcctgccaagaatcttcttcttctgctgct

SEQ ID NO: 67766 - DNA, 441 bp, Triticum aestivum
  unsure (1)..(441): unsure at all n locations
  Clone ID: PAT_TA_67766
ggctgcaggcaattcggcacgaggcatttttttcnagnaagaagaagacccgtccaacccttctctccccatccctcccccaacccccccaagtcgatatgcctcccagacgcaaaccccaaccgtcggcgaagaaacccctgcggcgttccggaagggtcaattccgccgcggccatggccgattccgccgatccaaccccgtccccgccgccgccggaagcctcctctgccgccatcatctggggtatcatcgagaaggagattcacgagctgcccgggagggatgatggggtgtgccaatacggggcgtatcttcagcggctcatccgggtgcagaagccgctgctgtttgacctgccgcagaaagaggaggcagggaagcttgttcagaaggtgtcttttgatttagttaaggacgagcgtggtggggatgcagatg

SEQ ID NO: 67767 - DNA, 881 bp, Triticum aestivum
  unsure (1)..(881): unsure at all n locations
  Clone ID: PAT_TA_67767
tcggcacgagggcgaacaaaaaatccccaactcaatctcgtcgcccatcaaccctaggctcgtcgaatcctcctcccccaccgcctcaagatgcagatctttgtgaagacattgacaggcaagaccatcacccttgaggtcgagtcgtctgacacaatcgacaacgtcaaggccaagatccaggacaaggagggcatccctccggaccagcagcgtctcatcttcgctggcaagcagcttgaggatggcaggacccttgctgactacaacatccagaaggagtccacccttcaccttgtcctccgccttcgcggaggcatgcagatcttcgtcaagacgttgactggcaagaccatcacccttgaggtggagtcgtctgacaccatcgacaacgtgaaggccaagattcaggacaaggagggcatcccgccggaccagcagcgcctcatcttcgctggcaagcagctcgaggatggcaggacccttgctgactacaacatccagaaggagtccactcttcaccttgtcctccgccttaggggaggcatgcagatcttcgtcaagaccctcaccggcaagaccatcacacttgaggnggaatcctccgacaccgtcgacnacgtgaaggccaagatccaggacaaggaggggattccngccggaccagcagngcctnatnttccctggcaagcagctngangatggcaggacccttgctgactacaacattccagnaaggagtccaccctttnactttgtcctccgcctttaggggnggatgcanatttttntcaagancctcaccggaaagacattncncttgaggggaatccttcgacacccttgacacgtgaangccnagatccaganaagggnggcat

SEQ ID NO: 67768 - DNA, 599 bp, Triticum aestivum
  Clone ID: PAT_TA_67768
gtgatccctcaacgcactagggttagcgacctccatgccgccaccagccgccatgccgacattaccttcgaccaagaccgacgagtccacgggatcccacgagcgcggacttggaggagttgatctgcaaggtcaaggtgcaggccttgccccaacgcaaggagaggagcgccggtgccttcggcagcagctcggcgcaggccgggatccatggagaggtacgaggtgctcaaggacatcggcgacggcaatgtcagcgtcacgcgcctgatgcggaacaaggagaccgaggaggtcgtcgccgtgaagtacatcccatggggcttcaaggtaattaggtctcccctgtgatctattcgttccagcatgggctgctccgttgagtttttcttatcccgtcgggattcccctactgcatatatagtaacgggcaaacttttgggtgtcctgatgtgtttgcggattgatgagaatgtggccaggtagatcataaaccaccactcgctgctgcacatcaacaaaatccgataaaaggaggtgtgtttgctatctattcccttaagccaatcgagatgattttacatcgagatgatgtcgcc

SEQ ID NO: 67769 - DNA, 621 bp, Triticum aestivum
  unsure (1)..(621): unsure at all n locations
  Clone ID: PAT_TA_67769
ccgattttggaagaggggaagctcaaccaggcctagccaaccacagtaccttgcttgacctgcttgaaatcccccaacttatggacatatttgttttgtatttgaagttgattgatatttttatatgacatttggtgctcacatatgcaaaattttcaggttccatggtacatctgctgtcacatgatcttcttgatgcatattcacaatcaaaaatagattttgtgcctacttgctttcttatgcaccgtgctgttagctcgngggagaatcagtaaaaataattctgacatgaaactgtatatgattgttctgaaattagtggttccacggtgtctatatatctaacgtatttactttagcagttcaggaggatgcttttgggcgatacaccctacttatgtaggaagaaatgaagtcagcctgcaccaggggtgcacttgacaacaacagggacacaaagttggtctgattggcaaggcttctggttagctctttacacatggtaatttaaacatctgaaaatcaagatttatttctggttatcactaaagagaagtattcttgctaaatcagctttagctaggagagaatggaaagaaatgttctttacctaatcag

SEQ ID NO: 67770 - DNA, 705 bp, Triticum aestivum
  Clone ID: PAT_TA_67770
gcaagaaccgcttgagttccccattgttaacacatgcttttcattctgcactgacgcaagcagcgtggatgatagcaaggagtgcattggcatgggttgctgtcaaaccccttttccaggaaacatcagctccttcaacaccggatctgcaccattgccatctttatacaactctacaaaccagtctttcagcccgtgcagctactcatttgtcactgaggaggactggttcaagtttgatcgttcatatgtcagctctacaaatttcgcaactaaatatacagatggggtccctttggtactagattgggttgttggtaataaaagttgttcggaagccaccaaaatggggtcacagtatgcctgtcaagccaagaacagtcaatgcattaatgtgtccaatggccctggataccgctgcaactgctctcaaggttatgagggcaatccctatctacaaggagggtgccaagacatcaatgagtgtgaacctccaaaccagtcgttgtatccttgccaaggtaaatgcacaaataccgttggaaactacacctgtttctgcccatcaggattcaggagcgatgatccaaagagcataccctgcgttccagctgacccaaagaaagctcttaaggtggtcttaggcatatccttcagtgccatcttcctcatggtttgtatctttgctctacgggctgagtacca

SEQ ID NO: 67771 - DNA, 611 bp, Triticum aestivum
  unsure (1)..(611): unsure at all n locations
  Clone ID: PAT_TA_67771
cgcaagnaacaggcatggcgtggaagacttggaggcggaggctggcaggagaagcaagctgatgatgccggaacaggaggaatctggggtaggcgagatggtggaggaaataatgcttcacggccacgacatcatcatgaaggggatagaggatctgcacatagcaatgggcaccgaggccgagaagaaccacaggaagggcaccggcaaggcagcgcgggggaggcggggtgcaagcgaggtcgacctccgcaccatgctcatccactgtgcgcaggcggtggccacgggcgatcaccgggggtcgaacgagctactcaggcagattaagcaacactcatcacctaagggggatgccacacagaggctggcgtattgtttcgccgagggactggaagcgcgccttgcaggcacgggcagccatgtgtatcagtcgctcgtggcgaagagcacctcggtcggagagttcctcagggcctacaagctctacatggcagccagcagtttcaggaaggtgaattttatttttgttggcaagatcatcatggatgccatggtcgggaagagccgcttgcacatcgtggattacaatgtggaatatggattccagt

SEQ ID NO: 67772 - DNA, 261 bp, Triticum aestivum
  Clone ID: PAT_TA_67772
gggccatgtgtccacaacgatattaaatttattttttgtgggggtgggcccaccacagtagcttgctgctggggcccacacgcgtcgcctgggcgttgcactgctgccctggcccggcgctccccaaccaaatcaagcaaacttttgaagtctgttaagttcggtttatgccattacttccaatggaagctactgtactttattctgaactttaaagggtattctgaaggtatctcaaaccgtgttgggttttgcagtagc

SEQ ID NO: 67773 - DNA, 542 bp, Triticum aestivum
  Clone ID: PAT_TA_67773
tttctttccacgtctagcttgtctaatctgagcaagcttagccagcgtcatacacacacttgtctgcgtgccgcacgtaccgtcgagctatccgaactgaaatgcagaggagcagaggttgtgccccgggcggtgagcacgcctgggcagcggctgacggcgggatacagctgcagcgccgggagagggagctggtggcgcagctgcacgagctgctgtacccgtccacgtccccgtctcggagcggcgcgtcctcgtgttctggtcttgcggctgacttgtgttgggagcacggcagctcacaggtgaaggcaacggcggcgtcgtgcgccggaggcaaacggcgcggggggcgcaagagagtccgggaagatgaacggcacgaggaggggcaaggacaccgcggcggtgctgcgactgcgacgaaggctactactcgttgcaggaggaagaagcaaggggcgacgacgacgacgctcgtcacgacggtgccggatttcgacggctaccagtggaggaagtacggccagaagcaaatcgaa

SEQ ID NO: 67774 - DNA, 171 bp, Triticum aestivum
  Clone ID: PAT_TA_67774
tcgtcgccgtgccttcgtggccatggtcatccccgagcgacgacaagatgtctagaggcagcgccgtcctcttctccgtggacttcaaccactgggaccaagccggggaggccctcgcgcgtcgccatcgcgctcatctccgcctctgcatctcgacagccgccgtcgtca

SEQ ID NO: 67775 - DNA, 378 bp, Triticum aestivum
  unsure (1)..(378): unsure at all n locations
  Clone ID: PAT_TA_67775
aatcctctcgatctctccccaccaacccgngcctcccctcgatccagccctcctctgccttcctgcccgttctggatcggagcccgagcagatgagctccgttccccatcgcgcttttctcctccgccctgtctcgcccggtgcctgatttgcatcgcgtcccaagccagctgcaagcggccccgagcagcctccctcgcgcgcgccccgcaggagctcgatcccgagcgggtcgagctagccgtccccgtcagtgatgagcagcagcagctcccgcagctccggctagccatgccattggtgaacccctcaggaaacctctccttcctccctcgctgctacttctctgaatttgattccctgccatgtccttgcagc

SEQ ID NO: 67776 - DNA, 350 bp, Triticum aestivum
  unsure (1)..(350): unsure at all n locations
  Clone ID: PAT_TA_67776
ctattatncaagccagcctgttataaaaatggatcttttgacgcacctctgngattcgttaagctcctgtttgtggaatatctccttcagcaaggaacaagcacaagcattgaacctnagctacaataatcttcctcactatttgaagatatgcctgctgtgtctgaatatgtatccagagggccacacaatctggaaggacgatttggtgaagcaatgggtcgctgaaggtttcatccatacaacagaagggcaagacatggtagaaagttgcagcaagctatttcaatgaacttattaatagaagattcatccaaactctatgtagcaagtacaacaatgaggtgttg

SEQ ID NO: 67777 - DNA, 544 bp, Triticum aestivum
  unsure (1)..(544): unsure at all n locations
  Clone ID: PAT_TA_67777
ccctgttgtacttcctgatactcttatgcgtcctaatttcatgttcatgtcttctgtttacactgttcctggctgttactccactgaagtctgcaagtaatgaagctgaaactctggnagttctctatgcactctcagagagaaccattgggcagtactcaccatagnagaagatgtttttctggaagatgttgcccatgaagaagttcaaaggtcttctactgatgctattctcagggatccaatggaaagtcatcaaaatcatcagaaatcagctttggagcatactgaaagttctgacaccactgtagagtctgatcctgacagtcaacaatcaactgcttatgcagtgagtactcctaaagctcaaccctcaccacctgtcttccatgaagagccaaaaccagtttgtgtggctgactggacagagtcggtaccaaaggtttctacagccagtgaagtagaacatattcatgcagagaacatcaaaaggaagagtgcaactgaaaaagatgttgaagtagtagcagaagtttgcagggac

SEQ ID NO: 67778 - DNA, 204 bp, Triticum aestivum
  Clone ID: PAT_TA_67778
atccgtgatgttctaggcagctgtgggtacgacatgaagaagagcatggaggaattaatgtcattttctacaaaagatctgggcaaaaggccagaggaatgagcatattgcagtacaaggacacggcggtagaatcctctttttccacggggagctgcctagggatcacaatccacatctagaccacagattacccctggagag

SEQ ID NO: 67779 - DNA, 683 bp, Triticum aestivum
  unsure (1)..(683): unsure at all n locations
  Clone ID: PAT_TA_67779
gaccttgcccgcctctcgttccgcttcatccgcgtcgacctccccaactccttctccgcccgctcccaccccttcaccgccctcgaggtcatccacctccgctgcgtccacatctccgacgacacagtcagcagtctggtcgctgcgtgcccccttctccacaccctcgatttgcgctactgcgaaggcctcgactccgtcagcgtcgcggcggccggggcgcacctgagtagcctcacggttgcagagtgtgatccgtgcaccgacgttgttttggccgatgaggcatccggtctgcgctcattccgctacagcggcgcctacatgcccgcctacagcatcccggccaccatcactagtcttgctgacctttacatctgcttcagagcatctaaccgccggcgacgcttgtccggcaccagaatccggttttatggacaggaggcttacgcttgcgagctgcgcagaaactggcttcaactactaaccagtctgtccaacctcaccgtgcttactctctgcagcagtatcctacggagactgtctgccaaagctcgtgccagattagctgccacaggcgctgcaccgtgcaaattactgaatttgagagagcttcagctactgatgttcgaagtggagatcaacaacatgaacgacatttactctttncttgtggcatgctg

SEQ ID NO: 67780 - DNA, 542 bp, Triticum aestivum
  Clone ID: PAT_TA_67780
attcggcacgagggaaataccctgctatttgcaagctgtgcaaaggaagtagttacaaatgcgcaggttaatgtagtcatgtctgataaagccctagttaagcatttacaaagagaacttgccaggttagagagtgaactgcgatgtccagctacctattcaagtcttgaagcattggttaaggaaaaagataatcacatccgaaaggtaaatgctacttctgacatttatgcgggtgtcttctttttgtacattataggaaacagatccatagttttaaacacaagtcacagagcttactgtttttccatgaaaattataacacatatagaaaagatgaacatggacatttgaagtttttcaaaatattttgacattttagttttttttcttcacttaacatgtgctcctgggtacaaaaccttgaattagatatcctagtaaaccactgtttctatgtatgttccatgcatcttttaccatgccagttaccttaaagtgtccaaatacaccttctcttcttgtgatggtgtagaagttca

SEQ ID NO: 67781 - DNA, 456 bp, Triticum aestivum
  Clone ID: PAT_TA_67781
gcggcgatgtccgggcgcggcaagggaggcaaggggctgggcaagggcggcgccaagcgccaccggaaggtcctccgcgacaacatccagggcatcaccaagccggcgatccggaggctggcgaggaggggcggcgtgaagcgcatctccggcctcatctacgaggagacccgcggcgtcctcaagatcttcctcgagaacgtcatccgcgacgccgtcacctacaccgagcacgcccgccgcaagaccgtcacagccatggacgtcgtctacgcgctcaagcgccagggccgcaccctctacggcttcggaggctagtagatacgtggtgtgctctgctggtggcggccgtgtttttctgtgttatatgtgccgtggtggatgggatgtacttctctgtcgtgcgtttgtgttcactagtctgcaataccattatccgttcaatgaaaaaaaaaa

SEQ ID NO: 67782 - DNA, 371 bp, Triticum aestivum
  Clone ID: PAT_TA_67782
cgaggtggatatcctcagcaaagtatcctgctctcagcaagcaaaccttcacacccaatcggtttgccagttatcaagtttgatgacgaggtgggttcacggtcaaagaagcggaaaaggtcaacagaagatgttttagcatcgcatgcacaagccatgttcgagggtgggagactgcaatgtagaaggacacctgagttggcttgggctgatgccacattgactgagaaggttgacggtgaaaaagcaacgtcggaaaatagcaccttcgtttctcgagctcagagaagacttactttaacgaccagcttgattcagtgtctccttcctgctctgtcagcgagacttcttgcagcaaaagttgctgattg

SEQ ID NO: 67783 - DNA, 173 bp, Triticum aestivum
  Clone ID: PAT_TA_67783
ttcggcacgagggaaaagacaaattttcttccccttcccatgttttgtgcatgtacgaagagaaaaaagtgtaaacaaaaaaaaggaaaaaagaaaagagacatctcctttgaagaaaggattgtacatacatgaatgatataaagttaaagttccccactctaaaaaaaaaa

SEQ ID NO: 67784 - DNA, 153 bp, Triticum aestivum
  unsure (1)..(153): unsure at all n locations
  Clone ID: PAT_TA_67784
tgcttggcttcgccgccaagggcaccctgcgtcaaggcgattccngacatcatnaacgcaacaccagctgtacaaagtaactaaaaattcccaggtgtcggactgtttcctgaacaggaagaaggactacaaggacgggacgttctcctaggt

SEQ ID NO: 67785 - DNA, 215 bp, Triticum aestivum
  Clone ID: PAT_TA_67785
caaaggggaagtaccgactaatttcagattcgtatgaacaaagaagggctatggaattggttacagcctatggcacaccaaagttatcaccctgcctgtaagctggtacttcctgcttcggtgttctttccctaagatgatgttggttgtttactgtagtatgcctgttatatgctagttagtcattgctaaatgccagctccttatgaaactga

SEQ ID NO: 67786 - DNA, 110 bp, Triticum aestivum
  unsure (1)..(110): unsure at all n locations
  Clone ID: PAT_TA_67786
tcctagcgccacactccccggtcgactgcagctnnnaccccatgtccgtgacaaacgtncccgcaatgcgcatgcagggctcctactccttgtgtgactacgccggcgtc

SEQ ID NO: 67787 - DNA, 681 bp, Triticum aestivum
  Clone ID: PAT_TA_67787
ttcggcacgaggggcgccggcggcgggcgaggtgtgctctgaagccccagtggctggacacgcaggtcagtgtgctgatgctctgccacaattcttctttggagtgtcgtgcgaagttagatctgaatcatgtttaggttgctaggggacagaagagttgattcggatttctgcagcgattcatagtaatgttatgcacatatttgttctattttcggtgctgtgctagttgtacatgttgtggatcatttttttcgaaaaatatgcttctgtgtaggaaaatatagagctgttttggagattgttggaagtgtggcgacagtgatgttagcactaatctagtagctcttggattcatagtgtggtaattggatttttgcattactggaggtttgaaatttacagagatgtatgtagattgcatgggtgtcgaatcagcgtcgttgttttggaaattttgtacttgcaggatagatctgattcgcacaggagtgttgccgggctggcggggtgtattggttccgttctaccagtggactcccaggattcgatgagtgcccccattgtcaaggtggacgcggtcggcaaagcacagccataagaaactgtgctgaacatccttctctccttctgattttgcagctcttttagcaagtttgcatatttagaaaggttgagctt

SEQ ID NO: 67788 - DNA, 653 bp, Triticum aestivum
  Clone ID: PAT_TA_67788
acgagggtccctacctttcccttcgagcaaactcacacaactccacaccaccgcagcccccaaccccacccgaagcagcagccatggcccccaaggcagacaagaagccggcggccgagaacaaggtcgagaaggcggcggagaagacccccgcggggaagaagcccaaggccgagaagcggctgccggcgggcaagacggcgtccaaggaggccggcggcgaggccaagacccggggcaggaagaagggcagcaaggccaagaagggcgtggagacgtacaagatctacatcttcaaggtgctgaagcaggtgcaccccgacatcggcatctcctccaaggccatgtccatcatgaactccttcatcaacgacatcttcgagaagctcgccggcgagtcggccaagctcgcgaggtacaacaagaagcccaccatcacctccagggagatccagacctccgtccgcctcgtcctccccggggagctcgccaagcacgccgtctccgagggcaccaaggccgtcaccaagttcacctcctcctagactgacggcgtgcagttggtttctgcatctgcatctgtactgttgactctgcttatctatctatccgcaagtagtggtagcagtagtagcacctgtgctgggtgattg

SEQ ID NO: 67789 - DNA, 702 bp, Triticum aestivum
  unsure (1)..(702): unsure at all n locations
  Clone ID: PAT_TA_67789
ggttccgtcggcgccgccganctcgcacggcgaggcagaccactgctcgatatcctaactccaacccagccaactcccacccgtagaccctaattctaaggcagcctaatccctcgccatggaggattcccttgtgccgcctgtgcctcctgccccaaccacccttttcctcactcgccggcgatcacatctcgacagcgcctcctaccgcacgctctcccggctcttctcccactgcctccaccaccgcccctcgcagctcgctgccccggcgccccttgaagtcgagcccgccgctgcgaaccctatatgcgacgagtcgccacaggggtgctcggtaccgcctggacggggaaaggacttaggagaagaggagactgcggtaaggacttctgtcatcgagaacccctcacccgcggcagtcgatgcagccaccggtaaccctattgcagacccggctgtggcaccacagagatacatggagaatcaagtggccggggttcagcgggtggagggcgtaacagatatggttgttgggggaaacgtctgccgtgagactgttgcgttcgtggaggagttgggggcagaggatgttttgaggtcgatgaaggattgttggagggggaggttgacgaattggcagagccagatgtagtggtggtcaatgatgatgaacatctgctgcttgatacgatgatgacc

SEQ ID NO: 67790 - DNA, 939 bp, Triticum aestivum
  unsure (1)..(939): unsure at all n locations
  Clone ID: PAT_TA_67790
gaatccccacccaatctcgtcctccgatgcgactccacgctcgtcgaatactcctcccccaccgcctcaagatgcagatctttgtgaagaccctcactggcaagaccatcaccctagaggttgagagctccgacaccatagacaacgtcaaggccaagatccaggacaaggagggcattcccccggaccagcagcgtctcatcttcgctggcaagcagctggaggatggccgtaccctcgctgactacaacatccagaaggagtccacccttcacctggtgctccgcctccgtggtggtatgcagatttttgtgaagaccctcaccggcaagaccatcacccttgaggttgagagctctgacaccatcgacaacgtcaaggccaagatccaggacaaggagggcattcccccggaccagcagcgcctgatctttgctggcaagcagctggaggatggccgtaccctcgccgactacaacatccagaaggagtccaccctccaccttgtcctgcgcctgcgtggtggcatgcaaatcttcgtgaagaccctcaccgggaagaccatcactctggaggttgagagctccgacaccatcgacaacgtcaaggccaagatccaggacaaggagggcattcccccggaccagcagcgcctgatctttgctggcaagcagctggaggatgggcgtaccctcgccgactacaatattcagaangagtccacccttcancttgtgctgcgcctgcgtgggggcatgcanatcttngtgaagaccctcaccggcaagaccatcaccttggagggtgagagctncgacacaattcgacaatgtcaagggccagatccaggacaagggngggnntttnccccggaccaacagcgcctgatntttttttggcaagcanctgggnggatggtcgnacccttccagactacaa

SEQ ID NO: 67791 - DNA, 484 bp, Triticum aestivum
  Clone ID: PAT_TA_67791
ggaatcctcgcgtcccggtggcgcgacctctggctctccgcccctcttaatctcgactgccgtgagctcaccgccggcaggaatgaagtccgctccgacgtcgtctcccgcatcctttcctcccaccggggacccggccgtcgtctctacatcaacacctgcatccactggatactagcagacaccgtggaagcttgcctccgatccgccgctctggacaaccttgaggagcttgatttcatcaaccatctgttagagaaaccacagcgggcattgatcctccgcttctcgcccaccctccgtgttgccaacattggtggatgcaacctctcggacgtcaacttccatgagctccaccttcacttccccttgcttaagcagctcggtcttgtaaatgtcatgatctcggagagctcgctgcatagcctgattgccgggtgcccagctctcgagtgcttgctgattgacatgtgctctggcttcc

SEQ ID NO: 67792 - DNA, 513 bp, Triticum aestivum
  unsure (1)..(513): unsure at all n locations
  Clone ID: PAT_TA_67792
ttcggcacgaggattctgttgatccccaacatgggaaatggcctcaccgcaagnaaagtggattcgccgcaaccgctcttaactagtgaagaagttcttcgtgttcgtttggacatgtacaatttgaaagaatctcagaattcagaagagtccctcttcaattgcctcacatctaaggaggagctgaaggtcaacttccctcacaccatgacatactattatcattccattcgtgacggcctgaaagcaaagtcttacccgcacttctttcaccaatttgttgggaagttttcatctccatgctgtaactatattgaacctacgactctggaaggtgatttgcaatacatcgatttctttgacaaactaatggagtcagcgaggtacagagagaccaaagacggggtgctagccaaggctattgtcattgcaaacaagtttttccaaaaaatgctgttttttcaaattaggattgctgttgatgagtacttacagctcatgcatcatctcgag

SEQ ID NO: 67793 - DNA, 462 bp, Triticum aestivum
  Clone ID: PAT_TA_67793
gcaaggttgtgaaccacatgttaatcatagatgagtttgaggcagcgtggggtattttcttagataaatacaactcgaggaaacataccagcatgacacagttgtatgagatcagattaaagtgggataagcggtgcttcaagggagttttctgcgccaaaatgacaagcattcaacgcagcgaaagtgccaatcacatgctaaagacctacattccaccagcgagtccaatgcacgtgtttgtgaggcaatacatgaggctgcagttcgatcgagagcgagaggaaagctatgaggagaagaggacaatgattggtggagcagtgaggagaactaatttggcaatagaacggcatgcaagtaggatatacacgagagcaatgtttgaagagttcgggcgactactgattgaagccactgcctacaatatcaccgaaatagagaagatgagaaaatatgtaa

SEQ ID NO: 67794 - DNA, 657 bp, Triticum aestivum
  Clone ID: PAT_TA_67794
attcggcacgaggaactctctctacgccttcttctcctctccaccatacaccggcgttgggttcgtcggcggcgatcaggccggagacaggagagccggagaggttgtctggtctcgtgtcatctccgctagtccatgatctgtcaccgcgaaggccgccgggtttggatccggacgagatgaagcacttgtttcgcaggcgacttgggacggctggccgtccccgagtgggccggaggccaaccgtcggtgtgccggtacgcccaccaaggcatggtcgggttcctcaccacttggagctcccgtgcactgcatcgccagtacttcagcctttcttctccaactccgaccgccgccgctcgatctccaccgccggttgatacatccttgacacgaacctcttcacgcactaccgggccgctgagagaatgcagctccggaggcaccctgccaagacactgcctattgagctcaatggagaagccatagtcgacagcctcactgaaattaataagaaaagggtgtgggctagcagaatggtgagggatgacgagctctacatagtacaggttcagggcattcctggcatcagtctcccaactacgctggtcgtcaagaagtgccagaacgtgaacctagcactacaagtggatgaca

SEQ ID NO: 67795 - DNA, 558 bp, Triticum aestivum
  unsure (1)..(558): unsure at all n locations
  Clone ID: PAT_TA_67795
gccgaggttgtccagngggagtccgagtcgatctcgaggaagaccctcaggaactcggctgagaagttcgagttccaggcagaggtgtccaggctcatggacatcatcatcaactcactctacagcaacaaggacatcttcctgagggagctcatttccaatgcatctgatgctttggataagattaggttccttaccctcactgataaggaggctttgggcgagggtgacactgctaagcttgaaatccagattaagttggataaggagaacaagattctctctattcgggataggggtgttggtatgaccaaggaagatttgattaagaaccttggaaccattgccaagtctggaacttcagctttcgtggaaaagatgcagactggaggtgacctcaatctcattgggcagtttggtgttggtttctactcagtatacttggttgctgactatgttgaagtggtcagcaagcacaatgatgacaaacaatatgtgtgggagtccaaggctgatggatcattcgctatttcggaggatacatggaacgaacccctg

SEQ ID NO: 67796 - DNA, 516 bp, Triticum aestivum
  unsure (1)..(516): unsure at all n locations
  Clone ID: PAT_TA_67796
ttcggcacgaggnaaatctttggagagtttcatgcttgtaggcacatatgatgagaatttctctgcaaagtttgcgaagaccctggaaaaattacagtatgttcgtttacttcggttgtcaatgcatttcaatatcgatgctttgctatccagtgtcacaaagttcatccatcttcggtatttagaactcaggtatacatctcaggagcgcaaacctttacctgaggctatatgcaagctctaccacctactgctactggatatcatgcactggagtggtttagatgacttgccaaaggctatgagcaatctggtgtgcttacgctatctcctcgttccggggtcagggtcattgcactcaaggatatcaagagttggacaaatgaagtttctgcaagagctcagtgaatttcgggtgcaagaagagaaaggctttgagattgcgcagctgggatctttaagtgagatcaggagggtcacttagtatccttgatcttgacaatgtcaaaacaaagc

SEQ ID NO: 67797 - DNA, 198 bp, Triticum aestivum
  unsure (1)..(198): unsure at all n locations
  Clone ID: PAT_TA_67797
ttcggcacgaggcagcaggtcatgcgagtacgtggtgcccatggtgggtagcataatcnatagtcgcacgcaacacaaggcagcgttaggttacattgcattgcgttgcgagtaagtatataatacgggaaaagacagacatgttnctcggcgagcccacctgtcaatattgaaatgaaccgcgcacctactctcttc

SEQ ID NO: 67798 - DNA, 374 bp, Triticum aestivum
  Clone ID: PAT_TA_67798
gctcctcctcctcctccgccgccgccgccgccacctcgccccagcccagcccccatcaccggcgaagatgaagaccatcctggcgtcggagacgatggagatcccggaggaggtgaccgtgaaggtgtcggcgaagatgatctcggtgacggggccgcgggggacgctgacccgcaacttcaagcacctcaacctcgacttccagctgcaggagggcgggcgcaagctcaaggtggacgcctggttcggcacccgcaagaccatggccgccatccgcaccgccatctcccacgtccagaacctcatcaccggggtcaccaagggcttccgctacaagatgcgcttcgtgtatgctcacttccccatcaacgcct

SEQ ID NO: 67799 - DNA, 469 bp, Triticum aestivum
  Clone ID: PAT_TA_67799
gaactcccgggtgttgatgattacccaaccaaattcagtgtcgaacacctggctccaatatcactgacatgccttatgcctccatcttacccgagccatcattctccatactttactctcgcagtacaatggttggataatgtgaagatttcctccctctgtgacatgctcgactcgctctgggcgcagcaacctggacaggaacttatttttgagtgggtgcaatggctgcagagctctacgctctctcattttggttttgatgacggaatagtaatacgggattctgtaagtacgatggatcatgtggatgttcgcgttgttggagagattctgtctgtagaggatgttgttcaacagttgatcaactacaatgaagagcaatgccaagaatcttttcttcagggctttcatgtttgcatgatttgtttcagtgagtacaaaggcatcgacttcataaaacttccat

SEQ ID NO: 67800 - DNA, 509 bp, Triticum aestivum
  Clone ID: PAT_TA_67800
ggaagagtggtctcgttcccaatgctgtgatctttacaacgctgattgacggtttcttccaggtgaacagaataagtgatgcgaaaaatatttttcttgacatgcacaggtatggagttgctcccaccgtgcccgtgtacaacagcttgattgatggagctttcaggtctggtgattcacaagaagcattaacagtttatgaggacatggctcgcctaggtttgtgcccagatgagttcacctgcagcataattgtaagaggcctctgttcgggaggtcaagtgcaggtagcggccaggtttcttgaagcaatgcagcaatctggtgtttatcttaatgctgctgcatacaacgcgctaattgatgagtactgcaagaatggagatctagctgaagccctggcaacatgcacaataatgagtgaggttggaattgagcccaatgtggtgacctactcctccttgatagatgggcattcaaggaaagggaagatggaaatagcaatggct

SEQ ID NO: 67801 - DNA, 649 bp, Triticum aestivum
  unsure (1)..(649): unsure at all n locations
  Clone ID: PAT_TA_67801
ttcggcacgagggattnattggtaatgaaacaatttgcagcctcatataggctctatttcagatagcataagtgtgccatgctttggattcaaacttctttttcgcaggatgtgttgccaacaatgtaagtgatcatgagactcacttctcccacagccttctcttgtcgacaaggctcgatgctcctgcttcttgtgaccccaaagtcaaggcgcgactctgctacaaccctaagactcctctagatgggttttccccctgatttttttcacatcctctggatgaactttctttactggaatttttactgttttgtcaactgatgttttggagtctaagcagtttatgttttttacagattgatatgtaccccctatactgacaaagtgggtctttcaatggatgggtcgagtcaaatgtatgcatatataaatataccacaccctgagttcagttgtgttttctcagatttatgtacgaatgacacctgttttcataacttctttacaatcaaggtcataggatgcgattgaacatgcaacaacatacctcattcagctatgatgttagccttttgctttagttatcaggcaaaatttcttgcgttttgtaccttcatgtgcctctcgttcaaacgtcaatgatggt

SEQ ID NO: 67802 - DNA, 945 bp, Triticum aestivum
  unsure (1)..(945): unsure at all n locations
  Clone ID: PAT_TA_67802
gaacaanaaaatccccaaccatnctcgtcgcccatcaaccctaggctcgtcgaatcctcctcccccaccgcctcaagatgcagatctttgtgaagacattgacaggcaagaccatcacccttgaggtcgagtcgtctgacacaatcgacaacgtcaaggccaagatccaggacaaggagggcatccctccggaccagcagcgtctcatcttcgctggcaagcagcttgaggatggcaggacccttgctgactacaacatccagaaggagtccacccttcaccttgtcctccgccttcgcggaggcatgcagatcttcgtcaagacgttgactggcaagaccatcacccttgaggtggagtcgtctgacaccatcgacaacgtgaaggccaagattcaggacaaggagggcatcccgccggaccagcagcgcctcatcttcgctggcaagcagctcgaggatggcaggacccttgctgactacaacatccagaaggagtccactcttcaccttgtcctccgccttaggggaggcatgcagatcttcgtcaagaccctcaccggcaagaccatcacacttgaggtggaatcctccgacaccgtcgacaacgtgaaggccaagatccaggacaaggagggcattccgccggaccagcagcgccttcatcttcgctggcaagcagctcgaggatggcaggacccttgctgactacaacatncagaaggagtccacccttcaccttgtcctccgccttagggaggcatgcaaannttcgtcaagacctcaccggcaagaccattccacttggagtggaattcctccgacaccattgacaacgtggaagggccaagatccaggacaaggagggcatttcttccggacanaaagggttttatttttgccggcaagcanctgggaggatgggccgcactnttgctgactacaa

SEQ ID NO: 67803 - DNA, 498 bp, Triticum aestivum
  Clone ID: PAT_TA_67803
ggccaagtgaaattctcgatctccaaacaccagagcctcacagcagccagatccccagccaccccaagttccgatggcccgcacaaagcagacggcgcgcaagtccaccggcggcaaggcgccgaggaagcagctcgccaccaaggctgctcgcaagtcggcgccggcgaccggcggcgtgaagaagccacaccgcttcaggccgggaaccgtcgcgctccgggagatccgcaagtaccagaagagcacggagctgctcatccgcaagctccccttccagcgcctcgtccgtgagatcgcgcaggacttcaagaccgacctccgcttccagagctccgccgtctccgcgctccaggaggccgccgaggcgtacctcgtcggcctcttcgaggacaccaacctgtgcgccatccacgccaagcgcgtcaccatcatgcccaaggacatccagctcgcacgccgcatccgcggggagcgcgcctagatttggggtcgccg

SEQ ID NO: 67804 - DNA, 509 bp, Triticum aestivum
  Clone ID: PAT_TA_67804
gcacgaggcagcttctttctcttcccgtcgtcgcttttacagagactccggcgactccgaccactcgagcacgatctcagggtcaaagcaggaggcacaccttgatggcgcccctggagtcaagctcctcacagctcttcttcgacagcacgttcgatgtctacgactgcggtaccttggcaggcaccagagtcgtgccagatccacctccattacctggaacttcttatggcaagcagagaagttccaggaatgcaaaagaggctcgttgtgttcatgatgtccctgaggaggtccgggactgctggaacaggcttttcttggaaggatatcaagccgatgtccgcgtatcgacggatgatggaagcgagattttatcgcattcctgcattcttggcatcagatctcccgttctaagaagtatgttggaagaagctagagtggaagatggtttcagaaacatcctgatttctggtgtcccatctgaagcagccccgtgtcttcatcag

SEQ ID NO: 67805 - DNA, 512 bp, Triticum aestivum
  Clone ID: PAT_TA_67805
ggcgacgccagggtctccgccaagtccgccaaggccaaggtccgtgctgccggtcacgggccagcccctgccaccctcgacgacgcgctcggctccgacgacgacgattcggaggacgaggcggaggtcgcggcccaggagaaggcgatgcggcgcgaggtcgtggaggatgatgaggactccgagtccggcgagtcggagggggagggggtgccgctcgtcaccatcgccgccgccgccaagagaaagcgcgtcaggaagctctccgacgagttcgaccgcatcgccgccgcgcagctggagtggggcgggaagaagaagcccgcggccgcggctccggccaaggcgccgctgaggaagaaggcttctggtgctgcggccgttcctgctccggccgctgaggcgccggcgaagaagtcgctgaagaggaaggcggtggcaccggcggctgtgacagcagcgaggacctcaccgaagaggaaggctgcggaggcgccggcggcaaggaggac

SEQ ID NO: 67806 - DNA, 576 bp, Triticum aestivum
  Clone ID: PAT_TA_67806
ggctcgccgtcgccgtcgccggaggaggtgcaggagccatggcgccggagccagaggacgacttcctgaacgagaagaacccgaggccgctcgacgaggacgacatcgccctcctcaagacctacgggcttgggccgtactcgaacagcatcaagaaggtcgagaaggagataaaggagatggccaagaagataaacgacctgtgcgggataaaggagtctgatactgggttggctccaccaagtcagtgggatcttgtatcagataaacagatgatgcaagaggagcagccactgcaggtcgctcgatgcacgaagatcataagtccaaatactgatgatgccaaatatgtcatcaacgtcaagcaaatcgcaaagtttgtggttggcttaggggacaaagtttcccccactgatatcgaggaaggaatgagagttggggttgatcgaaacaaataccagattcaaattcctttaccgcccaagattgatccaagtgttacaatgatgacagttgaagaaaagccggatgtgacatataatgatgttggtggctgcaaggagcagattgagaaga

SEQ ID NO: 67807 - DNA, 583 bp, Triticum aestivum
  unsure (1)..(583): unsure at all n locations
  Clone ID: PAT_TA_67807
tcggcacgaggctcgcccggcccgccggnnggggagaagaaggccatcaactcggagctgtggcatgcctgttccgggcctctggtggcgatgccgccggtgggcagcctcgtcgtctactttccacagggccacagcgagcaggtcgccgcttcgatgcacaaggaggtggacatcatccccaattacccttcccttccttctaagctgatctgcaagcttctgagcctcaccctacatgcagattctgaaacggacgaagtttatgctcagatgacgcttcagcctgttaacaaatatgatcgggacgcaatgctggcatctgaacttggtctgaagcaaaacaagcagccggtggagttcttttgcaagacgctgacggcgagcgacacaagtactcatggtggattctcggtgccacgtcgtgcggcggaaaaaatattcccaccactagactttacgatgcaaccacccgctcaagagctgatggccaaggatcttcatgacattccatggaaattccgacacatttttcgaggtcaaccaaagagacaccttttgacaactggttggagtgtctttg

SEQ ID NO: 67808 - DNA, 525 bp, Triticum aestivum
  Clone ID: PAT_TA_67808
tcggcacgaggctagagtcccacatttgctacagaggaggaacaagaagcatccggtcgaagagatgaaaacaatgaacaaaaagcacaccaactacaaacaacggatcgtgggaaattatacacaaacaacaaattgacagcccaagaaaatgaaactttatcatctaatatggtgggcacacaaggatttgagtctctgtacaaaatgaaaaaaagtacctttagttacatctgcagcttggtgaaggtgcccctttccgaagatatgatggtaggaggtcacacctttgttgatgagagagtgatgtctttccatgatggagtagccattgctctgagaatgttgagctcctgtgagacaccggaggttgtgggatcatcatttggtgtggatgggtcaacggtttcgctgttaactcagaggtttgttaaggctatggtaggacgagcaaggcaccacatcagcttgcttggctccgctcaagtggagaagatcaagcgcaagtttgacaagatttatggc

SEQ ID NO: 67809 - DNA, 641 bp, Triticum aestivum
  unsure (1)..(641): unsure at all n locations
  Clone ID: PAT_TA_67809
ttcggcacgagggctatccactccatggnaagggttgctaagcttgtgtttcatagccctatgcacgctactggtcggttggtttctcaagctctcgggtggcaagagcaagccggccgggaagccgcagctccctccggggccatggactctcccgattatcggcagcctccaccacgtcgccagcgccctcccacaccgcaggatgatggagctgtcttgtcggtacggaccgctgatgcacctcatgctaggtgaggtacccaccgtgatagtctccagcgccgaggcagcgacgctggtgctcaagaccaacgaccccgcgtttgcgggccggccgaacagcgtgattttggacatcttcagctgcggtggcaagggcttcgccttcgccccatatggcagccactggcgccagatacgcaaggtgtgcatcgtggagcttctgagctccaaacaggtaaagcggatggagggcatcagggccgaggaggtggccaacctcctccgctccatgaccgccttgaatggcaccaccttcaacatcagcgagaagatggcgacgctcagcaacaacctcgtgtcgcgggcggttttcggcggcaaattcccgcagcaggagttgtatctccgcgagctgg

SEQ ID NO: 67810 - DNA, 631 bp, Triticum aestivum
  Clone ID: PAT_TA_67810
ttcggcacgaggcaccaccgcagcccccaaccccacccgagcagcagccatggcccccaaggcagacaagaagccggcggccgagaacaaggtcgagaaggcggcggagaagacccccgcggggaagaagcccaaggccgagaagcggctgccggcgggcaagacggcgtccaaggaggccggcggcgaggccaagacccggggcaggaagaagggcagcaaggccaagaagggcgtggagacgtacaagatctacatcttcaaggtgctgaagcaggtgcaccccgacatcggcatctcctccaaggccatgtccatcatgaactccttcatcaacgacatcttcgagaagctcgccggcgagtcggccaagctcgcgaggtacaacaagaagcccaccatcacctccagggagatccagacctccgtccgcctcgtcctccccggggagctcgccaagcacgccgtctccgagggcaccaaggccgtcaccaagttcacctcctcctagactgacggcgtgcagttggtttctgcatctgcatctgtactgttgactctgcttatctatctatccgcaagtagtggtagcagtagtagcacctgtgctgggtgattgccaacgctttgt

SEQ ID NO: 67811 - DNA, 653 bp, Triticum aestivum
  Clone ID: PAT_TA_67811
ttcggcacgaggcccctacagctattagcatccgtactgttgctgtcagcggcggctggggcagcagatgcttcggatcacgccggcagcaacaccaccggtgatcttgcggcgctgctcgcattcaaatcccagctctcggaccccctcggcatccttcgcgatggctggacaagaaacaagtccttctgcagctgggtgggtgtgtcgtgcagccggcgacatcagcaacgtgtgactgctgtgtcgctgccggatatgccgctccaaggaggcctcatccctcatcttggtaccctttctttcctccatgtcctcaacctcaccaacacaagcctcactggctccatccctgatgttcttgcaagattagagcatcttcagccgcacccccaagatcaaaccattttttcgggccggcgccaaaaaacgcccaagtcatgcccccaagacgacgaaaagcgccggttcgacccttcttttcgcccggcagccgcaggccaaacccggcgcactggggggcgaccgggggctccggcgcaagggaaaagcacggctggcccacactgtcaggtgaaaagtcaagattttttccccgactcgcctcccaccccccgcgccctcggccggcactagctatatcccggcgctgc

SEQ ID NO: 67812 - DNA, 625 bp, Triticum aestivum
  Clone ID: PAT_TA_67812
gaggctctaggaggaacttacctaccgatggcttgaaggatgatcttgtgaaaaggctctttgaggaacttcagggtgatatatttggtggagacgggccagttggtggatctcctcccgatgatgatctcaaagaggacgaagcccctggttcggctgatgcatctgtttgccaggctgcggtggaacaaaatgttgatgaaggtccttctcaggtcgcaaccctggaaggatatcctgttggttctgttacagaggctagtgaggaaagtgccgatgctactacagaggttattcaggatgctgtagttagtaccgaagaagttagtcagacaactcttgttgcggaggctagtgagaaaaatgccgatgctactacagaggttattcaggatgctgtagttagtaccgaagaagttagtcagacaactcttgttgcggaggttagtgagaaaagtgccgatgctactacagaagtcagtcaggatgctgtagttagtaccgaagaagttagtcagacaactcttgttgcagaggctagtgagaaaagtgccgatgctactacagaagttagtcaggatgctgtagttagtaacgaagaagttagtcagacaactcttgttgc

SEQ ID NO: 67813 - DNA, 296 bp, Triticum aestivum
  unsure (1)..(296): unsure at all n locations
  Clone ID: PAT_TA_67813
cggcacgaggcaacaacaacaacagnatgcagtgggagcaccaaacccagacccatacccttatatatatgatttgcaaggtaaaaaaatgagcagagagatcaggaatgctggttcactgtataattttgttgcatgttcagcaacacgtaccagttgatgcaaacatgcatgcttagcaaccaaccaattaccttagcatggatgacttgcttggcttaattatggaaagctaggttgcgtgatgacgtgtgtatatatatgatatatttttatattttatctgaaaaaaaaaa

SEQ ID NO: 67814 - DNA, 121 bp, Triticum aestivum
  Clone ID: PAT_TA_67814
aagaatctcactagtgttgctatgcacatgaaacaccccacctataaagttgtgtggtttattgaccattatcctatggttcccactccatgcatcatcgacaagccactcacataggtca

SEQ ID NO: 67815 - DNA, 567 bp, Triticum aestivum
  Clone ID: PAT_TA_67815
caagataatgaaacagttacaagacgacatggtccgaacacctgactattacagagtaccatcgatcgacaaagaagacaggaacagactatctaagcggaggtgaacttggtgacggccttggtgccctcggagacggcgtgcttggcgagctcgccggggaggacgaggcggacggaggtctggatctcccgggaggtgatggtgggcttcttgttgtagcgggcgagcttggcggactcgccggcgagcttctcgaagatgtcgttgatgaaggagttcatgatggacatggccttggaggagatgccgatgtcggggtgcacctgcttcagcaccttgaagatgtagatcttgtacgtctccacgctcttcttcgacttcttcttccccttcttctcgccgccctccttggacgccggcggccgcttctcggccttggtcttcttcgccgccgtcgtcttctcggccttctccgccaccggcttcttctccgccttgggggccatggatgccgcggctgctgctgctgcttcgacgaggagaggtgtggtgtttcgctgggac

SEQ ID NO: 67816 - DNA, 654 bp, Triticum aestivum
  Clone ID: PAT_TA_67816
attacaaagctctactacagcaagaatggatgaagctcctgcttagagcatcagcagcaacaacttgtgcccagcaaacaatcaatccaacatctaggcattctacagtccagtccagcaagaaagaagactagttgcccaggagttcatttcattaccatggaggtagcagcatgacatttgaagtttagcaagtcataattaaagtactaaaggcatacaaattagatttgctggatacgatctagttgagcttcaactcttggatacggagcgaggagaacctgagcaaggctcaaagggccttcatgaatgatatcactttcaggtggaagaccatctccaggaatcagagggccggaaaagcatcttctcttgccatcgctgaggtcatacaagacgtgtacgctgtccaactggattccagcaaaagaaatgctgtagatgcagttgcccttgatggaaggaagcatatctgcatcaactaccatacagttgccatgacttatgaagagcgcgctgctgccgagactttctattggttcaagtagcttccgcttgacatcgatgctgaaaacttgaatgatttcgggttgctctctaataagcagcagtttaccggctgactcaacaagagcaacattgtagtccttg

SEQ ID NO: 67817 - DNA, 628 bp, Triticum aestivum
  Clone ID: PAT_TA_67817
atttctgacgttcttccttaaacatgcacataacaagatgaaacgaaaccgctacaggaacaccaccggaccactacgaagaacactacgacatggaacgcatcgatctaagccttggtggtcttcttgggggacttggtcgtcttcttaggagacttgggctccttgccctccttctccgcggtcctcttggggaggagcaccgggttgatcttggggatcacgccaccgtgcgcgatggtgacgccggccagcagctttccgagctcctcgtcgttcctgacagcgagcagcaggtggcgcgggatgatgcggctcttcttgttgtccttggcggcgtttccggcgagctccagacttgccctccaatggatcctcgttaagggatttagattgtactcattccaattaccagacactaatgcgcccggtattgttatttattgtcactacctccccgtgtcaggattgggtaatttgcgcgcctgctgccttccttggatgtggtagccgtttctcaggctccctctccggaatcgaaccctaattctccgtcacccgtcaccaccatggtaggcccctatcctaccatcgaaagttgatagggcagaaatttgaatgatgcgtc

SEQ ID NO: 67818 - DNA, 308 bp, Triticum aestivum
  unsure (1)..(308): unsure at all n locations
  Clone ID: PAT_TA_67818
caataattccttggtnggaactgtttncattttattgcccagntaagggagcncagntngcaactgtngatcagncactaactatcgtntggtncatncattacattcaagaanggatncagngcgataaatgcagcanaattgtanccttatnctggacagtaatgccaanatgctagcctagcacgcncatccgctcgtntgtccttcggttttagggccttgttntgcaactgaattgaagtanatgtnttgatcgngctcatgctccaaggcnagcttggcnatgcacagnaaagcggggtcna

SEQ ID NO: 67819 - DNA, 384 bp, Triticum aestivum
  unsure (1)..(384): unsure at all n locations
  Clone ID: PAT_TA_67819
ccctgtctaggcgngatcgncatcatggganacagaggaagggaanggngggattcatatataagtcatagcnccanggagatagctacncangctccatttntcctgctgccgntgtcagttttttgctgctgctggctnggngctnttaaccngcctcttnttaggctcccgnggntttgactnanccttttngatgccacccttggcggctgctggcttggtcgccgnggnactganntttgcaggncccttgggggnactaacctnggnaggctccttggccttcccgtnaagnccggttggcttnacggccttnagggatgccattcttatatgctgctntgttccggnactggaaggcttaaaaacttaagctgtcgc

SEQ ID NO: 67820 - DNA, 676 bp, Triticum aestivum
  unsure (1)..(676): unsure at all n locations
  Clone ID: PAT_TA_67820
aacttgcaaacaacagtatccnaataattcttcatatgttcctatnacatcttccatcctgtagcttcctttcaaatacaggagtaactaacaacagcatcagcaagaatgagaaaaccaaggagcagaggagtcacaggttgtttgggagcagacccacaaacgggcgcacgcacacacactatacaagattgtcggtaggcttccctgtaatcatcccggaggaagtttttgtcaacgaagcgaactcgcaaagtttgttcacttgcggtaaagaatgtcacagtgaccacgcctacacaacaaggtcagcaagggtgcgccatcagatgataacaagtcggcgtcgttgcttccctcctccagcagtttaggagctgtgctcgaggaaaggtagctccgagtcaaatggagagggcccttgttcaagtctgactgatgaaagaaatcgaggcgcttcactaacacaacttgacccgtcgagctcttatccacgacttcgacacgcaacggtatgccngagcgtgtatgtcaaagccctcatttgtgtagtggtagcttcagcatccagcgatcggaccgttttccaacagaactggaggacattcacatttttggggatagattgcttgtagaactcttctgtccggatttcagtctcagtaagcaacctaag

SEQ ID NO: 67821 - DNA, 704 bp, Triticum aestivum
  Clone ID: PAT_TA_67821
cggatcgtctggtaaaatagtgtagagaagatatgttttaagcgatacaatagtactcatacttgtcacgctaaatgatggaaacttttctgatacaggcaaaactttggggttgtctagatctccaaagagccgagagaatgaaaagacagaaaatctagagaccagcccttttcttcaagtgttgcttgaaatccatgatatcgccttcccacctagtcaccgcctggttctcacagacccagatctcttgagcaacctgattgatcagcctgaagtcatggctcaccaggaccaaccccccgtcccattccttcagtgcctcagcaagtgagtcaatggtctcaatgtcaagatgatttgtcggctcatcaagcaacagcatctgtggctgcctaaatgctagccaagcaaaaatgacacgggccttctgcccatcagacaggtttttcattggcatcacctgtgcctttcctgacaggccaaacttgccaattgcagctctcatcttctcctcttcattcccagggtactccctcatcatgtactgcagaagtgtgctcttaccagccccattgggaccgaccagtgcaactctcgagtcaaggtcaacaccgaagtcaaggttcttgtagatgagattatccggagtgtaaccaaatgtgacatcagcaaactgcagcactggtggtgggagtttgcca

SEQ ID NO: 67822 - DNA, 635 bp, Triticum aestivum
  Clone ID: PAT_TA_67822
cgagttgaattatacaaaaaaaaagggtgacatgtgaacacaaacaccatagcgacatggacactcgattgttggtgcaataacaagtgataagcctgtcaaatttcacttgaaaaatataaccaactgtgtgccacagattgatcatatattcttgttggggcattacatgcatgttcacatgttatagcagaagtacattgggccggaaggtgggtgtcggtgctcacagagcccagccgtgcactgcgtcggggaacttgtaacgggtggaagcccctctgatcattttgagctcgcctgtgttggcatcaagtctcatttcgagagccgacatgacagcaacattgctcagaggaatgcaccagtcatcccattcacgcctagtgtcatagaaccttgtaacgcagaacttgccctcaccaagataggtgaggtaagaatgggccaaatgccaaccctcaccaacgtaaacatcaacattgtcccatacttgcttgtgcaccgggggctccgaggccttagctccagcgatcatctcagccgagcacagcttgttcaatctcttggagaatccaaagtagatgccatactcaggtatatattgcactcggccttcaaaaggcagcgtccag

SEQ ID NO: 67823 - DNA, 562 bp, Triticum aestivum
  Clone ID: PAT_TA_67823
tcgcggtgcgattcttacaggataacacggccacaaacacacccgaacagctaactacgagacacaggaagacgaacagcctaagaggaggtgaacttggtgacagccttggtgccctcggagacggcgtgcttggcgagctcgccggggaggacgaggcggacggaggtctggatctcccgggacgtgatggttggcttcttgttgtaccgcgccagcttggcggcctcgccggcgagcttctcgaagatgtcgttgatgaaggagttcatgatggacatggccttggaggagatgccgatgtcggggtgcacctgcttcagcaccttgaagatgtagatcttgtacgtctccacgctcttcttggccttcttcttgcccttcttgtcgccgccctccttggcggccgacttccccgccggcagccgcttctcggccttgggcttcttcccggcgggagtcttctcggccttctccgccgcgggctcctcctccgcgggcttcttcgccgccggcttcttctcggccttgggcgccatggatgcggacggtggggtggacc

SEQ ID NO: 67824 - DNA, 264 bp, Triticum aestivum
  unsure (1)..(264): unsure at all n locations
  Clone ID: PAT_TA_67824
tttaaacctnantgntaaaaataaagatnggangtncntcancagacaggtnggccacacatgcagngtttcagcaaagcctttccaggaattcanngaaggnggagaacagatcaggncancncntgccacaatcagnttgnccaacgccaatccatgttgggattanangatgcgaacaacgccatccnttatnattatcctgttngcntctngnntcctttccaggnnganctttacttggcccctagtgtaagcaacagc

SEQ ID NO: 67825 - DNA, 524 bp, Triticum aestivum
  Clone ID: PAT_TA_67825
cagcaccattgttacaacatgacactgtcagaaaacacacagctacctacagagttcctcagacgaggaagaagaaagaaacacaagactcaacgcacgaggagcctaggacgaggtgaacttggtgacggccttggtgccctcggagacggcatgcttggcgagctcgccggggaggacgaggcggacggaggtctggatctcgcgggacgtgatggtgggcttcttgttgtacctcgcgagcttggcggactcgccggcgagcttctcgaagatgtcgttgatgaaggagttcatgatggacatggccttggaggagatgccgatgtcggggtgcacctgcttgagcaccttgaagatgtagatcttgtacgtctccacgctcttcttggccttcttcttccccttcttgtcgccgccctccttggacgccggcaccttcttctccgccttgggcttcttgcccgcgggggtcttctccaccggcttcttctcggcggccttgggtgccatggatgctgcgc

SEQ ID NO: 67826 - DNA, 449 bp, Triticum aestivum
  unsure (1)..(449): unsure at all n locations
  Clone ID: PAT_TA_67826
agaagatagcaaacagcagcgagatgctgcgattacatcnacgacncgaaccctagacacaggctagctaatctggtggcggcctagcctccgaatccgtagagggtgcgtccctggcgcttgagcgcgtagacgacgtccatggcggtgacggtcttgcggcgggcgtgctcggtgtaggtgacggcgtcacggatgacgttctcgaggaagatcttgagcacgccgcgggtctcctcgtagatgagacccgagatgcgcttcacgccgccccgccgcgccagacgacggatcgccggcttggtgatgccctggatgttgtcgcggagcaccttccggtggcgcttggcgccgcccttgccgagtcccttgcctcccttgccgcggcccgacatcttctcccttctccttccttctcctcggtgaggttgacttgtctttgtggtagc

SEQ ID NO: 67827 - DNA, 141 bp, Triticum aestivum
  Clone ID: PAT_TA_67827
caactagcacaagaaaacaaactagttgttgcatctacaaaaatctgaaatgaccatctaacaactaagttacttacaactagcacattcaaaactgttgcctcatgttgttttttcttagagaaaaatctgtactgaacc

SEQ ID NO: 67828 - DNA, 607 bp, Triticum aestivum
  unsure (1)..(607): unsure at all n locations
  Clone ID: PAT_TA_67828
gaagctcttagaaaccagnctcgccaaaaattaatgtttcctccttgttgttagacatttctacagaaacaatttcttcaggttgtacccgcaaaagagcaaaaatgaaaggaatgtagaaataaaagaacctaagtgttagtttctgtatcgaggtcgtataccgaagataatccaggcaagcatccaaggtcaacggcattcctgtcatgcctggacgcttccatgatgtgtcagtataagcaagtgccctctggccaagtagatcatcgaaatgtacgctgatcttgcttacgtaatctggagctggtagttgctcgactaatctggacctcatagtgcataatgggtaagctccatctccacatattttcaatcatcggggtccatctcctcatcttgctcggatttattcgtgtcgcttctatcagattcctgctgtgtgtcttggctaggatcatcttcgggcaactcaccctcgtaatcctcactttgaggttcattattcttggtaggcacgagtgccagggtgcgaaccatccaatcagggcagtcttcttcacctccaaaaaggagcgcaccatgcttatctttcaccggttggaca

SEQ ID NO: 67829 - DNA, 162 bp, Triticum aestivum
  unsure (1)..(162): unsure at all n locations
  Clone ID: PAT_TA_67829
atacacacacanacncacattgntgcctcgattgtttcntctncaccgatcaacccacgtncgcatgcacacaagatgagtatcttnacttctgctntgntctagntagactcgagctgcgcgtaccacacaccctggatcttgncatccttgggcgccttg

SEQ ID NO: 67830 - DNA, 521 bp, Triticum aestivum
  unsure (1)..(521): unsure at all n locations
  Clone ID: PAT_TA_67830
tagctttgcactncttncttgcctttatattgatgtctttcgtgaaaacagaagcctcagcgctagnttaacctggttgggnaggtagcgcaaccaggcaaatcttcaactttggcactagtagtccatccagtacaaaacagaacaaaactccctcactgagnattattcaacctgatganaagtcctcccacccaacgccatagatgtggatcccccagtgttctttcctgatctcgatgaggaatttgcacccctcacattcctcgaaagcacgtcttcgtcagtggcgcaattaaattcgacccttgagtggcatgggataaactacagaaaacaacaaaaagaaatggaaaaggaagatcaaaatataggctatcctcatgcttgctggggaatgagacgtttgcagatgagactggcaaatagctaaactctaaaaaccgatagactaaaaaagggaaatgaatgcaacaagtaatgactaaatgagaaaaaagaaatctaagaaaaaagtacag

SEQ ID NO: 67831 - DNA, 492 bp, Triticum aestivum
  unsure (1)..(492): unsure at all n locations
  Clone ID: PAT_TA_67831
acactggctttggtttggngntatatagnatactgattcgaaactgctgctgctgctacatcagnatcagcatgaatgcagttcagaccttccccctgctggtgagagatgcctgcacttgatcatatccagccaacataaaggctcccgcaacacctgaccgaagaatgttcgcaccagctcccttgtacagcaaccttggggtggcacccacatccagcaacacctcagagaagctaaacccattcatcatcattcttctcctaattgtatcaattgggtatgttgcaaaggccgacatgttggttgtcatccatgctaatgcaaaattggctaggaaatcatcctgcttgctactgccagtgagaacaatagacttgagggcgccataaagtccaaagtacaggccacgggtatatccctgctccatacgaggagacgagataccccctgtatagatccttcacgtgtgctctgggtcccaatatacga

SEQ ID NO: 67832 - DNA, 409 bp, Triticum aestivum
  unsure (1)..(409): unsure at all n locations
  Clone ID: PAT_TA_67832
tcgaaatacagnaggnaaatagcgaactacagnaggnaagtagagaactacacaagtcgcggtatcatcaaacttttgggatctgcaagggggcaaggaagagcctagccgccgaagccgtagagggtgcgaccctggcgcttgagggcgtagacgacgtccatggcggtgacagtcttgcggcgggcgtgctcggtgtaggtgacggcgtcgcggatgacgttctcgaggaagatcttgagcacgccgcgggtctcctcgtagatgaggccggagatgcgcttcacgccgcccctcctcgccaggcgccggatggcgggcttggtgatgccctggatgttgtcgcgcagcaccttcctgtggcgcttggcgccgcccttgccgagccccttgcctcccttgccgcgcc

SEQ ID NO: 67833 - DNA, 478 bp, Triticum aestivum
  unsure (1)..(478): unsure at all n locations
  Clone ID: PAT_TA_67833
caattgaattgcaaattgagatgcctgtaagaacaatataaagctagctaacaaagttgagcttgtgaactatctatcctagagtagtgtttcctgaagacgatgacctcaacagatgaggatggtgatttggagttaccgaacccggcattgcaccagagctgaacataatgttcggcgcctgtgcaactggctgagtctggatagccgtaaacggtaagcgaggcccaaacgagagcatctgtggccgccgctgcacgaacggcatttgtggatgcccctgcccctgcatgtaattagcgtatgccgctggtaccgtggcttcagccatggagcgtggcatggccaacggtctagggcttatattcgttggattgggtgacatagtgctaccaccactggtgggcagactagtttccgggggatttgagcaggctcgcatcgcctggatacggncagctgaaaatcctctgcttgg

SEQ ID NO: 67834 - DNA, 170 bp, Triticum aestivum
  unsure (1)..(170): unsure at all n locations
  Clone ID: PAT_TA_67834
gagaagaatacagaggtagaagagagacgggacagagaagaagagttcccatcgggcgtctaggcagggcggccagaggcgaccagaggcggcaggctgcccttccagcggggtcgcnaggagcaaggctgacggngctcccgtccggnggcgtctttaggagagntnct

SEQ ID NO: 67835 - DNA, 499 bp, Triticum aestivum
  Clone ID: PAT_TA_67835
caaatgggatagagccaataatggaatcgaaatagagtatttaaacgacacatcatagctcgcacacaggtgcaggagtcaaagtgcaataacgcccaggaacacttaacatacactaagattctccaaaaaagacttgacactaaaacttctgctagataactcgatggcagacaccagagcactcatttcttcttgatggcggccttggtaaccttggcaccggtggggtccttcttctccacgcccttgatgacaccaacagcaaccgtttgtctcatgtcacgcacagcgaagcggccaagaggagggtaggtggcgaaggtctccacaaccatgggcttggtgggaatcatcttcacgataccagcgtcaccgttcttcaggaacttgggcagcgcctccagctccttaccagatcgcctgtcgatcttggtcaccagctcggcgaacttgacagcaatgtgggcctcttgggctcgttgatctggtcaagagc

SEQ ID NO: 67836 - DNA, 579 bp, Triticum aestivum
  Clone ID: PAT_TA_67836
ggccttccataattaaaatttaggaaaacgtaaaggtacattgtatgatgggaaagaaaactaaagccactcaatgcacattacatttttttttctcaacactggatcattaaccattagtccagttgttttctcataaactgagtgtaaaattaaagatttcattgggggaacacgattacttgaaagggtgcagagtcacacccaaagctatcactaccattgaatgttataccaagaggagagcacgaaggactgtgagccaggcgaaggcagagctataagaccgtcattcttctcttggatcacaactattaccatatgccggtaaggagaagctaatacgcataggatcctatacacaagcatttccagcatgcacaacacatgatagctacatctttgctttcttcccaaccccaggtaatttccatagaagcttatcacaaaatatttggcttatctgcttcttctcccaatgaaagaattcctggatacggttgcatgaatggtggcactactcgatcacatttaatatttttgagcatctataggaagtgctagcacaacatgtaacag

SEQ ID NO: 67837 - DNA, 708 bp, Triticum aestivum
  Clone ID: PAT_TA_67837
aggaagctcgacaaaaataattactaatacacagtacaaatgtcacttgatcagtcctaatgtaacagaagcgtatgtacttctctgtacagaccatctgagctgaacaccgccgccgccggcgctcacctgaaactgcagcaaaaccacactaccactaggaatctctcgccgtcggtcacaagcagcagagtgggcaccggacgagcccgttctcgttgcagtcggggcaccggacttgccctccaatggatcctcgttaagggatttagattgtactcattccaattaccagacactaatgcgcccggtattgttatttattgtcactacctccccgtgtcaggattgggtaatttgcgcgcctgctgccttccttggatgtggtagccgtttctcaggctccctctccggaatcgaaccctaattctccgtcacccgtcaccaccatggtaggcccctatcctaccatcgaaagttgatagggcagaaatttgaatgatgcgtcgccggcacgaaggccgtgcgatccgtcgagttatcatgaatcatcggatcagcgagcagagcccgcgtcagccttttatctaataaatgcgcccctcccagaagtcggggtttgttgcacgtattagctctagaattactacggttatccgagtagcacgtaccatcaaacaaactataactgatttaatgagccattcg

SEQ ID NO: 67838 - DNA, 686 bp, Triticum aestivum
  Clone ID: PAT_TA_67838
tgaattttttttggtggcttatatggcattaagctttctaattcattgtgctacgcaattccataggagcaatttcacagctcaaacatttctgtgccacgaactagcaagatttcccgtcagctgctgagcagtcaaacaagaatagctgcagttgcagggaagaagaaagaacataaaccatgcattgtgaagaagctgcaggtgatcatcacatgaaccaggtcgaccgcaggaccaacgccggagtccgcttctccccctccatgacatacaccaggccaggctgcagcttgccgcccctgccgaggttgaagctgaggaatccttccaggtgcgggccgtgcgtatccccctccgccgcaccgcccatcctcactccccatcccagctcatgctcaggggtgtcggacaggcagcagccccaccgcaccggcccatgcccggaccacccttccatctctacccagccttgtgctctcatggcttcaaacagctcacactccaccatcgcagcagcgattgactgcacaggcctgggctgcggtccgtgtgccgcagggtcgttcctcgccatgggagcaagaagaatgtccggaggaggagtgcccctttgtggttttaggctgccaaagggaatggcaagtgtcccgaggttgttgaaccgggacagcaacgggcggatc

SEQ ID NO: 67839 - DNA, 663 bp, Triticum aestivum
  Clone ID: PAT_TA_67839
cgaaatctggctacggacgggcatggagttattttctttcttttacagaaagaagcgtgaaggaaatcatgctagaaacagaaaggatgtccttgccagggcattgacctgcttgtgtacataagcaacggataactagaaggatattttctgaatacgaagagctgacctaggcctttgtaccatcgtaacagcaaaaacatagaagaggcgggactgcgccattacaaaagctccaggtaaatgactcgtacagtccacagcgaagaacatcaatctcaccactccgaaccgctcggtcaaccagcaagatgaattagatcttagagaccgcttcccgtcgctttgctggtaggagggctttccactgaagcaccacagccaccggtctatactcacagaagaggaaacttcacggttaaacacctgtcatttctggtaatgaccaggccatgccggcaaatgtagagacctaatgcaacccttcaacacccccatcgccactgatccctgcaactgcctcaaaattctcatcttgatcttgtatgccgttgacaaatacgctgatcgggttcagatgctcagctacttccttcctcaccgtctcaatcgtcaagatgacaccacggttgttgctgtagcgtacgttgtaatggatggaca

SEQ ID NO: 67840 - DNA, 655 bp, Triticum aestivum
  unsure (1)..(655): unsure at all n locations
  Clone ID: PAT_TA_67840
attacctagttgctgagtnaggaggccaaacagctacctcatttctgactccagctccaggactaataaccaatcaagaaacaacctcttacgaattatacgagagactgaatcacattttctttgtcaagggagcagataacaaatatctactcgatatctactgtactgcggatggtaacatacaaatatccccgcactttgacttcgtatatcttctttgaatgcgtttgcgatttcatcattcattcagggaacgtactggcactggcggagctacatgtgttcctgcaggggccatgcccccccaacctgaataaaatgtctgaaggaatttttcttggaagtgcttaattagaaaaggtatagtttttggccccctcaagattgttgtatttgcctttcgcccctccaacgtttcttctctagctccgccactgcgtactggagtacacttatttcttttctacagcatcactttcttatcttccttcgcagcaagggccacccaagtaggaaagaacggcagctggcgggaatggctaccctctggacagaacggcttggaaatttgaaaatctgccaaatactatgatgtaaagcaagtcaacatgttaaattgagcaaaaaacaaaaattacgagtgaaaggaaat

SEQ ID NO: 67841 - DNA, 167 bp, Triticum aestivum
  unsure (1)..(167): unsure at all n locations
  Clone ID: PAT_TA_67841
cnagntgtannacccgnncacnttcannancccaaccgnnttgnnanggatgccnancctgcncccatgtaatnacttnnagtagctnctncancnnaccatatnctncangcanggntatnaangcntnananngccttgccatntntgccttnctntgatgcatg

SEQ ID NO: 67842 - DNA, 373 bp, Triticum aestivum
  Clone ID: PAT_TA_67842
agtaagacaacataacatataagcagaaaaaggaaaattacacagatcttcatgtaagatcttacgaatatagcatcgactcagacttggttaagtcctagtccactcagatttaccacgcccgatacgagagctgttgctggctcatgagtgttgggttgtacactgcccgaccagctgctactcctacattgctggtagatagaccatatatgcggtggacgaaggtacattagagtcggtacagtgcaaaacgggaagcacgcggagaccagaccaccattattcacccgccgtacgtctacagcaccggcgggcgatcaattcctccatgagctgcccaacatcgtcgtacgacgacccacccttctcc

SEQ ID NO: 67843 - DNA, 628 bp, Triticum aestivum
  unsure (1)..(628): unsure at all n locations
  Clone ID: PAT_TA_67843
acatactgcgaagaacagagagcacaataggcgcacacctgggacattcagaaaatacaggaccaactatctttattagtcgccggttggctccatgatggctggaccgagccatcaggtagcaagggtgaagttgtcatacaccttgccatcactgctcctcttgtactcaaacagaagcgaggagtggttgaaggccgtgagcttggtgaagccgtagtctctatccctgaacacgctccacttggggacggcgctggtgtagccgttgaggtggctgccgccgccgcccgccaccacgaagatggtcccgttcatggtgcccgagtagcggctccgctcgccggtgacgcactggttctggtagagcgggcaggtgcgctcgtagttgtgcacgtggccgaagatggcaaggtcgacgcggtgccgctgccacagcttctgcaggctctcccgcccctcgggctcctcgaaggagccctgctcagcgtaccacttgttggaggagtatccgagcacacggtgcgccgtgaagatgagccatggctggtgcttccggtccaccgtggagaggcactcctcaatgaacttgtgctgcggcgtcccctnccgccagtcgtgctncgag

SEQ ID NO: 67844 - DNA, 109 bp, Triticum aestivum
  unsure (1)..(109): unsure at all n locations
  Clone ID: PAT_TA_67844
aaggcgagattttcccttgacaatgcaataagggacctacattttcctgcanagagcatggagccacacaaccagctncaatcggatcaacatcatgagctatgacaac

SEQ ID NO: 67845 - DNA, 544 bp, Triticum aestivum
  unsure (1)..(544): unsure at all n locations
  Clone ID: PAT_TA_67845
ctaacattccccctacagtcgtagcgggagtgaagcggatgattacgaatgaatttggagtcttgtgcttccgtcgtcttctccgctgcgccatcatcagtacgactctgatgggtcgacacctagggcgatgactgcgtccccttttggtgcctcccttgtctctcctctattccctcccgcaatcatagcgggagtggcgtggatgctggtgatgacacggacgctgttgactgtagttgccgccgatgtgttgctgtagacgtggtcgtgtgtgtcgatgtcgatgtaaccgtggtcgaggtagtcgtggtcgatggtgtggtcgtggtggatgatgaaaccgcacaaagccggaggcgcaaaaaaaatgcactatgacggagctgcagacgtggacagtgcaccttgcggatgtcagagggtgtcgtcggtgatgagtcaattggttttgccaggaccggaggaaacccatcgagcacacatccgttttgccagaaccgtgcgaccgtgtagggncgtcactgtagtgatgccatgtcga

SEQ ID NO: 67846 - DNA, 474 bp, Triticum aestivum
  unsure (1)..(474): unsure at all n locations
  Clone ID: PAT_TA_67846
taacctggtaactatggncatccaaagatgtnccgtnttttgctgaacttgggatgcttgatcttccatgttctnttttntttgaagggaactttatccacttaaacttacaacaatctntatacctanaatggtttttatgccgggtgacaaacaacanatgaaagttcactttcactganaacatacctcggncatattttttaggtctataaacgatccgaaaagagcgattgaatcanatnttattatgganattaacaaccaagtcatgcncatcatntanaagcctccanacgtcaagctgcccagccatgctntggcactcccgcagtatctnatccatgctgctgtacctntcgatgatcagcctcctcctntgcaggacgcaggccgcaatggcataaagcaacaaatcgtcggttggaggagcatggagccttatccttccccatgtggaccttccgatcccag

SEQ ID NO: 67847 - DNA, 562 bp, Triticum aestivum
  unsure (1)..(562): unsure at all n locations
  Clone ID: PAT_TA_67847
cttttgctttagctaagcacacgattacaacaagtttataacattacactgagtgttaacactaagtttatttgggaaaaaaaaggatgaagaaaagtagctgccatggaagcaaagagaccaaatgcagaagggaaatgagtgcaaacgagaatatccaaactgtggtgtttacaactaatgcactgatgagctcgtcttaagcagaactaccgaggataccttgcagatgaagcgaactcctcttccatactatactgcctggacaatacctggctcctacctccatctgcagtccatggaccatttcttacaccacccccctcatgtcccctggatgcttgagtgccttcgagtttgatctccacttgcttcatggacggacgatcctctcctcttaatgcaatacacattgctgcaagcgctgcgacttcttccatgtcactgcctccctcttccataacttgcggatctagtatctctgataatttgccttgtgtgaataaggcanaaaaatgtgtaacaaggccttcatcttctgaagatatgtatgaaaatggtt

SEQ ID NO: 67848 - DNA, 104 bp, Triticum aestivum
  unsure (1)..(104): unsure at all n locations
  Clone ID: PAT_TA_67848
ccgacacaacagtgaagaacgtcgtaccactaccactaagtgccctatcaacgatcgatatcncaaacacaagcgtacatgacatcacggtcgagcaaccaacc

SEQ ID NO: 67849 - DNA, 728 bp, Triticum aestivum
  Clone ID: PAT_TA_67849
aacaaaaactaattcccctcttagttcttatgaataagctttcagagtctagctatttctcacatccggaaggatttaagtgagatcatatattctatgtactaaaaatgaaaaagatcaatcctccaccggatttacacgaggattaagaaaagccttaaagtccgaataaccggaaggatttaagtgaggtcatgtattctatgtactaaaaatgaaaaaggtcaatctcccatcagatttacatgaggattaagaaaagccttaaagtctggataaattaccagtacttcatgaaacagagtacattaccttgtcccagtcgacgtcgtcgctgaacgaagcaatgcaccagcccctttctatatgctgcagtcattcgatcatcatagactggtagagcaccctacaacaaacctccaaaatgattaacgatatcgatcattcctcagtgcagatttgaagaagtcaccataatcccgcatagggcatcctagtgagaagcaatcaggtgtccagaagtactcatttagagctatcataaatacaccacgtagaatgtggtgattttccatgctgaattttttctgcctcctaccaaatataagagaaccatatccattaccaagaagcttcttcatttctttcggggatatgtgttcgacccaaaggcattttttctcgcatcaatatcggaaaccactcccctgatcatgctctctgtatca

SEQ ID NO: 67850 - DNA, 667 bp, Triticum aestivum
  Clone ID: PAT_TA_67850
agagctttaaacaaacagtctactctaataaaccggcaagagtaaactttttaggcatccatcgtgaaggccacgttgtgcttcttgcacttcgccaccacctccacgccgtctttgtcgaacacaatcaccctcaggttgttcggagtcagcagcttgaaagtgactaagtacccgatcttgatatgatgagcggcagcgaagggggtccaacccttatcaagggtgactctaccgttcatcacccattatacacaccctctagttgcagccggtgttggtcttcagcttgaattcttcagggacgatggggaagtgcttggtgaagtcaagcggcatcgacttgcactccagatgcaaggatgaccttgcagaagtgggttggcccgaccttgacatggaaatggccgaagttcccggaccgcttgggggcgctggggagctccaccacctccttgcctttctcttctgccgacaccacctatacttgcccttggtgattcccaaaggagcgttctcgatctgtgatttcttcttctccgagaggatgacttggtatgtggatcttgtcgcccagaatttccattcccatcaatgaccataagaaccagacatttgtaaggaactccccaccttcacccaggctcttggcgtgcaggtagcccct

SEQ ID NO: 67851 - DNA, 743 bp, Triticum aestivum
  unsure (1)..(743): unsure at all n locations
  Clone ID: PAT_TA_67851
aagctgaaatnacaatgagccaaaatgcatattgcattgtttacgacactgatgctacagaccaaagtacaacaaaacttccagcccaggtgatatgattggcacccaggactgaatcaaatggcgtatatgaaagcgactaacttagtcgacctcctcgatcttggggccagcaccgccgctggcagccggcgcgtcctcgtccatgcctcccggcatgtcagcaccagcgccctggtacatcttggcgatgatggggttgcagaggccctccaatggatcctcgttaagggatttagattgtactcattccaattaccagacactaatgcgcccggtattgttatttattgtcactacctccccgtgtcaggattgggtaatttgcgcgcctgctgccttccttggatgtggtagccgtttctcaggctccctctccggaatcgaaccctaattctccgtcacccgtcaccaccatggtaggcccctatcctaccatcgaaagttgatagggcagaaatttgaatgatgcgtcgccggcacgaaggccgtgcgatccgtcgagttatcatgaatcatcggatcagcgagcagagcccgcgtcagccttttatctaataaatgcgcccctcccagaagtcgggggtttgttgcacgtattagctctagaattactacggttatccgagtagcacgtaccatcaaacaaactataactgatttaatgagccattcgcagtttc

SEQ ID NO: 67852 - DNA, 186 bp, Triticum aestivum
  Clone ID: PAT_TA_67852
ctgggatggtgttggtgtgtaggttgcatgctgaccgagatctcctcttcgtcccgcagtctccctctatgcttcctcctcgtcctacccggtctcaactgctttgctagatgtaggccgatcgatcgggtggcggaggctgcgcagtgtgtacacgacgactgggcggcggcacatctcggttca

SEQ ID NO: 67853 - DNA, 696 bp, Triticum aestivum
  unsure (1)..(696): unsure at all n locations
  Clone ID: PAT_TA_67853
catctctaaaanacctttcattacactaaacaccacccacgatacataaacttgccaagcagaaccgaaacctaaacaagggaggatgaggcatccttttgtacagacccttggaacatcaagcactcctaagaccagctatcggaccggatcagatcagatcaggcggcggcgaccttgcgggccttcttggcggccggggagcggacggtcttcggcttcgccttggccttggcagcgggcgacttcttggccttggtgaccagcttcttcttcaaagtaacgatgccggaaacacgacccggccaattaaggctaggagcgcgatgccggccgaagggtcgagtaggtcggtgctcgccgtgaggcggaccggccgacccggcccaaggtccaactacgagctttttaactgcaacaacttaaatatacgctattggagctggaattaccgcggctgctggcaccagacttgccctccaatggatcctcgttaagggatttagattgtactcattccaattaccagacactaatgcgcccggtattgttatttattgtcactacctccccgtgtcaggattgggtaatttgcgcgcctgctgccttccttggatgtggtagccgtttctcaggctccctctccggaatcgaaccctaattctccgtcacccgtcaccaccatggtaggcccct

SEQ ID NO: 67854 - DNA, 307 bp, Triticum aestivum
  unsure (1)..(307): unsure at all n locations
  Clone ID: PAT_TA_67854
agcctctcttactttgaagggntagattaaagcttgacatctagtacaactactcagacgttnggataccaccactaatcgattacaagaatcagattaccaaactccagttctgaacctaccaagaaatcactacaaaaatagnncagggcaatcgagcgagaagaacgcancagntcatggtgaacaagggaccggatcggcgtccgtgtgctgaatggacgcnttgtcttctttcgctggtgcagcttcattcggggaagctggtgtttncggcggtgccgncacagnagnagntttcttacca

SEQ ID NO: 67855 - DNA, 668 bp, Triticum aestivum
  Clone ID: PAT_TA_67855
atattacagagcaatacatcaactaaaacatcgccagttccaatattaatttaaggaaacaagatccagctacaacttcataaccaaatataattagcatactaatacttgacatcattgttcaacatcagatcgactgtgcaagactccagaaactcaggaaagcagacttgcccttgatttatttttcaactgcagagtgctctatgcatgttcattatttgaagcatttggcattaacatgtccctgtgacgtcgttgcacttcaagactggggcatgttagctcagccaggccctgacaatatgacatgctagctcaacaagactcttattccttggggacacaacgcccttgaaaactagcacatgctgcatgagttcattggatacatgtgagatgaaagtctccaacgaaagagaagccagaggaaaaaaatcaaagccccaaccaaagggcaatccttgaagatagatactcagagaattcaggtcagcaagtttgctaggtaccattggtgagaccaactccctgcttggcgtgctcgacaccagctctgcttgagtgtaacagatcgatgtggtgatgttcactagtaagctcttcacttgcaatgcttctccaagtgagactcgaaccttgaggttacctgcaaagtgaaaactgga

SEQ ID NO: 67856 - DNA, 757 bp, Triticum aestivum
  unsure (1)..(757): unsure at all n locations
  Clone ID: PAT_TA_67856
attaatnctgaaatagaaattaattcttaggtgagacatgtgatataactaaattcaaatgaaaatagcatatttttattctcatatgatataacacaaccgtcaagtgcttattaatatattttccctaaatggcagtgagcactgcctggcttagttttacgccttttgcacgcaaagctgtcaacctcttctccataatcatcgttgtcatcctcctttgttttgaattttgaagaaatgcgggagcaacagtcaccaacgtcttccacgtaccatatttcgtcgaacaaggtagacacatatggatcggtctctccgtatccttcttcgatctcgaaacatacatgttgctgtgctagtagcagcttatcttccttcacgacctgattagttgtttttttaatgtaacaacccacggatgcctctccagaatagttctcatcaagtatatctccaacctccatcacagctatggctgttgacataggaggcctgagcactattcgctccgcatggatctggccaccagacctcagcctcttagccattcttgaaattcaaaaatatcttatggatataaaagctttgatgaagccgcaggtctaactcacatttgcaagtataggctatgtgcctggagaacagccgttgcttctatatatagaacaaagacgatcgcacgtgcttggtcctgctgtcgttttttgaaatttgaatccggcactgattgtattaattgcaggcccttcgcccc

SEQ ID NO: 67857 - DNA, 153 bp, Triticum aestivum
  unsure (1)..(153): unsure at all n locations
  Clone ID: PAT_TA_67857
ataggtctcttacttgcttcgcccacacctttagtagcatgtctttctctttcattgcttcancggctgccaggaatgcctgcatggnctntagctcgnncttgatgaaccanatatncttgcgtncacccatgangaggntnatntntgnng

SEQ ID NO: 67858 - DNA, 211 bp, Triticum aestivum
  unsure (1)..(211): unsure at all n locations
  Clone ID: PAT_TA_67858
tacttctgaatacttgaagttcttcgaagaactaccggttctaaaaattgtcaattgaacctatctgggatcctaccagttcatctntctattttttttncacttccttgtctcactgataaacattttttagaagacatgtcactaaaccattgcagaagaacagtcnntacagggacaaaagcacctgggngtgggtatatggcttgat

SEQ ID NO: 67859 - DNA, 458 bp, Triticum aestivum
  Clone ID: PAT_TA_67859
aacttgcgttagatgtcattggttttgagcatatcgaagaattgtatgagcatgatgaaacttttgccactccatataccaagtgtttgtcgaatacatcatgggaacgctattacatcaaagatggctatcttatgagagctaacaaactttgcatccccaagtcgtcccttcgtttgttgcttttgcaggaatcgcatggagggggcttaatgggacatttcggacgcgacaagacgttcgccacgctctcgaagagctacttttggccaaagatgtttcgggacgtcaatcgcttcaccaaccgatgtttgacatgccgcaaagctaagtccaaagctcaatctcatggcctctatatgcctctaccgattccataccaaccatgggaagacattagcatggacttcatacttggtttgcctaggactcgcaatgggaaagattctatatttgtc

SEQ ID NO: 67860 - DNA, 478 bp, Triticum aestivum
  unsure (1)..(478): unsure at all n locations
  Clone ID: PAT_TA_67860
gagggtaaaatccaagnaagaaggaaacactgatagatgacctcaaggagacgtttgacaatcttcgggttaacaaaatgatgctcaatctggataaatgtgtttttggtgttctggcaggcaagctcttgggctttctggtatccaacagaggcattgaggctaatccggaaaaaatcaaagcgattacatccctggctaaaccgaagtgtatcaacgatgttaagcgtctggcaggtcgcattgcagcccttagccggtttatcagccgtttgggagggaaggcaattcctttgtatcatatgttgaaaaagacagacgatttcgtctggagtgacgcagctaatgcggcttttgaggagttaggcagttggttgaaccgccggttcttgcagctccggttgataatgaacccttgctattgtatgtggctgccaatgcccgagcggtcagtgtggcaattgtggttgagcgtaag

SEQ ID NO: 67861 - DNA, 623 bp, Triticum aestivum
  unsure (1)..(623): unsure at all n locations
  Clone ID: PAT_TA_67861
ggttntgtgtaggagtntgctagagctggcacggggagtagctcagtgggctcatgggtttaagagtggtgtcctgtttctgttcaacacaggggaagaagagggtcttgacggggcccacagttttataactcagcaccactggagaaactcagtacgttttgctgttgatttggaagctatgggtatcagtgggaaatccaccctttttcagggtactcaccaatgggctttggagagctttgctgctgtagcgaagtatccatctgctcaaatagctacacaggatgttttccgttctggagcgataaaatctgctactgatttccaaatatatcaggaggttgctggtcttcctggccttgattttgcatatacagatacgacatccgtgtatcacacaaagaatgacaaaatagagctcctgacacctggatcccttcagcacaatggagaaaatatgcttgccttcctactccatgctgcttcatcaccaaaatttatgaaagatgcacaccaggcaaagcaagagagcacagagcagaataatgctatttttttcgacattctgggcaagtacatggtggtctatccacagcggttagcaaccatgtttcacaact

SEQ ID NO: 67862 - DNA, 500 bp, Triticum aestivum
  unsure (1)..(500): unsure at all n locations
  Clone ID: PAT_TA_67862
attcggcacgaggttctgatgacaatgcttcttgcaagnactgcattgactgacattccaaacatttctcattttggtttggaagagttaaagcaatgtgactcctctggcattccttcaacggtaatcaagaatgagtccacacagattgttaaacaaccatattacttcgataagactgaagatggttgtctttcccaaaataatggagcacagaaatctcagatacgtctttggattgagaatggtcagaacatgaaatgtgaaagtgcatcagcttctaacagcaaaggtcttgatacacaaagcaagtcaaatcgaaagagatctcgacctggagagagttctaaggcacggccaaaggatcggcagctgatacaggatcgtataaaggagctccgagaaatggtgcctaatggagctaagtgcagcattgatgctttggagaagacagttaagcacatgctcttcttgcaaagcgttacaaagcatgcagacaa

SEQ ID NO: 67863 - DNA, 831 bp, Triticum aestivum
  unsure (1)..(831): unsure at all n locations
  Clone ID: PAT_TA_67863
cggcacgaggcaaatccacacccaatctcgtctccgatcgactcgaggagctcgtcgaatcctcctcccccatcgtctcaagatgcagatcttcgtgaagaccctcactggcaagaccatcactctggaggttgagagctctgacaccattgacaatgttaaggctaagatccaggacaaggagggcattcccccggaccagcagcgcctgatctttgctggcaagcagctggaggacggccgcaccctggccgactacaacatccagaaagagtccacccttcacctggtgctccgcctccgtggtggtatgcagatttttgtgaagaccctcaccggcaagaccatcactctggaggttgagagctctgacaccattgacaatgttaaggctaagatccaggacaaggagggcattcccccggaccagcagcgcctgatctttgctggcaagcagctggaggacggncgcaccctggccgactacaacatccagaaagagtccacccttcacctggtgctccgccttcgtggtggtatgcagatttttgtgaagaccctcaccggcaagaccatnactctggagggttgagagctccgacaccattgacaatgttaaggccaagattcacgacaaggagggcatttccccggaccagcagcgccctgatcttttgtttgncaagcagctggaggaaggtcgcnccccttgcccgactacnacatncagaaaggaggtccacccttttacctgggggctncgcctccgtggngggnatgcagattttccgngaanacccccaccggcaagaacatnaccccttgaggttg

SEQ ID NO: 67864 - DNA, 516 bp, Triticum aestivum
  Clone ID: PAT_TA_67864
gggaagagccccgcctcgcagtgcttcctcttcccggcgcgccgcacgtcccccctccgccgcctcgccgtgcttctacaaccccggcgctcctaccattccaactcacaggtggcctgacctcccaacatcaacaaaacatccaaaatgctacaggcatccagcaactaaacccacagctacagccaggcggcagcacgccagcgacgcgagcgctcgttccaaagcaagccaaccagccagcaggagcctcgggtcattgtgcctcctggcgcacggtccacgcacgccagagacggctccggccaatgctccggcgagggctccagcgccgctagcgagcgacctggacacacggcgccgataggaggtccgacctgagcggcgcatgatccggaaaggctccgcgcgtgtaagcccgcgctccctgaagcaaatccatgggaacctggtcgtcaagggcatcgcctcgcgcctccagcccctgcgggacctgctactcgcgtgcgtctcctc

SEQ ID NO: 67865 - DNA, 512 bp, Triticum aestivum
  Clone ID: PAT_TA_67865
ggggcgctccctccccggccggccggcggcgatgacgagcctgcaggcggccccgcgcctcagcctccacctgaccccgtccgaacaccgtggccggctgcttccgccgtggaggctcgtcctctccccctcctcctgcaggctttacactctcatttccagacaacatcccatttgcaatgcacaatcatatgctgatgatttactggtggccagtgcccaaagctccacaactgctctctcaaggttgcttgctgcagaaagagaggaagcgaaagctgtgctatcgctgttcttaaggcagaaaggtttgagaagtgcggtagctgcacggatcgccaacaaatcagatggattcattgagcacctgagttcaaagctccaaagtgcttacagatctcgatatgctgaaggaagggagctgagtacacctgagatcagagatgctctccttccctatctagaagctctttctaaagaacatggggatagtttggttgaagtggtggaga

SEQ ID NO: 67866 - DNA, 619 bp, Triticum aestivum
  unsure (1)..(619): unsure at all n locations
  Clone ID: PAT_TA_67866
gccgacacctccccgcgtggnactaaatgtagaaggggaggcagatagttgggattttggtgttggtaaggacagtaactacgacagtcttgttgtgccatttgcagcttatgggatatatgattcggcaacttccgtgggagtctagaacttactgcatgaacttcccattgccatgaataaacggaataacgatattctgcatgatttctagcattcgttgaaaacttttcagtagctgtactgtttgctgttttttgtgttaaatttatgctgctttgtttgtattgtgttagttacggagcaatatttataattttgtttgcttttgttaaaaaacatctgcacataattgctgcagttgacagataaacctcttgtggtgttgaagagaaagtaactatttaatcaacacatcagacgaagaatagtccttttcatgttgacattgctgtatatctatgtggtcaaagctcaaccagaaagtagcctgattgtcctaacagctagcgatgacacgctttatcccaaccatcagtgtgccaccagctcagttgtttttatttctaattatgcaaagcatagcagatttatatctgggtggattagaaaaaaaaaa

SEQ ID NO: 67867 - DNA, 656 bp, Triticum aestivum
  unsure (1)..(656): unsure at all n locations
  Clone ID: PAT_TA_67867
ttcggcacgagggccgggtcagcaccgtcggctgggtaatactgctgcggtggccctcgcgctccggtctcccgcgactccattttgaaataccgagggatctcagtaaccctctcttccatggagacctcgccaccgccgtcgccttcgccggctagctcgccgggccggccggcgaagccgcggttattcatacaggagatggttctccgcaacttcaagtcctacgccggggagcagcgcatcggtccgttccataagagcttttcggctgttgttgggccaaatggaagtgggaagagcaacgtcattgatgcaatgctcttcgtgtttgggaagcgtgcaaagcagatgcgtctaaacaaggtctcagagctcatacacaactcttccaatcaccagaacctagacagtgctggtgtttctgtccattttcaagaaatcattgatctggatggtggaaactacaaggttgttgagggcagtgaattttccataacaagagttgcattccgtgacaacacctctagatattacataaataaccgtggaagcaattttactgaagtaactaaagtgttgaagggcaaaggagtggaccttgataataatcgctttctgatccttcagggcgaggttgagcagatctncctgat

SEQ ID NO: 67868 - DNA, 110 bp, Triticum aestivum
  Clone ID: PAT_TA_67868
ttcggcacgagggtcgcgtgatgtatccttccgatgtaccgtgtggtgagttgtttgaatgttgcaacggttttgtcgtgaaactgaaattgatgggaccaaaaaaaaaa

SEQ ID NO: 67869 - DNA, 633 bp, Triticum aestivum
  Clone ID: PAT_TA_67869
gccgggttggagtaacagaacctttcttgatgcacatggctcatggggcagcaatgcctattcgtggaaggcccaagaaaaacactagtggaggttctggtgcaaacactcttattaatgaccagtcgcttagagtatctaagcgcttttatgtggcgctgatgatatcaaggctggctcaggagattcctgtcacagatgtttgtgaatcatttaaagttgctagaggtacgattcaagccttgcaggaaaatgctggcaggtttgcttcaatggtttctgccttttgtcagagacttggttggcaggatttagaaggtcttgttgccaagttccaaaaccgtgtctcgtttggagttagggcagagatcgcagaacttacaacaattccattcgtcaagggctcacgtgcaagggctctttataactctggtttgcgtacccctgttaccattgctgaagcatctattcctgaaattgcaaaagctcttttcgaaaattcttggtctggtcaagatgattctgggttacggcgaatgcaatttggtatagccaagaaaataaaaaatggagctcgcagaattgttcttgaggaggcagaagcagccagagtagcagcattctcagctttca

SEQ ID NO: 67870 - DNA, 618 bp, Triticum aestivum
  Clone ID: PAT_TA_67870
gtagtaccagtgcctgtccgtgccttccaagcccgagtactaccatttcactacctcagaaagaggtggctagcagggcgcggaggatggagcgggcgaacacggagctgtacctggagaacctgtgcatcatgcaggcgaacgagcggctccggaggaaggcacagctgctggcccaggagaacgagcagctcctcgccgatctcaagcgcaagcagcagcacatggcggcctcctccagggcggcgccccagatggcgaagggcgccgagccgtctggccataacgcggccagcctcaagtccggcaagcagcagccccagtgaccgtgccggagtcgcgcgcgtgcgtgcatgcagtcgtggaagccgtactcgtctctgtgaaaaaactagtaggagtagtagtactcagcagattgtagattagagctggcatgcatgcacgatcgagctagtagtgatttagttctacttttggtgatttagcaagaggaagtggtagtgatggcagctagcgcttttgggggttgtatttgcatggctttgcctttgtggcgccatttcttgtttcagtgtgatgaccctgatggtggtgggtacgtacgtagcgtaccag

SEQ ID NO: 67871 - DNA, 626 bp, Triticum aestivum
  Clone ID: PAT_TA_67871
gcctttccgccctcaaagccgccgcatcgcatcgcgtcgcccacccagcaagcaagcaagccgcccgctatcgtcgccaggtagggcgtgagattcggaggaaggcgctggcgatcgacctccgggttagggcctcggcagcggcggcggtcggataatgtgtatactgtgcgccgtgcaacggtggtcgcgccgcgtcgccaccatgctgccgtggctcgtcctcccgctcatcctcctctgggcgctctcccagctcctgcccgccgcctaccgcttcgaggtcacctccccgcgcctcgcctgcgtctccgtcctcctcctcaccctcttctggtacgagattctcctcccgcgcctctccatctggcgtgcccgccgctcggcgcgcctccgggaggagcgccgtgcccatgcgctcgagcttcagaagctccgcaagaccgccacacgccgttgccgcaactgcaacaatccctacagggaccagaaccctggcggcggcaagttcatgtgctcatactgtggccacgtatccaagcggcccgtgcttgaccttggccctgcggggaaggtcccggctgggtggccttgcagtcaggattgggctaatgcagtcggtgacc

SEQ ID NO: 67872 - DNA, 558 bp, Triticum aestivum
  Clone ID: PAT_TA_67872
tgaggaattcggacgaggcgacgacgacgacgacgcggtgcggccatgcctgcctccatctcatgcccaagattctctcgtcttcatcctcctcctcatccatttcgcgccgcaaaccggcaccagcagccttcactcggagcccgggctgccgagtcacgccgccgccgagtttgaggtcaaacacccggttcgccggaagctgccacaccgtcgcgagctccggtacgagcctggcagagtacagcggcgagggtgcctccgccgtaggataccaagatggcggccttcccttcgtaaatctgtcctcgtccaatatccaacgaaccgagccgatcttacccaaggatgagtccacgccatcccttctcctcgccgctctgccggctccgcagaagggaaacggcccagagggccacttggaatcaacccctgcttacccagccgccatgaaagctctgtttggggcctgcctcgccgggaacgcgacggagcacctctggaatttcacctggcctgccgcagtcgccacgctgcatcagagcctcctcccggtcg

SEQ ID NO: 67873 - DNA, 598 bp, Triticum aestivum
  Clone ID: PAT_TA_67873
aggtgacatatatcatctttctttctttctgaggaggaaggagaagtaatggggcacattgctgatcctacgggcgccgtagtcgtgggctgcaaagtgctgcccatcttcaacgagaatggcatcgtggacggcgcggtgaagaagatcgtgcacaggatcgacgggaagaaggcggtcgcccgggtgaaggagctcctcaagtgggctgcccaggccaggccgtacggcagcagcaacggcgtcagtgggaagaaatggaagcagttcctgagcttccagggaagggacggtggtggtcctgcagcaccggtatcaaagtgcgacgacgacgcgagctcggggtccgggtccggcggcaagctgagcttcaagtgggaggcgggcagctgctcgtcggcgtcgtcggtgctgtactcgccgctgtctttcgcgtcggcgccggccgggaggacggagcagcagacaccgtcgaggggcaacgggagctacaactacagctacaacgcgtacgcgtcgcggctgtcgtcggtgagccagaagagcacgtcgtcggaggcgtgccggatggcgcagtggatcaccaccgattcagact

SEQ ID NO: 67874 - DNA, 582 bp, Triticum aestivum
  Clone ID: PAT_TA_67874
cgcactccagctaccacgccgtcgacccaaccctcaacgctgccccagcagcatcggtcgcggccgtcgtcgtaccagctcgccgctccacctgctcgcctactgtcccttcatcctcaatggtggagcgacccacgccgtgtcctcgtcggcgcctgtgtgcgtccgcctcacagcacgctcgagcgccccctccttgagtcgtcgccacctgggaaagcagcgacgatctgcctcaccaagatgacgacggctgcctcaagttgggggacacatctagttggtgatagaccaggggagacgttgctccatgaacaggggagtacaaacaggagcaggtggataaactctccacgaagctcaccagaataaaaatagggaaagaaactgaatctggggaagacgttgttaatatcatcaggttgttatgcttaagtacagatacagttagatgtgaagctccaaaacagggtttataatcgctcggccatttctgtttctttattaacttatcatgataagaccatatacagttagatatgaagctgcttgtttgtcgccctttatgttaatgtgatattc

SEQ ID NO: 67875 - DNA, 370 bp, Triticum aestivum
  unsure (1)..(370): unsure at all n locations
  Clone ID: PAT_TA_67875
gcacgagggagcctgcaagtgggggcaccggnagccagcagtgtgaagacgtcatggacagaggtcgtcgggatgtccgttgagaaggccaaggagatcatcgccaaggacaagcctgatgctgagatagaggtcctgctagtcgatgcgttggtcacccaggacttaaggcccgaccgtgtccaaatcttcatcgttgttgccgacacccctacggttggttagctagcttatcaggcatgaatcattaataattatgtaacagaggataaagatatctggcacatcaggcaggcactttctctttgataaggaataaaggcatgctgggcatgagcgaatcatgcccaagttcaggctaaaaaaaaaa

SEQ ID NO: 67876 - DNA, 873 bp, Triticum aestivum
  unsure (1)..(873): unsure at all n locations
  Clone ID: PAT_TA_67876
ggaccgcagcgtctcatacttcgctggcaagcagctggaggatggccgtacccttgctgactacaacatccagaaggagtccaccctccaccttgtcctgcgtctgcgtggtggcatgcagatcttcgtgaagaccctcaccggcaagaccatcactcttgaggtggagagctccgacaccatcgacaacgtcaaggccaagatccaggacaaggagggcattcctccggaccagcagcgtctcatcttcgctggcaagcagcttgaggatggccgtaccctcgctgactacaacatccagaaggagtccacccttcacctggtgctccgcctccgnggtggtatgcagatttttgtgaagaccctcaccggcaagaccatcacccttgaggttgagagctctgacaccatcgacaacgtcaaggccaagatccaggacaaggagggcattcccccggaccagcagcgcctgatctttgctggcaagcagctggaggatggccgtaccctcgccgactacaacatccagaaggagtccaccctccaccttgtcctgcgcctgcgtggtggcatgcaaatcttcgtgaagaccctcaccgggaagaccatcactcttggaggttgagagctccgacaccatcgacaacgtcaaggccaagatccaggacaagggagggcatttnccccnggaccagcagccgcctgatcttttgctgggcaagcagctgganggatggccgtaccctnngncggctnccantattcaanaaggngtcccccccttcanccttgngcttnggccttgcgggggngggcatgcaannnttnggnaagaacccttcacccggnaagaaccattcaccnttgnagntg

SEQ ID NO: 67877 - DNA, 575 bp, Triticum aestivum
  Clone ID: PAT_TA_67877
atgtagccatctttaagggataagtgcttttctgcaataaccaagaacagtttggctactctactcagctttggtgaggcaattgctatgagtaaaagatcaccggagaaattgtttgttctgctagacatgtatgagataatgtgtgaacttcaaacagagattgacaccatctttgttggagaatcatgctctcaaatgcgtgactctgcactcagtctgacaaaatgtttagcacaaactgcacagaagactttcagtgatttcgaagaagctgtcgagaaggatgcaacaaagaatattcatactgatggaacagttcatcctttgacaagctatgtgattaactatgttaaatttttatttgactatcaatcaactctgaaacagctcttccaggaattcaaaagggaagatggatcaggttctgagctggcatctgtgaccatgagtattatgcaagctttacaaaataatttggatgcaaaagcaaaacaatacaaggatcctgcattgatgcacatctttttgatgaataacattcattatattgttaaatctgtccgcagatcaga

SEQ ID NO: 67878 - DNA, 560 bp, Triticum aestivum
  Clone ID: PAT_TA_67878
gcgaacaagcaccgccgctgacgcatctcgagtagtttccagttcgccggagaaggagcaagatggccggaaggaagggcggcgacaggaagaaggcggtgacccgctccgtaaaggccgggctccagttccccgtcggccgcatcgggcgctacctcaagaagggccgctacgcccagcgcgtcggctccggcgcccccgtctacctcgccgccgtcctcgagtacctcgccgccgaggtcctggagcttgcaggcaacgctgccaaggacaacaagaagacgcgcatcatcccgcgccacctgctgctcgccgtccgcaacgaccaggagctcggcaggctgctcgctggcgtgaccatcgcccacggtggcgtgatccccaacatcaactctgtgctgctccccaagaagtccgccgcagccgagaaggaggccaagtcgcccaagaagaaggccgccaccaagtcccccaagaagaaggccgccgccaccaaggagtaggcgccccatagcctagttccataatcagcgagaagatgacgagcctttttttttttg

SEQ ID NO: 67879 - DNA, 151 bp, Triticum aestivum
  unsure (1)..(151): unsure at all n locations
  Clone ID: PAT_TA_67879
ggagnagagagagagagaactaggtagtcggcttgcgttatcgtgatcccaccgcttattacctcgttctcctcatgctccattgcgactacataataaatcctagtacgaaatgagttcaataaacgatatacatccgacaaaaaaaaaa

SEQ ID NO: 67880 - DNA, 569 bp, Triticum aestivum
  unsure (1)..(569): unsure at all n locations
  Clone ID: PAT_TA_67880
gctagtttggtcctagcgtagccgcggnggacctccaggcggcggggcaccttcgtttcgtcgctctctcctctgcatcattccattcctggaggtccaagtcgtcctctccttcctcgctcgccggtcaagatctccacttcgcactcgcgggcatcctcgggagagcaaacaagaagaagaagaagaaggactggactgccgtgtaggtgtagtgaagatccctttgaccagtaacgaacgaatccatatctgctgcttgccgtgagggatggccggaagcggcctgtgggtagttggattggcttcccttcttgcactccctgggatattcgtctccgtctccgtcgaggccagcccgggagatgctgatccgcactacagaacttgtgtgggggagtgtcagaatacggggattattggaggcaacatcatcagtcactgtcagtcccgagagaacgacagcatatctgctggaagttcttggtacacacaggaggctcttcgcgtgcagtggaagcaactaaactgtatgacagactgccgctactactgcatgatgcgaagag

SEQ ID NO: 67881 - DNA, 119 bp, Triticum aestivum
  Clone ID: PAT_TA_67881
agaatctgatgatactggtcctgaaggagatacagagaaagataaggatacttttggaagtatacagcgcaggaggatggcacgtccaaagggaggtagtcaagcatctcaacgggaac

SEQ ID NO: 67882 - DNA, 539 bp, Triticum aestivum
  Clone ID: PAT_TA_67882
tcggcacgagggattggtggcattggaactgtgcctgttggccgtgttgagactggtgtcatcaagcctggtatggttgttacctttggtcccactggtctgacaactgaggttaagtctgttgagatgcaccatgagtctctcctggaggcgcttcctggtgacaacgttggcttcaacgtcaagaacgttgctgtgaaggatctgaagcgtgggtttgttgcatccaactccaaggatgaccctgccaaggaggcggccaacttcacctcccaggtcatcatcatgaaccaccctggtcagatcggcaatggctacgccccagtgctggactgccacacctcccacattgctgtcaagtttgctgagctggtgaccaagatcgacaggcgatctggtaaggagctggaggcgctgcccaagttcctgaagaacggtgacgctggtatcgtcaagatgattcccaccaagcccatggttgtggagaccttcgccacctaccctcctcttggccgcttcgctgtgcgtgacatgagaca

SEQ ID NO: 67883 - DNA, 495 bp, Triticum aestivum
  Clone ID: PAT_TA_67883
ggggcctcgagggctcgaatacataagctcgaatacacaagagtcggcggaagcaacaatatctgagtacagacataagttagacaagtttgccttaagaaggctagcacaaaagcatctacgatcgaaaaggcaaggcctcctgtccgggagcctcctaactactcctggtcgtcggcggcctccgtgtagtagtaggcaccctcggggtagtagtagtcgtcaaatatggcatctggctcctggactccaccatcctggtgtttgtggttgaggtcagcgagcgcggggtgaccgggatgcgtcgaatttgacgacaagagacggcggtcgtggcgaggagacgacggcgatgcagagcgtatgggccgccccgactcggtttggtgctcaggacggacaaagcaggccacaccggacctccttgatgtgctgccgagcaacggaaacgacggtggccgcgatgatgacggcgacggcgaggtggggcggagg

SEQ ID NO: 67884 - DNA, 393 bp, Triticum aestivum
  Clone ID: PAT_TA_67884
gcaaaccctcgcccctgccctcctcctcctcctccgccgccgccgccgccacctcgccccagcccagcccccatcaccggcgaagatgaagaccatcctggcgtcggagacgatggagatcccggaggaggtgaccgtgaaggtgtcggcgaagatgatctcggtgacggggccgcgggggacgctgacccgcaacttcaagcacctcaacctcgacttccagctgcaggagggcgggcgcaagctcaaggtggacgcctggttcggcacccgcaagaccatggccgccatccgcaccgccatctcccacgtccagaacctcatcaccggggtcaccaagggcttccgctacaagatgcgcttcgtgtatgctcacttccccatcaacgcctc

SEQ ID NO: 67885 - DNA, 273 bp, Triticum aestivum
  Clone ID: PAT_TA_67885
ggcgattccggcgagttctggcggccctcgccggcgcgcaggacacgcacgtgctcccctcgccacgctccttccttccctccggccagatccgctcctcgcggccgtgtcccctcccggcggctagggttccggctgcggcgtcgcctccagctccggcgaggtgagctctgccttcccttccctggccttgattcagatctccatcttccttctctccccgacgcccgagcccgacgacgccgtgccggcgacggcatcggctgtgtgcgc

SEQ ID NO: 67886 - DNA, 447 bp, Triticum aestivum
  unsure (1)..(447): unsure at all n locations
  Clone ID: PAT_TA_67886
gataacagggttatcctttgttacaatttactaaaccttgtgtggtgatacaattactgcttgaccattgtaggaagctgttgggctaaacaatgtataacatatcagtttgacctcaactaccgaaaaatactcccagatattactaagattacagtacactgataaatggtggtaactaaagctaaagacttcaacaactcaccaaaatgtaatgggactccagcgcaatgttaccttccaatcaggaattttgttcacatgattcaactcagagctgggcgaacactggtttcagtccaaagccaaaactcattaccgtacagagcatgacatgtattttgcttcacacatccaaaattgcaaaaacagaaaccaacttgtctatcttcctgtgccatnaagatctaaacttttggcctccgaaattcaaaccatatctcataa

SEQ ID NO: 67887 - DNA, 377 bp, Triticum aestivum
  unsure (1)..(377): unsure at all n locations
  Clone ID: PAT_TA_67887
cacgcattaatgaaacaaattctagcacaacaaataatnaatcccaaggtcggtcactctgttttattggtgtccaaaaaaaaatctaaattagctagaagattgcctcatcccttcctaggagaacgtatcctgtgcaccggatgaattggtgcaacgaatgcgccgactgattctgagccactggatgaagaacagacgggttggatcttagtataaggnggcagccggtacatttcacacaatggaccttgtaaagtcattcaactacacaagcagtccttccaagatcccatcgtcttcttcccttcgctcttctcccttctgtacctgtacaccgaggatttgcaagctagggttagcgatttgcttcatcg

SEQ ID NO: 67888 - DNA, 153 bp, Triticum aestivum
  unsure (1)..(153): unsure at all n locations
  Clone ID: PAT_TA_67888
gacgccgccgacgacccccggaatccgcccgccatggcgacccccaacccgccgtcgncccagcaggacgagccctcctnctccgccgatcccaaggtcgaagaaggactactcgacggcgatcctngagaggaagatgtcccccaaccgcct

SEQ ID NO: 67889 - DNA, 485 bp, Triticum aestivum
  Clone ID: PAT_TA_67889
ggcaaggcgccggtcccggcgaagaagaaaacggagaaggtgaccaacccgctgttcgagaagaggacgaagcaattcggcatcggtggcgccctcccgcccaagaaggacctccaccgcttcgttaagtggcccaaggttgtgcgcatccagcgccagcgccgcatcctcaagcagcgcctcaaggtgcccccggcactccaccagttcacccgcaccctcgacaagaaccttgcaacaaacttgttcaagatgcttcttaagtaccggcctgaaggtaaaactgttgaggccaagaagccaatagttgtgaagtatggccttaaccatgttacctacctaatcgagcagagtaaagcccagctggttgtcatagctcatgatgttgatccgattgagctggttgtgtggctccctgctctttgcaggaaaatggaggtcccttactgcattgtcaagggaaaatctcgccttggatcgattgt

SEQ ID NO: 67890 - DNA, 198 bp, Triticum aestivum
  Clone ID: PAT_TA_67890
actgcttaagctgttcttctaagctatatgcgccgactttcaagatctttgtcccacattacacctttctactgcggcaatacatgcgaactggaagacgtgtgggaagcggtagcagcatgactacggacatgtcgaggacaacaagccgattggcaactttctttacattcagtcacactagggatcaatggcgtt

SEQ ID NO: 67891 - DNA, 420 bp, Triticum aestivum
  Clone ID: PAT_TA_67891
ggcacgaggtcgtggacgaggccatttctgcaaggccgcccgcaaattgctgcatgcaacatcgatgtagctctgatccagaacctggttcttggatgcaacacgcattgtcctggacaggtatagccccggtcataccataatatgttagtgctcagtcatgtatgcatctccatgttgcaagcctgccatacttgataggatcagtacttattaactactcatatgtgcttgtagagaagaatacaattattatttaaccagtccagatttttaacatttgatgtgcttccaagggacacagatctctactcttctatataatccacactttgttctggaagcaagtcagttgtaccatgctgttacatcacaacaaggtgtcatttatcacaacaaggtatcatttgatgtactgct

SEQ ID NO: 67892 - DNA, 488 bp, Triticum aestivum
  unsure (1)..(488): unsure at all n locations
  Clone ID: PAT_TA_67892
ggcgaattcgacaagcccccganctcgccggatccgatggccgtcacgttctccgacctccacaccgccgacgggctcaaggccctcgaggcgcacctcgccggcaagacctacatctccggcgatgggatcaccaaggacgacgtcaaggtgttcgcggcggtgcccgtgaagcccagcgccgagttcctgaacgctgcccgctggtacgacgccgtcgccgcggccgtttcttcaaggttccctggccaggcctctggggtgagtgcatcctcggctcctgctgcagctgctcctgctgcttccaaggatgaagatgatgacgatgacatggatctgttcggcgatgagaccgaggaggacaagaaagcagcagctgagcgtgaggctgccaagcctgcaaagaagaaagaaagtggcaaatcctccgtcctcatggacatcaagccatgggacgatgagactgacatgaagaagttggaggaggc

SEQ ID NO: 67893 - DNA, 651 bp, Triticum aestivum
  unsure (1)..(651): unsure at all n locations
  Clone ID: PAT_TA_67893
ggttcgccactatggtatgatngccgcgcttgactcatctcctgcgtaaaaatattccatttgtgtggtcttctgaagcccagtctgcatttgatcaactgaagcgagccctcacaacagcacctgtattgccactccctaattttcagaaacagttcgtaattgagactgacgcttgtgataccggagtgggtgcagtactacttcaggatggccaccctcttgcatttgtgagcaaaggattgggactcagaaccaagggtctgtctacatatgaaaaagagtatatggccgtgcttcttgcagtggaacgatggagaacttatttacaacatgctgaattcctaatacttactgaccatatcagcttgtcacacctggaagaccagaggttacacactagttggcagcagaaaatgttcacaaaattgcttggactccagttcaagatcaggtacaaaaaaggcattgacaatcgtgccgcggatgcattatctcgcagaccacacttaggggaggaccttcttgctatatcttcacaccagctagcttggatacaggaaatgttggatgtgtatcaggatagtgctgaagcaagtgaacttttggtcaaattggcagtgcagcggtctgaaaatgatccatgttctc

SEQ ID NO: 67894 - DNA, 420 bp, Triticum aestivum
  unsure (1)..(420): unsure at all n locations
  Clone ID: PAT_TA_67894
tccttatgctaggtacgagaagaagaaaatccangaaaaggaaaaagagttaaaaaaagaatacaagatgatcaaagagataaggaagcaaagcggcgtttcacgggacgaccggcagtgcaagattctagcggatccaccactttggaaaaacatcatcatatcacaccctaaagatggaaagttcaagaccaaagccttccctctttttgaagctttgggagaattgcatgatggtcaaactgcagaagagacatataacttcacctctaacgagtcatcacattgctcaacccaatcacatctcgagaatcttggaggagctggcaagaatcaaggagaaacatcagctgatggtgagaatcttggaggagaaagggtgcagattgatgaagatgttgaggaggtgtacgtgcaaga

SEQ ID NO: 67895 - DNA, 699 bp, Triticum aestivum
  Clone ID: PAT_TA_67895
gtcctcatcctgcttcccttgcttctccttttcttcatcctcctccatgcctcccccatcaaagccctcctcacgacggccaagttggttctagcgccggagctctccacggtgtggaagccgcagcccgctagtatctttgtcaccgaccatgagacggcgcacagccttctcgtgcgcggcagcgccggcggctccttctccaaccgcccaccgtccatttctcccagcgccatcctctcgcaccgtcaataccagaacatcacctccgctccctacggtgagcactggcgcgccattcgtcacaacctcacatcggaggtcctccacccaacgcagctccaccggcacgcgtcagcgcgccgccgtgcactacatggtcttgtcgtggacctcgccgagcagaggaaaaacggcgtggttcacgcggcggagagcatccgctacgctatgtttggcctggtggccaacatgtgtttcggcgacaacatcaacaataaccgcgtccgtgccatggccgacgctcagagtgacctcgtcaagtccctatctacggcgcgcgtgttcgcgcacgcgaagctccccgcactgaccaggctcatttatcgtaatcggtggaagaagctagccgccttgcgacagcagcaggaggagacgtacctaccactcatcaactcccgtcgcggccggcaccggcga

SEQ ID NO: 67896 - DNA, 504 bp, Triticum aestivum
  Clone ID: PAT_TA_67896
attcggcacgagggcttcctctccctctagtttgctcatcgtccccagtccagcactgcatggcgcccctgcagctttctcctctctccttggtttcggctgcctgctgcgctcgcacgtccggttccaaaggagggcgacggctgtgagaacccgttgtttggtcaagcgccaacgtaggaacgcgtcagcggcggccagcgtgtcgctctccaaggtcgcggtgactgggtttgtgtgcgagcaggttggggaacacgacccgcgggtcaacactggcggctcggtgcgtgcgccgtgctctcatgacggggacgctgcctccagcacgtacgatggatccgctgccgttgaacaagattcggccgaggcgagcagctcttgcttgaaggctcacatttagtaatggagtgcgcgagccgaggaaagctcaataaacatatgccaacaatatgattgtttgcgtacgtgggtgtggtgtgttatgtcgttcgtgggtttgtt

SEQ ID NO: 67897 - DNA, 544 bp, Triticum aestivum
  Clone ID: PAT_TA_67897
gcacggtggcgctgcctacggaagtcgccgcactccggctgcgcatactggagttggagagggagaaccagaggcttgcccagattgtttccacctgcagctgcagctccaaggagggcaatataccatcttctttagctgagagccgtgatcaacaagtgctgaagaatgtaaaatcacacgaaagtagaacctcagaccatggcgtaagccttccattcgatcacatgacgatatctactgaaaatcaagcactgtgcaatgttaaaggggaagggcatgatgatttatctaaaattcgaaggaagcattctaaaagaacaggtcgccaacaagggaatgtaagccactgccaaaagcgattaattgctctgaaaatcatgtactttggccagagattctatggctttgcttcggaagcccacacagagccgacagtcgagtctgagattttcaaagcaattgaaagagcaagactactggttggaagcagggaagattcatgctattctaggtgtggaagaactgacaaaggagtttctgc

SEQ ID NO: 67898 - DNA, 335 bp, Triticum aestivum
  unsure (1)..(335): unsure at all n locations
  Clone ID: PAT_TA_67898
atgtgacactctcatggcagctgacagttangcttgttgacctgcagatgcagttaaacttggcaaacgagtccaaagatgctgctttaggacaagctgaccggttagatggtgagaggaagtcattggcattgcagttggaatcaaagtcagcagaagttgagaagcttcaggctgtggtgacttcattggaagaaagtggggctagcaaggagttggagttggagttgcagttagaatcaactactgcagaggtagcaaatcttcgaaagacggtggcatccttggaagcgaagattgatgcagtgaaaaccctgtctgcgcagcacaaagca

SEQ ID NO: 67899 - DNA, 658 bp, Triticum aestivum
  unsure (1)..(658): unsure at all n locations
  Clone ID: PAT_TA_67899
ggnctgcaggnaattcggcacgaggccgccttctcaaatcccccatcgcgccaaatctcaagcccctgtagccgccatggacgcctcagccaccggcgccgtctccaaggtgaagaagtacgtggtggggcgcaagcttggcggcggccccaggaagaaggcggtggcgcggtccgtcaaggccgggctgcagttccccgtcggccgcatcgtccgcttcctcaagaagggccgctacgcgcagcgcgtcggcatgggcgcccccgtctacctcgcctccgtcctcgagtacctcgccgccgagcttctagagctcgccgggaacgccgccaaggacaacaagaagtcccgcatcatcccgcgccacctgctgctcgccatccggaacgaccaggagctcggcaagctgctcgccggcgtcaccatcgcgcacggcggcgtgctgcccaacatcaaccccgtgctgctccccaagaagacggccgagaaggagcccaagtcgcccaacaaggccgccaagtcccccaagaaggcttaggcgattactagtccttcgtattagaattagtgtccgatgtttaagtaatggtgtcgatctagtatatgttctgttctgctttgaaaataataatcagaaatctctctgacttgcagttna

SEQ ID NO: 67900 - DNA, 290 bp, Triticum aestivum
  unsure (1)..(290): unsure at all n locations
  Clone ID: PAT_TA_67900
agtgcgcctccgtggtgttcgacgtggagcctggcaggacgtaccggctcaggatcgccagcaccacctcactctccgccctcaacgtgcaggtccaagggcacnacctgacggtggtggaggccgacggcaacccggtggagccgttcaccgtcccagacatcgacatctactccggcgagagctactccgtgctnctcaccaccaaccacacgccgacgttctacaggtctgggtccttctggatctccgtcggcgtgagaggacggcccnccaagacgctgccggcc

SEQ ID NO: 67901 - DNA, 428 bp, Triticum aestivum
  Clone ID: PAT_TA_67901
ttcggcacgagggccgccgccgccgcctccttccgcaggaagctccctccccgcaggcgcgatggtgtacatcaagaaccagaagacaagggcgtactccaagcgtttccaagtcaagttcaagagaaggcgccaggggaagaccgactacagggccaggctgaggctcacaaaccaggacaagaacaaatacaatacccccaagtaccgttttgttgtgcgatttaccaacaaggatgtcactgcacaaattgtgtatgctaccattgctggtgatatcgtgatggccgctgcctactcccatgagttgcctcgctatggtcttgaagttggcctgaccaactatgctgcagcctactgcactggtctccttttggctcgtcgtgtgctcaagaaccgtgatctcgatgaggagtatgaaggcaatg

SEQ ID NO: 67902 - DNA, 459 bp, Triticum aestivum
  Clone ID: PAT_TA_67902
cgcgacgccctcccgcctcctcctctgatgcagaaacccggctgcccaccacctcccccctcctactggccggctcctcgggtcctcctccacgctctactcatcctcagcggcgccggcgccagcttccctgccgacgcgctccacggccgtcctctttgcgcacgcgctggtccacacccacgtcctccttcagtcgaccccgtctcagatacaactggtctggtgtgatggttgacatggggtactatgcctctgcttcccaacccgtcccgcctcccaagttcaatttttgtgtccttacagttcaaatccgcgcgcccagttcgaactgtccagaaaccagtcctgcagcccagtataatataagtgggcaggcttatgggactcacgctggtcaaactacacctccaagaaggcacacaaccttcagatcgaacagattgtggggaagtgtga

SEQ ID NO: 67903 - DNA, 535 bp, Triticum aestivum
  Clone ID: PAT_TA_67903
ttcggcacgagggattgctgcctttgccctgtgaaaggtggagcgctgaagccaacaaatgttgataacttgtgggtacatgtggcatgtgcatggtttcagccacaggtggcttttgatagtgatgagctcatggaacctgctattgggatattgagcatggcacctctgctatttatgaagatgtgcgtcatttgtaggcaaatacatggttcttgtacacaatgctacaggtgctcgacttattaccatgccacctgtgcatcaagggcaggctatcgaatggagctgcactgcttggaaaaaaacggcaaacagacaacaaagatgatttcatattgtgctcatcatcggagacctaaccctgataatgttttgataattcaaactcctgctggaactttctcttcaaaaaggcttgttcagagtagtggcactatagctgcttcaagactgattaggaaagatcttcccaaggattcagcatcagaagttgaaactacagagaatttatgttctgcaagatgtcgagttt

SEQ ID NO: 67904 - DNA, 421 bp, Triticum aestivum
  unsure (1)..(421): unsure at all n locations
  Clone ID: PAT_TA_67904
aggagagaccgtcagccntgtccggccgcggcaagggaggcaaggggctcggcaagggcggngccaagcgccaccggaaggtgctgcgcgacaacatccagggcatnaccaagccggcgatccggcgcctcgctcggaggggcggcgtgaagcgcatctccggcctcatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggnttcggcggctaggctctttctcgccaccccactgcagatcccgaaagtttgatgataccgcgacttgtgtagttcgctagttcctctgtagttcgctatttcct

SEQ ID NO: 67905 - DNA, 131 bp, Triticum aestivum
  unsure (1)..(131): unsure at all n locations
  Clone ID: PAT_TA_67905
gaggcctcctacctctccttcgcggcgccacccggnacgctcgagtcccccgacagccatggncggcagcggctggagaggccccgcggtcgctgcnccagaaggagcaggacatacagatgatgctcgcc

SEQ ID NO: 67906 - DNA, 916 bp, Triticum aestivum
  unsure (1)..(916): unsure at all n locations
  Clone ID: PAT_TA_67906
acgaggcggaaccacgaatccccagnccaatctcgtctccgatcgaccccaggctcgtcgaatcctcctcccccgccgcctcaagatgcagatctttgtgaagaccctcaccggcaagaccatcaccctcgaggttgagagctccgacaccatcgacaacgtcaaggccaagatccaggacaaggagggcattcccccggaccagcagcgccttatctttgctggcaagcagctggaggatggccgcacccttgctgactacaacatccagaaggagtccaccctccaccttgtcctgcggctgcgtggtggcatgcagatcttcgtcaagaccctcactggcaagaccatcacccttgaggttgagagctccgacaccattgacaacgtcaaggccaagatccaggacaaggagggcattcctccggaccagcagcgcctcatctttgctggcaagcagctggaggatggtcgcaccctcgctgactacaacatccagaaggagtccaccctccaccttgtcctgcgtctgcgtggtggcatgcagatcttcgtgaagaccctcaccggcaagaccgtcacacttgangtggagtcgtctgacaccattgacaatgtcaaggccaagatccaggacaaggagggcattcccccggaccagcagcgccttatctttgctggcaagcagctggangatggncgtacccttgctgactacaacattcagaangagtccacccttcancttgtncttcgncttcnggggggnatgcagatccttcntcaagancctcaccgggaagacattcacgccttgagggggagtcttttgaaaccatcggacaacgtcaaggncaaaatccaggacaaggngggcattcccccggaccaacagggccttttttttnnaggcaag

SEQ ID NO: 67907 - DNA, 103 bp, Triticum aestivum
  unsure (1)..(103): unsure at all n locations
  Clone ID: PAT_TA_67907
tggcgacggncggtgtcggcgcccgtacttcacggcgacggtgcgggtctccaatatcccgncctccgccgncgctaaagagctcctagcattcttcgatatc

SEQ ID NO: 67908 - DNA, 536 bp, Triticum aestivum
  unsure (1)..(536): unsure at all n locations
  Clone ID: PAT_TA_67908
ctgagaagaagcctgtggagaagacccccgcgggcaagaagcccaaggcggagaagaaggtgccggcgtccaaggagggcggcgacaagaaggggaagaagaaggccaagaagagcgtcgagacgtacaagatctacatcttcaaggtgctcaagcaggtgcacccggacatcggcatctcctccaaggccatgtccatcatgaactccttcatcaacgacatcttcgagaagcttgccggcgagtctgccaagctcgccaggtacaacaagaagcccaccatcacgtcccgggagatccagacctccgtccgcctcgtcctccccggcgagctcgccaagcacgccgtctccgagggcaccaaggccgtcaccaagttcacctcgtcctaggctcctcgtgcattagttcttgtgtttctttcctcttcgttgtctgatgaattctgtagctagctgtgtgtgttctgacagcgtcatactgtaacaatggtgctgcctgaataaatagtcatgttgctgcttggnaaaaaaaaa

SEQ ID NO: 67909 - DNA, 250 bp, Triticum aestivum
  unsure (1)..(250): unsure at all n locations
  Clone ID: PAT_TA_67909
attgctggatgaatgaggcgcgtgacctgtcttacgacatggaggattacatggacagcttaatatttgataggcctgaagatgcctccattgtccccaacaacatcaagacaaccagatcccgcttcaaattctttggtcatgccaagactcccaagactaagactaaggttgatgntattgtggaaacactgtatgagttgaggaagtatgtccaagaggcaattgaacggnaccacgtgtacaatct

SEQ ID NO: 67910 - DNA, 537 bp, Triticum aestivum
  unsure (1)..(537): unsure at all n locations
  Clone ID: PAT_TA_67910
tgcaggtaattcggcacgaggcagcggcncgaggcgcggtgccgacgcgaccaccgtgtggtgtggggccgcctccacgcacaaacccacgccctccgctgtgcctgccctgcgcgtcaactggagatggctgcagttttgagtctgctgcaatgctctcggtagcggggggagagcccatggctgcggggggtggagtcagacgacggcggcgacctctccgtcaggtcccgtgcggccaagcgtggccgtggtggagcagccttgcccgcagggtgccgaccttgcgcttttcttgaagaagaggaagctgttggtgcctccgctagtctctacagaccccagccatgggcgctgcccactaggtgctcgatgtaatgcctgcatggcatggtgatgccaaactctgtttgctgactcttagcagctttccccagccatttttctgcctgtcagctgttttaccccaggtgccggacactccagccgtgggcactactcatcaggactgcgagatgatgttgttcttgatgttcg

SEQ ID NO: 67911 - DNA, 560 bp, Triticum aestivum
  unsure (1)..(560): unsure at all n locations
  Clone ID: PAT_TA_67911
gcgccgccccgccccgccgaagcagagnatctttccggagatcccccgcaatcgccgggcgcgcaccaacaaatccggcctccaaattccctcggtcacgccctcctccactcctcctctccagcccagctccgccgccgccgccgccctcctcacagccgcaggagggggattgactgtgccagggggagagggcgacgtccccaccggccacggccagggcacgccgccgcggggtcgcccttcccttcctcactagcctcgccggacgcccgtcccctcccgtctcaaggtctgcctttgagggccaacatggagctctttggtgggtagaagtccacatatataggcattcttgaaatttgttgattaatttattaaccattcatgttgagggcaaagcaactcagcacgctaacccagtgtgcacggtccttctaccttagtgggtcaaggtgtggtagcgcggatggagcttcgtgcacgtgccctgatgatgacacttgtggttcaaagaggcagactgcgagtgctatcgagcgcagatcttctgtgaaggt

SEQ ID NO: 67912 - DNA, 523 bp, Triticum aestivum
  unsure (1)..(523): unsure at all n locations
  Clone ID: PAT_TA_67912
ggnctgcaggnaattcggcacgagggtctgaagttttgattgcgtctcagcgtctcagtttttccctgcttcatcatttaggagcgatcctcttaactctcttccgcagatcgaagaaggcaaccgatcgggaagatgagcagctggttgtcgtctgtcgagaagatgaagaggtggatggtgatgcccgcggccgctggagcggagccgaagctgctgtgcgtcgtctgccacgtcccgcgcctggaagatccacccgtggagggagattatgtggaagaacgtgtgcacggcagcatcaaaccgcttgggtcacgcttgcattgccctaaaggatttttataaactcaacatgatgcagcgcgtggactggaatgagaagcatagggttatttttctacataaaaagaaaaatgcctacgcattgctgtattcgggagacttatcaactgcagcaaagaatgcaatgaagaataattttgaaacaaagatatctcacatagtggatatcagctaccacagc

SEQ ID NO: 67913 - DNA, 454 bp, Triticum aestivum
  Clone ID: PAT_TA_67913
cgcccccctcccgcggtaagcgcgacgcctgggagtctcccctcccctctgctggattggctcggagcggacgggagatccatccaggctgtgctgctagccacggatttgctcgctgccgggcctcttgacggttcgactcggctcttcgagatctcagcttgttctccagaaattttgggggttcaggaacccccgcgccatggagtcaggtgataccaaatttgatgcatcacagtatgctttctttggtaacaatgtcttggaggaggttgagctaggtggattggatgatgatgatgctggtgatgctggttttgttgggcctggtgacgaagaatatactcctatttatggaagggatatgttggaggacgaaggtgtaggttcatttactggtgttgatgatcttgcaggggcattctcaaagctgaccagaactgttaacgaacca

SEQ ID NO: 67914 - DNA, 608 bp, Triticum aestivum
  Clone ID: PAT_TA_67914
catggaatctagtacgaaatttagtgatgtaaaaggtgttgatgaagccaaagctgaactcgaggaaatagttcactaccttcgagatccaaagcgttttacacgtcttgggggaaaactgccaaaaggtgttctgcttgttggtcctcctggcactggcaagaccatgttagcgagggctattgctggggaagccagcgtcccttttttctcgtgcagcggtagtgagtttgaggagatgtttgtaggcgtgggagctagaagagtgagggatctttttgctgcagcaaaaaaacgatcgccttgtatcatattcattgatgaaattgatgcaattggtgggagtagaaatccgaaggatcagcagtatatgaagatgaccttgaatcagttgcttgttgagctggatggctttaagcagaatgaggggataattgtcatcgctgcaactaacttcccagagtcattagataaagcattagtcagacctgggcgctttgatcgtcatattgttgttcccaatccagatgttgagggcagacgtcagatcttagagatccacatgtcaaaggtcttaaagggtgatgatgtggatttgatgatcattg

SEQ ID NO: 67915 - DNA, 542 bp, Triticum aestivum
  Clone ID: PAT_TA_67915
ggcacgagggatggatcgcctgaaactagctcgccaaccccaccagaagtttgtgacaagcctgctgaaatcttggatgagcttgctagtggcattgatattcctgcaaggacaacatcagtggatgcttccgaggaggtatcttcatggattgcaagccttgtggatgttcagaataatgcggcgcaggcagaaacagattgtggcctgccatttgggttcaggaaacaagaggatgaagggtttagtgtaacagctggctggccaacttcaccggtgctagtacctgaagataaaagtttctttccagggtttaagaagcatgaagaatatgaggccaagggttcacctttttccagtgatcgaagcctctcaaactcagacaaagcaatagagaagcggcgaactaaaattgagaaaacggtgagcctgcaagaactccggaagcatttcgctggtagtttgaaagaagctgcaaagaatttaggagtgtgccctactacattgaagagaatatgcagacatcatggaattgatcgttg

SEQ ID NO: 67916 - DNA, 642 bp, Triticum aestivum
  Clone ID: PAT_TA_67916
gcgaaaactctatagtgatagtttagtgtatattggcttggattctttctattgttatgggaaaggcatatccccacccagttcttcttcgtcttaattaataactccttcctgaacttcaaagtacgatagaaacttacttatatctcgtaggaaaactagagaatgagccatctccatctcgtagagaaactagagaggtgctgggcgcagctgaaaggaaatccaagaagagtccatgaaaggctagcacgattaggatcctttgtagggtttatctcggaagagaaggctatgaagcgaacatctcttctttgggagagaggggaagatctatgcaggacacttaacccgtgccggaggactgcacacagctggtacaacctcgtgtggtacattttacatgttcttacaagtccgatggtacagttgacctagtatcgaattattatagattccgttggcagccattgcccccctgcatgtcgtctgacacgaccgaaacgaaactttacaccccctagcagccccctgtcggcatcgaaaacggagggaagtgcgcgtgctgatgtttaatcatgcgatgccaatgatgtaagcgcgggcccgcaggtgcagacaggttcgtcgggggcaagcttc

SEQ ID NO: 67917 - DNA, 429 bp, Triticum aestivum
  Clone ID: PAT_TA_67917
gattcccctcacggccgccgccactccgcctctgccgccgccgagatgggtcgcgtgatccgcgctcagcgtaagggtgcgggctccgtcttcaagtcccacacccaccaccgcaagggccccgcccggttcaggtcgctcgacttcggcgagcgcaacgggtacctcaagggcgtcgtcacagatgtcatccacgacccggggcgtggtgcgccgctggccaaggtgaccttccgccacccgttcaggtacaagcaccagaaggagctcttcgtcgccgccgagggtatgtacaccggccagttcgtctactgcggacgccgcgccacgctctccgtcggcaacgtcctcccgctccgctccgtgcctgagggaggcgtcatctgcaacgtcgagcaccacgtcggcgaccgtggtgtcttcgccagg

SEQ ID NO: 67918 - DNA, 505 bp, Triticum aestivum
  Clone ID: PAT_TA_67918
tcggcggcgccggcgatccgcccctgcctcttcttccccgccgactcgctgctgccaatccccccaccccaccagtagtccgactccgagtcgcgccaccaccatcctcctcttccccgactcgaccgatcccgtgttcaaaaggcaaggcaatctaatccccaaatcctgccctagcctgttgcggcgagctcaacacctccagatccatggcgctccccaccttgcccttcaatccctccaccccgatgggccccgggtttcccgactcggccatcctctgcagggtggcgcgtgtgtcggcggactggaacgcgaccaccgccgagtgccgcaccgaggacggccaagccgtggaggtgtccttctggctcgtcgacccgccgggcatctcctacttctccgtcaactgccccggcatcaagcacgagtaccacgcctggctcatctgcgccgaggacgccttcgtcctcttcagcctcaagttctggggccccgcccgctt

SEQ ID NO: 67919 - DNA, 453 bp, Triticum aestivum
  unsure (1)..(453): unsure at all n locations
  Clone ID: PAT_TA_67919
catttgccacgctctcccaagnaactagttttggcccaagatgtttcgcaacgtcaaccgcttcaccaaccgatgctctacatgtcgcaaagctaagtctaaagctcaatctcatggcctttacatgccacttccaattccatatcaaccatgggaagatattagcatggattttgtacttggtttgcctagaactagaaatggaaaggatttcgtctttgttgttgtggaccaattctccaaaatggctcatttcattccttgcaacaagatagacgatgcttcacatgttgcaaatttgttttgtggggaaatcttgcgccttcatggagtgccaaagacgattgtctcggaccgcgacgtcaagttcttgagttacttttggaagaccttgtgcgccaagctcggaatcaagcttttgttctcttcggcataccatccacaaaccgacgg

SEQ ID NO: 67920 - DNA, 862 bp, Triticum aestivum
  unsure (1)..(862): unsure at all n locations
  Clone ID: PAT_TA_67920
gctctctcctcctcctcctaagatgcagatcttcgtgaagacccttaccggcaagaccatcacccttgaggtcgagtcctctgacaccatcgacaacgtcaaggcaaagatccaggacaaggagggcatccccccggaccagcagcgtctcatctttgctggcaagcagctcgaggatggccgcacccttgcggactacaacatccagaaggagtccaccctccacctggttctcaggctccgtggtggtatgcagatatttgtcaagaccctcactggcaaaaccatcaccctcgaggttgagtcctcagacaccattgataatgtgaaggccaagatccaggacaaggagggtatcccaccggaccagcagcgtctcatctttgctggcaagcagctcgaggatggccgcacccttgcagactacaacatccagaaggagtccactctccacttggtgctcaggctccgtggtggtatgcagatcttcgtcaagaccctcaccggcaagaccatcaccctggaggttgagtcctcggacactattgacaatgttaaggccaagatccaggaccaaggagggcattcccccggaccagcagcgtcttatctttgccggcaagcagcttgaggatggccgcacccttgcggattacaacatccagaaggaatncacccttcaccttgtnctncggcttcgtggtggcatgcaaatctttgtcaagaccctcaccggcaagaccatcaccctggaggttgagtcctcggacaccattgacaatgtgaaggncaagatcagggccaangganggcattccccccggacagcagcgcctgatcttttgncgggcagcagctngag

SEQ ID NO: 67921 - DNA, 441 bp, Triticum aestivum
  Clone ID: PAT_TA_67921
agaagcgagcaaagtatgtcggggcgcggcaagggtaggcaaggggctcggcaagggcggcgccaagcgccaccggaaggtcctccgcgacaacatccagggcatcaccaagccggcgatccgtcgtctggcgcgtcggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccagggacgcaccctctacggattcggaggctaggccaccatcaccgccagattagagtgtctagggttcgtggtcgttgatgtaatcgcagtatctcgctgctgtttgctatcttctgtagaatggaattgaatggaaaaaaaaaa

SEQ ID NO: 67922 - DNA, 101 bp, Triticum aestivum
  unsure (1)..(101): unsure at all n locations
  Clone ID: PAT_TA_67922
gtctgggctgctgtcagattgccctgccgccgcagataccgactctccctgtcatcagtaccgggnttgatcttgaagaattacatcaatattcgctggga

SEQ ID NO: 67923 - DNA, 639 bp, Triticum aestivum
  Clone ID: PAT_TA_67923
gtcgagattcgcgcggccgtgtctgcctctgggtccgcgcttccgttgtctagcgtcctgagctgagctagatctctcagctcgctctttgccggcgctttgggcttagatctggctggggcgagtaggcggaggccgatcgcggattcgtgacgagggaggggagccatggagctgggggcggccgggatgcggcggtcggcgtcgcacaactcgctgtccgggtccgatgacttcgacctcacacacctgctcaacaagccgcggatcaacgtcgagcgccagcgctccttcgatgaccgttcgctcagcgacgtctcctactccggtggccacgccagaggaggcggaggcttcgacggcatgtactcccccggcggcggtctacgctctctggtcggcacgccggcctcctcggcgctccactctttcgagccccaccccatagtgggcgacgcctgggaggccctccgccgctccctcgtctttttccgcggccagccgcttggtaccatcgccgctttcgaccatgcatccgaggaagtcctaaactatgatcagggttgggagaagaaggttgatcggtttaagcttggcgagggggccatgcctgcaagctttaaagtgctacatgacgat

SEQ ID NO: 67924 - DNA, 652 bp, Triticum aestivum
  unsure (1)..(652): unsure at all n locations
  Clone ID: PAT_TA_67924
ggnctgcaggnaattcggcacgaggtggttttatattgaacaagcaacagtaactatgttctgatcctacatacacattcttttctcttgtttcaaatttttctttttttgttttattcttcatttattttttgcttctttccccagttattccctttttgaacaaacaactttttttcatttacctttagttctttttttctttgcgtcaagaaattgttgccatgtgtgtttcatactagttgacacgttgacacttcacacctcaacacctcattagttctagattttgttttgtttccagactgatctttttctttccctttttttttctgaaatgccatttgtgttgcatgcaacataaccacctcaactgcccattaaggccactactaccacgttcaccaaataaccgactagcaaccccaccctctaccgcactacccccattaccactatccctctaccggactacccccattacccctatataaatgccatctgtatgctcttgtgttttgcctctcttcgaaatcacttcccttcctctcaggatacattcttttgcgctttgaagagttgctgatgccagtaaggaaaaggtcacggtgccaggtggatcacatgtctccaagcgcaattttgaagctaa

SEQ ID NO: 67925 - DNA, 741 bp, Triticum aestivum
  unsure (1)..(741): unsure at all n locations
  Clone ID: PAT_TA_67925
ctgcaggnaattcggcacgaggtctccccaccggcttgtttgtagaatacttcgtacgaaatcccaccggccttcggctgccggtgattgatcgaggcggatgaatcatggttaggcttgaggagtagggtagccaggttcggacggaatcagctgagggtattccaaatctgtatcgagtcatcgctgtggagtgcggagttggtgccgagttgagaactgtaggggaatagaaatgttcgagaacgttctgccccctttgtttatcgtatttctgctgggattgctttccgagttgcatttggatctgccatgtcaattttatctttaggttcagatcagccttttctgctttgaacggatatgacataatagggcgctaaattgttatgtggaaatcagtaggcacatctttggtttcactgagctattatagattttttggtaagcacaaataatattcaaattgtaaattgtgtttgtgaaacctctagctgacctgtgccagtttcttgattttgatcatcttttccatgacagagaaacgtgaaatactctctgttatggtcgggtggttttgctgttctaatttggcacctacgttgcagtatgtaaagtgcggctttgcgggagaaaacttccctacatctgtctttccttgtgtcgttggaaggccattgcttcgctatgaggagtcactccaggagcaagaattgacagatattgtggttggagctgctt

SEQ ID NO: 67926 - DNA, 699 bp, Triticum aestivum
  Clone ID: PAT_TA_67926
cggtccgccgccgccgcacgagtttacagtcgggttcttgaaccgtatcacaaacggtttctccggggagctcattattggtcgtggtcggcacggagtagtttacaagggaatgcaggacaatggggaatggattgctgtgaagaagcttcatctcatgccaggacttgatgacgaggaatttaaaaatgagtttaataatcttatgagggtccgacatcaaaataccatatggttagttggctactgctgccatacaacagaagtgcctgttgagcacaacggagaacatgtttctgctagggtggaagaaagagctttatgctccgaatacttgcacggaggaagtcttgacaagcatctttctaatgaaccatgtgcgcttgtttggcacacatgttacaaaataattaaggggatatgtcagggtttacgttacctccatgaaggatttgagtatcctatttaccatctggaactaaaacctacaaaaattttgctggataaggacatgatgcccaaaattgggggttttggtttctctaaactctttgattcaataaaaacctttgactcatcagaagttacgggtacaagtgtatacatgccaccagagtacatcagtcaagggaaaatctcaccaaagtttgatgtattcagtgtgggcgttataatcttgcaaataatggtaggaaagca

SEQ ID NO: 67927 - DNA, 641 bp, Triticum aestivum
  unsure (1)..(641): unsure at all n locations
  Clone ID: PAT_TA_67927
gcaggnaattcggcacgagggcggtgtgggtgtcggaggtgatgctgcagcagacgagggtgcccgtcgtcatcgattactactcccggtggatggcgcggtggcccaccgtggagaccctcgccgccgccacgcaagaggaggtgaacgagatgtgggccggtcttgggtactaccggagggcgcggtttcttctggagggagcgaagcagattgcagaaaagggggaattccctagcacagcatcaacacttcgtcaggttcgcggcattggggattacacagcaggcgccattgcctccatagccttcagtgaggtcaccccacttgtggatggaaatgttgtacgtgttatcagcagactttttgcaattgccgataacccaaaagaatcctcaacagtaaagagattttgggagcttgctggtcaactggtcgatccatcaagaccaggagacttcaaccaagcaatgatggaactaggagcaacattgtgcagcaagaccaagcctgattgctcccagtgccctgtctctagccactgccaagcgcttgcgctttcccatgaaaatccattggttggagttacagactacccacgggtggttcccaaagctaaaccacgtcgtgatttcgctgct

SEQ ID NO: 67928 - DNA, 416 bp, Triticum aestivum
  unsure (1)..(416): unsure at all n locations
  Clone ID: PAT_TA_67928
gttccttgaataataaatgaaaacccttgtaattttcttcctcggactcgctgttgccaacgccacagtgtttttcaaagattatttcacagatggagataattggaaaacaagatggctgtcctcagaacataagaaggattttggtcagtggaaattgacaccaggaaagttttataatgacgaagaggaagataaaggtctccagacaacccaagatgctagattttatgcaattgccactacctttgacaagttctcgaatgaaggaaaaaatcttgttgtgcaattnacaataaagcatgagcagaatatcgattgcggagggggttacatcaaacttttcccatcagatctaaaacctaaagatatgcacggagagtcaaaatacaacattatgtttggacctgatattt

SEQ ID NO: 67929 - DNA, 246 bp, Triticum aestivum
  Clone ID: PAT_TA_67929
ttcttcgtctccgagttggtctgataattcaggtaatggccagtgaactggcacgacatctcaagtgctcaggagaagaagcatccatgcagctaatgagcctcagcccatatgaaatgaagcgtctaattcacaacatactcagtgggaaagaatttggaataactaaaagtgttaaaacacatgcttcttctggagacatatcagtcaaaacgcaggagtcatccaaagcagacaaaagtgaat

SEQ ID NO: 67930 - DNA, 561 bp, Triticum aestivum
  Clone ID: PAT_TA_67930
ggtcgccgccgtcaccttctacacctactacctcatgtcccgcgtgctcgaccaccgcgaggccgccggccgccgccacatccgcttccgggagctcgccgccgacgtcctcgggtccgggtgggtgttctacgcggtggtcaccgtgcagaccgccatcaacgccggcatcaccatcggcagcatcctcatcgccggcaactgcctccagattatgtacgagagcttggcgccgaatggtaccctgaagctgtaccacttcatcatcatcgtcgccgtcgtgttgtcgctcttctcgcagatgccgtcattccactcgctgcggtatatcaacctcgggtccctagtcctagccttcggctacaccatcctcatatcgggcgcgtgcattcgggcaggtatgatgagcaatgctccggtgaaagattactcgctgagcccgtcaaagtccgggaagatgtatgacgccttcctctccatctcgatcctggccaccgtgttcggcaacggcatcctgcctgagatccaagccaccctggcgccaccagcggcggggaagat

SEQ ID NO: 67931 - DNA, 155 bp, Triticum aestivum
  unsure (1)..(155): unsure at all n locations
  Clone ID: PAT_TA_67931
attacatatttcaaaggtgcataggcaaataatgtcagcaatctgtacggcttgatgtatacactttacaatataacatctgtaaaccttctgtagngatgaagatgcattgttgagcaccaagtgtccaaaacacgtggagctgagatggcaga

SEQ ID NO: 67932 - DNA, 413 bp, Triticum aestivum
  unsure (1)..(413): unsure at all n locations
  Clone ID: PAT_TA_67932
aacgtttccgtgattggattaaccctcgtcatcggtatcgtggtgtttattgtttgctcgttatgttctggcggtaacaagaaaacggaagaggagtccgaacaagacgaaggtgaaaaacggcgtaaaggcgtctncaaaaccgncactaagcaaaaacaaaaattaccggtcaaaaacaaacaacaaacgtttagctttgcacatcccttgttgcacacagcactcaaagggcacggcggcaatattctcgatattcacttcagtataaacgggaaatacctagcgacggcttccgaagaccgcacagtaaggttgtggagcgttaaagactttggaacaggaaataaatgcgtgagagttaacatagaacttgaccatgcaaaacgtattgaattcagccctgattcaaa

SEQ ID NO: 67933 - DNA, 656 bp, Triticum aestivum
  Clone ID: PAT_TA_67933
ctttggcgtccccatcaacgatgacacactgaaactaatgtctagatacactggcaagaagataacccaagaagaccgtgcgcgggaagcgatgcggctgatccatgctgaagacaagcacttgagcgctctcaaccacgcgctcgacctcaagaattcacatgggatatttgggattggggtgacagccatggtcctcatctacaacgccaccggcgacacgctggtgctgcaggttgtagagcagcagaaggactggtctggcgaggtggccagggagctaagcttctttcaccccacagtctccttccagaacggccagtggatcgccttcgtccatatggactccaccgagtcagaggcggcccgggtctttcgaggccgagatatcacaggccaggttcgtgactatatggttgcctggtccgtctcttggagcaggagaacaaactcagcatacactgaggtacgtgagaaagaacacttcccaaagttgtgggatcactacaagggtttactggagaaggcaggcaaagtcaccagggaccaaaccgatgagtattgtgcatccactattagtgtcggtgggtacacttcctcggaagtcattgcagtattgcagcacaagtttagccctttgctagagggtggaacta

SEQ ID NO: 67934 - DNA, 732 bp, Triticum aestivum
  Clone ID: PAT_TA_67934
aggaattcggcacgagggggcgggcccaatggcgaaccactcagcgatcgccaggatgtagtaagtatgccaggaccctgagcagcatgtctggagttgggagtgagttgaatgacgaatccgggaagcccatctggaagaacagggttgacagttggaaggagaagaagaatgagaagaaagcctcagcgaaaaaggctgcggctaaagcacaagttccgcctgtggaagaacagatcatggaagaaaaggatttgacagatgcgtatgagccactttcccggatcatccctatatcgaagaacaagctcacaccttacagggcagtcatcattatgcggctagttgttctcgggctcttcttccactaccgtatcaccaaccctgtcgacagcgcctttggtctctggctgacttcagtcatatgtgagatctggttcggtttctcctggatcctggatcaatttcccaagtggtgtcctgtcaaccgagagacttacgttgataggctgattgcacgatatggagatggagaagattctgggttagcacctgtggatttctttgtcagtacagtggatccattgaaagagcctccgctaatcactgcgaacactgtgctgtccattcttgcggtggactatcctgttgagaaaatttcgtgctacgtctctgacgatggagctgccatgctcacgtttgaatcacttgctgaaactgcggaatttgcaa

SEQ ID NO: 67935 - DNA, 665 bp, Triticum aestivum
  Clone ID: PAT_TA_67935
gtgcccgtgtccgagctggtggagcttgaggtgcatcggtggtgcttcgctggcctggctggatccgggcggatctggcccatggtggttcggcttggggaggtggtgttggtggctggtggaggcgggagtggtggaggctggtggcggtgagtgttgctggtggtgcgaggtgggaatactgcggccggttttcgatctcccccacctttggttagtgctgtggcactttggatctggtctccggcaggtgcacggtggcgcgcgtggggcgtgttggtgctcctgatgtttggctgcagcctggaaccatggtggttcctggcctcgggcagtgctcctctgctcctcgccggcatggtgctcggttaggttcggcggctcgcgctgcgtccggtggccctgcgttcggacggccattggtggatccagtgcctagtgctgatgtttggccgtcggcggtctccgcggggtgtggttggctgcgacggttcgtcgtgcttcttcgtctcggaggggcccgatggtggtggtgctcagctgccgtcttgctgtagggatgtgctcaaactccgggtgagaaccttgcattgactatgtcgatgtcagcggcaatggtgtctgtggacatcgttttcctcgttggaggtgtcgttgtggagctc

SEQ ID NO: 67936 - DNA, 673 bp, Triticum aestivum
  Clone ID: PAT_TA_67936
gaggaattcggcacgaggccgccgcccgctcccacttcggttcctgcgctccgccgtctcaaatccctcaccgcccccccgcctcgccgcgccgccacccacccagacctctgccagggagcgagcgagcggacggaggacccttccgcggcgacctccggcttcaggctgaaggagtgaaaggtagggtgggcaaggcagagtgagggatgcagagttaagagtatttggatgctgcaatggcgcaggctgctattgaatctgctgtgagtggtggcgcgttgattgggagaccggcaggggtcctgaggatgaagaggaagactccctcggagctgcggggagaacaatataagagacgcacttctgaaaagattgctgatgatcagttatttgcttctgcagcatttgataggccaagcaatgggcttcggaatatggagcaacaaaaaatacccaaatatatcaacacttcgtgttacagaggtgttcccagttaaaaaatccagaaacgttggaaaggaaaactgtaaggatgctttactcaataatgagaaggttcccaaatttgctgatactgtaactacttcacattccgtgtcatcttcattcctgcgcggtgactctgttaagttggactcttctattccatcacttgtggaggcagcgaaac

SEQ ID NO: 67937 - DNA, 633 bp, Triticum aestivum
  unsure (1)..(633): unsure at all n locations
  Clone ID: PAT_TA_67937
ttcggcacgaggnaatctcctcagcctcccgcgcatctcctccgacatggcccgcaccaagcagacggcgaggaagtccaccggcggcaaggcgccgaggaagcagctggccaccaaggccgcccgcaagtccgccccggccacaggcggcgtcaagaagccccaccgcttccgccccggcaccgtctccctccgcgagatccgcaagtaccagaagagcaccgagctgctcatccgcaagctccccttccagcgcctcgtccgcgagatcgcccaggacttcaagaccgacctccgcttccagtcctccgccgtctccgccctgcaggaggccgccgaggcctacctggtgggcctcttcgaggacaccaacctctgcgccatccacgccaagcgcgtcaccatcatgcccaaggacatccagctcgcccgccgcatccgtggagagagggcctaagctctgttcgtcgtcgtctgttagtcgtcctcttagcctgatgtgttcatcggtggaaatgtgcgtgcctagtgtttgttcgtgtcgtggtcgatgtagtgtgtctgttctgatgtcaccatcttgctgtcatcagtaactgaaatgaaaatgttgctatctgttcaaaaaaaaaa

SEQ ID NO: 67938 - DNA, 201 bp, Triticum aestivum
  unsure (1)..(201): unsure at all n locations
  Clone ID: PAT_TA_67938
cgacgaccacctgtgctgcgagatcgacggccagcacctcacctgcggcgncatcctcngccangacggcagcntntgggccgagtnccccaacttnccnaagttcaagcctgaggagattgctggcatcgttaaagactntgaagaacctggacaccttgcaccaactggtctttttcttggaggcacaaagtacatggt

SEQ ID NO: 67939 - DNA, 699 bp, Triticum aestivum
  Clone ID: PAT_TA_67939
ttcggcacgagggggattcctatcttgactgctcttgttggtcttcctctgctcctccgcctctcattctcatctcctcctctcctccattgcgtcgcgttgcctggaaaagatccgcgtccaacctccactgagtgctcgcccctgccaactcactgccgggagaccttgacggccgcggagcatttgtgttgggtggcagtgaaaaacttgctagcaagaaccatggagtttccaatcattcagagctgaccgctgacctggatatcgggagcagtgagccagtgacgcatctggactctggtgcgccgccgccgcttccgcttccgcttctgcttccttgtcccctcctatcgacgagggcgcccccgctgtgttctgctctccggtgaagcaccaaagttttccagctgattgggcatggaggtcgtcacgggtgccatgggcagcctgctccccaagctgggccagctgctcatggatgagtacaacctgctcaagcgcgtcaagaaagacgtccgatttctgtccatggagcttgagagcatgcatgctgccctcatcaaggttggtgccatgccgcgggaccagctcgacacgcaagtcaagctctgggccgatgaagtcagagagctctcctacaacatggaggatgtcgtcgacaagttcctcgtacgcgttgaaggtattcagcagcct

SEQ ID NO: 67940 - DNA, 679 bp, Triticum aestivum
  Clone ID: PAT_TA_67940
ggaaaatccgaactttcgccccacaggaatcgattccggcgagcgagcaggcggcggcgccggcggcgatggcgagcggctcgtcccggccccagattctctgcgtctccttcaaccaggacaacagcatgttctccgtcgggaccaaggaagggttcaagattttcgatgcccggaccgggaggctctgcaacgacaacaaacttggagggctgaatgtcgtggagctgtggtttgctacgaacctcatcgctatggtcggaactggggaacagccttcacggtcccctcgccgcctttgcctgttcaataccattacaggcgcctcgaagaaggatctgaacttcaggagtacaattttggctgttcggtttagtagaacaaggcttattgttgttttgcaggacaagacctttatttatgatctaaacagcactcgtatcttggaggaaattgacacggtacataatcctaaaggcctttgtgcatttgctcctaattcagaatggtgttatttggccatcccagcaagcacatcaaaaggatctgcttttagtgtataaagcatcagaacctgaattaatatgccagatagacgcccatgagtcgccattagctgcaatggcattttcttccaatgggcatgtacctagcaacagcttctgagaagggcacaatg

SEQ ID NO: 67941 - DNA, 648 bp, Triticum aestivum
  Clone ID: PAT_TA_67941
gcggcgccggcggcggccctcccaggccacactgacgctgcttccgcaccccccgcccgacttgttccccttccctcgggacagatgctactacttccatgactgccaggtaggactcctgcgccaccgcaggaactccgacggcggcggcggcggcggcttttatcttcgccagcaccgtcccagagcctatgacgcctacatcgtcgccgcgctctgtacacggctaaccttcccggagacgttaggcctttacacctacgtctccgacaccgaggtgtggagcagcaaaccagcctcattcccagacggcggcaaactgccccgagccgcccttcgatgtgacaaggttatcaccatcggaggaaaagccggcaccatgcctgggtcgatctcatgcggggtatcatcctatgtgatgtgctcccactcgacgacgacgccaagacgcttcgctacatccctctgccggaccccatccggccagacgacaccatcgacgaatctggaggcatgtaccgggacgtcgccgtcgtcggcagccgcatcaagtatgctgaggtgaagatgcacgtcaggccgggctcggccggcccgaaaggctccttcaccatcgatggctggaccgccgtcgtatggagcaggccg

SEQ ID NO: 67942 - DNA, 641 bp, Triticum aestivum
  Clone ID: PAT_TA_67942
ggctcagtgataaaggaggtgggggtgcaaagacagccaggaggtttgcctagaagcagccaccctttaaagagtgcgtaatagctcactgatcgagcgcccttgcgctgaagatgaacggggctaagcgatctgccgaagctgtgggatgtcaaaatgcatcggtaggggagcgttccgccttagagggaagcaaccgcgaaagcgggggtcgacgaagcggaagcgagaatgtcggcttgagtaacgaaaacattggtgagaatccaatgccccgaaaacccaaggtttcctccgcaaggttcgtccacggagggtgagtcagggcctaagatcaggccgaaaggcgtagtcgatggacaacaggtcaatattcctgtactaccccttgttggtacggagggacggaggaggctaggttagccgaaagatggttataggtttaaggacacaaggtgaccctgctttttcagggtaagaaggggtagagaaaatgcctcgagccgaggtccgagtaccaagcgctgcagcgcctgaagtatgagccccgtggactagcgattgcttctccacgaggctcataccaggcgctacggcgctgaagtatgtaactgatgccatactcccaggaaaagctcgaa

SEQ ID NO: 67943 - DNA, 670 bp, Triticum aestivum
  Clone ID: PAT_TA_67943
ttcggcacgaggggagcagcaggcggaggagatgtcggaatcggaatcgcgggggcgcgccgacgcaatgtgagcgaggaggaggtgctggggaagaagaagaagaggaggaggaggacgacgaagccgcgatcccggtctcgcgctcccttcccccgacgagccgcccgtccgcggccccgcgagaaatgcacaggatggcgcttcctagctggagtgacatttcggcctacctgtcagagtattggtctgtcgtagctgccactgtcatctttgcattggtaggtggcgtgacaatttattataccatcaatcagttgaacaaaaatatcagcttgagcttgatgaaagctatcagagcaagggcaaagaagtacaagaaactgaaagacaaggtccctgccgcttcccacatctggaggaaagaacctggctctcgcagtaaaggtctgaaatgctgtgtatgcttgaagtctgtttcaccgccacagtatttgggggggactatccatcagtgtgatatttgtggtgccactgcacatcctagttgctcagggaatgcacacaaagattgcaaatgcgtttctatggttggccttgaccatgtcattcaccagtgggctgtccagtggattgacacagctgatcgctctgaagaagactcattctg

SEQ ID NO: 67944 - DNA, 527 bp, Triticum aestivum
  Clone ID: PAT_TA_67944
ttcggcacgaggaggtctcactcttctgctcgagatgcggacggtggctagcctgaccgacgacctcctcgtggagatcctctcccgtctccccgtaaagtcgctccgccgctgcatgtgcgtgtccaggacctggcggggcatcatctcgcacccgcacaaccgcaggcagctgccgcagaccctagagggcttcttctacgtgcccgagagcaagccggcgccagctcccagtttcaccaacgtcgccgggacaggccgccctctggtctctcctctcttcggtttcctgccccagcaccagagcatcttcctgctgtcctgctgcaacggcctcctcctctgccgctgctgggaaggccaggacgacttccattacgttgtgtgcaatccggcgacggaggagtgggtccggttgcccgactccgtcaatgccggcaccgagtgcatggcacgtctgggtttcgaccctgccgtgtcggatcacttccatgtgtttgagttctccgaggatcacgacatcagcc

SEQ ID NO: 67945 - DNA, 477 bp, Triticum aestivum
  Clone ID: PAT_TA_67945
attcggcacgagggctgcttcagtgaacgccgcctagtagttatctttcatgcctatgcttgaggcccccaatcgcatccccgccgggcgcttctccttgcagctcgacgacatcagaccagcacctgctgcacaagggggcggattagttatgcctgacaaaggtttcagcgtcctcggatgtcgccatggcctggtcctaatctccattccatcgtggaatcaggtcctgatctgggaccccgtcaccggcgaccagcaccggattgcccttcccctggggttcgatgcaaagaaaacctatatcaccggggcggtgctccggtccgctgccggagacgtccaccacttccaggtagtcgtggtatgcaacgacattcaacatacacgagtggttgcctgtgtctactcgtcggagacagatgaatggggtaattctatctccatactgattcctttctatgttacgggaaggcc

SEQ ID NO: 67946 - DNA, 261 bp, Triticum aestivum
  unsure (1)..(261): unsure at all n locations
  Clone ID: PAT_TA_67946
cacatgtacacggtaacatcaccaacccaactacaaactaaacgatattccaccggatttccattggagcaacactaattctgggcaaacagcacccaactacagctgccaggaggactgaatctaagnaggaggtgaacttggtgacggccttggtgccctcagagacggcgtgcttggcgagctctccggggaggacnaggcggacggaggtctggatctcgcgggaggtgatcgtgggcttcttgttgtagcgggcga

SEQ ID NO: 67947 - DNA, 463 bp, Triticum aestivum
  unsure (1)..(463): unsure at all n locations
  Clone ID: PAT_TA_67947
tggccctataggnattcccattgtattgcttattacatatacactggtgcacaggtagatgtatcttgttcagaattgcaccatcaataagtaacaagaaaaggaaaatttaacaanaactgcagctctctaccttaagcctaccaactaggaataatcatactcgaatatataataaagcaaaggaaattaagacaaaagagactatgcaagaaactaccgaggccatcatcttcacctgtgtttttctttatacaccccagcattttgatgaggaagcacatggattaaatttcgaggaaagccaaatctcacttcaactgctctagtcgctctctctgacctcgacaggcttcgcagcaacagataaatccccagcagggcctttcttgcccagagggctcacactcttggccttgccaagccgaacagcctgtgcaaaagtcttggtgatatgacccac

SEQ ID NO: 67948 - DNA, 549 bp, Triticum aestivum
  unsure (1)..(549): unsure at all n locations
  Clone ID: PAT_TA_67948
cttgctacagtcgcaagttttgtgacgacacccaaccactggnaagtaaaattcatgaacacctgtgacgcagagngtagtggaataaaacctagtacatgaagagaggggaagaaagagaggtgaggaggactaaaataccaaaaggcgtcgcgaacgccaattcagttctggctgcagccatcggcagcgcaacatctcttgccaaggagttccactggaccgagccgagccgcctctccgcgccctcacctccctctcccaatgcacgaactctctcccatccgcgcgtcgccgtcgccgctgcagccggtgctatctcccttgatccgcgccaccgggtgctcctcttcttcatccgcgccaccggccacttctctcacttcatccaggccgtcgcctgctcctccccctcgcatcctcctcaatcagctgtggcgtcaagcgaggggctactccggcgtgtggattagcaggttgccgctacggtgaggaagtcaggagggaggaggacgtgtgcggcggctgtgtggattgaggaaaaaggcc

SEQ ID NO: 67949 - DNA, 197 bp, Triticum aestivum
  unsure (1)..(197): unsure at all n locations
  Clone ID: PAT_TA_67949
ttcatgttctttccgggctncgtatcccccgtttgggggactcatggattcttcaagnaacccgctagncggcctncgtcaaagacatgctcttnaagcttgggcgttctttcgggggatacggggtggctagnaggtattttngcggnatgtaaactccccgggnagggcagatgctccggcatgggcgtcggcct

SEQ ID NO: 67950 - DNA, 280 bp, Triticum aestivum
  unsure (1)..(280): unsure at all n locations
  Clone ID: PAT_TA_67950
gggnaagccatggctccagccaatcccctgcctggctccactgccatggatcacctacgtaactaatgatatattgttacaaaaaanatcaaaccactagctcctcactaaagcatccacataggactccttggtagctaaaatccctccaggtggggctcatagttctgggatttcaaattgtacttttcacccgtgtcacataaaatgaagatcctcgcggacaccgtcttcacatgtataaatggatttgcaaaagaatnngctgatgaaaagcgtt

SEQ ID NO: 67951 - DNA, 115 bp, Triticum aestivum
  unsure (1)..(115): unsure at all n locations
  Clone ID: PAT_TA_67951
agttgccaatacttanttactaaggtctttcctcatcaattcagtaccaacttgcatgttaagaatgcactatgtgataatcctatacttggttaccaatagtccccacatgagc

SEQ ID NO: 67952 - DNA, 538 bp, Triticum aestivum
  unsure (1)..(538): unsure at all n locations
  Clone ID: PAT_TA_67952
ttaggtttacagctacctgtagtntcgtacagtgcagcctcttgcttcaaaaacacacttttcatataataaaaagagaggatgaagaaatctaaactaatttggtgcagtactgactggtagacgcatcaatgtcagcagtagtaatattaacagcaatgtgtgatgcaaaaattggctacagctagtgtctaatgtctaatgaagagtttgcaaaaatattctcctgacaaatagacaggccaaaagctcagcgccctggtagcgcctcagaagattccagagacgtattccaatgccactcaaactttcctttttttccgacggacaggccgcattccagggcagtcagtctaagagtgaaacgaggtccacattcgtatgttataatgaacaatttaggtttacagctaatgatgtagtcatcgtacagtgcagccatctggcttcaattacattgcgaaaatctacagctagctcacttactagtaggtgacaagttacatcagaagctttcaatttgactcctggaaaagta

SEQ ID NO: 67953 - DNA, 505 bp, Triticum aestivum
  Clone ID: PAT_TA_67953
ctacaccctgaagtatacatacagaacacacaaaagagagacgccgcaagttacgctggctgccatgtactacacgtttccactttttcttcaccagatcccaggtaacttgcaggttgctaacttgaggcttcagccccaccactcaccactagaccccaaccagagccccaacaccaacagataacctcggcgtacgcaacgtacgtcttattgccgctacagcttaatcagtgtacgtacataccaactgctaagctgctaccagcctgactatacaacaacaacagcactacggtacagtaaaagcacgcatgcatgcatggagcgttcgtgggtgggtggcctggccctagccgggcgcacgcggctgggcagtgcagcgcatgctgctaccagatgaagctcatctcggcgctggcgcgcgcggcgtcgtcgtcgtcccgggagggggagtggacgtgccgcccctcgtaggtggtgatcaccatgcgcgggtcctccg

SEQ ID NO: 67954 - DNA, 259 bp, Triticum aestivum
  unsure (1)..(259): unsure at all n locations
  Clone ID: PAT_TA_67954
cancacaatccttacaaagattgtaacatcatactgccaactacgtacatacagaacgcatgaagcgacgaggatcaagcctaagttgtctaggaggaggtgaacttggtgacggccttggtgccctcggagacggcgtgcttggcgagctccccggggaggacgaggcggacggaggtctggatctcccgggacgtgatggtgggcttcttgttgtagcgggccagcttggccgactccccggcgagcttctcgaagc

SEQ ID NO: 67955 - DNA, 667 bp, Triticum aestivum
  unsure (1)..(667): unsure at all n locations
  Clone ID: PAT_TA_67955
ttttgggcgtgactgtgctgtttccgccccagcacctatcgttggatggttcggttggttgctttgtatacaaagcggggggaaaccctttttcggtaaatgcgacaatattgctagcgatttccattatggttctatcctgtgatatggggttctgattgtgtgggctctgactgtatgttggggttagtgcaacaatagcttgctgatcacgtgagtaggttttctttgatgtgcctgactgtacgcttgaagataaactgccatctcttttccaagacacagggctgttcgccgacacggtgccttcatggttccctggtgctggtaatcggggtccaatcttgcttactaaaggcgtgctgaattgggtttgatctactgatgccatgggaggtacattgtcggtgttggtgtcttccctcttcaagatgcaccttttgcttccatgcgccttgcaacaagtgcagctatctgctatgcatatcattagcttgtcagtgaaagtgaacatattggactggaaggcttgacgcatttctgaaatatttgctagcccacgggcattctgctcacggagaagtacgccgagtttctccgttgatatgcttgggtagcgtgttcgtatataatttgaaaactcttgcgcatcggntttggcatagct

SEQ ID NO: 67956 - DNA, 503 bp, Triticum aestivum
  Clone ID: PAT_TA_67956
atttgggaatagggattactttatgaggtcgaatacaaaacacaaagaaacaagggcaccctatagacactcagtcccctggggtggacacgtcaccgcgacctaaaccacaatttccatagttacttaaccaacccttcacagtgaagaccgtccagacgccgtatgccgccagaaaaacaagaaccagtgaatcaacgagtggactgcccgagacaccggaggcgaaggtgcatgccacagtcatggcgagaaccaccaccatggcagttacgtgcttcatctctcctctagacggggtctttctcatcagcagcagcttcaccaagagacccagccctatggcaagtgtaagcgtgttcaagaacatgaaaagaggtatagtgtgacctgcattcctgagggcgagcagggcatggtgcttggtcttggagtctggatagggagtatgcgcggctaccaacagcggcagatagtccttgggtatccagttaggcgggtgc

SEQ ID NO: 67957 - DNA, 489 bp, Triticum aestivum
  Clone ID: PAT_TA_67957
cctagctatgtcgttctttgttctgacaagtggaaagagaaaatgtggaaaatgcacatagtttacatcttgcattacctgtgtctagcaatcccgatgctgggttgcacaaataaagatgcagcccaaatgtggaaaatgtacataatatacatcttgcattacctgggtcaggaaatcccgatgcaactgggtgcgcagataaagatagcatgcgagcccaggccgcattttgcatttccaatatttcaagggctctgcatattcggcacgccagaaagggacgcattttgcatttccaaaatttcaagggctttgcatattcggcacgccagaaagagcacttctacggaagtcacattggactccttgctagagcatggaaaaccttgttgatggatcttcgaaacttctctggtccttgaaccaatattggctagaaaggtgagggcatttgcaacataacagccaaccccaacgctggagctt

SEQ ID NO: 67958 - DNA, 465 bp, Triticum aestivum
  Clone ID: PAT_TA_67958
cattgttacagtatgacgctgtcagaacacacacagctagctacagaattcatcagacaacgaagaggaaagaaacacaagaactaatgcacgaggagcctaggacgaggtgaacttggtgacggccttggtgccctcggagacggcgtgcttggcgagctcgccggggaggacgaggcggacggaggtctggatctcccgggacgtgatggtgggcttcttgttgtacctggcgagcttggcagactcgccagttctcgaagatgtcgttgatgaaggagttcatgatggacatggccttggaggagatgccgatgtccgggtgcacctgcttgagcaccttgaagatgtagatcttgtacgtctcgacgctcttcttggccttcttcttccccttcttgtcgccgccctccttggacgccggcaccttcttctccgccttgggcttcttgcccgcgggggtct

SEQ ID NO: 67959 - DNA, 517 bp, Triticum aestivum
  unsure (1)..(517): unsure at all n locations
  Clone ID: PAT_TA_67959
gtgtgttgagttccttacaaagtcaaatatgaactaggcaatgggaaagatgtaaactggaggaaatagaacaacctggtttcactatgcaccgatgactgtcccttcatccgaagcattctgtaaaacgtatggatagccacctcaccgtgaggaccagatagctttggcaagtgggcgtttgagctctagcccaaacacagccggctccacaccgcgtcgcctccgccgcattgagcaatggcaggaacgtgtacgcgtcgggcctggctccgcgtgccaggatgcccacttacagccgcaacagcatcctcagcgccagcagccgccgccgcgaggcgccccggcgaggaatttcgtcgaacgggccacgggtgcgccgcagggcgcgcagattgtcgcattaacattagccgcgggctgttgcagtgatgcgcagggaacgggtcagcagaagagtccaggcggtggcggctggcgagcgtctggtccaggagcgacggcggtggccgtncag

SEQ ID NO: 67960 - DNA, 427 bp, Triticum aestivum
  unsure (1)..(427): unsure at all n locations
  Clone ID: PAT_TA_67960
gctgatgtatttacctcattttnaaagaaaaaaacttgacgtacaggtttgtaattgtgttatgtgtggctttgggttcccagtttctattttctggtttcaaggttgggaaatagtaacacattgtcccctgcgtgtgggtagcactcttttgtccgtcttgcgaactgccggccatgtctgcagcgcacggtgagatgaattcatcttcttcctgatacgaggcacgagacgccgaccatatagattattcaacaaagcgggggaggttgcatctaaatgttgaaaccatctgagatagctctctatccctatcccttggcatgtcccgcgcctcctcatccttcctctcactcagcttcccatctccgttgccaccccttaggcgtagtccttcctctctctctctctctctctctctctctct

SEQ ID NO: 67961 - DNA, 361 bp, Triticum aestivum
  Clone ID: PAT_TA_67961
ttgaaaactgcaatggccttttagaacacaaagatacagagtgtgcacaaatactactcattgatacttaaagaaattggcagaatgccctgatctcatactctcctagttccaagatgtgtgcaatatgacaacacgaggaaggacaagttcatagcagtgcaatgctttcttctctaccgaatgacataatgaacataccaattttcttattagtcttggttcatgtaaaactgaatctagctggaacctcccctctgcaagctgttgcataatcttcagcgaggtgcggtgcagcatccttatgagggcatatgaacttctcgacaaataccttctcgctgatcacgactgcagcata

SEQ ID NO: 67962 - DNA, 188 bp, Triticum aestivum
  unsure (1)..(188): unsure at all n locations
  Clone ID: PAT_TA_67962
tgggtaactagtacgtggtggcatcagtcaacagggcctgcgactgtgnctnatacttgaatnctnggttcctggaatggtctgcagcccagacaaatatgccgnagagcttaccctgcccctgcagagtccggcaagcactaagcgcggtgtccaccggcaccgangtgttngttnccggcggggng

SEQ ID NO: 67963 - DNA, 147 bp, Triticum aestivum
  unsure (1)..(147): unsure at all n locations
  Clone ID: PAT_TA_67963
gtttgatgtcgatgtgctatatgtttgtatgatgagncatgtatacaagnaaaaatgtatggttcggtgaatgtatttagttccaacaagggaattgtgctgtataaagtttcacccaaaactgaagtgaaaacccagggttctaac

SEQ ID NO: 67964 - DNA, 228 bp, Triticum aestivum
  unsure (1)..(228): unsure at all n locations
  Clone ID: PAT_TA_67964
tctctgcccctattgngttnaactatcgcagataacagacagacgtancattaggttccacataatngagacactgncctaaaaactcattattttaaatttgatagccagngctcttcttagtaggactcacggtnaccaccatagccgccgncaccaccaccacggncaccaccgnatccgncgncaccaccaaagccaccgncaccatagccgncgncaccacct

SEQ ID NO: 67965 - DNA, 406 bp, Triticum aestivum
  unsure (1)..(406): unsure at all n locations
  Clone ID: PAT_TA_67965
aaccctaggcactctaatctggtggtggtggcggcctagcccccgaaaccgtanagggtgcgtccctggcgcttgagggcgtagacgacgtccatggcggtgacggtcttgcggcgggcgtgctcggtgtaggatgacggcgtcgcgnatgacgttctngaggaagatcttgagcacgccgcgggtctcctcgtagatganccccgagatgcgcttcacgccnccccgacncgccagcctncggatcgtcgncttggtgatgccctggatgttgtnncggangaccttccgntggcgcttggcnccncccttgccgagcccnttgcctnccttgncgngccccgacatcttctagctnctntctcttcttctcctgggtgaggttgacctgtctttctttgngagg

SEQ ID NO: 67966 - DNA, 611 bp, Triticum aestivum
  unsure (1)..(611): unsure at all n locations
  Clone ID: PAT_TA_67966
gcaacattttatttagttactgatgacagcaagatggtgacatcagaacagacacactacatcgaccacgacacgaacaaacactagcacgcacatttccaccgatgaacacatcaggctaagaggacgactaacagacgacgacgaacagagcttaggccctctctccacggatgcggcgggcgagctggatgtccttgggcatgatggtgacgcgcttggcgtggatggcgcagaggttggtgtcctcgaagaggcccaccaggtaggcctcggcggcctcctgcagggcggagacggcggaggactggaagcggaggtcggtcttgaagtcctgggcantctcgcggacgaggcgctggaaggggagcttgcggatgagcagctcggtgctcttctggtacttgcggatctcgcggagggcgacggtgccggggcggaagcggtggggcttcttgacgccgcctgtggccggggcggacttgcgggcggccttggtggccagctgcttcctcggcgccttgccgccggtggacttcctcgccgtctgcttggtgcgggccatgtcggaggagatgcgcgggaggctgaggagatttgggggattgctg

SEQ ID NO: 67967 - DNA, 202 bp, Triticum aestivum
  unsure (1)..(202): unsure at all n locations
  Clone ID: PAT_TA_67967
caatcaacattctaactaaactnacataagcacagcacaaactgnttacttcctagtggnccctgatcactcagatgccaactactncaatcttctctagttatgcccangagagaaaaaanaaaagttctttagtagtgaactcanggttacattgngattgnncacaacaaacnggtgagcnccanggagtntgacatga

SEQ ID NO: 67968 - DNA, 346 bp, Triticum aestivum
  unsure (1)..(346): unsure at all n locations
  Clone ID: PAT_TA_67968
cgatgtacaaggccttttctcaatgtacaagtggttttgtaagcaatttgttacagtcaaatggccagaaaggactgcacgtgtgttactgctgcgacaacacatcgactttgtgaaaaatggtcaactgcatctctaaactgatattattgttcagttttagcttctaaatacactcctaaattaaaccaagaggcgagcatgtcatctgtatacaaagcaacaccacagaagcctaatctcagttcgatggtgtgctgatctctntngcgctgcgctagagggggcgaggctgcgctggcaccacggtcctctccatggccgaatctcgttgaggagcagcttc

SEQ ID NO: 67969 - DNA, 146 bp, Triticum aestivum
  unsure (1)..(146): unsure at all n locations
  Clone ID: PAT_TA_67969
ccatgctcttacaagtggnnctncagcaaccgatgccacttccgaacagctagctggctggctagttcgttccaggtgctccggtgacggaccggccaacgacgaccaccctgctggacgcgcccctaccgncgnagaggaagccc

SEQ ID NO: 67970 - DNA, 202 bp, Triticum aestivum
  unsure (1)..(202): unsure at all n locations
  Clone ID: PAT_TA_67970
aacacaacattncggcaccaaactaccancaccaacaggtatgaacaggcactccctccgtaaacaagccgccacgtaggtaaaggaaagcctagccgccgaagccgtagagggtgcggccctggcgcttgagcgcgtagacgacgtccatggcggtgacggtcttgcggcgcgcgtgctccgtgtangtgacggcgtttcg

SEQ ID NO: 67971 - DNA, 165 bp, Triticum aestivum
  unsure (1)..(165): unsure at all n locations
  Clone ID: PAT_TA_67971
aatcttacaattctgtggtngggtcgacctcgaggccgnngcagaggagagggagctcgacgaccttgatggaggaggccagcgtgaggaggagctcggcctaccatggnggggagggcgtgatgctggtgctcttgggccagcttgccggatctgacnctggcg

SEQ ID NO: 67972 - DNA, 533 bp, Triticum aestivum
  unsure (1)..(533): unsure at all n locations
  Clone ID: PAT_TA_67972
attgttagtagaagtacataggaactttgtgaaacaaaagatttgtataatttgggagaaaaaatncaaatatccaacgcatacacatcagcaaatttcagaataacaatatagttgtggaagactaaatngatttaatactacataacatacaaatgtaccatgtnactgaaacacctataatccttttttaatctcttagatttgtggaaagctataaaaacttccacttcaaaaatttgcaaaaatacaaattccaaaatctgtgaaacaaattaagttttaaaactgaataagccataaaaaattacttgaatagtggatacttatttgagattaatgggtgatcttagcatgtgttaattgtttggtggcaggaaattcaaaaatacatctattgcacatgtgccaagtgcattgaaggtacatntgacagtattgtattattggaaatcaattaaactgaaatatgcatcatatattctaaccaactggcaacgtgtcagtctctgcaatcatgtgatcccatccgc

SEQ ID NO: 67973 - DNA, 332 bp, Triticum aestivum
  unsure (1)..(332): unsure at all n locations
  Clone ID: PAT_TA_67973
tcaaaatacaaaacgaatacgaccactcccaagcaactctttctagacattaatacatgcgaaacaacacagagaaatggtcagatatactgccatttgactccaacatagagaagggattccgtcaactaatgcaattgacactaaaaagagaactagataaagaaacgcctcgcatttgctctctgcataatgtcttgtcccaaacaacacacctgatgtgtttgactaccttcttgcgaaatgattgcagcactactggggtgcggccanatgccttgggcttcggcttaacctncacttcattcaccccacggntaaatattgcatca

SEQ ID NO: 67974 - DNA, 614 bp, Triticum aestivum
  unsure (1)..(614): unsure at all n locations
  Clone ID: PAT_TA_67974
tatatatactcctacataagncgcacacacagnagcaagaacacacaacacaacccacacacacgcgagcacacacacacacagcaagaacacacaatcacaacccacacctaaaacaaagccaacagaaatacccattagcaagaccgattttagatttccttctcatcctgcgctacatcggtctggagactatccacgaacctggtcccttcaacgagcgccctgaaattccccttgacatactcaccatactcgatcgccctgtacctggcctcgccgagccccgggagcggcctcaccgtcccggcgacggacgcgccctggaacatcaccacggtcgtccggcctctctcggcgtccaccaacaccctatgctcggcgctcctgtacttgccgttggtgagcacctggaggatgtcgccgacgttgacgacgagggcgcccggcagtggatccagcgggaaccacctgccgcccctcctcacctgcaggcccggggtgtcgtccacgtgcagcaggagggccaggccgaggccgtcatggtgcggcgtgatgcctatcaccttgtccgggtgccggcatggagggtagtggtgcatggccacggtctg

SEQ ID NO: 67975 - DNA, 240 bp, Triticum aestivum
  unsure (1)..(240): unsure at all n locations
  Clone ID: PAT_TA_67975
aacatgccancatttactctaatagatatagatattcaatcagaacatgcatcatttactctaataaatatagatagtcntcagcgcatcatctacataacatcatcaatgcaacttggatcatcatcttgagcaatcgtcatcttcgatacgagcgtnaccaaagtgctcaacaacagtcaccagattccaggtcttcacctcacacactngngcttacggttctttgaaagaaaccnt

SEQ ID NO: 67976 - DNA, 362 bp, Triticum aestivum
  unsure (1)..(362): unsure at all n locations
  Clone ID: PAT_TA_67976
agggctacacgannacagggtgaagctcccaaataagtaatgaaatagtactccaaaactaatgcacattcttcactcgggataatgtccacaaaattgcacttgagtttccctagtacttaatacattggtagcccctcgaatatacacacatgatcccctcctcgcagcgattcagcctgtgaagaaacagtatgcagtctggcatttccctgtttacagactactactgcctttgatctggcaaggaattcaaatccggcatgctgacacggctgaattctgacccacangttgaacatttcttatggnactngcaaaacattnacaagcaaactgaacaaacatatcccatgtcaata

SEQ ID NO: 67977 - DNA, 292 bp, Triticum aestivum
  unsure (1)..(292): unsure at all n locations
  Clone ID: PAT_TA_67977
tccacacattatacatgcacacacaactcacacatatatcatgcatctacctatctcttaattgacctcatgtcgaatcccatggtacacgaggtgcccgtacatcatctggttccacgtgtccggcacacccggcaggcaccagtggctgcaatcctntggggcatccgatggcgtctcgggctcccggtgcctcgacgggtgcccgtcccccctcatgnncgtcatgtacgttatgntcaagaaaaccgcatctttgttcattccatgccgtctcctcatgctctgtgcc

SEQ ID NO: 67978 - DNA, 143 bp, Triticum aestivum
  unsure (1)..(143): unsure at all n locations
  Clone ID: PAT_TA_67978
gtccgtccacattatnttatnttacagatccgggngcccggccagngcanccaggcaccgatcctntttattaattcttaanaacanaagcggntntgnttccggatnatcgngtccacggcgtcnttgttggggggccanat

SEQ ID NO: 67979 - DNA, 244 bp, Triticum aestivum
  unsure (1)..(244): unsure at all n locations
  Clone ID: PAT_TA_67979
gtctgattaggctgaacaaaaagggcatgcggctgtttgcgtctaactaaaacaggaccatagtgcaagataaaaggctccaggaacaagcggctaacaaataggggtaaacggaacagtactctactctgaaacagagccgncgctgtcgccatctgagccgtcgctgtcgtcatctgagcctccgntgnngccatctgagccatngctgtcgtcatctganccatagctgtcgccatatgag

SEQ ID NO: 67980 - DNA, 118 bp, Triticum aestivum
  unsure (1)..(118): unsure at all n locations
  Clone ID: PAT_TA_67980
taacttcccaaacagcgcagtacttcttgaggactctctccatctgcccatccttctcatacnnaatagtagtacctctaatcatcatcctcgactcttaagaacctcccccgtcttg

SEQ ID NO: 67981 - DNA, 573 bp, Triticum aestivum
  unsure (1)..(573): unsure at all n locations
  Clone ID: PAT_TA_67981
cgtttctggacagtnaacattcatcaggaatacatcacaggcaagcaacaacaatggaagctcacattgcaacatgcgtttggaaagaaggagagttcactcattgaggtttccaaacaggacagccagcattcatcgtaaatccatgaacagtgcaaatcttctcaatttcctctcttggaagacaaatcttcgcagctctgtttcctttcagaacattacaagcataaccgaaacatccaggtcaggaacttgtattggcttgtcggatattgactttttccagtgatatgccacaagcactcaggatcttgagaattttgttaattcttccatcaacctttaaacatttgatttcaaccattttaagatggtcagatgaaaatgttccttccaacaaactgttatctccttctgtcaccattgaagaatcaaattcctcagcaaatttaagagtaaccttctcaagatttggcgagtgttggataaaatgaatcacagcactgaggtcagcatgcaaacaccagtcgttgagtatcaaagtctttaacatgggaaatgtcnggccggcac

SEQ ID NO: 67982 - DNA, 245 bp, Triticum aestivum
  unsure (1)..(245): unsure at all n locations
  Clone ID: PAT_TA_67982
gtgacagcattcagactacccgaggtagttcacaacattcaaaccgtatcttgtccatggntcacaaaaacctcccaagtttccatctggacanaacataacccgaggatnggaatgntgtgactgcatnttcaggtagttgttgcttcttctgccattgcataacttccctaccgcaaaaagatgttacccagccacttggatcctccgcaacgctaggtatcgctagcataccaccacctnac

SEQ ID NO: 67983 - DNA, 446 bp, Triticum aestivum
  Clone ID: PAT_TA_67983
atctttgttcatgtttccaacaacaaccgatgcaataagatccacacactacacgtatacaaatcccacaccaatcacttcacactatgccataaatggaatgaatcgagctgcgagcatcttgctccagagtacaattatagttcatctgtagccgttctgttcataagtcggcggcttcggcccgagcaggctggtcatcatcctctggacccgaccctgcggctttctttctctcggccttgccacgatttggttacgctctgccgccgcgcctgtcgtggctgcggctctcggaggctgctcccctactctggggacggtcttcaccagattcctgaactgaaggttgtagaacatctgcaggtagcgttgtttggccactctctcttgcttgttcagagtcctccagaagccatacattgaccccatgttcagcactttag

SEQ ID NO: 67984 - DNA, 655 bp, Triticum aestivum
  unsure (1)..(655): unsure at all n locations
  Clone ID: PAT_TA_67984
aatgctctttacaggttcctggcactctttaacgaaggctaaatnttattagccggagcgcaacttaacgactgagtactcggagcgtcgtccacgaacgatcatactaagattataacatcgccacaagcatgttgcaaacctgctgcacttctgtgcaacatcagcaagatgtttctgcatgttctcagatggatacttaaaatctatcaagaaggatagattgctctagattgtaccggaagtttcatccccccagcaagaagtgcgcaggctccactttcgccacacaaccaaacttgaatgtactgtatttcctgtggacgcctgtaagcttgccccctgcggccttctggtggaattgtaccatcattttggagcactcaatgagctgatctctagtgtatctgctgtgtgtctcgcagatctttgtccactgccagcagcgattgatagcacaatgggcagtgtaaactgcagcggcagcaagcagcgaagggcagtacttgagcatttggtattcaaccaggcagagctcaagcatgaagaaagaaactagctgtagctgcttgtcagaatcagctgccttcaggaaccttctcataaaaacatattgcgttggtacagacatgttgtactccagagtgtccaggac

SEQ ID NO: 67985 - DNA, 136 bp, Triticum aestivum
  unsure (1)..(136): unsure at all n locations
  Clone ID: PAT_TA_67985
actgaatgtagcctcttattgtacgagtcttgactgaataataaaggaaaggaggtgctgcgtttctgaaaacaaacgcaggagaaataaatagttatnatgaacaatcatgcggaagcctctgtcgtttattggg

SEQ ID NO: 67986 - DNA, 220 bp, Triticum aestivum
  unsure (1)..(220): unsure at all n locations
  Clone ID: PAT_TA_67986
aatacagtaattaaacgacagnacaggtatcattgctcgcccgggtataagagtctgcagcaacaaaagcaatgaccatgtaacaaaaaccttctgctagaatagatgcctatttcttcttgatggcagccttggtaaccttggcgccggtggggtccttcttctncacgcccttgatgacaccaacagcaaccgtntgtctnatgtcacgcacagcgaa

SEQ ID NO: 67987 - DNA, 493 bp, Triticum aestivum
  unsure (1)..(493): unsure at all n locations
  Clone ID: PAT_TA_67987
tacaaactcgaggttgcaatattgtagttattaacacttttaaaaaaaaggtgggagaggagagtgcaagaaatgaaactaggtttttcaatgcaaaacagaacgggaggcatatagttgtacaatactgtacaagttaataggaaacaaattagcaaatgtgattggtcgaattataacagctcaggaacttaagaagaaagaaagttaaaaagaaagaatgtttattgtgtttataaaaagtaatatgctgaaaatatttcaaacatattcaccaatattgtctacagcaaggctaatgaaagtaaaatgctcttgtaaagtantaagtcatgggaaatgtatgttaatatgttttgtataatttgcaaaattgcaatgttacaaaagcatttgctgcagtgaaaaaccaggattagtcaaatcaactaaatgagttcgttaaagtgttgttaagnaaatgatatctacagncaacaaacatacctataat

SEQ ID NO: 67988 - DNA, 666 bp, Triticum aestivum
  unsure (1)..(666): unsure at all n locations
  Clone ID: PAT_TA_67988
gaatgtaatgcctgaaaacnggccgtgcntttttcccttgcnaatctaccgtcattgccctcggaaattaggacatgccagactnctcaatgtattcctaatccctggtcttatacaaaacaaatttctcacggnccaatccacactgtaatatctactgtaacagagagtcccggaaaattttgaactgtnctcgtgggagaaggaaaggcggagagcatatatncacaccaggtgagttccttggcacgcgacgctgaatattctcgtttgattgcagagacttctgagtagacgtctggcattgtgggtcgatcttttggtgtctctgtggagcatgagagaccaagctgaacaagctgcataatgcagctcagcaactccaccattgcatggtttccatggtccaggccttcgtctccggatctcgggattatgaaggtaggatcaagtatatcacggatctttttggggaatgcatttcccacaaatttctgaagggtcaggccattcttgaacaacacatctgttgggcatttccccgtgagcatttctaggatgataattccatagctatagacatcgcccgctgttganatcttgttcccgatgccatactctggtgcaatgtttccaattgatcctcttggtccttgtaagctcgcg

SEQ ID NO: 67989 - DNA, 112 bp, Triticum aestivum
  Clone ID: PAT_TA_67989
gtagctataatgcccaaagtttaagatttagaatacactaaaatataagttcgttggcaaccttctgagaattacttaatatacaaaagactctgacatttacttacagaag

SEQ ID NO: 67990 - DNA, 201 bp, Triticum aestivum
  Clone ID: PAT_TA_67990
cttaatagcaactgttaagagaaagcaacagcagagaaggaacaaatctcgctagtacaacttcaggttatataggacattgtaaacatagcaggcaactttcctcctcaaacgaccagagccttacagtccattccatttttgttaggcaaggatggaatctaagacctgggcttctcgctctcttcaaggagaaaaagc

SEQ ID NO: 67991 - DNA, 575 bp, Triticum aestivum
  Clone ID: PAT_TA_67991
attgaggcaggcaccgttactatttctcgagatcagaaacatagcgatgcgattcttacacgataacacggccacaaacacacccaaacagctaactacgagactcaggaggaggtgaacttggtgacagccttggtgccctcggagacggcgtgcttggcgagctcgccggggaggacgaggcggacggaggtctggatctcccgggacgtgatggtgggcttcttgttgtacctcgccagcttagcggcctcgccggcgagcttctcgaagatgtcgttgatgaaggagttcatgatggacatggccttggaggagatgccgatgtcggggtgcacctgcttcagcaccttgaagatgtagatcttgtacgtctccacgctcttcttggccttcttcttcgccttgccgccctccttggccgccgccgacgacttgcccgccggcagccgcttctcggccttgggcttcttcccggccggggtcttctcggccttctccgccgcgggctcctcctccactggcttcttcgccgccggcttcttctcggccttgggcgccatggatgctgacgc

SEQ ID NO: 67992 - DNA, 246 bp, Triticum aestivum
  Clone ID: PAT_TA_67992
caacagagataaactaatatgtgaactgcatagcagatgaacagatcacatctagggcacatactagaaacatgaattctaccacgatctcgaacaggaaggatagaatcacatacggtgcagcgggagcaacaccgccggcgttgacgttgtcacccatggcgtcgaggacgaggttgccgaggtcggggaagaagtcgtcgttctcgaagtcgccgctgccagcagtcgtgcgagtgcgctccc

SEQ ID NO: 67993 - DNA, 662 bp, Triticum aestivum
  unsure (1)..(662): unsure at all n locations
  Clone ID: PAT_TA_67993
taaattggcaagcttaagtgaatcttgtncactttttgtgtgtatgacatgtggggctcaagtgtggcttgaaccaaatgctcacctaagttagtcaaatttacctaatcttagatgtagcaacctttagcaaagttagtcacaaaccaaacaacctcttcatgttgggctcgttctccgccatgcccggcgagatcttggtgtactgcatgctagagcggtaggcctccatcctggtaacgcctggccgcatgccgccccagtagccagtgatggcgtgccacatgtacacatacttgagcccgtacttgtccttcggcgcgcgcaccagcgtctcgatgccagtggcggtggccgggtcatcgccgctctagaaattactgttctccttgttgccagtgagccggggaaggggtggcggcttgccggcctcgctagggaagtccgcgccggagctttgtttcttggttccgaccgacttccaggcatcgtcggtgatggcgaacttgggcggtgcgcgttccgccggcggtgatgctctggaggccggcctcgatgcctcctgagtggtgatgtcctggtagaaggccgactgcccatgtccaccacctgaaggagtcaacgatcgcagggagcttcttctcgcgcgcgggcggaaggtt

SEQ ID NO: 67994 - DNA, 685 bp, Triticum aestivum
  Clone ID: PAT_TA_67994
tgaaattgcgcatatatgtaacaacagttgtacttcagatttgctaaactaaacagggtgctactcctaaacctaaaaggcatatattacaactcttgtcaactggtaacacagacgattcccctaattacacaacaaaaacaccaaaaggatgaagatgtttctgctccggaatcagtagacccagctatttgatcgttttgcaggtttcttggatgttgaaagcatgcacatcaccgattggaacatcttgcctccctaaagagtcacctagataagcaatggttcgatcttgcattttgaaacattgtccaaattagtacgagctggttacatttaaagttaagatgtccctagcaaaaacagcgtatttgcatacttgcatatcatctcgtaaaaattcatatcaaaggaacatcaacatataccttcaagaaaattgagcggctttaaacactagcatctttgtcttggaattaacatgaccttaatatagttcacaagatgatatagttcacaaattataacatagctaaatgaaacaatattgctacaaatcacttgatgagttcatagtcctacaccatcccgtggtaggcacaaaagcacacctacaggataaaatcaagaactcggacctaaaaaaactttcaagaaaacaatacgacatatgggaaatgccaaa

SEQ ID NO: 67995 - DNA, 434 bp, Triticum aestivum
  Clone ID: PAT_TA_67995
tgcactcttattgataattatcgcagcgaggagctacatatggcaagacaacgatgagagcggacaggaacatgttaagctacaccaccaagctctgaaaccggaacatcacagtaggactctctgataacgcacgcacgcggctaccgctacctaggccctctccccgcggatgcggcgggcgagctggatgtccttgggcatgatggtgacgcgcttggctgccacaagccagttatccctgtggtaacttttctgacacctctagcttcaaactccgaagatctaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccc

SEQ ID NO: 67996 - DNA, 693 bp, Triticum aestivum
  unsure (1)..(693): unsure at all n locations
  Clone ID: PAT_TA_67996
aagatagtatatattgagaacgaaacgtncaggaagatagtatatatttgaaacaattgtaaggaaaagtattgacaccagttggaagcaaaactgacataatcagcttaataaaagtgcatacaaatccaaagatttcataattcagacttattacataaaattagtcgatatctgatgacatgcttaggctgatcatgaagtagttgtaatgttagttttggaggtaattttcaatggaaggtggtgcaatccgtaggtgcttttcgtgcgtcttgaagattccttggtccttgcatggttgttgacggtgccctatgtgtttttattaccgttatcctcttgtccttcacatttgttcattttcacattgttattcttgtttatgctttttgacaacctggagatgcacttgtgtatcctgaagatgttcctgttgttgaccctctttgttggtggctccatcttctgtaaattggatgcttcttttcgctgaagagtacctatttatgtttttgtcggtgtccatagttgcagattggcaagcaggaggcatgtattgcccaagtggacttgtgttttggctccccggactctggatgctctttgatgacgctggactcttctccagttctttgcttggagttgactttgtagagggcagcatttgtgcattgtcaactgggaagcttt

SEQ ID NO: 67997 - DNA, 213 bp, Triticum aestivum
  unsure (1)..(213): unsure at all n locations
  Clone ID: PAT_TA_67997
aaaaaagtggcagnaacactggtagtgctataaaggattagaaaacctgcacgctttaatgncgaatggaagttacgagctgagggtggaattagaagattgcgagaatgatagaagatacgccaaatacaggtaagctaacaccagatgaatcaatgaaactgaaatataaattatttcttgcagttcattcgcaattgggtcgagtgagca

SEQ ID NO: 67998 - DNA, 217 bp, Triticum aestivum
  unsure (1)..(217): unsure at all n locations
  Clone ID: PAT_TA_67998
gaaaaagtcctagtaaagaaaaccntncgtgggatnngagagctgcttgtttagcaagctccaagctgatgattgagcaagcgcgaagcgcaaccatgggactgcgggctccgagaggccgacgggccctcgatccgcctttccgcatagcctctgaccaaaatcgcaccgccgtccaagacgggaaaacagccccaaaacaacagcggcgcgggcc

SEQ ID NO: 67999 - DNA, 616 bp, Triticum aestivum
  unsure (1)..(616): unsure at all n locations
  Clone ID: PAT_TA_67999
aaaatntggcacatgctacaaataaaccggatgatttctctaggaaatatccgcctagccagccgtctcggattagcgtgctggtggccgttcgatgcagcaaagccacagcaggagaccagcttcaacgtagcgctgctggcacctgtcaaagcttcactgtagcacagcacggcccggcaataactccaatgcagccccgacaagctgacaacgtccggcgaagctccattgcagccccgacggagctccaacgaagcactgacgtcgttcggcgaagctccattgcagcccggacggagctccaacgtagcaccgatgtagtccggcgaagctccattgcaactccggcagagctccaacgtagcatcgacggcgtccggcgaactccattgcagctccaacgaagttccattgcaactccggcgaagttccattgtagcgccggctctgcttccgtcggagttgaaagagttgcctcgacgcacgctccaacgagccgcatgactaccctgatagtaccagttgtgttgtgcaataagcagcagcagcagcagatgtgctcaccgcagccctcctccactggtagcaccggtggcgtttgcaacgcagcacc

SEQ ID NO: 68000 - DNA, 640 bp, Triticum aestivum
  unsure (1)..(640): unsure at all n locations
  Clone ID: PAT_TA_68000
gtgaactgnctgatgccggttgtgagtagagttggttgaatnccagaatgcgttaggaaatctactacgccgaatacaccaaaaccgacaacaaaaatcaaagaaatctactactgcacttccatggggcgtcggtgccgccgttgactcccctcgcacgcatccggagaatgcgccagcaaactgcacaaggcctccagcccatcgcgcactgcacgtgagcttcagaggagatgcgcgggacgcacggggtggggtgggacctgtcgttgaccctgatgttggaggaagaaaccggcagcaaggaagcctggcgacgtgggggtggcttgagcgggcaggatccaggggtcggcaagggatgttgctcctgggcgttgccggatttcggcagccacacagctgccgaggagggagggtggtcggggcttgggcgacactgggtggggaagttggtgtgggagaacggcaatggctcgaggtagcctggcggcgtggggatccggcatccctgctgctggcggcggagggaagtggtagaaagcggcgttgggggtcattacgtcattgttggagaaggtggaggcgaccccgcgagcaatgggcggcggcagcgcgaggccgtgcaagtggtgatttt

SEQ ID NO: 68001 - DNA, 122 bp, Triticum aestivum
  unsure (1)..(122): unsure at all n locations
  Clone ID: PAT_TA_68001
agggtggnaaaacagatatactctccgtcntctcttcatagagctggtctcgacctgtaacaacgacgacacgctggctggctaaggtgccctcaagctgctcaaggcgctcggcacgaggc

SEQ ID NO: 68002 - DNA, 349 bp, Triticum aestivum
  Clone ID: PAT_TA_68002
cccaatgaacatcatactgcacgcctgtgcccctctacaagctaaatcaggaggcttgaaaatgataaggaagcagctgttggtcaaccaaggaagacttggacgcggacggcgaggagcaagatggtgatgagggcgaagtagatgacggcgtggatgagcatggaggcgccgctggtctggaagctgccgaagtccacgatcctgcccttgccggggatctggaacagcagccccggcgagaggaggatgaatagcgccagcccgacgaacaccggggcccagtccgccattggctacctacctcctctctgatcgatactcttgatctgtgatagtaggaccagtc

SEQ ID NO: 68003 - DNA, 596 bp, Triticum aestivum
  unsure (1)..(596): unsure at all n locations
  Clone ID: PAT_TA_68003
acagaaaatccaccaaattcgatcnattaccatccaccatcctctcacaaaccggatgatgcagtgagagtagaaatgttgttgcatgggcatgggctcagcacaagcttaccaaaagctgccagtgatagataatctacttaactactttgctctgaattctagagtcttaagactgtcaccaagatgacacattgtgccattgtgccaaacttaagtagcagcaaaatgccggcaccacctgctgctactactgactgagagcgtttctaatcatcccatctacgaaaacgccaaaaaaaagagaagggcttcggtttcgcgacgcgcaggcaggcatcacttcttcttcagttccatcgcctcccagaacaatttgtccatctcatcgttctcggggtccagctccacgccgcccgacagctcctcgcaagctttctcatagtcctttagcagcatcagagcctgtcctcggcgaaggcgcgcctccgcccactccgggcacctcctcttgcatctggttgcatcctccaaagccttttgtccatcgccaagctgaagccagcagcgggcttcctgctcgcgagcatcttgcc

SEQ ID NO: 68004 - DNA, 633 bp, Triticum aestivum
  unsure (1)..(633): unsure at all n locations
  Clone ID: PAT_TA_68004
ctctgtcgattngtttctcttaggctggtctatgggaaggaacttcggagtacatacacacttcaatacaactttgcttatgtgacacatatttaatgaagagagaggtgcttgtggtaactactagctaagttaccagaacatcacacttcaagaaacaatgagtctataacctaataaatacatcgttgcatgacactacatagatgttcctacccactatgaaggtagtaatatagtctagggaagtgtgtaagttactagcttagcttatgttcttgcctattgtgaccagccttacaatctggtatttctctctcgaccgcatgccagttgacaaggtacgatggcaagggcgtcccccattgcgacgagatctgcaggtgcccatccccgccctgcccccggcttccccatcgtctggccccccgccctggaagaagagcacctcgcggcggattccattgcgcccacatcgtcttgctgatcaccgtgccgtcgcatgtcgggtgcctcaacagaaggccgggaagtctcgccgtgggagcggccaaccctgctcggtggggtgagaggtatgcatcttcgaggtccctgatgtgcagaggctacacatnctgagcctgctgccgc

SEQ ID NO: 68005 - DNA, 596 bp, Triticum aestivum
  Clone ID: PAT_TA_68005
tgttgagaggaattggagaggagaattggagaggagagatacagcttggagaggaaggaagaacttgaggaaggaggggatcgagatctgattacactcgctgccttccaccgctagccaaactgggtattatagccctccctattacatgggcctcacgacaggtatgttggcccaacagtccaccgccacttcagtcagtcgatggcccagcctctccatccttgatgcttgtcagtggtagggtactagcgctgacattgcctcccgcttgagtttcagcctgtccccagactggagcagtagggtagcgtatcttgatggtgtcatagttctcccaagtagccgcttccacatgtaaccctgtccactgtatcagaacctgcaaaagagtagtatcgcccctcttcaccaatttcctgtccaaaatagagcctggcgccacatcgagactggagaggtcaactagaacaggtaaagtagtgaaaactggtgtatggtctggcacaaactctttaagtttgagacacatggaaaactggatgaattttgagcttctgcaggcagttgaagcttgtacgcggcaaggccaattt

SEQ ID NO: 68006 - DNA, 618 bp, Triticum aestivum
  Clone ID: PAT_TA_68006
gcagatataacatttaggcattcaaccctggaatgatattttgcagtttcaacagaatacaaatatcataagtgaaaggttgtttgcaccaagaggtgttgatcccgtgaccttcgggtttcaccaaccttctgaacctgagatagcacaaattagaatgttacctcaatgtgatgaaatgcaacctttattactggcctaatgatttcaagggattaatatagtaaaccatctcaggaaagatccaacattattcccaagaagcagtttccaaaacagcaagatgtatgtagtcatcaggaacattagagtctaaaaaataaaaggaacatcctacgtacaaacctaaaggaaacatgatataaaactacaaccgagtgtattaactacgtatagataagtcaccaattaatagaatatggacagaggactggagaaaacataatagttacttgtaggttgcattgtcgttgctcatgatcaatcaaaattcaaaaacaaaaaggtagaacaacactgttttgtgataatgcaaagaacaaaaagatggatttaaagttatcgagcactgctaggaaaatattgtcttgaagaacgaaaggtaagaaagcaataaag

SEQ ID NO: 68007 - DNA, 632 bp, Triticum aestivum
  Clone ID: PAT_TA_68007
taacagcaagtctccggtgtctgcgaataaacccgacccccccaaccccaacacaaagtaagtagcaccaattatccatgtctcctctccctactaacccattacaaaaattggttcccctttaaacccatctacagctcgtcatggtcctcgtcgtcgacgccgccgtcggcgccctcgccgcccggagctccgccggacctctggtacacggccgacacgatggggttgcacacggcctccacctccttgagcttctcctcgtagtcctccttctcggccgtctggttctcgtccagccactccaaagcctccttgagggcctcctccaccttctccttctcctcgctctccagcttgtccgccagcttgtccttgtcgccgacggtgttcttcatgttgtagacataggtctcaagctggttccgggcgtcgatgcgctccttcaccttcttgtcctcctcggcaaactcctccgcctccttgaccatccattttcggggctagttgattcggcaggtgagttgttacacactccttagcggatttcgacttccatgaccaccgtcctgctgtcttaatcgaccaacaccctttgtgggttctaggttagcgcgcagttgggcaccgta

SEQ ID NO: 68008 - DNA, 667 bp, Triticum aestivum
  unsure (1)..(667): unsure at all n locations
  Clone ID: PAT_TA_68008
aatttgaacttctagtattattcntcggcgacacgagtttttgaagtctttctctgcacaaactttgaacatcaacaacattaacaccacgacacatcaaagcagtaactgtaccattttttttacatacaagcatacaaaaattcgcaggagcaacacagtataccccgatacgtcgttggactgatgctctgggaattttagaaccgatgaaaaaataccctgatacggaactttagagctctagggatctgtgcttgtagtagacgaacggatcgacctggatgttcagggaattgggagacgccgcgggacaccgttgagccagccatggcgaatttgacaccgttgctgtagttggagcccagagccttcaggtatgggttcatccacatactgcaattcatgcattaaattgcaccatagtgtcttgtctggacgtacacgactgagccggcgggctgcacatcaagccacacggacagaaaagtggtgcggaatgattcggttacaggcctgctaccgattcaagtcatacgcatccgcagcctggcaatgggcttccaatattcatctttttgagctgctacctttgattttttttatgcatccttttttgtggcatctcatctcctttgcttcaactttgggcactttgatatggtca

SEQ ID NO: 68009 - DNA, 348 bp, Triticum aestivum
  unsure (1)..(348): unsure at all n locations
  Clone ID: PAT_TA_68009
gttttgnaatttgaaccatgcgtgttcattggtgcgtgaagcttattgacnttatgacatcacacaatatactatntatatgatttgctgttgaaacttcaaatncgacgccaagaccaagcttgtggccgccaccgttcaaattctttgcatcaaccaaacttgatagggtcagtttcacaccttttntangttggngtgaatatccaaatcctacttgaccgacgttgtttacttttgcattaagcgcggcctcagcgtcgatgttatatttagtancaacgccaaacttggtgttattctgcccagcactccaggatagttggataccagnancaaggttcttgt

SEQ ID NO: 68010 - DNA, 152 bp, Triticum aestivum
  unsure (1)..(152): unsure at all n locations
  Clone ID: PAT_TA_68010
ggttgatggctggttaatacataaagattacatactaacgctncctacatacataaatattnacatcaggggatggatcggatcgccaatgagcacccaggcangggacaacctnggccctagatctttctctgccaaagacaccaaaggct

SEQ ID NO: 68011 - DNA, 558 bp, Triticum aestivum
  unsure (1)..(558): unsure at all n locations
  Clone ID: PAT_TA_68011
tttcctaaagagtnccgttttgccaaacttgtttatcctcttaaaaaaaacttgttcagtacaaccgagaggacggaacggttccagggcctcgtcaacccacacaacgccggcatcatgtatccagcagacgttcttgctgcctgggcttccggtgttacagggataacatgcacgctcacccaaaaaccattcagaaaaacagcgccacatggtaactccctcgacattcagatacagcatactgaatactgtacgaccgcatttcccctcgctccgtcaagtgcagcggcttccccatgctccacagcctcgtccctcaatttagccgcaaataggcaaagcacttgttacatcacagcatgcaccaagttattcgaaaactggaggccctggtgatggngtgactattttttcaaatcctgcaaccaaattggaatggggcgttacaaagcgccgtggtcagcagcaccgttggcagaggggcattcggagtactggattgcttcatgcgaagcaggggcgcatctgaccgccttttttttttggaggaggata

SEQ ID NO: 68012 - DNA, 436 bp, Triticum aestivum
  Clone ID: PAT_TA_68012
atcgaaaccttagttctacaagctaatcgatgctcgtctgtctctacgccttcttgtcggccttcttgggggacttggcggtcttcttgggcgacttgggctccttctccgccgtcttcttggggagcagcacggggttgatagggcagaaatttgaatgatgcgtcgccggcacgaaggccgtgcgatccgtcgagttatcatgaatcatcggatcagcgagcagagcccgcgtcagccttttatctaataaatgcgcccctcccagaagtcggggtttgttgcacgtattagctctagaattactacggttatccgagtagcacgtaccatcaaacaaactataactgatttaatgagccattcgcagtttcacagttcaaattggttcatacttgcacatgcatggcttaatctttgagacaagcatatgacc

SEQ ID NO: 68013 - DNA, 582 bp, Triticum aestivum
  Clone ID: PAT_TA_68013
catagagatacagtgaaatctctagccctacacatcagaagttggaagctagacctccattctccaaggcttaggccccaacggaatagattccacattacatgtgtatatacatacagattcagtgacatttctaaccgtacacattggaacttggaatctggatctccatggcttttactagatgccaagtgatcgatctacaatacatgttacacagggccattgccttgtcctacgcaccggactctaagaaagtagtactatgtatacaaagagattcagtgacacttccaaccctacattttggaactccgaagctgagatctccaaggcttagggtaggtgacaacggatctatccacaggccacaatacatgcatgttgctccctccgtttctaaatataagtctttttaaacatttcaaatgaattataacatacggatgtatgtagatatatttagagtgtagattcactcattttgcttcgcatatagttactagttaaattctcttaaaagacttatatttgggaacggaggagtacttggggccatcgccctgtcctacgtaccggact

SEQ ID NO: 68014 - DNA, 374 bp, Triticum aestivum
  unsure (1)..(374): unsure at all n locations
  Clone ID: PAT_TA_68014
ctttaatattattatgattnaagcagatcacttacagaaatgaattccatacggagacatatacgcgcgcgcgcgcgcgcacacagggcattagggcaagaacacacaaccacaagttcacaacccacacacacgcacacgccgaggcaaacaaaacacacctaaaacaaagccaacagaatacccattagcaaaaccgattggtctcgaggctgtccacgaacctggtcccttcagcgagccccctgaaattccccttgacatactcaccgtactcgatctccctgtaccttgcctcgccgagccccgggagcggcttcaccgtcccggcgacggacgcgttctggaacatcaccacggtcgcccggcctctc

SEQ ID NO: 68015 - DNA, 375 bp, Triticum aestivum
  Clone ID: PAT_TA_68015
atgcattattgatccctgttacgcattaaaaatattttcgttgcattgttcacttattcaacttctttgatttttttgttttatttcaatcgaaaaatggaatttactctttcttggtcgcttcgtcctcctttgcaagcgcagagagcatctctttcttcttgagagcgattctctcttcacgacgtcttcggccttccttgttcttaagacgacgtgcacttgcttgatcggagaacatcttggcacgagattgctttgccttttgtttgtggatatgctccataaggatacgtttgtttttgaatccgttaccctttgctttcaggtagagagtatggtacatgtgcttatcaatctttttagattcccgat

SEQ ID NO: 68016 - DNA, 366 bp, Triticum aestivum
  unsure (1)..(366): unsure at all n locations
  Clone ID: PAT_TA_68016
acacagttcgaaaacatttattaaggcaacagccaaatacatgacacaagtttagacaaacgttcatgcaaactaattagacagaggaacgccaggcatcgagtacaccagtggcttactgcacgtagttttcctatgcccaggcaagacaacagccaaatacatgccacaagttcagacaaacgttcctggaaacgaatgagctggaggaacgccaggcatcgaggacaccagtggcttgctgcacgtagttttcctatgcccaggcaacccacacttgctgcatgtgcccactttcctttcctttntaggcaacccacacttgctgcatgtgcccacttttnctttcctttttaggggcgnaac

SEQ ID NO: 68017 - DNA, 357 bp, Triticum aestivum
  Clone ID: PAT_TA_68017
aattgttaaggcatccacacacataacagtagcagctagctcaaggaaaccaaacatgatggtgcaatttctgtcatccagtttctgatcgcagaatgtgcattaattaggacgacacatccccctcctcgtcctcttcttcttcttcttcttcttttcttcttcttcactgtgcaacatgttcagattctcagcaatctccacgtcgaacttgggactgaagtagaccaggtccatccctagcatgccatccacgctgcgggttccacggaaggtgatatcgtccgggatgtacttggcgtcatctggatagacaattttcctcgcactatgcacaccatagtagcaacggcccgc

SEQ ID NO: 68018 - DNA, 637 bp, Triticum aestivum
  Clone ID: PAT_TA_68018
caatatatgtactgtacaggaccacaaattaggctggctatatagttcgcagctgcggctatttacatactctactaccggcattgtttgcatttataagtaattttcttgtgcggggatgctgtataagaattgcatatgtacgttcctgtcgctacgacgaatgaacctataatgaatagaatagcagagtatacgccattggcgggctaagcagagcagagcagggcggagcagaggaggagggcggagcagagcccgaggaggacgatgggcgtcggccgggctgtgtcgtgctacggcgacctggagcggcaggtgtcgtggtcgatgggcatgacgctgccgggggggtagctgaagctgagggggcagttgaggcgcgtccagaaggcgaccttgaggaagatgcccatcctccaccgggtgcgcgccttgccggacagggtgatgggcaccaccctggacctgagcgcctcctccatggcccgcatcccggcgaggtccagcttggccccgcgcgacgccccgctgtagggcagcgtgagggagctctcccgggcgacgctgaaggtctcggccctcagctgcagcagggtggtgccgtggaacttgacgtcgatgttgaagctggaga

SEQ ID NO: 68019 - DNA, 293 bp, Triticum aestivum
  unsure (1)..(293): unsure at all n locations
  Clone ID: PAT_TA_68019
acaggaaaaaacattctangttaaacctnggactcgaacagtttacagaaaanggngtncagtatgtctgcaancatgncntggncncaacatctaagaaaatccancangnaacatgcagcagctcttnagcctaagcnggggcncccttgcccttcttcttctggagcttcctcatgtanaactccagctccttgccctccaggatgtacccataanntntgccacactgnccagggcgagacnaaatgcaggccancagccttccaccgttnaactgctcctnaatggga

SEQ ID NO: 68020 - DNA, 602 bp, Triticum aestivum
  Clone ID: PAT_TA_68020
cgagcatgtactgaaattgaggcaggcaccgttactatttctcgagatcagaaacatagcgatgcgattcttacacgataacacggccacaaacacacccaaacagctaactacgagactcaggaggaggtgaacttggtgacagccttggtgccctcggagacggcgtgcttggcgagctcgccggggaggacgaggcggacggaggtctggatctcccgggacgtgatggtgggcttcttgttgtacctcgccagcttagcggcctcgccggcgagcttctcgaagatgtcgttgatgaaggagttcatgatggacatggccttggaggagatgccgatgtcggggtgcacctgcttcagcaccttgaagatgtagatcttgtacgtctccacgctcttcttggccttcttcttcgccttgccgccctccttggccgccgccgacgacttgcccgccggcagccgcttctcggccttgggcttcttcccggccggggtcttctcggccttctccgccgcgggctcctcctccactggcttcttcgccgccggcttcttctcggccttgggcgccatggatgctgacggtggggtggggcc

SEQ ID NO: 68021 - DNA, 701 bp, Triticum aestivum
  Clone ID: PAT_TA_68021
tctattttcgaaataacttacaaatccgatacaagatggaatagattcaaacaccaattgaaaaccatctctggacattgtaacaacacacctgtctatgacgatggaatactccagccaaggtcagggatactactactacataagattctacagaacatggcaacacgcccctacatgaccgttaaggcgctgcagtttgaaccaggccaaaacatacttgaaaagaattaccttttaaaagccttcaggtactgcagcatggttaatgctttagcactactaccttcagatggaaggcatctctcttctaaactaatcgctagccagagctttctcatggcgcttcttcttctgaacattcttctggcgcttcttcttctgaacattcttctggacaaagaattcgccgcagaaaccatcagacctcatgaggaccttcttgatagtaggcaaatcgcagttcagcaattgtaccgtagagccggcaagaacttcaacacaatactcttgcctttcgttcttgaagttgatttccggaaacaatgcctccaactttttcagtgaatttaatgcgctagcacggctaacttcaaatggaagatcattcctctcttcaaagatggcaagccagagcttttcaatggcctccgagaaatgcctccatctgtgtatcagaagattggcatagggaatttccg

SEQ ID NO: 68022 - DNA, 417 bp, Triticum aestivum
  unsure (1)..(417): unsure at all n locations
  Clone ID: PAT_TA_68022
aaatnacataaccatgatttagaacagttaagattctcgacaactaggtgatgtgaccaccaaaaatcacaaaatccaacatgaacatgttgcaagggaaatcatgaccatacggctgacatgggcctttcttcaaatattccgtcctcgctgcatatctgatttcggcagtagaataatcacaaatttgttttcggagtcctgctgattgcgcctgctgattttgcaaactgtagctgcgcgtttgcatgagctagatgctctgccgccgttgcctcctcccacacacgggacatcttcttttggttcgcccatccacgaacggcagatctggatcaggtgcccggcggccggaggacggtggctggcgttccggtgaggctgagctctgtggcagcgagccggcggccgctaggc

SEQ ID NO: 68023 - DNA, 174 bp, Triticum aestivum
  unsure (1)..(174): unsure at all n locations
  Clone ID: PAT_TA_68023
cccacgattgctgggtgtatggcttcctactatacgtgaagtgaaactttaacactttccataagatgcaactgatttgacgaagcggagcaggcgacggaaggtagtctttggttgttctcgagctttgtaaatctgcangcttacancagataatgcacaaatttacatggt

SEQ ID NO: 68024 - DNA, 558 bp, Triticum aestivum
  Clone ID: PAT_TA_68024
acgtatttatctagttacttagttgtccccccctaacgagatcgaagtaaaaagaatcataaacatacgcacatgggttactgggctgccaatgtgtcccacataatcccatgaatttcactgtgtgcagccctccccctcatggcaaaagctcgatcagaagtatcatgcaggactttcaaaaaagattcaaagatctctcctacattctttttttacaagatctcctacattctttcattgttcttttccaggggggatacataatttcaaatctatatactcaacaacgtggctaatttattaaacttttaaaattttgtccaagtcaacagaaaaatatatcaagttttacataccaaattagttttattaggtttatcacaaaatatatttttgcatcatctatagtgatgttgaaatattactatatgtcctctaaatttggttaaaacatagagaagtttgacttataataaaactataaattgaataaatttagaatggaagaaacataatactatgtgtatatgtataacagcacacatacataaattt

SEQ ID NO: 68025 - DNA, 250 bp, Triticum aestivum
  unsure (1)..(250): unsure at all n locations
  Clone ID: PAT_TA_68025
tggcaaggcntncaannggtttacaaaggtaacaaaacgccttctgtatcccagggnaagcaagcaacttcatctagctagctaggaagcaagggaaggtggggtggagaatattcggacccgtgtcatgtcacggtggggactctcggaggggccgaagaagggggcgtgttggctggtcggaatgcagggtcngcattccgggcattccgctncaggtgctcccatgtgatncttttacgctcctccg

SEQ ID NO: 68026 - DNA, 614 bp, Triticum aestivum
  unsure (1)..(614): unsure at all n locations
  Clone ID: PAT_TA_68026
atggcatattgttcatagtntgaaatttttctaagtcgttacaaatactattgaactttggttcaaaaaacagatactagtattaaaccactagctcgggagaaaagatccacatggactcaaagtattcgatgtccctccatgacttgctcatagtttgtgacttcatgttgtatttctccccgtgtcgataaaatgaatagcatcttggtccgcctcatcacaagttgaaatagacttgcagaagaatctgctgatgaaaagcgtttggctgcctagcccaccaacaatcggcacccagcagtgggcacctttgcaggcatccgcctcataaacctctaccttgagagtggagctgatattataggagggcactcgaacttgtcgtatcaccattaatagttttccacatgactcgactaagtaccagtggtccctaacttcatcctcatcatccgaccaagcagtaatgccttcaagaatcatgtcatcgccggttttcttccggcgttgctctatggtgtcctctttgctctgttcctcattattgactacctcatctatatttcccgtatcattgttcgcggagtcaaaatttccattatcatcgctcc

SEQ ID NO: 68027 - DNA, 531 bp, Triticum aestivum
  Clone ID: PAT_TA_68027
aacaaaactagagaacaccactagtcacccatgaccgcaatagaagagcagaaaaacactacatgataaaaagtgaacataaggtactcatgattgctaagttctcaggatgacatttgaccgaggcaaggctctgccatatgcctacaggaacagtcgacgtggtgagcaaaaatcatgctatcttgcctcccagcctccagcggcccagcccaagtgccttgcttctaccgtacaagtacttttgaaagggtccaggttttctaccgacaggcacgcatttcggcaatgttaatttccctgtttagctttagcatacgaagactgaagctcccactccggcgtacccaaatcttctcaagcggtatgtcgttagccttaaacaactgtgccagcatatggactctaggatcatccttggtgcatttgatcttcaccattctaaggtgtttgcaagcaaatgatcctccgttcggtttaaatcttcccagtgcattttggatgtcaaagttcatttcaagttggagaaag

SEQ ID NO: 68028 - DNA, 780 bp, Triticum aestivum
  unsure (1)..(780): unsure at all n locations
  Clone ID: PAT_TA_68028
atcgtaccgttgtttacccaatgttaagacatagattctgacacccatcttgtccgaattagtgaaggtgattcgatgcacagcatgatcatctacatatatcattacagttctacctaacataacgctatgcagaccttcagagaaaggctcccttctgacctacatcaagtactatgtaatatgcccttctaaatgatccggatggctaccagcataacgaagctactccagtcagcaaaaaatcctccttctgctgccatttcagtcacccagctcccacaatggcgagacggtgaactcagcatcgaacccatcgagctggtaatctttaccatagatgtcggggtggtacgccagtttctcagtgatagcatcaacatcaatatacatggcaatgtccttgaggtagtcagcataaacttcctctcgttcagcccaagaagcatcccaatgctgagtgatccacgcgtcgtcaccaacaccgtgcaccggcatcggtttgacttcatgctcaccgaagacagaggcagcgacaattggcttcacttcacactcaccaaagacagaggcagcgaccattggcttcatttcacgctcaccgaagtcagaggcagcgaccattggcttcacttcacgctcaccgaagacagaggcagggaccattggcttcacctcacgctcatggaagacagaagcagcgaccattggctttcactttcgcgttcaccgaagacagnaagcagcgaccattgggcttnactttacgctcaccgaana

SEQ ID NO: 68029 - DNA, 376 bp, Triticum aestivum
  unsure (1)..(376): unsure at all n locations
  Clone ID: PAT_TA_68029
atgtgcttatatttactaaaattagtttcaaatccagtttgaacacgacttttatttaaagacatgtatagtattgatttttaaagtcgaaaggtctccctacattgggatacaccatctgataaccacgtaatctctatgacacgggctaactgcagtgaaatacccactcatcatttgaccgtgtacttatcaaatttcttttctggatcatacggctcccacctactagcaggaaagatgtgtttgttcttttcaaaccagngtcgcagcactactttacctgcgtggctctcatctttctctacagtagcatnaccaactaatctaacattcatcatggacatcaaactggaaaantgacccacttttacca

SEQ ID NO: 68030 - DNA, 591 bp, Triticum aestivum
  Clone ID: PAT_TA_68030
gaggaatcccatggctaaacaatcgttgtacaatataattgcagaagttgattcttgtctacaaattacagcaagtggagctttgatggaacagtttcagaagccacttcatagactctagcgtctaaacatacagtgagagggaaacattccccagttacttggttcctgactagggccatccatctctcgttcggaaaaaataaaaaacagggcccatcttgtttgattcttcattgtcagaaatcaacttattacaacacaattgcttgacgtaatcagcccaaataatgtttatgactcaccctcgcatgcaggagaggtctgtacatcactaaacacattaacagagcagagcattcctccagcttcatccgcgaacgttatcctcctacgtttcctcggcaattctggatgcgaagcggccttctttccctctagtgtcaatattttacaaaaacgattgcaatctttgttcattattgtcaaccatttccttgtagttctctccacctttaatgcatcctcagatgctgctctcatctcggcagtgttaaaattaggaagcaaagactgtgcttctgatgacaa

SEQ ID NO: 68031 - DNA, 572 bp, Triticum aestivum
  unsure (1)..(572): unsure at all n locations
  Clone ID: PAT_TA_68031
acaacctagnattcaacttgtttctcgctctgaacaagtcaaggcataaccaaaataataaaacaaaagaccacagagacaacatgaaccatttcttagcaatgcataccataggcttaatcatccagttcatcggcggcgccttatgtgatctgttgtaaggccagttcagaatcctggatgttgatggtgtagctcgagagaagctggatgatcgtgaaaggacggtcggcgacgaggacaaactgcttgtccttcttcgcaaaatcaacagcttccgagaccgtctctactttcctgtcctcgatgttgaacttccagatacgagcagaggaacccaggtgttcagtatagtaaatacagtttgcctcaatcgatgggaacatatcggtgttcacagctaggcacctatggtgaccaatgaagatggcatgcttgatgatgctcttcacatgcgaaagtgtgccattctcgtcatcgcacttgaaaacctggatgagtccttgtcccttgatgatggccagcagatgtccaccaaagtccattaggaaacaccgggcgttgtctgcaga

SEQ ID NO: 68032 - DNA, 556 bp, Triticum aestivum
  Clone ID: PAT_TA_68032
tggaaataggtgcccaattaaatatattagccgttttcgtgcgtacaaaggagaaacaggggcatgcatccactgcaatgttaggaaaaagaagatgcacaaagacatgctactactcaattacatcacataaacggctcagcactgggagctttgagtagcatgccacgtaataaaagcattcccaggtccaaccgaggcgaccatctttaatctcactaagttgccctgtgctagttttgtatgagaaaagcttatttgactccttgtcaacgaggaagaggacccctctttccaagtcaagagcaacaatccgataaaaacacaaccaggacagataatctcggttgggaaggaagttgtcccttccaaatgcatctcccatacaaaaacgatgctttagagaccacttgcaaggacgataatcatcaagagtgaaaactgcaattgtactgccgccctcctctggaaatgcgcactgcaaaagcccccattgattggctgaagcaaccatttccaacagtcacccggcagcttgatagtataatgatatggc

SEQ ID NO: 68033 - DNA, 435 bp, Triticum aestivum
  Clone ID: PAT_TA_68033
ccccgccctccaatgaaaccttccaaaacaaaccgaaaaactattttattttcagaaaatgatgagaaaaatcatttcagcccagaccattatctaacataccctctcaaatcaaatgtatattaccttgtcagagcatgcacacttgactcacccatggtaatgctagccttcctcctcgccactctcaacgaaaacaacacccttatctttcttttgcctcttagctccatcaccactgtcctttccactgccagtttctgaccacatcacctcaatgatgtcgctaccgtacttgtcggtctttaccttccctatcagcttttctagctcggcaatagtggttggagtatggcagtttagcagggaaatttgctccgtggaaagaactgcatgcgggaatatgcccccattacgagaagagatggttctacg

SEQ ID NO: 68034 - DNA, 554 bp, Triticum aestivum
  unsure (1)..(554): unsure at all n locations
  Clone ID: PAT_TA_68034
caaatnctgagnaaatatncgagtcgtggacaatggtatctgaatgtttagctaacaaagtatgaacgtatatcaaggtagtatatagcacatagtctgcaacaatctaacacacacaattctgatacactgcaaagtaaatgttagcaggcatacctcactgggaggtgccatggtcctaatgtttctgtactggtcattttcagctacaagaaatgagaaatacatactcaggttttctcagctgaggtgagatgccccagtttttttgtcatctgttcgatgctgctcttgtccaaccaaaaacttccgcggtctcctgctgttgtttgatttgcttctctgtctcgccgttctgattgggcctcctggtgtgcatgggtcaacccaggctgctcggtaagaaactgctgccaaaatccatcatttgcgtcagcaggaaggtcttgggtgggttgttgatctctcgatggaccattttctgtaacagcaggttctaaattgacatctatctcggagaccttagctcgtgaatctgcacgagaatgagcttg

SEQ ID NO: 68035 - DNA, 270 bp, Triticum aestivum
  unsure (1)..(270): unsure at all n locations
  Clone ID: PAT_TA_68035
aacagcagcgagatgcggccattacaccgaggacatgaacaccaccatcagacaacgcgtagctactagcacaaatccggtggtgcgagacgggtccttcttgcccggaccggcgcggcctagccgccgaacccgtagagggtgcggccctgtcgcttgagcgcgtatacgacgtccatggcggtgacggncttgcggcgggcgtgctcggtgtaggtgacggcgtcgcggatgacgttctccaggaagatcttgagcacgccgcgggtc

SEQ ID NO: 68036 - DNA, 143 bp, Triticum aestivum
  unsure (1)..(143): unsure at all n locations
  Clone ID: PAT_TA_68036
atcaccagaccgcatgcagaacatcagcacaggcgtatnannttntnncctctnatcacancacatgacggcgcaggaganggcgttgncgncgangaacaagtcggtgagctggtcgtcctgccngcngacctggccggacc

SEQ ID NO: 68037 - DNA, 696 bp, Triticum aestivum
  unsure (1)..(696): unsure at all n locations
  Clone ID: PAT_TA_68037
ttaattttttattnagaagttagtacaaaccctaagaattcagataccaaaacactcagacatatatcaccaatcattggatcaaaacgtccaaaattaacgccaaagaactactgaagtactgacagatgcagatatccaggaaccctagctagctagctagcaatatagaaacgaatcgcccctgctagctgtgactagagaacaagctgctagtactcatccaccacttcgatcagcttgctggccactgcgcttgcaaaaactggagacccaggatgaatcttagtgttgaacatgtagatgtggcagtcgccgatcttgccgccggagaggtggacgaggtctaggtggaggtcatccagagcccgggacgcggcggcgaggcacccgtcgcggcggcgcttggtgagcttgatgttcacctcgtcttccacgatccgcacgtccacgaacgtctccttgctcctccgctggatgtacgtgctccgtatcggctgcggcggcggtggcatcgctggcatcaccgcggccgccagctcgcctgcagagcactccccttctccggccaccaccaggggcgccggatccaccacgtccccctggtgctcccgccggcccctcttcttctccaccagcagcgtcagctcctccaccgtcctcccaagctcctggatgtactcgatcgcgtcatag

SEQ ID NO: 68038 - DNA, 738 bp, Triticum aestivum
  unsure (1)..(738): unsure at all n locations
  Clone ID: PAT_TA_68038
gttgatgtcggtcttcttgtctgttcgctttagtntgtaaatcgtttgttgaatgtcgtggcacatattctagctagatcatgagtcctctagtgactctatttttcatgtaaccccggattgtatccgggaggctctctcttttgattatacttgatcaataaagcgcgatattcctcaaaaaagacatggatgtgttgggtatatgccacgcgcggactgtgacttccaacgattccacatctctctcttggtcttcttcctcaccaacagctgaaaagggaccaggcgacggtgacttccatccagcacttccatttcttcatcggcatgtaattagtgcttgtttcagcttccgtagctgtaaatgatgcagcagttatctcttggtcttcttcctcaccaacaccgtgctgccagacagaaactttcagcttccccccttttctaacagaaacaacttggcgtgatagcttcacagagccatcagcatcaactggcaactcatcattattaaaatccagtaatgagatcatcacaccactttcagcgtccgtgctagcagtaagcacaccacggaaatcacgaggaaactgcccttcaatgacttgaacacggattgtggcttccacagatgaacaaacagtgtaatgctgcagctccagtgtgcaaagcttgcttgtgtgcttgataggaaggtagcagcctaagctgtacgtcttagcaaatttgctcaaa

SEQ ID NO: 68039 - DNA, 192 bp, Triticum aestivum
  unsure (1)..(192): unsure at all n locations
  Clone ID: PAT_TA_68039
aggaaggtctacctcanctagacaaacttgctcggttagcaacaaacttcaacttctctaggtnacatcatnatgataataataatncttgctactactgctactaataatncccggtcgcgtgcanaggccacgtcacanaagctcancancaaaaantacagcatggcgcctcagntanagcagcacccg

SEQ ID NO: 68040 - DNA, 547 bp, Triticum aestivum
  Clone ID: PAT_TA_68040
agttcttacaaccacgggccaacaaagcgttggcaatcacccagcacaggtgctactactgctaccactacttgcggatagatagataagcagagtcaacagtacagatgcagatgcagaaaccaactgcacgccgtcagtctaggaggaggtgaacttggtgacggccttggtgccctcggagacggcgtgcttggcgagctccccggggaggacgaggcggacggaggtctggatctccctggaggtgatggtgggcttcttgttgtacctcgcgagcttggccgactcgccggcgagcttctcgaagatgtcgttgatgaaggagttcatgatggacatggccttggaggagatgccgatgtcggggtgcacctgcttcagcaccttgaagatgtagatcttgtacgtctccacgcccttcttggccttgctgcccttcttcctgccccgggtcttggcctcgccgccggcctccttggacgccgtcttgcccgccggcagccgcttctcggccttgggcttcttccccgcgggggtcttctcc

SEQ ID NO: 68041 - DNA, 379 bp, Triticum aestivum
  unsure (1)..(379): unsure at all n locations
  Clone ID: PAT_TA_68041
aggcggngcaccaggtgtagggtggactccttctggatgttgtaatcagcaanagtgcngccatcctncatctgcttgcnggcaaagatgaggcgctgctggtccggaggaatgccntccttgncntggatcttgnccttgacgttgnnaatggtgtnggaggattccacctcaagtgngatggtcttgccggtgagggtcttgacgaagatctgcatgcctcccctaaggcggaggacaaggtgcagggtggactccttctggatgttgtagtcagcaagggtcctgccatcctcaagctgcttgccagcgaaaatgagacgctgctggtccggagggatgccctccttgtcctggatcttggccttgacattgtcga

SEQ ID NO: 68042 - DNA, 216 bp, Triticum aestivum
  unsure (1)..(216): unsure at all n locations
  Clone ID: PAT_TA_68042
aatcaattacaaaatctacacattacgcatggatgccataagctgagagcacgataaattccaatctaacgttccccgntcaacaggaggcgaggtnaataaccctggccctacagaaacctctntntccaatctcccggcgtgccgagcagcatgcacagcgacaagaacagcagaacgcatggnttccntatacgccatnatgcattcatagtt

SEQ ID NO: 68043 - DNA, 632 bp, Triticum aestivum
  unsure (1)..(632): unsure at all n locations
  Clone ID: PAT_TA_68043
aacgattgcatgtgtatttacgttgtacatatatgtacaattagttagtagcttaacttgggcagataattaacagtgcacggttatttacattgtacagtacatgtacaattagttagtaagtttaacttcagcagataattaacagtgtgcactcattagccttatggtggcaggagctgctagctgctgctcatggtgcgccaaactgacagcgcgatccccaccagcaccaccaccgcggccgccatgttcgtcaccagctccgtcgtcggcggcgtccctggatcctcgctcgccggcagcagctttggtgacacgtcccaatcctcgtgctcagtcggctgtcttccaccgttcgccgcctccctcgctttcttgtcctccatcctcttctcctcttgcttcttcatcttctccagcagtggcaaccttaccttgccgtcttcgtcttgcaccttgcgatgcttcttcttcgtcttcgcctttgcttccgggagacgatgactaggcggccgtggtggtggtggtggtggaggcggcgatggagatgagacgccgattggtatatctgacagcgggggtgacttangctgaggcagagtggctgtactctgttttggaggtggcaa

SEQ ID NO: 68044 - DNA, 658 bp, Triticum aestivum
  unsure (1)..(658): unsure at all n locations
  Clone ID: PAT_TA_68044
cgttgagcttactnnacttgacatcgctcaaattttagtataagctgagctgagcctcgtccaactcgctcgaactggactcggttacagccctatccgggagcgctcgcccacacggtcctactatgccggttctgtatgccgacgaacgcggagactggcgtttccatgcaggcgcagtgcggcgacagcgtgatgatcaccatcatgcagcacgaggtggagggacttgaggtgtgggccggggacgggcgttggctggccgtgccgccagatccgacgaccatcccttcaccgccagcaagatgttcacggtaaggccgccctcttgctcgcgattgcggcctcatgtctggatattcgtaaaccgggccagagagtggcattcgtgtagctcaggtgctggacagcgaaggtctgtcccgcccgggctaatcaccgtgtcgcaagccaagtcaggccggagagataaaacaggttaaactattgtaccccaatgtcgtacgacaattcctgctgccttccttggatgtggtagccgtttctcaggctccctctccggaatcgaaccctaattctccgtcacccgtcaccaccatggtaggcccctatcctaccatcgaaagttgatagggcagaaatttgaatgatgcgtcgc

SEQ ID NO: 68045 - DNA, 120 bp, Triticum aestivum
  unsure (1)..(120): unsure at all n locations
  Clone ID: PAT_TA_68045
gaacatgtgcttttattgtttatgcccattttccactactgttaattcttgntgggagttnttcataggcgcggacgagcccattcttgcgaggacctctncatatgacagcntcatntg

SEQ ID NO: 68046 - DNA, 709 bp, Triticum aestivum
  unsure (1)..(709): unsure at all n locations
  Clone ID: PAT_TA_68046
atttttgctgcaattatttngattgtgtaccacatacttctaggtatcctaaatgtataacacggttataattcacaagagttgtataagaacttctacagtcaatgtctcgtaagttactcatagcactgactataccaaaggatccaccaacgatggtcaatagtaacttttagagaccagacatgttgaagttgatcttgatggcttgcactgaaattgctgtatcaaatgttaccgtccataaaagatgcagaaaatgtccaacaaaaagaaaatacatctctcttgcagcagatatgattactctagtctccactccaacaaaaagtgttgtattcttcaattgcaggccctcaaaatttggcaacttagtagaaaattctgcaaaatgagctccatctgcaacagtttgtgaggatgaaaagaatatattatatctctcatgctgataacatatgtgcaacaacggttattacaaaacttccagcgcgcataagcagtccatattataaaggttaccactaaattccagccacaaattacttgtagttccacttttcataaaaaaacatagtttcaaaagatcagaatttattccttggaacagatctttcaagaaacagcaagcatcatacacataacgaaagcactgctctgtaacagaatgaacgagctaaagtgaatgcaagcatgcttttagtgctta

SEQ ID NO: 68047 - DNA, 569 bp, Triticum aestivum
  unsure (1)..(569): unsure at all n locations
  Clone ID: PAT_TA_68047
gncataataatactgnatgaaccatcaaggtggccaacaacaaatccatggcaagcaacatcatgtagnatcaatgtcacacaaacagtttgcagcccaccagnacaaggcaaggcagacaggaaaaacatccggcttgactactccaaatcaagccttcaacctaaaaccgactcgcacagtctctggctctcaaagtattgattgataagacagacagactcatcatcctctctctactcgatcagatcgtcatcgtcgtcgggatcaccagccagcttccttgcaaggtaaaggaagggcttctcaaagttgtagttgctcttggcagagatctcatagtactgcaggttcttcttcctgtggaatgtcacctgcttggccttaacctgcctgttcttcacatcaaccttgttgccgcacaggacaatggggatgttctcacaaaccctgcacaggtccctgtgccacgtaggaacattcttgtaggtcagccttgaagtgacatcaaacatgataatcgcacactgaccatggatatagtatccatctctaaggccaccaaactt

SEQ ID NO: 68048 - DNA, 567 bp, Triticum aestivum
  unsure (1)..(567): unsure at all n locations
  Clone ID: PAT_TA_68048
ccttgtcattacaagnctgaaacaaannaatagnagnacaagnaatgggcggctcagttacaaggacgtattcagcagttttcctaagtacggcatgcaatgctagaagggtataatggcatatacaaatgtgtcaactgtttgttcattcgtactcctttcgaaggtgaagatagctgacgccgttggtcttgtgcgagtacgcatatttcatcacaatgtcatgaaaatgtttcttgtcctctggagttcttattctggccttaaacctgggtacaaaatcttgtgatctgacaggagcaattgcacgaagtactcttatgatttcctcctctgtaattgcagacatatctgtgtcactccctgctgaagcagatgcttttgaaataggttccacggacgagggtggctcctccttgacacctaatgttcttgcctcaggttctgtctttggcttttttaccgctgcacgattcgaagtttttgcaccatcacctccggatttccttttttgattggacctgggtgcaggtggagtgctaacagcaagttctgttgctgttagtt

SEQ ID NO: 68049 - DNA, 624 bp, Triticum aestivum
  unsure (1)..(624): unsure at all n locations
  Clone ID: PAT_TA_68049
cactgcatncaaaacaaaaanaggnaaattcaacttggngtgattaaatagngnagnaaaaaaggnatagnacaataatgaacatctacaaagnatctaaagatctagnaggccaaacaaatggcagctgttgagaacaaatggtggttcgttcacgaacaagtcgttaatccaacttccatccgctgccgcgacgtgcaccggcgacctgataggcccgtcgaagtccatctcctggagcaacgcagcagcagcagcgggtgccggcggcgacgcgttccacccccagcagtcatcctcgatagcgaacagacgcgagtaatcgtcgcgctctctcggcggcacattggcaccgccgtcgctgccgccgctgctccatgtgatatccgaggagcttgccggcgattgagtctcagaactgatagctccagagctgctaccgggaacgacggcgacgtctggagctgctgcggtgtcggtgcggacggtggtctcgaggatcaccggcacggccgccgactcggtcgccttgcagctgtgctccgagatgtacaccaccgtatacttcggccgtccatcgtcgctgccgtcatcgtcattgcgctgcaccgttcgtttggccgg

SEQ ID NO: 68050 - DNA, 560 bp, Triticum aestivum
  unsure (1)..(560): unsure at all n locations
  Clone ID: PAT_TA_68050
ggcttgcagnctcagtcagggggnaggaaacacagtagcagctgctccaccgcaaaattactagcatagtacacataataaacacaggagnagaaaaaaggggtctcttcatcgttgctgtcttcctccacgcccagnaggagccacacatcgagatcttgcttaggcagacttcacggtggcggcgttgatgatgtcgatgaactcaggcttcaaagaagctccatagatgatccgtgtggatgcagcaacctcagggctcacattggtcttgagccagtccctcagattggcatggacttcctgcgcctgagccggtgtcgcaactttaccggtgccaatggcccacactggttcatacgcgacaaccacgttagtccagtccttgatcttgccagtaattgcttttgtctgttcagcgacaacttccatggttgatccagcttntcgctgctcaagagtctnaccaacacatgcaatgaccttnaagccctgagcgagtgcatatgcaaccttttnttcaacaaactcacttgatttctnccatcaagctcctcctt

SEQ ID NO: 68051 - DNA, 236 bp, Triticum aestivum
  unsure (1)..(236): unsure at all n locations
  Clone ID: PAT_TA_68051
tttgtaatttgaaacataacgtaacaaactcaagnacttagnatgaacaattcgccactcagtttacaatacacaccgacaaaccgcctcaaaaaccaccaaatcaagggatgagcacatggcgccgagaaacaaactagcctagccaacaagtggatacgagacccagattattcaaagtaaacacggctatggtggtgacatcctccttgcaattaaaaggggggctctgctac

SEQ ID NO: 68052 - DNA, 314 bp, Triticum aestivum
  Clone ID: PAT_TA_68052
ttacaattgtcctgcataaatctacatcacaacaacaatacaaatacacccatccacctcctatcactcaatcaaacagcccacatagtagcccgtggactagctagcttgcccgcccaaccaagctcaacagcaggcacaatttcccctcgagcacgattcgagtcactgccagcaaactgctaaaccagaacacgcgattaaaccactacgattgggataagaaacgtcgtgatcccccgcaattgggcgcgaagctgtctgtcacgcggcccgatccacccactcggcttcgtcgccagccaagcagcaaa

SEQ ID NO: 68053 - DNA, 238 bp, Triticum aestivum
  Clone ID: PAT_TA_68053
acaatgaagttggttatcagtatcacataataaaactagtgctagtgccatgcggacgaaaccaccaggggcttattcttccatccgaggtatagcaccccgtccttctccgcaagctggtagtttgccgagtagctctgcagcagcgtcctgatgctggcgttcaccagcgagctgagcggccggggcctaaagccgaccatcgtgaggcgccccttccacttgccgaagacctcgt

SEQ ID NO: 68054 - DNA, 148 bp, Triticum aestivum
  unsure (1)..(148): unsure at all n locations
  Clone ID: PAT_TA_68054
tggggaactttaactttatatnattnatgtatgtacaatcctttcttcaaaggagatgtctcttttcttttttccttttttttgtttacacttttttctcttcgtacatgcacaaaacatgggaaggggaagaaaatttgtcttttcc

SEQ ID NO: 68055 - DNA, 137 bp, Triticum aestivum
  unsure (1)..(137): unsure at all n locations
  Clone ID: PAT_TA_68055
agagggtgcgtccctggctgcttgagngcgtagacgacgnncatggcagtgacagtcttgcggagggcgnnctcggngtangtgacggcgnnncggatgacgnnctgaaggaagatcttgagcacgccgcgggtctc

SEQ ID NO: 68056 - DNA, 386 bp, Triticum aestivum
  unsure (1)..(386): unsure at all n locations
  Clone ID: PAT_TA_68056
caaattnccttgttttcactaatttacaagtcttgtgccacgcgagaaagaaaaggagcagcttccgaggccatgaactccattgcttcattaatttccaggggagaggaatgacgcggtttggagggtgttggttcaaggacaacagaagcggagtaaaagacggaatcttcacgagatacgcaataacaatagcggcaatgaggatttggcngatagcttggtncctaggcaatgcaaaacgatgtactttgtggggttgtttattgtgctatactcgtctccccgcggagagacaatcgtcacaatctcatggaaagaggccggccatgcagcacaagtggcaagttggatagcaccactaatgtagcaagggaagaaggcac

SEQ ID NO: 68057 - DNA, 764 bp, Triticum aestivum
  unsure (1)..(764): unsure at all n locations
  Clone ID: PAT_TA_68057
ttgatctaccaaaatagcagttgcaatntgcatacaaatggaaactagccaaagtaccaaaacaagccgcacactcatggcatgaactcatactgcagaggtaaaaagaactagtactatgtgtagtctacaggtatcaaaggcatagtagtgtattcatactttcctctaactgccagcaccaaataagaattcttgcaaaattcttgaagcctctgaaacttcgtgctgagtgctgagtgatccaagcactgtagtagagccagtaggcaaactagttccctttgggtctgaacttggatgtgaactagcttcttttgatgagttcttctcatcgagcagtggagctgatctctgtttatttggactgacatttttatccccttcttcagcctgcggtccaccaaaattctgatgtttactgccatttgtatacatatgcttctcgatggttagagcatcctgatgcaacatgctagaatttgatctgtctttactggaaggacgaaactgtacaccctttggtgtactggttgatgcttttagagcatttactgagatgccggcaaggtttttaaggatggagtaatgtttggtaggagcagaagttacacgttcgccatcatggaccgttgatgctttctgactacttgtttgctctctgccaggtttttcagacaccaatgacgcatcagatttctttgcatctggtttggaaggaccatctgcagttggcaccacatgagaaaatttgcatttatcac

SEQ ID NO: 68058 - DNA, 177 bp, Triticum aestivum
  Clone ID: PAT_TA_68058
attggtttgtatgcacggtgtatttgtaatacttagtgcgagtgctgctagtcaataaagatgggattcaaaggaaaaaaataatcaatcagcagtcaccatacgtatgtgcataataattgtacatatataatctgagttgatttctttcttaaaaaatatattatcaacatggct

SEQ ID NO: 68059 - DNA, 465 bp, Triticum aestivum
  unsure (1)..(465): unsure at all n locations
  Clone ID: PAT_TA_68059
gcttgtattaaatatgaaatagtgcatagtccttgacccgtacaaacacatcctancatacgcacaaagaattagagaaacaataaccaattgaacacgaagatctccacaactcaatgtcatcatccctggatcttacgagaagacctctgcaacacaagtatatgcaaccagttgcaagcaagtcatcatcttcaatcacgacataattgtcgccacgttgctccctcttttctttgcccaggtgccgaaaagacaaggacatacatgtgcatccaacatgcctacaccagtctaatccggcgctgttagcccatgaagactattcacactaacagtgttactcgtgctaatgcatttctcggcaccatcgccacacacatacgctatctcaccatttgccaggcaatgtaccaggagttaagccagccattcggtccttgaaacccaagccgtccctcttnt

SEQ ID NO: 68060 - DNA, 185 bp, Triticum aestivum
  unsure (1)..(185): unsure at all n locations
  Clone ID: PAT_TA_68060
tcataaaggctttanttcangtaaattaaattttacaaatngatggaaaaaatcactgaggtgcangtctacgaagattctttgatacatctaagattcacagaaacacatcgctagcagactatcctggatcaagcgaatnaaccacacaacaaaaacgccctacctgttctccaaagcaaaac

SEQ ID NO: 68061 - DNA, 580 bp, Triticum aestivum
  unsure (1)..(580): unsure at all n locations
  Clone ID: PAT_TA_68061
aggcacgacagcaaaatgttctcagagnatgttatctacaaatttattcaactgagtcatcatatgaacaattcattcatgacgtgatctttctagaaaagacaacgagcatcacagcagatagcaggcgaggagtccacggaatgggccacgcccacagccgcggcggagtcgtttgagagccatccgcatggacggccttttctgtggatcaacagcggtgcaatcaacacccagcctaaacacagttgccatctccttcatgtactgcgcttgatctgggatgtcccggtccacggcactctggaacatttcctgttggtttgccattagcttagtgaagttcttccgcgcccaggtcgccaaatgaccatccgctccaaattcattggccatccgccccgtgacgagctccagcagcagcaccccaaagctgtatgtgtcgaccttctccgtcagctcgcttgctgcgaccccgtattctggagctgagtaaccaaagtttcctagaggcaggcccgcaattggcaacggttggtcgagcccggccatgttcatctgtgcagcgtcaaagctggct

SEQ ID NO: 68062 - DNA, 129 bp, Triticum aestivum
  Clone ID: PAT_TA_68062
cagaatatcaaaagtcacccttgtttccttgaatgattaacatgccgatgcatgcaaatttgtacttattgaacttgaacaatataaatggatttatgttcccatgacaacaatgtgtaggggctctgc

SEQ ID NO: 68063 - DNA, 135 bp, Triticum aestivum
  unsure (1)..(135): unsure at all n locations
  Clone ID: PAT_TA_68063
cagngganggttaaaagctagggntngttaggaaagagccattgtanctntcccccnttagnggatntaaggnntntggtnctgcnccgggtagccattaccgtagtacggngtgtggnccggnganatggtgta

SEQ ID NO: 68064 - DNA, 234 bp, Triticum aestivum
  unsure (1)..(234): unsure at all n locations
  Clone ID: PAT_TA_68064
ccataggatatctacaacctagcacgttataatattgtccatgaaatgataatatacaacatatatggacaaaatatatcacacaacaaggattatgaaccggtacaatccaatttacatcaacaaaacatataaactactaaggttgtcactcgtgttcttgtcgccgaccctccgttcttgtcgtcgaccctcctgatggcaactatatgntnggacggcaacataccacaa

SEQ ID NO: 68065 - DNA, 372 bp, Triticum aestivum
  unsure (1)..(372): unsure at all n locations
  Clone ID: PAT_TA_68065
tagcctgaaacattatggtatactgaatnccagcaaacttcgcagttacgaaggccttttacggaactgatgttgcttaacataaaaatagaatgattatcagggttcagagattcactaatcatcgatgacatgctcggtaaaattgaaactgctggcgcaactattgctattttaaaattgaaactgtatatatacttgtagggaataaacctgttcttctaaatgaggaaaggcttcgccgtagccgaaaccaattctcgccctatgatatcctcacaaggattctgattgagagtcattgntcttctttggtctaatccgagtgatctcggggtcagcagtgtgctgcttgcaccctcgagggccata

SEQ ID NO: 68066 - DNA, 340 bp, Triticum aestivum
  unsure (1)..(340): unsure at all n locations
  Clone ID: PAT_TA_68066
ttaaaacttatcaagttcaacaaacaaaataaaggggcggagggagcactcctccgtaccaccgagtaacatattctacccatgcagcaacaaccaatctctactacctggatctcaaaggcaaatttcagatgaagccagtgctgcggcaagctgtacttggttggctggcaggcacagatcattcattggccatccgagtagaacatgcttgggtacagccagagcggccgaactgatgactgcactggggtgcttccaaagcctgcaggttcaacgcntgctggtctatcctgcatgcgatctggcctgncacacannctatanataaaccanngtc

SEQ ID NO: 68067 - DNA, 605 bp, Triticum aestivum
  unsure (1)..(605): unsure at all n locations
  Clone ID: PAT_TA_68067
gctttcnaacnaggtaaggtacaaagacaacaagggtacactcccaacatcacccgccctcactttggggcattcatgatgcatcacaacagtatcccccgtctttcggggtttccccgctgacggcgggcatactgcactacaaatacataaatatgaagaagaacatacacatcaccaagattacggacagacggcaccgacacagacaggctcacatctttagaggcctacttcttccgagtaccaggtcctttctgggggaaatgcaaccaccaaccaacagcttgcgctttcatggacgaaggacggaacagatcattgtgaaaacatcttccacaacttacagggatgatatttactaaaaagaaccacagagcaaccacaaccatgttccgaagccgatcaggcgtcttctgtcttgcacaggtctagcagtgacagtgtctctgctatggagagctccaggcggaatttaggaccatcatagtggtgcagcactggcctgaaagcatcctcttccaaggccttgcaaagccttctaatgcggatcctcacctttgcacttcttatcttcccaagcagtgggatcaatgtttgatcct

SEQ ID NO: 68068 - DNA, 691 bp, Triticum aestivum
  Clone ID: PAT_TA_68068
ttaggacatgaagtgctaaacacaacgacggaaagtttaaagggtatccatgacactattgctccttgtccacatcgtcaaccactcttctacccgtgaggcgtccgccgcctgggtctccggccttgctgctccacccctaccacggacctcttgggcatcccctcatcagccaatcgcgaaggtccttatttagcaatagagacaaaagcactggattgcaaatttgattcatagcaaggaaacacttttgtggcgcaaccactatgccataaacatcttgacatatgttctccatctccatagagcacggtctcagccccaagcccgtttaagccagagacgagcacgtacattggacgcaaagagcagccgtatcatctccctcaaatacacgacgataaaaatgagatgataggttatttaatacctcggatggtgtatgtgtgaccgaagatgtgtttcgacaaccatcaaaagaaggttaccagttaccactgcctgacatatatccgagtaatgtcaagcaagccatgacagtgacacctagagcagacaagaatcagatcagtattgtgaaagaaataccatcggctctggagaagataccttcaacataaaaaatacctataaaatgatggaataagaagattacccagcaatagaaaagcaaactaactatagtcgactt

SEQ ID NO: 68069 - DNA, 502 bp, Triticum aestivum
  Clone ID: PAT_TA_68069
gattattagtgaagtacaagggagggatttatttcttgaatacaaccggcagaagaaaagaagaggatattttcaattgatattgtttgttttgaggatactcaatggtgcaccccgtctatgctaatttgcctaatcccggttcttgctcatgtctcagacttctctccaccttcccttctaagttaattaggagccgcgtggtgtgatgattcaggtcgatcaacatcattggcgaggtgagacagaaccttgactacggtgtcgatgcgcgctctcatatcgggccgttcttggatgcacagcccagcatatgccacggccttccgcaagtcgaaggacggatatcggccctgcagcgctgggtctgccatccggcagagttcgaactggcgcacgttcgccaggaatggctgggcccattggacaaggtgtcgatctcccacggcatcctggtcgtcgttgaaggccctccgccctgtgatcatctccagcagcacca

SEQ ID NO: 68070 - DNA, 536 bp, Triticum aestivum
  Clone ID: PAT_TA_68070
aaacctagatgatacacacctgtacttactgtcagtgctcacgttattactgtcgaactacacgtcaagctccaattggcttgaggggtgagatttttctcgcttttaggacggaatcaattgttcctttactccctaggaccttacacaccaataggacccatttgagttcttctttcttgctccgatgccgcattttatccttaaaatgcctgcatagaggaaccctgcaggtgcccggtgtagaacacattcgcgaatgcagctcaagaagctgccacatacgcttgcagttggagcagccacgcggaacacgcattttgcatgccgagaaatggcgcaccagcaactcgatgcccttgcaggcaggaaacttgcaaacaacctgactgcccttcagtttctgatcccaggggccaatcgtcctacaaccgtctctgcatatatgaacaagagcttccatagcttcatacagctgaagataaaccttcttttcctccatccttttagctctttcttgccttcttgtgtccact

SEQ ID NO: 68071 - DNA, 386 bp, Triticum aestivum
  unsure (1)..(386): unsure at all n locations
  Clone ID: PAT_TA_68071
cttcagttatgatagactcagatgcatccttgatgtgaacagatcataagaacaatanttgaaaacatggaaaaaaacaaatattgtatcatgtaaaaatcaactataatgagtggaatatgtcaccatagtttcttcttcatcatcaagaacactttgaaatgccgcaaagagaggggagttgctatccctttatgcaacatttangtgatgaaggaacactcagtaaaaaaattcccaacgataacccaggaatcgccttgtgctccatcatgagaagccattgcccctgatggttggttgttnggtgtggttgtcacctccatgacgcggtcctactcctcgtcgccctntacgngngcctcgctccacctcggtgacgccgc

SEQ ID NO: 68072 - DNA, 595 bp, Triticum aestivum
  unsure (1)..(595): unsure at all n locations
  Clone ID: PAT_TA_68072
ttagtttctttcnagtacgtttaacctatcatcaagggatataatagtgcttccaacatacactaaattaatttaactgacactaaattaatatggaaactaagaagaggactgcgacttgaagcacgactgataacagagggaaaaacaatagtaccaaattgattcagtgcagagggcggtccgatctcatctccttagctaactaccatgcactttctccttccctcgatccgctggttgtgctcggtgcacctcctgttccttgtttttatctcctgaacgggatgcagctactactgcttcttattcctcctctgcagccattgtgtgggctccagattcaaccaagtgctgggacagtatatccctcgccctgacaccctcctcctcctcatctgctacatgccacacttgcttgatgcgattatactcctcatcgctcggcatgcctacaccgtcctcctccatgtctatcactatgttatgcaacaggcagcatgtgtcaactgtccagtacgcctcaagttgattatttggacgccacccttctccatttangcacttccatgtgtctttcaaccttgctagtgcc

SEQ ID NO: 68073 - DNA, 740 bp, Triticum aestivum
  Clone ID: PAT_TA_68073
tatgcgctacccttaatatctgttgtctgcacagtaatacgaacagtagtagtacaataccacaatgttctgaaacgagagggttctcttattctaatgcatacaggtacagcgcaataaaggcatatattgaaggggcatatatctgaatatacatgctctctatatcacttggacgacgacgtagctttgaaccactcatgtggaatagctctgagttgcaggtcatgccttctgctaaccgtgataccaaatttctcagacatgtcaaaggaagacagactagccccatcaggaagcatccagtcaaagtgatacagaaggtttgccaatgtgatattgagcgatgacgtgccgaatagtatcccaggacactgccgtcgcccagctccgaagggggtgtattcagagtatgtcccattgtaatcaatgttgttgtcctcaaatctttcaggcttaaactcttcaggatttttccagtaccttggatctcgggaaattgcatagacgttaacgtatacatttgtgcccttaagcatgtcacaatccataattttacagtcctctgtggccgagcgagggagtagaggagcgggtggatgcaacctaagaacctccttaatgaccatccgcatgtagtggagttcaccaaggtcactattaccaatggtagctcgatcttgacctagtacctctctgacctcttgttgtgccttacccatgatttcaggatgacggac

SEQ ID NO: 68074 - DNA, 548 bp, Triticum aestivum
  unsure (1)..(548): unsure at all n locations
  Clone ID: PAT_TA_68074
gnaattcggcacgagggccaacgacgcttcttggtccgcgagggaggccgtcgtggccgacgggcagtgggacacggatcgccgcatgctctgcctcagggcgtgccgggtggagctcccggtgctgccgtctgctccggcggtgccagagcatggatgcgggatcgggatgagcttctggttcccggccgtgtggacgatgcgggagcggagcgtcgttgccgggatgctctggaactcgacccaagccggcgctggactgataacagcgtcgagcatggacggccaaagaagctccaccaacctctccgacgtgaagtacagctacaacgacacgctgctcaacgacgccatgaagcattacctcaagatcagcaaggagaagaagatcacccgtgggttcgcacttgttcccggattttaacacaactcaccgtgactttgagttcggtttctacgggccggtcatcgggagcggacacgcggaccctgtcacaatcggctcggcgatggtcgccggcaatatgctggccgccgacgatgccttc

SEQ ID NO: 68075 - DNA, 933 bp, Triticum aestivum
  unsure (1)..(933): unsure at all n locations
  Clone ID: PAT_TA_68075
ttcggcacgagggaatccccagccaatctcgtctccgatcgaccccaggctcgtcgaatcctcctcccccgccgcctcaagatgcagatctttgtgaagaccctcaccggcaagaccatcaccctcgaggttgagagctccgacaccatcgacaacgtcaaggccaagatccaggacaaggagggcattcccccggaccagcagcgccttatctttgctggcaagcagctggaggatggccgcacccttgctgactacaacatccagaaggagtccaccctccaccttgtcctgcggctgcgtggtggcatgcagatcttcgtcaagaccctcactggcaagaccatcacccttgaggttgagagctccgacaccattgacaacgtcaaggccaagatccaggacaaggagggcattcctccggaccagcagcgcctcatctttgctggcaagcagctggaggatggtcgcaccctcgctgactacaacatccagaaggagtccaccctccaccttgtcctgccgtctgcgtggtggcatgcagatcttcgtgaagaccctcaccggcaagaccgtcacacttgaggtggaggtcgtctgacaccattgacaatgtcaaggccaagnatccaggacaaggagggcatttccccggaccagcagcgnccttattttttgctggcaagcagctggaggatgggccggacccttgctgactacaacattcanaaggagtccacccttcaccttgtcttnngccnttcggggnggcatgcanattttcntnaagacccccancggnnagaccatcacgcctgagggggagncttttgaaccatnngcaangnnaaggccaanatccaggaaaggggggatttccccggacancaangccttatttttncaggcancagntggngganggccgaccct

SEQ ID NO: 68076 - DNA, 468 bp, Triticum aestivum
  Clone ID: PAT_TA_68076
ttcggcacgaggaagctttgggctgcagaagggtttgctagaagtagcgatgaaggcaaggatttggaagatgtttgccagggatactttgatgtactagtgtcagcctcatttctgcaacctgaagtagggaagtactccaataaaatggacgcttatatagttcatgatctgttgcttgatttagcggataaggtcgctggaagtgattgtttcagaatcgagaatcagtggaaaaggtcaggagataactggacaatggaaggatgtgaagatgaagttcccccagacgtccgccatgtttttgttcagacctatggttcagaattgatcattgagaaaatatgtaaattggataacctgcgcactctcatcattgacagtgcagaatggaaaaaaccagttgaggagaaagtcctcaagagtctgtttgcgaagctaaggaagttgcgggtgcttatcatagct

SEQ ID NO: 68077 - DNA, 570 bp, Triticum aestivum
  Clone ID: PAT_TA_68077
ggcgaaacaccacacctctcctcgtcgaagcagcagcagcagccgcggcatccatggcccccaaggcggagaagaagccggtggcggagaaggccgagaagacgacggcggcgaagaagaccaaggccgagaagcggccgccggcgtccaaggagggcggcgagaagaaggggaagaagaagtcgaagaagagcgtggagacgtacaagatctacatcttcaaggtgctgaagcaggtgcaccccgacatcggcatctcctccaaggccatgtccatcatgaactccttcatcaacgacatcttcgagaagctcgccggcgagtccgccaagctcgcccgctacaacaagaagcccaccatcacctcccgggagatccagacctccgtccgcctcgtcctccccggcgagctcgccaagcacgccgtctccgagggcaccaaggccgtcaccaagttcacctccgcttagatagtctgttcctgtcttctttgtcgatcgatggtactctgtaatagtcaggtgttcggaccatgtcgtcttgtaactgtttcattatcttgtgaaatag

SEQ ID NO: 68078 - DNA, 444 bp, Triticum aestivum
  Clone ID: PAT_TA_68078
accgtcaccaagtacgtgtacgcgtcctgcgggttcctgcccctcgtgacaactgagctgggggcgtccgggggactgtcggcggccgtggtgccggtgccgccagtggccgcggcgttcttcgtgctgcccaagccagagctgcgagatgggccaatgtggagggagtgcaattggatggggttcgtggccgtggctacggacgaaggagcagcggcgctagggaggcgcgacatcgtggtagcatggcgcggcaccgtgcagaaactggagtttctgagtgacggaatattttcgttgggctgcgctaagcccgtgctgcaacccattcctggccccttggcggccgcctacaataacgccaaggtgcatgatggttttctgaccgtgtacttgaccggggacgaatactcccagcactacaggacctgcgccagagatcag

SEQ ID NO: 68079 - DNA, 580 bp, Triticum aestivum
  unsure (1)..(580): unsure at all n locations
  Clone ID: PAT_TA_68079
gactcgatgaaatcctacagnagtcccgcttccaaaaaatgtatcatgtgtgcatgtgtgcaaatgcccccctatttacgggcatcgagcaactacaacaattttcgcatctacaacagctacttggtctgacagctactgattctgttgaacttggtcacattgtggagcctcctgccattagaactgcgacttctattcttcctcttggatggactggccttcctggtggcaaaagtgctgaaccgctgaaagtagatataattggacacggtctgcatatgtgcacgcttttccaggctcagataaatggaagctggtattcaacggccattgaaaccctaccatcaacgacatcatattcattggatcaggaggtgcaacctacattgcaaaaaatgcggattttagttggacgtccactaaagcagcctccaaattacactagtgaggactttatggttcctgtggtcacaggtgctatgaatccagattatggagttgagccctttgaagataaaggttgttgcaagggtttgaatgaagttattatatatggtacaagtgattttgtaacaat

SEQ ID NO: 68080 - DNA, 642 bp, Triticum aestivum
  unsure (1)..(642): unsure at all n locations
  Clone ID: PAT_TA_68080
attcggcacgaggacatctgcacaactcttcaagncaccaagttcgcaaaagaaatggagaaccacatgcttacttgcaatgtgcaaggaattgcagttgctcactacggagcaattatttgggaaagaaattctgtgcttccatgttagacagtgtgaagagctactatttcctccgttcaaactgaaattcgcccacgacttcaagattctgaagcaattaggtcaagggtctgagggggaagtctccaaatgctcatcgaactttagtgacttcaaatgtgcggtaaaagaagttgtgccctcaaattttctgattgatgcaagtacaactaaaaagcattctgagcccagcgaggttacactgatggtaaaactgaaccacggtaatattgtgaagatgttcctgtcttggaacgaaactgggagtaacttcatgggccttccatcagatgcaacattcatatgcatgatgttgtctgcgaggacacctgtcgtactatcttgatcaaagatcaataattgagttggacacagtcaacaatttatttctgcaaatcaaagatcaataattgagttggacacagtcaacaatttatttctgcaaatcatgatgggcctggagcacatccacaagcagaa

SEQ ID NO: 68081 - DNA, 210 bp, Triticum aestivum
  unsure (1)..(210): unsure at all n locations
  Clone ID: PAT_TA_68081
attcggcacgaggccccattcctcccccgctcctcctcccccttccccaattttttcccttcgtcagggttcgttcgctcgttcgcagcgccgcccgattgattgattgattgattgtggtcgcagcagctcctcgatctcttcctcgccatgcctccgttccacgattgccgcgatggcggtctgctngtcctggacccggnagcggct

SEQ ID NO: 68082 - DNA, 528 bp, Triticum aestivum
  Clone ID: PAT_TA_68082
ggaagcctcaaggtcgcaaatagtttgtgttaaattcattgcacgaaagagatggtttgtggctgggtcaagtgatggttttgtccatgtgtacaaatatgagaataaaatggaaaacatcatgagttttgaagctcacagtcttggtgtttgttcactagccgttcatccaacaaagccctatgtgctgtcaggatctcgcgcacaaataaagctttgggactgggaccagcactggagcttgaagtgcatacaaacatctgaagaacactggggctatgtttgtggagtcgcatttaacccagaagacaccaacagttttgctagtttcactgatggttcggaggatcacgcaatacaggtctttctccctctgtctgtctctacgatgaagtacgttctattttctaagatgtctagtgttcaggtttggagtattgattctcccgaatgcaagtttactctttctgggcattcgcgtaatgtgaggtgcctggatttcttcacacgggatggtcggaagtgttt

SEQ ID NO: 68083 - DNA, 562 bp, Triticum aestivum
  Clone ID: PAT_TA_68083
gaggaattcggacgagggtcgatcttaggcgaaataatggcttctgtacaggcggcgaggagcgccgagaaggagaaggcacacgccgtgtgcctgcctgcgccggcgcaggggcacatcaacccaatcctggacgtggccaagctgctgcacggccgcggcttccatgtcaccttcattaacacggagtacaaccacgcgcgcctcctccggtcacggggcgcgtcggcggtggctggcgtcccgggcttccggttcgccaccatcccggacggcctgccaccgtcggaggacatggacgtcacgcaggacggcgattctgtgtgcagatccatcgaggagacttgcctggggcccttccggcgagttctcgccgagctcaacgatccggctagtggcgtcccaccggtgacctgcatcatctccgactcggtcatgagtttctccatcgaagcggccagggagcttggcgtcccctacgtccatttctgggaagccagtgccgcgagctacctcggcttgcgccactaccgcctcctcgtcgaccgtggtctcgtcccac

SEQ ID NO: 68084 - DNA, 533 bp, Triticum aestivum
  Clone ID: PAT_TA_68084
ccaccaccagcacccatggcacccaaggcagcggagaagaagccggtggccacggccgagaagaccaccgcggggaagaagcccaaggcggagaagcgggcgccggcgaccaaggaggccggcggcgaggggaagacgaggggcaggaagaagggcagcaaggccaagaagggcgtggagacgtacaagatctacatcttcaaggtgctcaaacaggtgcacccggacatcggcatctcctccaaggccatgtccatcatgaactccttcatcaacgacatcttcgagaagctcgccggcgagtccgccaagctggcccgctacaacaagaagcccaccatcacgtcccgggagatccagacctccgtccgcctcgtcctccccggcgagctcgccaagcacgccgtctccgagggcaccaaggccgtcaccaagttcacctcatcctaggctggcttcgttgttgtttcatgagttgatggcggcaggcgtcgtgtacgtagtcggcagtagtacgatgttacaatctctgt

SEQ ID NO: 68085 - DNA, 676 bp, Triticum aestivum
  unsure (1)..(676): unsure at all n locations
  Clone ID: PAT_TA_68085
aggaattcggcacgaggcacaaacgatccttggactgctngtgctgttcttcattccgctcctgcaagaatgcagactagaggagggtttgatgttcaaaagcatgggccagagctggacatagagagcaagcacgcaaactggatgaaagcatctccatggctaattggtgcaaatcctcgagatttgattatgcctgtcgatggtgatgatggtttttatcctactgggaatgatctgaaacctgaagtcgtaagttccaatcgcaagtatcgtgcccatgtgttggtctgtgctccatccaactcagcacttgatgagattgtattgcgtgttcttcaaacaggaatacgtgatgaaaataacaacacttacaatcccaagattgtgcgtattggattaaaggcacatcattctgtcaaagcagtttccatggattaccttatacaacaaaaacaatctggggtggcatcagatggcgggagacgaggagctggtgaacaggatcgaattagagcttcacttcttgacgaagcagctattgtgttttctaccctcagtttcagtggatcggccattttcaccaggatgactcgtgcttttgatgttgttataattgatgaagccgcgcaagctgtagaaccagcgactcttgtgcccctggttcatggatgca

SEQ ID NO: 68086 - DNA, 900 bp, Triticum aestivum
  unsure (1)..(900): unsure at all n locations
  Clone ID: PAT_TA_68086
aggaattcggcacgaggctccgatctaagcgaagccaggctctctcgtcctcctcctcaagatgcagatctttgtgaagaccctgaccggcaagaccatcaccctggaggttgagtcctcggacaccatcgacaacgtcaaggctaagatccaggacaaggagggcatccctccggatcagcagcgtctcatcttcgctggcaagcagctcgaggatggccgcacgctggctgactacaacatccagaaggagtccacactccaccttgtgctcaggctccgtggtggcatgcagatcttcgtcaagaccctgactggcaagaccatcaccctcgaggttgagtcctcggacaccatcgacaacgtcaaggctaagatccaggacaaggagggcattcccccggaccagcagcgtctcatctttgctggcaagcagctcgaggatggccgcacgctcgctgactacaacatccagaaggagtccaccctccacctggttctcaggcttcgtggtggcatgcagatcttcgtcaagaccctgaccggcaagaccatcaccctggaggtcgagtcgtctgacaccattgacaatgtgaaggccaagatccaggacaaggagggcattcccccggaccagcagcgtctcatctttgctggcaagcagcttgaggatggccgcacccttgcggattacaacatccagaaggagtccaccctccaccttgtnctccgccttcgtggaggcatgcaaatctttgtcaagaccctcactggcaagactatcacctttggaggtggagtcatctgacaccatcggacaacgtgaaggcccagnaatccaggacanggagggcattccccccggaccagcagcgcctcatntttggctggtaagcagct

SEQ ID NO: 68087 - DNA, 130 bp, Triticum aestivum
  unsure (1)..(130): unsure at all n locations
  Clone ID: PAT_TA_68087
aacctggtcagagaaaaagaaaggaaggatcctgagataatntgtgcaacactgaggcaggntttgcacacaagtacccattttgcagaccagtactctctctgaagaccgtatattatgaacaacacca

SEQ ID NO: 68088 - DNA, 588 bp, Triticum aestivum
  Clone ID: PAT_TA_68088
ggcacattcccccctccctcggagcagcgatggcgcccaaggcggagaagaagccggcggggaagaagcccgcggaggaggagcccgcgacggagaaggccgagaaggcccccgccgggaagaagcccaaggccgagaagcggctgccggcgggcaagaccgcctccaaggagggcggcggcgagaagaggggccggaagaagggcaagaagagcgtggagacctacaagatctacatcttcaaggtgctcaagcaggtgcaccccgacatcggcatctcctccaaggccatgtccatcatgaactccttcatcaacgacatcttcgagaagctcgccggggaggccgccaagctcgcccgctacaacaagaagcccaccatcacctcccgggagatccagacctccgtccgcctcgtcctccccggggagctcgccaagcacgccgtctccgagggcaccaaggccgtcaccaagttcacctcctcttagattcagtctctggcagctgtagttgggtgctgtttacctagaattagcattgctcaatggaaattggtggagtattgtttagttcgtagttggtttg

SEQ ID NO: 68089 - DNA, 399 bp, Triticum aestivum
  Clone ID: PAT_TA_68089
gtcggcactcatggtgatgtgcagtacaacgtaggagaccgcgccgtcgtggagtcgggcagcgatggggcaccaagtaaaaacttaagatttctaaatcgagccgccatgatcacaagtgcaagcgacaattccgggggtgcatcaggtcctagcgtctggcggttgtgcacggtgcagcaggtcgaggacctcaagtccctcctcggtgtcttcccgctgtggtcgtctggcataatggtgagtgtgtcgatcggcgtgatgcttggcatgatcatcctgcaggctctcgccatggaccgctcgctcggaccacacttcaacatcccggccggggctatctctgtctgctccctcgtcgcattcatcgtggcaaccccggtcctggaccgcgcagtc

SEQ ID NO: 68090 - DNA, 616 bp, Triticum aestivum
  Clone ID: PAT_TA_68090
tccaccaaccttctccatggcgctctccgtggagaagacctcgtcgggccgggagtacaaggtcaaggacctctcccaggccgacttcggccgcctcgagctcgagctcgccgaggtcgagatgcccggcctcatggcctgccgcaccgagttcggcccctcgcagcccttcaagggcgcccggatctccggctccctccacatgaccatccagaccgccgtcctcatcgagaccctcaccgccctcggcgccgaggtccgctggtgctcctgcaacatcttctccaccgacaaccccgagttcaagatcgtcctcaccatcatccgcgacgggctcaagaccgacgccagcaagtaccgcaagatgaaggagaggctcgtcggtgtctccgaggagaccaccaccggcgtcaagaggctctaccagatgcaggagtccggcaccctcctcttccccgccatcaacgtcaacgactccgtcaccaagagcaagtttgacaacctttacggttgccgtcactcgctccctgatggtcttatgagggccactgatgttatgatcgccggcaaggtcgccgtggtctgcggttacggtgatgttggcaagggctgtgcc

SEQ ID NO: 68091 - DNA, 691 bp, Triticum aestivum
  Clone ID: PAT_TA_68091
attggtaatcacgatttgtcctacccacagatgtaaactcctagcattgcaaaatatgaacagacatataacagagaatgaattactgcaagtagagagatttctgactctctttttctctcagctgaacagaacattactgcatcgacatcattatccaaacaggacactactactatcaggaatcactagacagtaaccgactaagccttcttgggggaagaggtggccttcttgggcgacttgggctccttctccgccgtcttcttggggagcagcacggggttgatgttgggaagcacgccgccgtgcgcgatggtgacgccggcgagcagcttgccgagctcctggtcgttccggatggcgagcagcaggtggcgcgggatgatgcgggacttcttgttgtccttggcggcgttcccggccagttcaagaagctcggcggcgaggtactcgaggacggaggcgaggtagacgggggcgcccatgccgacccgctgcgcgtagcggcccttcttgaggaagcgtccgatgcggccgacggggaactgcagcccggccttgacggaccgcgccaccgccttcttcctggggccgccgccgagcttgcgccccaccacgtacttcttcgccttggagatggcgccggcggcggaggcgtccattgcggctagtgggttggaggtgcgga

SEQ ID NO: 68092 - DNA, 167 bp, Triticum aestivum
  unsure (1)..(167): unsure at all n locations
  Clone ID: PAT_TA_68092
gagagtaacgtcccatccatctccaatggaaggaaaccagggacgcaaaagtagccanggtggcaanagcaatcaaagatcaaggtacctgctaatcatgaaaaaggcaattctaccacagacagagaccatgngaagtntgtgaccnatgattgagttctaaaggc

SEQ ID NO: 68093 - DNA, 337 bp, Triticum aestivum
  unsure (1)..(337): unsure at all n locations
  Clone ID: PAT_TA_68093
gcttgcaaaaacgtcttacattatggaataggggagtattttactaatgctgggatgttcgaaaaagttcagaaaaaaactacaattgcaatattcangcctaattgtatcccttgcatacatggcaattgcgctaaagtaaaaccgaaaagtgcatgccacatggtgagggaagtcatcttaaagatatggtgcacngccatcttctcttgttccgtaaaattcttcagtggccttctagtatagtatcaatatacatgagggttgctttggtctagatcattacatctaagaggcggccngcaggggctacagaagcagcacacaccaacagnaa

SEQ ID NO: 68094 - DNA, 316 bp, Triticum aestivum
  unsure (1)..(316): unsure at all n locations
  Clone ID: PAT_TA_68094
attccgactactaacggcgtcggcggagggggcagcttaggccctctcgccacggatgcggcgggcgagctggatgtccttgggcatgatggtgacgcgcttggcgtggatggcgcacaggttggtgtcctcgaacagccccaccaggtacgcctcggccgcctcctggagggccagcacggngtggctctggaacctgaggtccgtcttgaagtcctgcgcgatctcgcggaccaagcgctggaaaggcanctngcggatnantanctccgtgctcttctggtacttgcggatctnccggagcgccacggtcccg

SEQ ID NO: 68095 - DNA, 270 bp, Triticum aestivum
  unsure (1)..(270): unsure at all n locations
  Clone ID: PAT_TA_68095
aaccctcacaaaaccgagtcgnannncaanncangngnttttaaccctcactaaagngagacgncngacaantcaagggaaaataaccctcactaaagngagccggatgacaattcaagggaaataaaccctcactaaagcgagccgnctnacaattcangggaaanaaaccctcacnaaagtgagccgttttnnanttcaggngaannaaacccncncnaangggagncgtatnacanttcangggaaanaaacccccacnanancgag

SEQ ID NO: 68096 - DNA, 569 bp, Triticum aestivum
  Clone ID: PAT_TA_68096
cagcaccattgttacaacatgacactgtcgaaaacacacagctacctacagagttcctcagacgaggaagaagaaagaaacacaagactcaacgcacgaggagcctaggacgaggtgaacttggtgacggccttggtgccctcggagacggcatgcttggcgagctcgccggggaggacgaggcggacggaggtctggatctcgcgggacgtgatggtgggcttcttgttgtacctcgcgagcttggcggactcgccggcgagcttctcgaagatgtcgttgatgaaggagttcatgatggacatggccttggaggagatgccgatgtcggggtgcacctgcttgagcaccttgaagatgtagatcttgtacgtctccacgctcttcttggccttcttcttccccttcttgtcgccgccctccttggacgccggcaccttcttctccgccttgggcttcttgcccgcgggggtcttctccaccggcttcttctcggcggccttgggtgccatggatgctgcggcggctgctgcttcgagggcgagagaaaagtttggctgggatggagc

SEQ ID NO: 68097 - DNA, 129 bp, Triticum aestivum
  unsure (1)..(129): unsure at all n locations
  Clone ID: PAT_TA_68097
ctcaacaccagtgacntgtggcattgcgggtctccctgatgccgacgaggtcgactgggtccccaaccttgacggtgccacgctcgatacggccagtggcaactgtaccacgaccagtgatggagaaaa

SEQ ID NO: 68098 - DNA, 276 bp, Triticum aestivum
  unsure (1)..(276): unsure at all n locations
  Clone ID: PAT_TA_68098
gaactttagggatgtncatctcaaaaaaaagaactttcagagatgtgacttgctgagataacaaccaggtaccttgaagattctcaccagaacacccaagcaaaaaagaagagtatttgataggattgtgctttcatacacaacaatcaggtatgtggttaagctcaaagtnagctatactggcagctaanaatgatgcaaactccttagtttctgatcaagcagtacgcctttccactcctctatccctttcaaaagaaaagagaaagataaggg

SEQ ID NO: 68099 - DNA, 121 bp, Triticum aestivum
  unsure (1)..(121): unsure at all n locations
  Clone ID: PAT_TA_68099
tnaccctcactaancnagncgtattacaattcaagngaaattaaccctncactaaagngagnngtatnacaattcaagngaaantaaccctcactaaagtgagtcggattacaattcaagt

SEQ ID NO: 68100 - DNA, 289 bp, Triticum aestivum
  unsure (1)..(289): unsure at all n locations
  Clone ID: PAT_TA_68100
tcnaattccaggtaacacaggcccatagcaaatagttcaacagncatgcctgggggttcagccncagaacganggtagcaaaattngacggngcaaacagatcctntnanggtangcntagggcaggttccacagaacatancagcncataagcttaacggtagcggcggaggganacggnctggttccttttccagggggntntcnttgagggcctgttnttgnggnggnggnnaccnttgccacncaaaccacggaatttttttcccgcaaaggngaaaccacccag

SEQ ID NO: 68101 - DNA, 687 bp, Triticum aestivum
  Clone ID: PAT_TA_68101
cacaatgtcttttatttcctcttttgcacagacacagtacgacagacgaagtgacgaacccggcaacaccggctcacaacacccaccaacattgttcatcggtattacacacgatattcatttcactgttacacttttttattcatggctacacccccacagaacagattcagttcatgctgcaccctccttgggtccaccgaaccaaccgaggcgggtgagcgactggttctctcctccttttccatctacatgctcggcttaatcttgagccgcgatgccagcttctgcccgagggacgtgtcacactgtgaccagtatgagacccagatgccctggatttcatgggttacgcgagcatccgtgagcgcatcaacccaccgctgtaggaaacggtcttgcctggcagggtcgaaggatcggtatctctcgccagcctgcttgaaattgttctccttctcgataatgcacttctcccggcagccagatagaacgcgaggagggatagggtactgttcagcatgacgagtaggatcaaaccttgaagggaagtagttcacctcctcatccctgtgcatgaaattcattaagccatcatgatggttgttgtggtgagcacatttcggggcgttcacaggaagcatcaagtagtttgggacagtgattgctgggcagaaagcaagctgt

SEQ ID NO: 68102 - DNA, 641 bp, Triticum aestivum
  Clone ID: PAT_TA_68102
ttttgtgtgaagtccgtcttgtgtttagttcgtgtgaaggtaagaaatcgcgactcgcacatgatcacgacggaaagagcgttttcaggtgctgggtggagtttgccaaccaggcacagtaaagccaggcggccgcagcgacagcagccgccgagagcacggcgacagcaccaaaacgcgagacgtccttggcggccaccgccaccgccatcatcccgagctccgcgaggctggcgatggcgatctccgtggcgccgatcagcttcgccttcccgatggggcttccggtctgcaccacctgcagcccgatcacgctgtacgccatgtgccccagcctcgacaccacgatcaggccgaggaaggtgaagagggcgccgcgccgtgagatggatccggtgaggtagaccaggacggccgcaccgaggagcgcgctctggccgagcaacccggccgctccggcattgaggatgccgagctccttgacaaggttcggcgtcatgaacgtcgcgaggatccccatcagcgccgacgagccggcgaacacgccgagtaccaacgggctcacgccgtgatggatcaggaacgtggtcatcagagcgccgggggcgagggcgacgttgaagcagacgagcacgtaggcg

SEQ ID NO: 68103 - DNA, 611 bp, Triticum aestivum
  unsure (1)..(611): unsure at all n locations
  Clone ID: PAT_TA_68103
gaaaggaagtcccgttnatgaagagatgcctacggagcaagaaacaacaacaggttcaggttcaaacgcaacaacagatattctccaccagaagacggaagtaccagaccagaatcccccggcaccgcaccgcaccgggttatgactaggacactacactttgtttggccgctgctctattccagactagctcacaccacatatgatttcacccatcctttatgcttagggcatntncaacaccgacacctaaactggacaccgtatttgtccacgaacagagggagcagtctgtgaaaacgaacgcaggagccggtcatccaacacaatccgtctaatttgcatacaacaaagtattaagagcacatctaataacacataagttcgtcaactacatatgaaaaacatgacccatttgttagtcaactacagcttgaattggcttctttttcagattagcctgcacgaaatagactcatcaatctgttaaaaaaggactcattgaggttgtacattttatgtcaaatgtcaattgcaaaaagtacgattgcaagaactaggaccattgatatgtgatatagtaagaacctattcggcatcttagtttctca

SEQ ID NO: 68104 - DNA, 144 bp, Triticum aestivum
  unsure (1)..(144): unsure at all n locations
  Clone ID: PAT_TA_68104
atatgaaaggtgngaggtgncngagcgactaacagagcanactgcacatcactcagcaggcttcngcgactcaaantggnaaggatcaanctatgaaangacagtangaaactnagcactgactaccatacancaagaccagtg

SEQ ID NO: 68105 - DNA, 582 bp, Triticum aestivum
  Clone ID: PAT_TA_68105
tgtactgaacattgaggcaggcaccgttactatttctcgagatccagaaacatagcgatgcgattcttacacgataacacggccacaaacacacccaaacagctaactacgagactcaggaggaggtgaacttggtgacagccttggtgccctcggagacggcgtgcttggcgagctcgccggggaggacgaggcggacggaggtctggatctcccgggacgtgatggtgggcttcttgttgtacctcgccagcttagcggcctcgccggcgagcttctcgaagatgtcgttgatgaaggagttcatgatggacatggccttggaggagatgccgatgtcggggtgcacctgcttcagcaccttgaagatgtagatcttgtacgtctccacgctcttcttggccttcttcttcgccttgccgccctccttggccgccgccgacgacttgcccgccggcagccgcttctcggccttgggcttcttcccggccggggtcttctcggccttctccgccgcgggctcctcctccactggcttcttcgccgccggcttcttctcggccttgggcgccatggatgctc

SEQ ID NO: 68106 - DNA, 332 bp, Triticum aestivum
  unsure (1)..(332): unsure at all n locations
  Clone ID: PAT_TA_68106
tctcgaaaggatatgcgaaaggtagatcggtcgatnatctnggtcaaaaaaatgacagatttttttgcgggaagatcgcaacttttgtacattacccccactaccaaaatccacattgtaggagagctgatctctccgcctcattccagcaagccaaggaaccattcctgcttccccgtcgcagcaacgtttgnnnnnggaagccgataagaccaccggtgaatggtcgacatctcaccggtgctagtctctccggcgtggcgcgatcgtcgtcttcccggcacgcctgttgtggatagggtcaggccccttgggaatcctcctcttgctgc

SEQ ID NO: 68107 - DNA, 380 bp, Triticum aestivum
  Clone ID: PAT_TA_68107
cagcgagatactgcgatacaacgaggaccacgaaccctacacatgggctagctcctaatctggtggtggtggcggcctagcctccgaatccgtagagggtgcgtccctggcgcttgagggcgtagacgacgtccatggcggtgacggtcttgcggcgggcgtgctcggtgtaggtgacggcgtcgcggatgacgttctcgaggaagatcttgagcacgccgcgggtctcctcgtagatgagccccgagatgcgcttcacgccgccccgacgcgccagcctccggatcgccggcttggtgatgccctggatgttgtcgcggaggaccttccggtggcgcttggcgccgcccttgccgagccccttgcctcccttgccacgg

SEQ ID NO: 68108 - DNA, 254 bp, Triticum aestivum
  unsure (1)..(254): unsure at all n locations
  Clone ID: PAT_TA_68108
tgttatgggcacacatagcaagctggaaaggccacaacacaaaatncaaatccccgcaaaacacacacacacacacacacacacaatccaaacgaaggcccgtgctttgccaacaacaacggcacatcactccttattgtggctcaatgtaaacttgaggagtaagttatcagatgtagcactcgtagagcttgatgtccatctgcagccggaagtacactgttccctcgtaggcgtcaaggcggagggtggcg

SEQ ID NO: 68109 - DNA, 374 bp, Triticum aestivum
  Clone ID: PAT_TA_68109
gatggatctcgatgttgtgaggcggctcatggaacttggtattgaagatcaaaagggagggagaggggagagagagagatctagctagtgctatggaccctaaggtcctaaggaactactcgatatgatcatggaggcagcaaggttgatgaagaagcctccggtaatggattccccatctggcagagtatgaaaatcggcctccagattggatatcctcggaatagaagcatgcggcgccggaaaattttgagtaaatttttttggagggtttcagtatttataggatttagaccttagaatggacataaggcggtgcttatggggcccactcggcctggcggtgcggacaaggccctggccgcgccaggtgg

SEQ ID NO: 68110 - DNA, 405 bp, Triticum aestivum
  unsure (1)..(405): unsure at all n locations
  Clone ID: PAT_TA_68110
tacaacaggncacctgnaaggcgagcaacattnagcacaactcttgaagaagaaattaaaacgaagaacaatgacggngatgaaacaacgacgaccgacaacagcgtatgtattgtcggtatgcaaggtggagcccttccgtcaattcctttaagtttcagccttgcgaccatactccccccggaacccaaagactttgatttctcataaggtgccggcggagtcctataagcaacatccgccgatccctggtcggcatcgtttatggttgagactaggacggtatctgatcgtcttcgagcccccaactttcgttcttgattaatgaaaacatccttggcaaatgctttcgcagttgttcgtctttnataaatccaagaatttcacctctgactatgaaatacg

SEQ ID NO: 68111 - DNA, 129 bp, Triticum aestivum
  unsure (1)..(129): unsure at all n locations
  Clone ID: PAT_TA_68111
attaaacgacagacagatcattgctcgctcgggataagagtctgaagcaacaaaagcaangaccgngaacaaaaacattctgctagatagcacgcctatttnttcttgatggcagccnnggtaaccnng

SEQ ID NO: 68112 - DNA, 408 bp, Triticum aestivum
  unsure (1)..(408): unsure at all n locations
  Clone ID: PAT_TA_68112
cactgctccttaggaatagagatgatctcaacacacgaaccatgttacaaagggccagttcttttgggcggcttaaaaaataagctgcctctccccagcttaaaaaaataagccgctcccaaaattcatggaggcttctagattagtaattccataactagttcagaagccccaataaataagggagggggcttatgacaaaagctagggaggaggcggcttattttttaagccgccaaaagaactagccgagtatcaaaccagtcatcttcatccaaaattacactccttttgcaagccccgtggctgaatcaatcnangtgtggctctcgtcggtaagaacttttgggccagccccaggcctgctgcagatgaagtagctaacgtcgcccttgaatttttggtttg

SEQ ID NO: 68113 - DNA, 674 bp, Triticum aestivum
  unsure (1)..(674): unsure at all n locations
  Clone ID: PAT_TA_68113
ttacagtccacacataccagagttcacatattagataaccacaaatccaattgtaaaccttgaagcttcagcgccacaagcttcagtgtatctcgggtcttgctgttgtcatctatctatataaattcagcacagatttgtaaattaataaagccatgagcactgataatattgacatcatttgcagtgtcaaaacataataaaaaatatacacaaattagcaaactcttgggaacagatcgcacagatccatgataatcacaaaaattactagcccaatagctcacgtagatgcatgctaatcacacatatccataggagggaaggaggttcaggacagagcatgtgcatggcggctgtgggcatgagtgtgcgtgtggggcagtggtgctcgcagctctacacaggagcgaggggagcagctccaatggccacggcggccatggtcgggagctcggctccgaccgccggcttacatccgcaccggatgagcagcagcgcaaggggcagagagagatgagaggggtccgaggaggatggggagagatggaagagggatgggaggagggagagttcaacctctgcgcggtgaggatgcgcgccggcgatgtgctcgcgaggcggcgagatctgtttgcaggaaagatgagaggagtgaggagcctngtgccgaa

SEQ ID NO: 68114 - DNA, 154 bp, Triticum aestivum
  unsure (1)..(154): unsure at all n locations
  Clone ID: PAT_TA_68114
ttacatgaacagcatcgctttatctaaacaaaatagtacaacaataaacccatgaaaaatatcagtttgtatgtagcaccacacgaatatagagttgaggctgcaccaattggttgcggtccctgtagtgcgttattttgncgcccggacgtgt

SEQ ID NO: 68115 - DNA, 341 bp, Triticum aestivum
  unsure (1)..(341): unsure at all n locations
  Clone ID: PAT_TA_68115
gcacgggnaagtacagtaaatttaattttgcaaattggtatgcttgctgtgcaaaatttgggtgcagaaatttgtcgtgcgttaaacattgctgttttaccgcaaaaaacatctctatgttagaagcacactgcagaaatcaagaatccatgattaacaagaagtgaaagcatatataattaaatttgttaatttacatgttcgcggcagagcattcatacattatgaagcacatccgaggaaccaccaagtgtccaagtcattgacttgtgggttttttaaatttgccatgcacccataccctttgcatgttcttgccattctttctattcactgatctg

SEQ ID NO: 68116 - DNA, 110 bp, Triticum aestivum
  unsure (1)..(110): unsure at all n locations
  Clone ID: PAT_TA_68116
aagatatgtgacatgtacatcatgtatacgccgnccatatatatatgtgcaccaggaataataataacaataatggaaataatttagggttgttggattggnaggagcag

SEQ ID NO: 68117 - DNA, 642 bp, Triticum aestivum
  unsure (1)..(642): unsure at all n locations
  Clone ID: PAT_TA_68117
cccttgctcgacgaatctgacgggcactacagactagcaggcactacatacaggatcccatcttagtccatgagaaatggatctaagcaacaatggctaggctatggggacgacggctactccttcgtggcggccgtcttcttcttgggggacttggcggccgtcttcttcttgggcgacttggcctccttctcggcggcggcaggggacttcttggggagcagcacggagttgatgttggggatcacaccgccgtgtcactacctccccgtgtcaggattgggtaatttgcgcgcctgctgccttccttggatgtggtagccgtttctcaggctccctctccggaatcgaaccctaattctccgtcacccgtcaccaccatggtaggcccctatcctaccatcgaaagttgatagggcagaaatttgaatgatgcgtcgccggcacgaaggccgtgcgatccgtcgagttatcatgaatcatcggatcagcgagcagagcccgcgtcagccttttatctaataaatgcgcccctcccagaagtcggggtttgttgcacgtattagctctagaattactacggntatccgagtagcacgtaccatcaaacaaactataactgatttaatgagccattcgcag

SEQ ID NO: 68118 - DNA, 213 bp, Triticum aestivum
  unsure (1)..(213): unsure at all n locations
  Clone ID: PAT_TA_68118
tgccccgcaaaaaaaaaaaagcctaaacctnttacaattttgcntatttncaataangngttngtaaaatcngggaattncaaagaanctntgggncaatnggntaataattattattattacnggccaaatntttatntttccacctatcatggcctcgaaancaattnacctggancatatggntngaaataatcccagaanctcaactgt

SEQ ID NO: 68119 - DNA, 120 bp, Triticum aestivum
  Clone ID: PAT_TA_68119
cttcgcagcagcatccgacctattccacaattcatctacgacagcatggaaacttgaaatggagtaccgaatggtgattagcgccgtgatgtagtgcacaaaaaccaaacaggaggtaaa

SEQ ID NO: 68120 - DNA, 695 bp, Triticum aestivum
  Clone ID: PAT_TA_68120
cagcatttaaaggtccgcacatgaacataaatggcacttattacatggcactaacatttgaaagaaattcttcaattgatgcttccattgtggtcggcgtttttccactgtctggtaaggtgcaggaacgcagttcttgattcaccagcgtcgtccagcgcctccttcgcttgccgcattgccccttgcgtccgatgccggagctcccgcccaccatcggactcaatcagccacctcaccttcgcgccacttcctgggcttccaccatttctttgtcatacccttcaatggccacggccagccgcatctcctcgactaagaacaccttgtttgtgtgctgctcggcgtacagaggccacgccagcatcggcacccccgccatgaccgcctccagcaccgagttccatccgcagtgtgtcacgaacccagccaccgcgccgtgcgccagcactgcctgttgcggcacccacgacatgacgaccagtgccctctccttggtccggtgcaggaagccttctggaaaaagcgtgttgaggtcgccggcaggctggtgctcgtcgccggtcgggcgccggacaacccacaagaaccgttgcccactcgtctccagccccgccgccatctgcttgatctgctcagcgctgaaccggcccaagctgccgaaactgagaaataccacacttgccttcggctgg

SEQ ID NO: 68121 - DNA, 586 bp, Triticum aestivum
  Clone ID: PAT_TA_68121
agaacatatactagatcgacaccattacttaaacatcggacactaattctaatacgaaggactagtaatcgcctaagccttcttgggggacttggcggccttgttgggcgacttgggctccttctcggccgtcttcttggggagcagcacggggttgatgttgggcagcacgccgccgtgcgcgatggtgacgccggcgagcagcttgccgagctcctggtcgttccggatggcgagcagcaggtggcgcgggatgatgcgggacttcttgttgtccttggcggcgttcccggcgagctctagaagctcggcggcgaggtactcgaggacggaggcgaggtagacgggggcgcccatgccgacgcgctgcgcgtagcggcccttcttgaggaagcggacgatgcggccgacggggaactgcagcccggccttgacggaccgcgccaccgccttcttcctggggccgccgccaagcttgcgccccaccacgtacttcttcaccttggagacggcgccggtggctgaggcgtccatggcggctacaggggcttgagatttggcgcgatgggggatttgagaaggcggc

SEQ ID NO: 68122 - DNA, 722 bp, Triticum aestivum
  Clone ID: PAT_TA_68122
agctgatgctttgaaatgatttgagttctggttcaattttgtatatattacatgaatgctccctagttcaaagcaacaaaccctccactatgtgtgcgtttatctcatttcctattcttctgctaggggctcatcttcaaacccctgatgaatctgagcaccaaatacttgttccgttggttttgaaaccctagtttcatcgacgctgcctagttcccggaaaggaaaattcccctttattcctgcatgcttgtcaagaaccagaccggcggctacttagctactccgtttgaaagcaccagacaaggcgttgtaagcttcgacgcagcgcctgaacttatcctctgcttcagcctgtgaagatccttggtgcttgtccgggtgccacttgagagctgacgcgcgaaaagcggacttgatatgatcaagctttaagggacccaaaactggcaagccaagggatattctatggctttttagatcgtcacgacgaggggcctcttcctcatccacatcactctcgttccaaactttttcccttgatttgttcggtcgaggctcctccctccattggaacccattaggaaggtcatcatcatcctcctccccgggccagtaccacgtaaaagatgtcttgccgccaaagctcccgtaagggctatcactagaatcatcaccatcaaagttcctccagtctatcccacctctgcctttgctatacg

SEQ ID NO: 68123 - DNA, 292 bp, Triticum aestivum
  unsure (1)..(292): unsure at all n locations
  Clone ID: PAT_TA_68123
tattttctgcaaaaatcncatgaacgctaaagcaagcatcttagttgtttttctgaaagtcctccacacaaacttcagaaccatagatgggaagcaattttacatggctgaccctagtaatctagatagattgaatttttacggccaccaaattgtacttgtgtgattcataccttgtactacatgctgagaacttctttgtagactatgttctttgtaaaatttgcaacggagtaggactggccttncttttgcttatctgggatggtaagaatnttnatattacttntag

SEQ ID NO: 68124 - DNA, 648 bp, Triticum aestivum
  unsure (1)..(648): unsure at all n locations
  Clone ID: PAT_TA_68124
tgatggngtttaacatagnttgctgagaccgtctgcaaagaaaaagaaaaggaaatcatatacgacatacgttagctcttcaccggcacaaacatttctcttggcaattagaacaatgcggctctgatcatgccccacgctcataatcctcgcataaaagtttggcgtgcaagaatgattaatcaggcgggccacgtttcctttgtctgtggcatcaacaaccacttcctcgctgattttgaaaagataacaatcttttccctgtacacgatattgtgcttcccgtaagtccgcaacacttcgtctgacctgttcaccgcggtactctagaaccatttctccttcttgaatgtccctacgagcaaaaagtccccacctatgaattcctgacctaccaaagcatactctactatgttccgttttctgaagataacgtagacgctccttaaaagtagaaaaggattccggatccctctcttcccttcgtggattcagactgtcaatttcatcccagcggtgttgacaatatccccttactcggtgtgccattgctgcctcccgggatctctttagttctttcctaacataaactcgacatcttgcagaacataaattctctgtagtttcaacttctgatgctgaatcctt

SEQ ID NO: 68125 - DNA, 678 bp, Triticum aestivum
  Clone ID: PAT_TA_68125
cgcccaaaaaaaaatctgctggccggtgtttgctttacaaaaagagttaatattctatatcagtgtaactttcttaacaacacagcgctgcgaggatgcccaagatacatgctggtcgttgtgaggctgaacgccatcaagatgagaaacatcctgcagtactctaacctaaacactcgcacggtaaagatacttgagacaactacaagctattcgacctttgtctccccactttttaccgtacgagttttgaaaaatgtagtacgacagcccatcacttgtgacgccataacctatgatgaccacacagtgggagcaatactgccctgaaggatttgtctcaaatgttgcgccctcaggaatgtcatatacgtcgttgcgtccaagcctatgatagtcggttgtgactctgaagttcccaataagagctattccatcctccaataaggcatgaccctctttaactctggctgtattaagcttctcaaattcctttatgcgataacgtcggtaactgtgaaaattttcttttgcgttgtcgtatgcttcttcggttatgacaccctgagcttcgagatagtaatcaagcgtgttgtggcctttaatagaatttgttgcacaaaatgcatcaaccagatctctaagatgttccagcgaaagattcagaatgaactcctc

SEQ ID NO: 68126 - DNA, 621 bp, Triticum aestivum
  unsure (1)..(621): unsure at all n locations
  Clone ID: PAT_TA_68126
gttgtcttttcttttanttttttacaacgaatgtggaccgaagagacgagggcaaatgaaccgcgacatatatcgaagtgaaccgcattactatcttgtagtttcgctaatttttcgcacttttacgttaggcacaagtgaacagcattactctcaaaagttaaccacattcgaggaccaaatgcactgcaagcgttgatatagtcaattgaattttgaaacacatgaaacaaatgcgctaaaacctctcgataatatagagacggattgaactgtagcgtccacagattttcaatttttttctcaaaaagtctttgtaactctggaaaatcaactataaagaactgcaacagaacgcctagccgcacgcctgcaccgcaccgatgactcacgtgtactgcagtgttgtacacaagcaaaatctgaagaaaaaaagtcccaaactgaacgccggcgatggcaccacctcgaaggaccaaggcgaactgcacgttggcgatgcaccgcaccacatcgagggacacaggcatactgcaccccggcatcgcaggacgagagtgctgccggacctgtcgcttgtcgtgcactgaagatctcaatcgcagaaacaaaaaatgaacg

SEQ ID NO: 68127 - DNA, 492 bp, Triticum aestivum
  Clone ID: PAT_TA_68127
tctcgctgtataaatccccagatatatatagagtagatgctattcgttttttaccccgaagtccaggctactcttcggttacggcttacttctaacagctcggctcgacttgatgcatgtactaggctaagggaactatcaaacttgtcctgcataccagagcaccattactgcagctgtcttgacagtgtgctgcgccatgacagaacaccgttggcttctctcaaactcctcgcccttctgtactcgatttcagcatctgagcatgcctggccaggcggagatctcttcctgagacctcaatgggttttagagatatttcatccctcgccttcctgaaaggatggcaatctttcgcggttgcatcatcctcagacagatgccccgctttcgttcctttgaatatatccaggtgcagtactttatgtggactgccaccagaaagctggtccagcgacttctttgtgcttgtggtctcgtttacattcaagc

SEQ ID NO: 68128 - DNA, 578 bp, Triticum aestivum
  Clone ID: PAT_TA_68128
atgtgtgtactgaaatagcacaatggtatctgggtattgcgttccttgagacatatagcaggtttataaaacaattttcaattcttaaagacaaatcggaagacgcttgccaccaccatgagattggcaacaaaggaacttcattatcgtttgtaatacacgctattttgctatgctggtatgaaagactgaagcacaagagtgtcttgtagcttaatagacgatatgagagcaagatcttccgtcatcatgatgcgacgacaaggccatagcatcgctacaaacatcgcaagttaaccgaatacctcctcattgcacactgggcatgacttgttaatcttaagccatcgagttatgcaatctgcatggtaagaatggctgcacggcaatcgtatcaacttctgttggcttttaaagtttgatttacagatcgcacattcctcgttgttctttttgctggagaagaagttacaattgttcctaaaaggcaccaggtagcatgtcagctcatcagataatcctctggattgagttcctactgcttgatcctttgcttgcagttgctcatatgacatatt

SEQ ID NO: 68129 - DNA, 565 bp, Triticum aestivum
  Clone ID: PAT_TA_68129
caaaccctgtagtttgtttacacttgcaatggcacttaaataagtggataatgcacgactcaaaatgttcatgcattatcccaacgcggcctttaccacacttgtagtttgtatatgcggttgcaatgccagtgcaatcaactgtccatgcattatctcaacgagaacatacaaaacacttgcaggccgaccacgaacagagcataacctctgctgatctctctctctcttagaaaaaaaactccgcagccaacgcggataccacaggaactgcgttccgggcacatgctctccgcctaccagatcagagaaacgtattatggaaagtcctctcgcacgtctagacggctagacctcatccgcacttggttcaaccctggcagcatttcccccggtaccatgagacgtcttgtaactgctgagcattgtttctacatggtgtacatcaacgaagtcgcaggacagatgtcgcccgtcaggctttgctcccttgaccgtcaaaattttcacaacatcgctcttacctgaaaagctgtggtagctgatatccactatgtgagatatc

SEQ ID NO: 68130 - DNA, 222 bp, Triticum aestivum
  unsure (1)..(222): unsure at all n locations
  Clone ID: PAT_TA_68130
aaaacaaacaagtcaaataatncttaattcgaaaaaaaacaagtaatgaacaggccacaccacccaacaaattgcctgagaactactactgcttttggaccagctgaaagacactaaaaccagaaacgaagtacacctactgttcgcagttcactcgagatcttctctgtttaaacatgacaaaaggtgaccaaaaaggaagcacgcgtgaacgaatggttt

SEQ ID NO: 68131 - DNA, 488 bp, Triticum aestivum
  unsure (1)..(488): unsure at all n locations
  Clone ID: PAT_TA_68131
taacctcccgcaagcccggcaagcacggttcatttncagtcacatacatccaacaaatctccccgtccatacgagcgatgcaaggcacagctctgccgatcagctcagaatgatctgcactgcagtcatgccccaaagttttacactacatacatacaaacatatagcagccgcccaatcatcagacaagcttgcctgtgactaccacttaattacttggccggacgactcatgncgntgcgccgtccacctgctgcctgcgccgcttactggactccttgatcttcagcagctcgtcgnagacgatccacgggaagctccagaactgcttctttcccggccggcggtggtccgggtgataagtcacacggtaccacgccgacgccctccttgacgcctccgncttcgggcggntcctgaaccaaccctgcacctncttgtgcaggccatccaccgagtagatgatgcggtccttcatcgtcaaagta

SEQ ID NO: 68132 - DNA, 278 bp, Triticum aestivum
  Clone ID: PAT_TA_68132
tgtcctaacgatgcagatgtttcgatttaaccggccgaatccaggctctgagttaaaaccaataaaactctgaagaaagaaaggaatgcagttaagacttttaattaacacacccgaaaccgatcgatcttcgcccaagcaagagcagccggcgagaaagaaagaaaaatcgatcgatcaggaggatgcgtgggtttctcagacttggatgaaggaatggcatggcacccccatgagctgcgcgagggtggtggaccggagcttcctctcggtgacgg

SEQ ID NO: 68133 - DNA, 709 bp, Triticum aestivum
  Clone ID: PAT_TA_68133
ttaataacaaagaagggtttcgaccgaaggttgtagtgtgttcatattacagaggagaacaggcgaccgtagcataatcttttgtatttttgagagatgaaatgcacagggcgaagcaactaattacagtgacctcttctctattgtggaaaaaaaatggaccaccagccgacctctttgtctcatcgcttccttttggctcccgaacttcgcttcgctgtggaactggaactggccttgtttgccgtagaagaaccccgcttggctctagcagaaccttccttcttgactgtacttttcttcttgaagttgcgaaatcccttgccactttcctttttgtattgtttataggcatcacggccagttaactcctgtccgtttttagagacataaaccttcctgccatcctctccagtgaaccaatggccagagccagactgactccccccagcatgtacccttcttttgccaaaatctgttgggacagaagtcctactgttgggagtcacccaccgatcattagcaccactactctggccaaactggctcctactgtagttcagattttcttctacactgtactcatttccctcggaagtgccagccccaatgggaacaaagtgctttaatctttcacggaccaggttctgcaccatctgatcacggtgacagaaataatgcatggcaggtggatggttgtccgtcagat

SEQ ID NO: 68134 - DNA, 247 bp, Triticum aestivum
  unsure (1)..(247): unsure at all n locations
  Clone ID: PAT_TA_68134
cgtgcaacagtctatagtattanntcaaaatggaaacatacacttctgcataacatgttaattactcgaatagtgtatgtttacccattttcatgaacttctttgagtatagtgtcgaaccattcgctgactttatttttgtggcattttttaccagctccctattctccgagagtgaacgcggatgcatcatgagtgtcagacagncggtaccagtcctnnaggtgactttttcagcggaggactc

SEQ ID NO: 68135 - DNA, 709 bp, Triticum aestivum
  unsure (1)..(709): unsure at all n locations
  Clone ID: PAT_TA_68135
gggtaaactgctgcaatttcnttcntcctagtacagaagtacatccagagaacaaacaaggcagggtaaactgctgcaatttccattccatcctagtacagaagtacatccagagaacaaacaaggcaggacaaacagcagcgagatgctgcgactacacccgactatcaggctactgatctggtggtggcctagccgccgaatccgtagagggtgcgaccctggcgcttgagcgcgtagacgacgtccatggcggtgacggtcttgcgtcgggcgtgctcggtgtaggtgacggcatcgcggatgacgttctcgaggaagatcttgagcacaccgcgggtctcctcgtagatgagccctccaatggatcctcgttaagggatttagattgtactcattccaattaccagacactaatgcgcccggtattgttatttattgtcactacctccccgtgtcaggattgggtaatttgcgcgcctgctgccttccttggatgtggtagccgtttctcaggctccctctccggaatcgaaccctaattctccgtcacccgtcaccaccatggtaggcccctatcctaccatcgaaagttgatagggcagaaatttgaatgatgcgtcgccggcacgaaggccgtgcgatccgtcgagttatcatgaatcatcggatcagcgagcagagcccgcgtcagccttttatctaataa

SEQ ID NO: 68136 - DNA, 148 bp, Triticum aestivum
  unsure (1)..(148): unsure at all n locations
  Clone ID: PAT_TA_68136
cactgntttataccctacatnagactaaagtgatgcganccgttccacatngcaaaagaaaacagtgtganctctgcgacacanaacaantttagatnccctagtaaaaaccatatgcaagnatagacatgtaaaaccccaactcagt

SEQ ID NO: 68137 - DNA, 731 bp, Triticum aestivum
  Clone ID: PAT_TA_68137
taattaataatataaacagtacattagtgatatcacaaaggaaatccttgaaatttgatgatacacctatatagaaggatgactaaatgaaaccaaaccacaaagatgaaacacaaaagcaacctaaattaactatattaaactaaaattgcagacaggatgcacgattcatcaactaaaagtaacactagatgcatccaccattcattccactttaatgagcattcatgcagcagcaacgcttgcgccaacaccacctccagcatcaccatcccctcctgatccaccagagaaaccaccaccaaaggaatcataatcacccttgggaaaaacaacttcatcctcttcattatctacatcttcatcttgggttgcttcaggtgcaatgatgatgttcctttggaagtagctatcccaatcaggaatgcactgctcaatcctagaaactcgacgaatagtcatcagagcttcaggaccacaccgaatgtcatttccagctgcaatcagcacgtcgaaataatccttgaaagcaactagcactgtatccttaatgtagtggtcggcaatagtaaaattcctatgacccaacatgtcaaaaagtgcatgtccaacgcagaaagcagcagaatgagtgtttctagttactatgcagtacactactcttgtcagtgtctccaaaaggaatattcagctgagctcttgtgacagctgaaatcttcatttgtgttgcg

SEQ ID NO: 68138 - DNA, 836 bp, Triticum aestivum
  unsure (1)..(836): unsure at all n locations
  Clone ID: PAT_TA_68138
attctgtcctccatatgtaccaatttagaggtacaaaaaacactgaaacaagctctcaaccaaagataacaacacttgactactgtaaaatcaacaccttttagcctcacgcaaaacccttttttgccttgagcattgagcactctgggtactccatttttgctagatgaccaggcctcatctcaccatagtgcaatatggcacccgactcgatcccagcgttgagtctcactcagggaaatcctctgccattcagtccaggggtacctgacaagcttcttctccttgcaactgcgacacttcaacccgctatacaggaagacatcctctagattgacagccgccaccagaacacgcctcacataactcacaaagcaatcttcagattcaaagccaaaaatgacaagtgttggaaacctgctgcgaccaagtcccactctacacccttgttctcactatatgattcttctttcctcttctccttgtccatttccatattacacacatgatcccatacctgtaaaatcaacacctttttgcctctttttcctcgagcagtgagcactctgggtactccatttttgctacatgaccaggcctcatctcaccatagtgaaatatcgcaaacgactcaatcccaatggtgagtctcttcttcatggagatcctctgccttttagtccangggtacctgccaagcttcttctncttgcagctgccacactccaacctactatacagggaacacgtncttttagattgaccgncgncaccagnaacacgtctcacataattcacgaagcaatcttcagattcaaagccaaaatggacgagtg

SEQ ID NO: 68139 - DNA, 232 bp, Triticum aestivum
  unsure (1)..(232): unsure at all n locations
  Clone ID: PAT_TA_68139
catgaccttcctgatngatccagtncacatngnagccaactcatgngattnttnactcaaaaaacacccaccctttagggcngtttntgttaaangctacaanggggttggggcanataggtcgcncccntactnttcnttganggcncccttgtcgntgncgtaaatnccgnccaanaacttcctgangtccttgttnttnacgnggcatttntggttgatnaaggcagna

SEQ ID NO: 68140 - DNA, 725 bp, Triticum aestivum
  unsure (1)..(725): unsure at all n locations
  Clone ID: PAT_TA_68140
cctcttnngnaagnggaatctacctcgaggtaacagcagaacataaaaactcaagggataagttttcagaaggaatgctggaaatttgaacggcctttctagcaacagttcgctgatgtgctgagtcagcaacccagatagtacatacaaaataatcttacaagtcatttaaccagtaatgttactgcttttgacgtctgctccttttcgtcgtgggcatttggctttgctccaatagttttttctccttgaaagccttcaccatattgtacaccttccgaattcccgatgtcaagcccatggaatcgattgaactttcatcgacgagtttcagtttcgtgctatcttgtcccttgttgcatgcttgacccacatcacctttgatcttgagaaccatcagctccacatgcatcgtcaagcgaatgtgggagaaaatgtgaacatgctgaccaacatcctccctgaggatcagattggattcctgttcaacatctatgtcaaccaattgcttcaaatacctatccatctcttttctcctgtttagcgggtcggtcttacgttcgtcaacaagaactgatgggaactcccagagccctgcaagcaggccctcttctggcctctttatcaagagaaagaaattacatttgccggctgccgtctcttgctccaagccttgtgcaatttgaacaacacaaacagcagcgaaatcacgacgtggtttagct

SEQ ID NO: 68141 - DNA, 629 bp, Triticum aestivum
  Clone ID: PAT_TA_68141
tcgagtgaacataaagtgccttgtactgtacctttgcttgccgagacactatgcatgacttccaggagttatctgctaggttagctgagctccatatttcatgactacgaagtatcttggcatcacgctctagtggctagccgctcaacacaacaagggaatcttctttcactatcttgcagtcaactaattcctgaagcagcctttctgcttcttcaatcctgcctgatttcgcgactcttctgactatagatagataaaatgagttgctggtgtttttaatttctgataccattactcgcattatatcagcagcagcttccgctttgctatctctgcacaatgcctggatcaccatgacaaaagtagttactttaacctgaaaaccaacagcaagtgtacgattcaagagctctagggcctcttcagccatgtttttcctacagaagcacataacaagtgaaccataagtaatgtcatcgggactgatcccatcactagccatctcatcaaacagagtcatagctttgtccacctcacccttgtttgctaaagcatctatcagggtgttgtacgtaatacgaaccaactgccatccattttctctgatgcaacgggctatcaaaaga

SEQ ID NO: 68142 - DNA, 531 bp, Triticum aestivum
  unsure (1)..(531): unsure at all n locations
  Clone ID: PAT_TA_68142
ctatattncgatgatttggattgtgtggtagatggtccacgcgcggcctactttagttgagatatataaaaagaacttcccctaaaaatgataaaatgacctacaaaggggacaagaaactaattcagctgatgacatggtcactgaacagcttgaactgtccggcgtcgagcacaagcttccgcacggacgcaatggcgccaatgatcccaacaccggtgaacaaggccatgatagccacgttgattacgtacaccgccgacctcttaggcggggccaacgccatgttgtacatgacgacggggagcacgaagtcgagcgggatgaaccccaacgcaccgaccacgcccacgatgtcaccgaagaacggcagggccgccgccacaaatgcgcatgccgcaacgtacaaggtccgcagcgccacccgcggcgccaggttccgccatgagaaccttccatggcccgcgtctgccgaccctttctccatgatctcgtaggccacttgcgagtacaccagcgcaatggccagga

SEQ ID NO: 68143 - DNA, 594 bp, Triticum aestivum
  unsure (1)..(594): unsure at all n locations
  Clone ID: PAT_TA_68143
tggntattttattgtatatttaagtaccgaacatgctgatttaaggggtaaaaaagtagcagaacatgcttccttcttttcttttctagggtacaatatacatggttttattctctgatggataacaaaaattcctcccttaagaacagcaaaaagggagagcatgttacacttaagtccagagtccccaagcataaaacggaccatcttcagctgctttcgttttgtcagtttgacccgcatctgacatcagctacaacatgtcgaatgtgcggcccataccatttgactcgttcgacatgctccagagagactttccaagacagtccatgagctgtcgcaatgctactgatagattcgacaacattgtccaaccagcgcgcctcgtctgagtcgttgacgttcccatgtatatgtaatacgcctccgccaaccctcaaagccctaacagcagtagcccagctacattcactgcagggtatcagcccaagacaaacacgatcagcaaccccttttggtgctatcaaacggttatctccttcaagtataacgcatcgatctgctacatggttgtccattacattccgctgaaga

SEQ ID NO: 68144 - DNA, 397 bp, Triticum aestivum
  unsure (1)..(397): unsure at all n locations
  Clone ID: PAT_TA_68144
ttnctctctctatatatntgttngtttcttacgtatacacgctacgtagctcaaaagaaagaaacaagcctcaaccacatcaaaagaagcgccgcgcgacataagtacgtatcaacccgatcgataaaccactagctagctatatatataggatcgatgctgttgctgcccgttcccttggcacgtacgtagtagtaagaattaacgatcaatcagcagtacttttttctttcaattaagtagaagatcgatggatctccttcttctccggcaccggcgacgatcagtacgtactaggggcagtgcacgttccggcccggcccgccgtagtagaagtagttgccccaggcgcggttgtagccgccctggatgccgtagcaggcggggtggtcggcga

SEQ ID NO: 68145 - DNA, 622 bp, Triticum aestivum
  Clone ID: PAT_TA_68145
catttgcccagaacagactgtgaaacgtaaacaacagatagtacaatgcagaaccaccactctcgattcgtaacattaagacaccataaaaggcatggagaacagaccattagcaccccaactctgatcattggccggcggcaatgggcttaatctcgtcacacgtgacgttctctagtggcaccatctgtggctctactggagccgtctgtcaattcctttaagtttcagccttgcgaccatactccccccggaacccaaagactttgatttctcataaggtgccggcggagtcctataagcaacatccgccgatccctggtcggcatcgtttatggttgagactaggacggtatctgatcgtcttcgagcccccaactttcgttcttgattaatgaaaacatccttggcaaatgctttcgcagttgttcgtctttcataaatccaagaatttcacctctgactatgaaatacgaatgcccccgactgtccctattaatcattactccgatcccgaaggccaacacaataggaccggaatcctatgatgttatcccatgctaatgtatccagagcgatggcttgctttgagcactctaatttcttcaaagtaacgatgccg

SEQ ID NO: 68146 - DNA, 428 bp, Triticum aestivum
  unsure (1)..(428): unsure at all n locations
  Clone ID: PAT_TA_68146
ctctatttttacaaaagcaaaaaatccgaactaagtctccccgttctaaacccaactcacgtaggttcttaattggtgaacaaacaaacaagctacacttctgcgcgtagctaacaacctaagtcgacatcgaggtcgtaatcctattaatcgatatgaactctcctaattgattgcgctgntatccctggggttggttcttcatttccttgaaaatcagggatcgtaatataaaataacactaattctaatatcactgaaattaaatcacatcaacaactgccccagttaaaggatttcaacttatattaaactgattaaccttaaccacccangggctttttttctttctttttaactttgntattttcaccaaaaaaaaatttttaaatttcttatcgagacaactaagacctgagacacctatc

SEQ ID NO: 68147 - DNA, 521 bp, Triticum aestivum
  unsure (1)..(521): unsure at all n locations
  Clone ID: PAT_TA_68147
ctctgtaagcttaaaatattgatcacctcgttcaaagtattgacaaaatcatgcagcacaatacatcttgaaaaatgccntgatcgaactaatataaaaaatattgcagaaataaatatcacaccattgcagaagtaattaagcagcagctaaaattttatcgagggattcattggcaattttgatttgttgttccaaacgttctctggtagccgaagccgtgggtagttttttcagtttctctttcatctccttaatggtttctttgtagcccaacgtgttgtgaaacacccggacgtgtttgtcacctccggacacgagatattttccgttgatggaaaatgacaagcaggaaatgagttcggaatgaacctctttgaactcctctgaaaactttcctgttctggttgaaaccatcacgatattattcaacacagcaaaagctgctacgtttccatcataggagaggcatgacaaacacatgtgctcagtgggtgagaaagaaagaccagagaaattnc

SEQ ID NO: 68148 - DNA, 141 bp, Triticum aestivum
  unsure (1)..(141): unsure at all n locations
  Clone ID: PAT_TA_68148
acaggaaacatgtnaagcnacaccnccaagctctgaaaccggaacatcacagtaggacnctntgataacgcacgcacgcggntaccgcnacctaggccctntccccgcggatgcggcgggcgagctggatgncctngggca

SEQ ID NO: 68149 - DNA, 498 bp, Triticum aestivum
  unsure (1)..(498): unsure at all n locations
  Clone ID: PAT_TA_68149
atgattctaaaagcacagcgcagggcaatccaatgcagataacacaaaaattccaagtcaagatactaaaatggacagtgtcctttgtatactgttaatttgtgacataacaactttgtcgcctaagacctcgactttttcttccgggacttgttggagcccttcggtggttctggagccttggccgaggtggtgggtttcgaagaggtggcaccggcattggcagcagatccatcatgcttctctctactcacagcaccctgagcacctctgacctgagccctcttgtccttcctcttcggacggtaagtcgacctctccctcttcttagccttttgcttcttcacttcctcgggagcatcaaccttcatggcttgctctacatgccttgcaccagatgtcttctccaggctctttacgtcaattccctgaagacccggcaacggtttcagctgcttctcatattgctcancttttgcaaggtcagtgcgtgcagac

SEQ ID NO: 68150 - DNA, 281 bp, Triticum aestivum
  unsure (1)..(281): unsure at all n locations
  Clone ID: PAT_TA_68150
gttacgctaatatcacagttcgcataaaaccaccatcaacatacaaaaaaaaaaaacagttcaaaaaatatngnttcgccgaagcagcaaangcatntntaagngttnccaaccacctaangatntatccgcnccanangcnccaccaaatcgacngcaatagtaaacacanggcatatntaacagacagcaggatgaccatatgaggncagggggnttaggcagcctccttttcctcctcctngnaatactnttcctcctcgtnggntggggcatcctgg

SEQ ID NO: 68151 - DNA, 515 bp, Triticum aestivum
  Clone ID: PAT_TA_68151
cataccttagctttatagaagaagaaagaatatatgtacgagagattgcaacggcgagatcaccacaaaccagcgatcccacacccctccactccagcttaactcaagcgactactcacaatatcggtgaactcctccccctcctgcaagagcccattgccgaattttggcaaatataggctcaaccgtcgcaagcacactacaaatgttaccagaatgaaaaacactattgttcctttgcttctgtaacgtccaactaatgagcgtgacaaacgaatcaaagcccttcctttcctctttttggatttgcttgcgtctacttgtccaccaatcttgaagcctgtcctggtgagaaggagtcatgctcattagttgccaaacctagatcaatgtccaccttgaagaagcataagtaccaaacatgcctcgcaaaggcgcattgtagcaggaggtgatccacaatgtcttcctcctgttcacaaaggaaacagggtgaagtttcatcttgtaatcca

SEQ ID NO: 68152 - DNA, 603 bp, Triticum aestivum
  unsure (1)..(603): unsure at all n locations
  Clone ID: PAT_TA_68152
tttcttttgtattgcaaacataaattgttgaattcccaggtctgcattagcacacagttgaagaaggcactgcccctctgaacctacgccaactgcagcatcattcatccccaaatccacttgcccctctgctgctttagaatcagacccagccngaggcttatttccatgacatcgcccagtaatattaatctcaggagcagctagctgagctccattcagtacaagtgtcgtcgtgccaacctgcaggggaagaggaatttccggcgacgagcacaaccctcgttccgaagacccaccagaatccagtaatgaatccgccttaattcgcatcaactcgagatatcttgacggatccctcgacttgcgaattatctgcatcgccctcgccttgaaacattccatctctgccaaatccacacctaggcgccctcccgtcttcccgggaaaagcagtaaggctctcaccggatagcttcatcgacaacatgctccaaccagaaaaagaaagggatgaccgaggggattgaatagaaaatcaccaggaagaataaatcaggattattgggacagagtagatgacttagaagtaggattcgaagac

SEQ ID NO: 68153 - DNA, 750 bp, Triticum aestivum
  unsure (1)..(750): unsure at all n locations
  Clone ID: PAT_TA_68153
aacttaaacttgcaagnaacccgaaatctgaatggattcaaacttgcaagaaacacaagacgtcagtgctcaatggccaatgggtcaggacaacacacccccagtcagcttttgatgcaacatctctctctctacctaaacttgcaacaaactcaagacgtcagcgctcaatggccaatgggtcatgacttcccgcagtatttatctaacactagatgattatacaagaacgccaccatcgcgcaagcgacgatggccagggccagaaacgccgtcttcgtcagtctcggggaggagctcggcagccatgggtacaaatctggttgaggcatcacgcagctctcaccattgaagtatatgcgtctcgggaaaccccagcccttctcgaaagtgaaggtcgacgggtccttcctgaacagaagctcggattgcacgttgccatttggcccagccaccatgagcaggtcattgtagtacttgagaccccacagcatcgcggtatcatttatcactccataggggttcaatgctttgtagttgaagctgaagattgtcgtgacattgtcgaaattcgggtgttgaacaaccaagttccactgcgagtagttcgtcccggtagttccagtttgaaatggtgatcttcaccctccagtagtcccttgtagttggccttaacatggccagtgcaccttgattgggcacatatggggcgaggcatcgtactaaagggggtcgagctgcccttgccag

SEQ ID NO: 68154 - DNA, 708 bp, Triticum aestivum
  Clone ID: PAT_TA_68154
aaaatgaaaataaacacaggtgacattagcatgacgggaccatgtggttagtaggccagcccattgtcacatgcgcttgaggtgagacctagtttggtctggcaataagcgaccgaaactactctgcacacgattgtgcatgcacgattcctggacgatgcattccttggacagtgcagatttgtaagacaatacaatccaacggttgcttttgtccatcgtgcataaatcgtgcagaaagccatcgtccgtgtagcactgctcataagcgacacatagttgcgccctccactgcgtgtttagcacccgatagcgtaccttggcccattgagaagcggagcagccgccgcgcccagtgctccgcgaggcgacgtagctagcagcggcaagccgacctggtgaggtccttctctgaatctgcctgcaccccttattcgttacgaaaccaagcaatatctctttctgcaagctgagtgccattcaaaagaagctcatcacacaatttctcagatgccatccttcagctctcggatgccaccagcagtaacccagcgcccctgctaccaagagcacacctgatgcactgtgaatctctctgcgtcataaatcagttctcctcacacatatcatcatcatgcgcactgctataagtgggaccatatcaattataatcgggggatggttgggacgggcttcaagtgcgtgcct

SEQ ID NO: 68155 - DNA, 658 bp, Triticum aestivum
  Clone ID: PAT_TA_68155
tttctgacgttcttccttaaacatgcacataacaagatgaaacgaaaccgctacaggaacaccaccggaccactacgaagaacactacgacatggaacgcatcgatctaagccttggtggtcttcttgggggacttggtcgtcttcttaggagacttgggctccttgccctccttctccgcggtcctcttggggaggagcaccgggttgatcttggggatcacgcccttccgtcaattcctttaagtttcagccttgcgaccatactccccccggaacccaaagactttgatttctcataaggtgccggcggagtcctataagcaacatccgccgatccctggtcggcatcgtttatggttgagactaggacggtatctgatcgtcttcgagcccccaactttcgttcttgattaatgaaaacatccttggcaaatgctttcgcagttgttcgtctttcataaatccaagaatttcacctctgactatgaaatacgaatgcccccgactgtccctattaatcattactccgatcccgaaggccaacacaataggaccggaatcctatgatgttatcccatgctaatgtatccagagcgatggcttgctttgagcactctaatttcttcaaagtaacgatgccggaaacacgacccggc

SEQ ID NO: 68156 - DNA, 127 bp, Triticum aestivum
  unsure (1)..(127): unsure at all n locations
  Clone ID: PAT_TA_68156
taaataaaggctaanacatcattgactctagnttcctggccaaggatagatacttnagacacaaggtgccccacaacttantcgaacagactgaagcccatgtcatcatnactctcttccttctncc

SEQ ID NO: 68157 - DNA, 112 bp, Triticum aestivum
  unsure (1)..(112): unsure at all n locations
  Clone ID: PAT_TA_68157
ctnttaacatccancanacantgctaccgaanttcactctccatcttcngctttacttgtgcgatcatcccccttcaggcgaaacctgaattngcccgntccgcntatcagg

SEQ ID NO: 68158 - DNA, 759 bp, Triticum aestivum
  Clone ID: PAT_TA_68158
acttggcttgtctgtactttcctacggaatggaagtttccaatgtttggtctgtgaccacgatatacatacaggaggagagattctgatgacatccatgtcctgcagggagtttctatatgaaacgcaaacagaaccggaagcgagtagaatatacttgctgtgccgacccagcaaagtcacagctccgttgtaccagcacatatctgcttctgttcctcctctagttttctccatgcagccttatctttctcgatcttggagagatgtggcttcatcgagttgccgagccccactcctccccatgcatcaagaagctccttctcccttgctcttctgcgctcctgcttcagttctccctctgttttcctgcatgcagccttgtcactctcaatcttggacagatggggcttcaccgagctcccaagcccctctcctccccatgcatccagaagctctttctccctcgctctcctgcgctcttcagcggggtttaagactcttgtcgaatttccttcagcagcagcagcagcagcagcctgcttggcttgctcaagcttcgttggacgcttgacaaagatgtcagcaaggcctccggccgctccatctgcacactgtgtatcactcttcttcagcaatagtgtgtcactaccacccttcttttcttgctccatcttctccttttcaggcctggagacatgtttaaccaagatctgatctaaactatcagatgctttgtcatcgttaccagtctgcacac

SEQ ID NO: 68159 - DNA, 331 bp, Triticum aestivum
  unsure (1)..(331): unsure at all n locations
  Clone ID: PAT_TA_68159
atcaaacacccacgagatgncaacacattcanagaagacacaagaagcaggctatctaagaggaggtgaacttggngactgccttggtgccctnggcgacggngtncttggcgagctcgccggggaggacgaggcggacggaggtctggatctcccgggacgtgatggtgggcttcttgttgtacctggccagcttggcggactcgccggcgagcttctacgaanatgtcgttnatgaaggagttcatgatggacatggccttggaggagatgccgangtcngggngcacctgcttcagcaccttgaagatgtagatnttgtacgtctcca

SEQ ID NO: 68160 - DNA, 626 bp, Triticum aestivum
  Clone ID: PAT_TA_68160
tttgtcctaagacaatacaaatttccacaatctagtctgatgtccaaaaccaaagcttaatatcgaaacatcacaagcatatttagaacacactataagcattttttaagaattcaagtaacacgactacaatgcactactagctgatttgaactccaacactacagcaccacttccaggcagctgacccaagtaattcttgccaaaaacatcaatctccaataacacagactaagtgtcaaacctgcacaattcaaaacacatacaacattataataagttataacagctagctcccaaatgaatagagtaataatattagttgattttccaagcaatcatccgatggacacaccactactatattaaggtaccatgaaaatggggtaacacacgctaaaaaaagcatactagttacaagttaaaaattttgttctataaatgtgtcattttatcatccaaacatagaaatcattttgaaacaaaggatgaacagataatttcatattcatcaagtgcaacaaaaaatcaagtttatatgcacatgacaagggcttgtatatataaaaatgggatgtttccatacaatgcaatgtagtttatagttaataatacatgaaaataat

SEQ ID NO: 68161 - DNA, 311 bp, Triticum aestivum
  unsure (1)..(311): unsure at all n locations
  Clone ID: PAT_TA_68161
gaacttagatatacagctttactgtnttaaagaagttgcaccaagagtatatgcgcgctccttctttaatggtaagatttgtctaagttcgttcatcttcgaaaaacatgtttagcaactaagnaagtgatactagtactccgtatntgagttcattacgattatgctgggtaaccactgtcttcgtacctgggaaacaaccacctgacgagcttgggacgggcccgcctcgttcccgtgaccatggncgtggccgtcgtgcacccctccttcacgcttntcgccccctgcattcctcccgtcctccagca

SEQ ID NO: 68162 - DNA, 681 bp, Triticum aestivum
  unsure (1)..(681): unsure at all n locations
  Clone ID: PAT_TA_68162
cgaagcatggtcctacangcacatgctcccgttccggcacccacaatgcttgttagcactaaactatttgctacagtggtactctatnactattgccataggcttaagttgtattacaaaaaacctctgcacagcaaaatcaaaggcaagatcgcactaactgcaaacaaatcgagaaagatcctttacatgggggctgcctaagtgtcatctgtgccacacaaagaatcaatgcaatcaaaattcaaagaatcaggtcacttggtttaccaatcatccgaaagacaagctggaatcaccacgattaagaacttgttctgtcagggcacttctgttcaccaatcatctgaaggaaaagcaggaaccaccacgtgtaagaacctgtgctgtcagagtacttttgtaccaatcatctgaaggaggagaagcatgaatcaccgcaactaagaacctgtactgtcagggcgccagaaactcttcctggcaacaagaaattgccgcctcataatagcggtcttgtaatgcagagagcgaagaacgcggtccatttttctgatcattccaatattgtcttgcaacacaaccatctaccaggtctaagtatcctatcaatttccgctgctatttcaatgatatcacacctatttgcgaggctctgaaggagatagctcatgtgaagaa

SEQ ID NO: 68163 - DNA, 441 bp, Triticum aestivum
  Clone ID: PAT_TA_68163
ctcggtagcattcacatacgagcatgctttctcgagtcatgtcgggaacatggacatacacatattcttatcttaggaacaaacaagaaagataaatggaaaaggaaaacccaaagcaatgtcagagttgacaaaaccgcaatggcactttatatgtggcccgtggtgagtgagctgtttaggccttgccggactcctcgcagcccggtggcttgaaggcgatgaagctgacgcactgcacctggcgcatgttgtcgaatccgatgatgcggacatacgcgtcagggtactccttcttgacctcctccacctcgttgatcacctgcgtggcgtcggtgcacccgaacataggcagcttccacattgtccagtaccggccatcgtagtacccaggggatgcgttgtgctcacggaagataaacccaaccttgctgaactcgc

SEQ ID NO: 68164 - DNA, 175 bp, Triticum aestivum
  unsure (1)..(175): unsure at all n locations
  Clone ID: PAT_TA_68164
ttatgaagaagagancagagatcatncttgacttcctaatanctaatgcatgcactgcactgactggatgatgagcctagttgacaacacccccagttcagtcatncttcgccaatccatgggactgggagcatncagcatnaaaacccatnncggcaatgttcattctatcaat

SEQ ID NO: 68165 - DNA, 648 bp, Triticum aestivum
  unsure (1)..(648): unsure at all n locations
  Clone ID: PAT_TA_68165
cgtgctagtaatacagncgaaacaacagacagcagcgagatgcggccattccattacaccgaagacaaccatggctagctagtagtacgagtatggcggcgcgaggtgggctcgactggaccggcgcgacctagccgccgaatccgtagagggtgcggccctgtcgcttgagggcgtagacgacgtccatggcggtgacggtcttgcggcgggcgtgctccgtgtcaggattgggtaatttgcgcgcctgctgccttccttggatgtggtagccgtttctcaggctccctctccggaatcgaaccctaattctccgtcacccgtcaccaccatggtaggcccctatcctaccatcgaaagttgatagggcagaaatttgaatgatgcgtcgccggcacgaaggccgtgcgatccgtcgagttatcatgaatcatcggatcagcgagcagagcccgcgtcagccttttatctaataaatgcgcccctcccagaagtcggggtttgttgcacgtattagctctagaattactacggttatccgagtagcacgtaccatcaaacaaactataactgatttaatgagccatttcgcagtttcacagttcaaattggttcatacttgcacatgcatggcttaatctttgaggc

SEQ ID NO: 68166 - DNA, 456 bp, Triticum aestivum
  unsure (1)..(456): unsure at all n locations
  Clone ID: PAT_TA_68166
ccatgggaataaaaacactcttagaaaggaagatctgctcccattaaaaaaagaaaaaaggaaaaaaaaanggagcatctgctttctcactatattggattgattcaacaagaataaaacaatcgccgccgcgacacgaggcgatgtgcgtaaagcttgcgataaaaaaaaagaatcgactggcgctctattctgtncccaaaactcaaaacacaaagattgttttgctacgacacacttnatctgttatatctacacacacactactaggctagcaccacagcaatgaccaaaaaggcgggctctntgttattgcaccgcctcctgcgaatcactcctgttcctgcgaccgaaaccgcacctacacacaaactcagggaccgggccctcggccccggcgacccagggatgcgcggccacggcctgcagggtcatacnatgtcccggatntttgta

SEQ ID NO: 68167 - DNA, 177 bp, Triticum aestivum
  unsure (1)..(177): unsure at all n locations
  Clone ID: PAT_TA_68167
cacagacctcggngcataacagantcatgatgtncatttgcntccagggctgnnttngnccacnnaaattggctattaagtagtntactcatgtggtgaattttattgaatacttaatctatactctgcatctaccaaaagcaaatctccttgaacaaggtctgatgccaaacaatc

SEQ ID NO: 68168 - DNA, 163 bp, Triticum aestivum
  unsure (1)..(163): unsure at all n locations
  Clone ID: PAT_TA_68168
ccgggcattgcttacaacaaaaatgtaatggtatatcttctctctgaactgaaatacacaggacagacatatatatatatgtatgtagtctgangagccnattcattgttgnacttgtagggtgaaaaacaaaataaatntaananagtngagttagngatct

SEQ ID NO: 68169 - DNA, 572 bp, Triticum aestivum
  Clone ID: PAT_TA_68169
ttactatttacaagataatgaaacagttacaagacgacatggtccgaacacctgactattacagagtaccatcgatcgacaaagaagacaggaacagactatctaagcggaggtgaacttggtgacggccttggtgccctcggagacggcgtgcttggcgagctcgccggggaggacgaggcggacggaggtctggatctcccgggaggtgatggtgggcttcttgttgtagcgggcgagcttggcggactcgccggcgagcttctcgaagatgtcgttgatgaaggagttcatgatggacatggccttggaggagatgccgatgtcggggtgcacctgcttcagcaccttgaagatgtagatcttgtacgtctccacgctcttcttcgacttcttcttccccttcttctcgccgccctccttggacgccggcggccgcttctcggccttggtcttcttcgccgccgtcgtcttctcggccttctccgccaccggcttcttctccgccttgggggccatggatgccgcggctgctgctgctgcttcgacgaggagaggtgtggtgtttcgcc

SEQ ID NO: 68170 - DNA, 217 bp, Triticum aestivum
  unsure (1)..(217): unsure at all n locations
  Clone ID: PAT_TA_68170
gacagggaacaggaaagaaacacangaactaatgcacgaggagcctaggacgaggtgaacttggngacggncttggtgccctcggagacggngtgcttggcgagctcgccagggaggacgaggcggacggaggtctggatctcgcgggacgtgatggngggcttcttgttgnagcgcgcgagcttggcggactcaccggcgagcttntcaaagatgt

SEQ ID NO: 68171 - DNA, 744 bp, Triticum aestivum
  unsure (1)..(744): unsure at all n locations
  Clone ID: PAT_TA_68171
cgtgttgatngttggcagtttagaaaattagtacacaatgggtaattgaccgtacacagaaagtctagtcacatatctctggtaatgctactcctttaattcttgtattgaaacaaactaccatatgtcgtgggataaccaccgtatgcacatcaatgtgacaataggcacctttcacctcgcatgattcatagttggtttgtgcctcctcttattctcgcgagcctgatctccccgagttagggaaaaccacagatgtgcacttcttcctcggtgcctcattgtcgccaacctcctttatatggttgccctgatacttcagcaaagtcattgaacatatgttgatttctgaagatgctaatgtgcaacctatatgggacgtcggcgtttcggaggcaagggaagcaataacatcaccaagtgcagacagtgacttgtcgatgaacttttgcctccttagacctctttccttccacttcagttttggccaagcgctcacttccagcatggtcaaccaaccacatgtgagttctagtcctttgcctagtaaccaaactgcacactcatgacggtgatccgtattgattctttggagttgttgcctctgcatctttgggtgctccctttcagtggttcaacctggagaggatttgaacaaaaggtcagtgttaaatctggcagaaaactgaaacaaaataacatcacccgaggcatggagtatagctgtataggagtagggagaga

SEQ ID NO: 68172 - DNA, 536 bp, Triticum aestivum
  unsure (1)..(536): unsure at all n locations
  Clone ID: PAT_TA_68172
ccggatnctttttattttccttctgtatnacatgtgtgtgatnatgaaacagggagttgaagtggcccaattccaacgtacagagaacaacactgctatcctatgtatacaagacaaacactactgtctacagatcaacaaattgcaggccatggcttcagtgtaaatcataactggttgtatgatgctgctatcatatgtctggtccaaattgtcctgagttcagaaaatgctgcaccacaattgctcacagctacagaaaaatctgcaaagctcgccctaaaatagtctaacgaatgaatcagtctgcccgcgcgtcccttcaatcaagcaatgtatgtacaggggaccatagtgctggtcagtaaatctttggtcattcagtattatgcacatgggttgtcacggatgaatgatcctatctggtgtgcgagagttgcttggatgcaaggctgaacatctcctttaggcgagcagatgaactggaaagaacattcttctcgattctcttctgatgcctggtggtctttgaccat

SEQ ID NO: 68173 - DNA, 588 bp, Triticum aestivum
  unsure (1)..(588): unsure at all n locations
  Clone ID: PAT_TA_68173
tctctggactttgatataataatgagatntccctgtgtgatgcactgcaaagtacagtaatatacctcgtaaagatagtccaaagaaagaaatgaaactaataattaacacatgataacttggactgtcgagcagcagtgagcaactctcaagcaacaagaccacctagccagatcattttctgctctcgagctctaactactccctgcagcttcgtcgtgggtagaaagagttaatcttggcgagagagttgcctagttgtgctccaagcagtcaaccagccaaatcttcagatctcagaatacctgagaatatcaggtgctatgggagggagcattctcccgtgctccaggagcttctgaaacgttggatctgaggtccaacggtcatctcaggtgctccgacaaattttcaaaaagcctgtcagaagtcccttaattacacgcatgtccaggggctcctcggatgaccgtggatctcagccgagcttgctgtgtagcacctgagactccctcctcagaatacatcatgctggtgtcagcattttttagctttttctttctttcttgcatgcatgctcttgacgtt

SEQ ID NO: 68174 - DNA, 613 bp, Triticum aestivum
  unsure (1)..(613): unsure at all n locations
  Clone ID: PAT_TA_68174
attggacccagctagttttaaacatgaaggaaatctgctgatgtggcatgtttgttccgtccaaaaatcacaacatagggcacatgcacaatccatgccacatgccgggaaagcaaaagaaatagatcaaatcattgaggaaaccaatgagagaaacaacacaagcaagcagatgcaaaatcaaaacaaaatcgcaagcaacacaataagaaagaaaaaataagagaaaaactcgggactgagaatcgatcagtaattctcatggccggggcaggagcacgtcgcgaagcaggttgtcgaagttgcggtgagaggagccggagtgcttggtggtggccttggctgccttctccttccactcctgtgccttcttcctcatctcccttcccctgtccccctccatgagctccgtgacaaggcccctgacgctgtctcgccggacgtggcactccatctccaggccgacgccccactcgttgcactggtatcgacagttggtctgctggtccccacaggagggccagctgatgaccggcacaccggcgcagatgctctccaatgtggagttccagccgctgtgcgtgatgaangcgcccacggccgggtgggccag

SEQ ID NO: 68175 - DNA, 300 bp, Triticum aestivum
  unsure (1)..(300): unsure at all n locations
  Clone ID: PAT_TA_68175
caggccatggcagcagccngngcagcggcancccgcttcctcngcncctcaatgatggtgagctngatacccttgcccttggggaggctcacccacggcttggngcccttgccgatggngaacacgntgnccagacgggtggcaaactggtggccctgcgcanactcaacgtgnatggncncnaaggatcccttatgctngnccctgttcntgatnacaccaacacgcccagagttgcgcccaccagaaaccangaccacatngccgacntcaaacttgatgaagtcaacaatcntgatg

SEQ ID NO: 68176 - DNA, 202 bp, Triticum aestivum
  unsure (1)..(202): unsure at all n locations
  Clone ID: PAT_TA_68176
atgtacggagaanatnacatgtgtgcccccaaacaagcccctgcatctgnatatgactatcgcctctacctntacangatacaanagagagagaaggaaaataataagaggtgtgtncgtccggtntnntcctcctgtnngntccttcatcagataatacgccnaatcatctcttctnttgacatcnnccacccaatcgtgt

SEQ ID NO: 68177 - DNA, 140 bp, Triticum aestivum
  unsure (1)..(140): unsure at all n locations
  Clone ID: PAT_TA_68177
cataaattaagnctgtacttgtcttacagagttgtattttcnccgtttcatggttatgtaaactgcaactctgtaagacaagtacagcttacataaccatgaaacggtggaaaatacacaaccaatactggtggcaaatc

SEQ ID NO: 68178 - DNA, 197 bp, Triticum aestivum
  unsure (1)..(197): unsure at all n locations
  Clone ID: PAT_TA_68178
gaggatgaacgngaaacagagcntgtnntataagcagnaggttatgaagcgngccagancncgcacnacaaatncaaccaccaactagaaangatgccactntggatncattngnccatcnaaaataattnnangngtgnttttatcaagcaaanggttttcaattangcccaactatnacacggtgttattacatc

SEQ ID NO: 68179 - DNA, 680 bp, Triticum aestivum
  Clone ID: PAT_TA_68179
aggacagtcggtgcctgccctagctctggaattgggccgctgtctttttatttttgggcgtcccatctcagcgcatccacagctttgtcttcgcgcaaaacctttgctcttttggagcgaccaccattgtctggcccgtctttattcatccatccatggagatccttgctctcttgctgctgaccggggaaccatttgacttacccaccgagagatgacgatgatgggtgcgcacagaagagacctttaatgaatctatcaagatttttttggggggtagaccggtcgggttgtggagcatatcatcgtcctaatcatcatcatctgctgatcttcctcctctttctgctgaccggggagctgtcgaatccagagctcgcgggcggcggcgacgatgccatggtgatcgtcgtcgtgctggcgccatcgcttgtgcagctgaggtagccggcgtccaggtccagcaccccggtcgggctccggggagcagacatggcgggggagtaggcactgcgcaggcctgcagttttaggtggtggcacggtggcgccggtggcctggatcatcgcttcatggcaactcagcacccgctccttatctacgtgggtgcagcaagccgccttatggacggcgtgttcttccccggccacggcggcggccaccgtcgcggcgatctccga

SEQ ID NO: 68180 - DNA, 613 bp, Triticum aestivum
  Clone ID: PAT_TA_68180
ttctccttcggtcatggacagctatcatgaaacgccggctcaagctaaaatgtctcacattatgagtttaaatgccctccacaacttatattactgtctttacaccctcaacaggttccccactttgtttgtgagttcctggtctcaccttttcactaatcatgcagtacaactgctagccattttaaacaagggcaactcttgcctcaccaaactatgctagatcaagccattcaaccatactgtccattattttcggtctctaccactgccatcgccagtttgccacccctaaagtacagctcctacaccgccatttattctctggcatgcttcaggtatccttgactcctgaaattcacatttcggacttgcgcatcagaaagattcacatgatctaaacctctgaaaccctgcttccacaataagacaattcaccacatacttccactacatcgaagcacacgatgttgtagtccggatgtgtaatgctcatctctcgttcacggaaatttccggtactatcccatatgataatgccacaatactcccagtgaatcatcaaattgtttactatatattttctctttaccgctagctactgccatcaaaa

SEQ ID NO: 68181 - DNA, 595 bp, Triticum aestivum
  unsure (1)..(595): unsure at all n locations
  Clone ID: PAT_TA_68181
ttatattgctattattnatggnagaaacccacataatattcttgtctacattgccaccctcgttcctcggatatgatacttgtatcgccagacgcagacgaggaagtagccaaaattgagtgtcgctgccaccgccagtgtccaatacacgttgtctagtctcccttggtctatgttccccggcagccacgccgtgacccgcctcacgatatctacaaacaccgtgcttatgtagaaccccatcgcgatgagcagcggcgccatggccgtagccaggctccgtagcgtcttggggaactccatgtagtagaaggccatgttccccgggaagtggagggcctctccagccccgacgacgcccagtgggagcaggagccacaacacggacatgggcgtgccgccggggtgcgcgcgcatgccgctaagcctccggcgctccaccagcgcagcggcgaccatgcctgcaatgttcaccacatggccgaggcccacgcgctgtagcggggacgcaggggtgtctgtgatcttgtgccagagagggaagactgcgcggtccaggaccggggttgccacgatgaatgcgacgagggagcag

SEQ ID NO: 68182 - DNA, 307 bp, Triticum aestivum
  unsure (1)..(307): unsure at all n locations
  Clone ID: PAT_TA_68182
agcatggtttctttttagtccaatnacattgtaacttactccctccataacataatataagacgttttttgacaccatgacagtgtcaaaaacttcttatattatgttacagagagagtatcatcttaagctaagccatggtgcctgcagtttgtccatccaagccaacagcagttgtccattgctgggctcacactgagaaacttgacctatgtctcatgtacaattacgaagcatgccgtaaaaaacaaaatgctagcgagctcttatattgacctaagaaagcaggaatttggtttcctgtgtg

SEQ ID NO: 68183 - DNA, 164 bp, Triticum aestivum
  unsure (1)..(164): unsure at all n locations
  Clone ID: PAT_TA_68183
gggctgaaggcagcaacattcgtgcaacatcctttattacattacaaagaaaaacggaaacataaatttctgcatnacatgggctgaaaggaagcaacattcatgcaacagcctttattagattacanagaaaacggaaacatatncttatgcataacatggag

SEQ ID NO: 68184 - DNA, 117 bp, Triticum aestivum
  unsure (1)..(117): unsure at all n locations
  Clone ID: PAT_TA_68184
agccaaggtaggatgatccatatcttggaaattggngacttctgcngntcgcgcttcttgatgatctgctcaggtcgacccatcttcttntcctgcgcctttgcaaagcgcatgtta

SEQ ID NO: 68185 - DNA, 474 bp, Triticum aestivum
  Clone ID: PAT_TA_68185
acacatgcgaataactttggtccacgattcagttcgagctacagaggaaatagcgaactaaacaagtcagggtctcatcaggcttttggaatctgcaggcggcgacaaagagcgacgaccgtcggccggacggccctagccgccgaagccgtagagggtgcggccctggcgcttgagcgcgtagacgacgtccatggcggtgacggtcttgcggcgggcgtgctcggtgtaggtgacggcgtcgcggatgacgttctcgaggaagatcttgagcacgccgcgggtctcctcgtagatgaggccggagatgcgcttcacgccgcccctccgcgccaggcgccggatcgccggcttggtgatgccctggatgttgtcgcgcagaaccttcctgtggcgcttggcgccgcccttgccgagacccttgcctcccttgccgcgcccggacatggctgtggaatgggactgggaggaagc

SEQ ID NO: 68186 - DNA, 289 bp, Triticum aestivum
  Clone ID: PAT_TA_68186
aattcatctgttttttcagcataatctgtagctcctccttcgttggacattgaagaaaacgctgcccggttctttattgcgtggtacaagaaccgcagtttacatatctactatcgacatgaggttcttctacaactcgacaacagtaactattctgatgtcttccctttgtgaaagaagggagggaggctataacttatggggcattgctacacctctggccctgacgcgaagaggttgacaaggccccggcaggcttggacagacacttcgcaggcctgaaaaagct

SEQ ID NO: 68187 - DNA, 677 bp, Triticum aestivum
  unsure (1)..(677): unsure at all n locations
  Clone ID: PAT_TA_68187
gtttaagnnttcaaaaacattgatacaaactcggnacaaactaaaacttcagcaatagctaaaggacaataaacacacaaaagnagttagnattccaaaacattgaaaatccttggaaaggaatctgaatcctctttggtttgctatatgaatcatgtgctcgatcatataccatcttgctcctgcacaaggaggccgagcgcagcgaggtggatgtcgatgtcatccgggaccgggtgagcttcaacatccctcggaagctgcaacaatgcccatcgtccgtcctccgtcctcaccatgcccttattctcctcctgccgccacccgggaggcaccatgtgctcgtctctaagaaagtcggcggccttgttgaccagcgccgggtcccttccaccgagctcgaacggctggccatgtgcccggtagccgtcgagtaggtggaggtgcgcctctaggttgtggtagctcgccaggtctccggtgggtttgaggaatggcgacacaatgtggtccagcgcgagctcgacgccgacgtgggtgtacacgctcggcacccttagcgcatccgccacccgcagcagcaccgccgggaatatcacctcgttgaacagaaaaccgggcaccttaggcaccatgtcgtgcacgttgcggatgcgcagcgccttcacgcccagctc

SEQ ID NO: 68188 - DNA, 608 bp, Triticum aestivum
  unsure (1)..(608): unsure at all n locations
  Clone ID: PAT_TA_68188
taagctcacacgacagnactagcctgcaacagnagtatatgccgatgataatactgtagttcccaatggtaaactggcaaactaactaccagcgtttagcagttacaagcatataaattacagtacacgagcatcgtgtgatcgagttccacttgtcttccactgcaaacagaccgccagccaggttgatgggaacaacacatcagctattctaaccctgcccttgattctccggatcgcttcatcagaatgagaatcatctcctcttgacggctccgtagttcctcgtgacccgaggcggaggtttcttaggcttgtcatcttcgtcgctgtcatcgtctttgctcatcaccatgcttggcatggaaccagtgtcggctttcctccctcttttcgcagtggtagtgcctctggcccgacctctgcctctaggagccggccttttccgtccactttgtgggaaactgtcctcgggatctgaatttttcaacaacttcatatacttcgttcgctgcgtcctcatctgaggaagagtccaccttctcactgcgaatagcagcacttgaccttgattgactgaaactaagggtggtttgtttcaatgagcc

SEQ ID NO: 68189 - DNA, 460 bp, Triticum aestivum
  unsure (1)..(460): unsure at all n locations
  Clone ID: PAT_TA_68189
atatgncagnggtagntaacattacattacatggtaccaaattagtccgcatgcccatcactaactgaaggcctgctgagcaactcaccgctggtaaaacagaatgacaaatacaaactgcatttcgacaccagaaatcaactaaaatgcggtgcgaacgaaagggtgatttgggtgtgctgataaagcatccctgaacgcagacactatggcatcaccggtgcgagccccatccagaacgatcttctcaaggcgtaacaggtgctccaggccaactggtacagcgcgttccccccatgtggagattttgaggtctcgtaggttgggcatggcccccgccttgaaccctaggtaagccccaacaccttccatagcaggaaaatgtgaggctcttcagaaaccgggaacagtcccgtgcccaatctaactctttcttttgggatatttaacgccatgagcc

SEQ ID NO: 68190 - DNA, 657 bp, Triticum aestivum
  unsure (1)..(657): unsure at all n locations
  Clone ID: PAT_TA_68190
catataggtaactanntgcatgnacataacgttaacatattcggnatacacactaacaaacagcataattaattcttgttcaaggtaataataggacttggnaaaactttagtgttcaacactaaacaaaactggcgacttgaaggacggcacacagcttagtcgtcgaacaggctgaatcccatctcgccatctgattcctcctcgggctcgtccttcttctcctcctccttaggggcagcggcggcagcaccaccggaggcagcagcagcaggggcagcaacggcaaacttgctcgggtccttgaggtactccttgatcttatcggcatggtcatatgagtagtctgtctccaaagcaaccgcaagaacattcttgtatgcgttgaggaacatgtgcggcgcagcagccatggtggggtatgagatcgccagggacagtgaggcaaccatggaaacaccagaagcaaacttgtccatcaggtcttcctcagtaaggtcaagaacctcagggctgaagacagacccacttgtcacccttcttgatcagctccactgggatagtaatttccacagtacccttgttaatcttggtgggaatgttaagcacctggaagaaggacgtctgggagggatccagaccagtgttgccaggggg

SEQ ID NO: 68191 - DNA, 498 bp, Triticum aestivum
  unsure (1)..(498): unsure at all n locations
  Clone ID: PAT_TA_68191
aacaactcaccatttttgcagcaacaacaacaaccaccatttacacagtcaacaacaaccatcgttttcacaacagccaccaatttcacagcagcagcagcagcaacaacaacaacaacaaccatttacacagcaacaacaaccaccattttcacaacagccaccaatttcacagcagcaacaaccaccattttcgcagcaacaacaaccaccattttcacagcaacaacaaataccagttattcatccatctgttttgcagcagctaaacccatgcaaggtattcctccagcagcagtgcatccctgtggcaatgcagcgatgtcttgctaggtcacaaatgttgcagcagagcatttgccatgtgatgcagcaacaatgttgccagcagttgcggcaaatccccgagcaatcccgccatgagtcaatccgtgctatcatntactctatcatcctgcagcagcagcagcagcaacaacaacaacaacnacagggtca

SEQ ID NO: 68192 - DNA, 488 bp, Triticum aestivum
  unsure (1)..(488): unsure at all n locations
  Clone ID: PAT_TA_68192
actggagaaggttttatgttggtttaccgtcttccgtcaagaaagtttctgattctatatttgaaaacggttttcttggaggggatgccattgatacttatgaaaagatgaaaaccatatttgggcacccaaacggggataaggttgaatcaactacccttatgtgctttcatcaaaatgaaataatcagagagatgaaggctaatttagatacgaattttcgcaacgtgcttaatctttcttctgctatcaatggatatgtgctttcacaaaatagaaaattaaataccattgattagaaattttctctttgctttcaaaaggataaagatgacaaaacttagatccttgctttataccaagctaagggcgtaaaactatagcacttcttgggaggcaacccgatgaataaaatttatttttgctttttgctttctgttcttgagtgtttgcacaattatgctattgttatgattgngttttaatta

SEQ ID NO: 68193 - DNA, 591 bp, Triticum aestivum
  Clone ID: PAT_TA_68193
gcaaggactcagatttcttaattgggtatccattttattgatgggaagtctctccattcttttccgtcaatgtttttatccggtgattctcaggaagatactaacggagcttcaagttcatcattcttcattcttttcttctccgatggattcaattcaagctttgtcaatcatatcctttcctcatttcaaatgctttcttatgccagtgcacctcttaatcactcacctcttgctattcatttgttccggagtgttgaagataactcggaagattcgtgtttccattctcaatccgttcgagttattttgagagtattatctcattcaagtcatttaattcaaccggtgcaatctctctttaaaatcgtttaacggtgtttctcttgagtgggcccataacccacaggtcttttgccaggatcttacctgactcttttattttccgggagccattcccaaattcatttccaggtttgatgtaagaatgaattttcatcagtcacatgccttctccaaggtcgttttcaaattcttttcatctttggctcaacctttttttcttttaatccttccagagtgtctcaacaa

SEQ ID NO: 68194 - DNA, 489 bp, Triticum aestivum
  Clone ID: PAT_TA_68194
ccgtcttcgccctcggcaagtcctccatcgacatggtggacccaacacaagtattcatcctttccaatctgaaaaaggtgttgccgaaagcttaccctcttccacacggatgctacagccgctatcacttttgcaggaggggaattacagagttcgcctctcgacatcttgtttggaggacaatgaagatgataggctcagcattttgcctgatgatgttttgctcaacattgttgagcgacttgatattgctgacgccacaagaaccaccatcctctccagacgttggaagcagatccctgcaatgctatcaaaagttgttataatggctggttcttttgaacccaagcacacaacaagcaagttaacctcagatgatataattcggttcaacagcaccatgctggaagcaaccaggagcatactggaaaggagggctagaactttatacaccattcacctgttgcgcatgcaattctacttgggaga

SEQ ID NO: 68195 - DNA, 454 bp, Triticum aestivum
  Clone ID: PAT_TA_68195
ggttttctcccataatttagttcataatgctgatgaagagccgataaatgcccttgaatatgcagtctttccaaatggtagcagtcacttgagtaatctaaatatgagtaaactggcagctgaaagcaacagcaagttccctacacaatcacagcatggtaatgggcacaagaaaggatctttgctgagcccgactggacctgtgtatctctaccaaaacctgaatggcgatagctcaaacactgatgtacctggacgacatgcaaaggctaattcacgaagtcctggctcgtccatgctgaataatcacctgaatactgatggtgaatatgccaaccttctttcaagtcaaagggggactggttatcaggtccaaccaatggatgcagtctatgccccttacttgcaggcaaaccccaactctccccttggtgcagctggaagcatgagtcct

SEQ ID NO: 68196 - DNA, 376 bp, Triticum aestivum
  unsure (1)..(376): unsure at all n locations
  Clone ID: PAT_TA_68196
tcggcacgaggcaacaacaaatcgcccagcaaccacaacaactcccccaacaacaacaaatcccccaacaaccacaactatttccccaacaacaacaattcccccagcancaatcaccccaacaacaacaatttccccaacagcaattgcccgcaacaggaattgnccacnncaacaacaattgccgcaacaacnaatgcgnccagnaaccacaacagactcccccaacaacaacgaatgcngcaacagccgacgantatttncccaacancancanttncncnagcancaatcaccccaacagacagcaatttcgncaacngacagattgcgccnacancancanttaccgtaacaacaattccnncaaccacaa

SEQ ID NO: 68197 - DNA, 323 bp, Triticum aestivum
  Clone ID: PAT_TA_68197
tcggcacgaggcagcagagcacagggccggcggcctttaactctccaaggcctagcctgcagctcccccccacaggagcagatcacgcccgccatggccagcctgcagctccctccacaggagcagatcacgcccgccatggccagcctgcagctccccccacagcagcagatcacacccgtgcgcgcgcacccgaggccgcccctggcctcctccaaccgcgcaagcaggccaagccgactcccgcccccctctcctatcatgcctttcccttctctctctaatctctcacatgttttctccaggtagtccgtcatgaagac

SEQ ID NO: 68198 - DNA, 232 bp, Triticum aestivum
  unsure (1)..(232): unsure at all n locations
  Clone ID: PAT_TA_68198
ggnctgcaggnaattcggcacgaggctggnagttggtgcctactgataaggaaaggtctctagtaatatatagttggatcaccgttgtttagtcgatggatatgtcgatgcagcggtgacaaataaagtgtcacacaacgtcgtgtgtgacccgcccaaactagttgtttaaattctgaaataaaatacaaataaagttgtatcaagacaatgttcatattgaaaaaaaaaa

SEQ ID NO: 68199 - DNA, 377 bp, Triticum aestivum
  Clone ID: PAT_TA_68199
ttcggcacgaggcacagttgtgccaagccggatgggggaagataactcaccttcctttggacaacaaccatcccagatccaccatatgctctcaatcaatactcctactagtcatccttatttaactgtgaaacgagacctagctttgagaagacccggtagttaagggagccagcaggactgaacatgatacaggcaactcgactagacttggggaatcgatccagatctgaattaaacaactcatcattgctttgatgtgtcgatggatgggtcatctgttgacattaactgaaggtggatccatgacactatcacatgttgtcacatggtcatggggctggtttgttgcactgatcgagattatcccatggttt

SEQ ID NO: 68200 - DNA, 538 bp, Triticum aestivum
  Clone ID: PAT_TA_68200
tcggcacgagggcgccacccttaggcagccgcccctcccggcttggggggcaagtttcctagggggtgggggcgcccaaacccatctagggtttcccctgtggccgccgcccatcccctagggaaccctagggcgcctccccctcctcccttccccctatatatagtgagggagagagagggcagccgcacccttcccctggcgcagcccctccctcctccaacacctcctcctcctccgtagtgcttggcgaagccctaccggagaaccacgagctccatcaccaccatgccgtcgtggtgtcggagttctccctcaacttctcctctccccttgctggatcaagaaggaggagacgtccccccctgtacatgtgttgaacgcggaggcaccgttgttcggtgcttagatcggattcggccacgatctgaatcgctttgtgaaattctccaccgaccgcgttcttgtaacgcttccgcatcgcgatcttcaagggtatgaagatgcactcccctctctcttgttgctagtctctcca

SEQ ID NO: 68201 - DNA, 595 bp, Triticum aestivum
  unsure (1)..(595): unsure at all n locations
  Clone ID: PAT_TA_68201
gctcaaccgtccctcgctaactagccaaagnaccttcaacaactgtgtcgaggcaacaaacgctgatgattggctcatggatatctgcaagcatttcgagtgcaacaacgtcaggcctgaggactttgtcaagtttgcctcgttccgactcaaagaccaagctgtagaatggtttcagcaatacaaagattccaaaggaggccgtgtgattacctgggatgaattccgtcaagacttcaaagctcaccacattcctcagagtgttgttgagagcaagtgtgaggaattctgcaacctgaagcaaggcagcctgtttgtttaccagtataacatcatgttccagaaactcgctcatttcaccaagcaggacgtccccgacgagaagagaatgatttaccagttcagaggtggcctcagagaagatcttcaacttgctcttgtgcttttcgagcctcagaagtacgatgagttttacaacatggcactgaaacaagaggctgctcagcttaagtacgatgcttccaagaagcgagtcagagatgcaactccttcttcctcaactcaagtggctgcttagcagcaaaaagtattggct

SEQ ID NO: 68202 - DNA, 704 bp, Triticum aestivum
  Clone ID: PAT_TA_68202
caagtaagtagtatttaacgcaaatccaccatgaagaccttactcatcctaacaatccttgcgatggcaacaacaatcgccactgccaatatgcaggtcgaccctagcagccgagtacaatggccacaagaacgacctttcccccagtcccaacaaccattctcccagcaaccacaacaaatatttccccaaccccaacaaacattcccccatcaaccacaacaagcatttccccaacctcaacaaacattcccccatcgaccacaacaacaatttccccagccccagcaaccacaacaaccatttccccagccccaacaaccccaactaccatttccccgacaaccacaacaaccattcccccagactcaacaaccccaacaaccatttccccaacaaccacaacaaccattcccccagactcaacaaccccaacaaccatttccccagctccagcaaccacaacaaccttttccccagccccaacaacaattaccgcagccccaacaaccgcaacaatcattcccccaacaacaacggtcattcattcaaccatctctacaacaacagttgaacccatgcaagaatatcctcttgcaacaatgcaaacctgcgtcattggtgtcatccctctggtcaataatctggccacaaagcgattgccaagtgatgcggcaacaatgctgccaacaactagcacagat

SEQ ID NO: 68203 - DNA, 625 bp, Triticum aestivum
  unsure (1)..(625): unsure at all n locations
  Clone ID: PAT_TA_68203
ggcgggatctaaactcccttacctttgacaggcttggcgagcgatatccggaccgattaactttccagctccgctgcccgaagacccagccccagctctactagtgaagctgctggttccggcgccttatgtggtgccggagaagaaggccaagaagaagaagaccacggggactcgaaagagtgcccgtaacgtggtggntgtcggactcgtcatccgacgagtccgagacgccctcttcccgtgaaaacgaggaggaggaagaagaaaactctccccccccagcggagggaggagagaagaggaaggtcgccccaacgggggaggccgaggggtctaggaaaaggaagacccctccgccggactacgcccccaacgccgaagggggcaaagaggagtggccaaacagggccaagcgtccggcaaaatcgtaagtttggatatcagaataactcatgatgttcctttgttgcacagctttccgtaatgtcgaatgtaattatgcagtccgccccgggccgaattcgacgaatcgtcgggcggctccctggactcatcggacgtgaactcggttccgcccgctgtctccccccgcactgcagacgacgccgaagtggcgtcgcga

SEQ ID NO: 68204 - DNA, 613 bp, Triticum aestivum
  Clone ID: PAT_TA_68204
gcctcgtgccgaattcggcacgaggggaccgacccgctgccccaaccagcgacagcccggtttcccgcctccacagctcgccacttgcatgaagggcgcgtggcgagcgcgcagggtcgaaaggacgggtgaggcgaccgttccccgccccgtgatcagggggcgtggttaaagactgcgaccgggtccatccagtaaatgagccgcacctccacgcctccctctttttacggggaaggcgcgagctgcctctttaccacgatgtgacgcatgcatgcggaaaccgcccaacgcatgtcgcccacgtcatgcgcacccctccacgtcgcgcgttcaacgcgggtcgtggggaagcgcagcagacggaaaattaccgcggtaaaaaccacccctcctgcccgcgcaccattttgggcctggcccaacaacgtgtcgcgcttatgtgtggcccaggcccgggggcccctgtcggtgtacaaaagtaggggcgcacctttgtagccctttacctgtgcacggacagtcggagccgcacccacggccgcaccaagcagagcaggggaaggaaccggagagaagccgaagcacaagatgcccaaggcaacgccagggc

SEQ ID NO: 68205 - DNA, 567 bp, Triticum aestivum
  Clone ID: PAT_TA_68205
gcccccaccgttgccgttgcagagcccgccacgccacgccgcccatggactacgagcgcatccacgacccgccccaccgccagtcgggcggattctcgccggccaagctgcgagcgatgcttctcgggctcgagaagcaccagcactccggcgaggacacctcgcccgaggccaacgactccggcgagctcgacgaccggaggagcttggaatgctccacctccaccgagatgtccagcaacagcggccacagatcaaggaaccgggctccggaggacgacagcttcgactccgagagcagctcttcggggccgacaacggttaagagggccgcggcggtgtctgctctgctgccgccgttctctagaccgacgccgtcgaaatgggacgacgccgagaagtggatttcgagcccgacggcgaaccgtactggccgtgtggatgaccgccgcagggtttgcgccgaagaagacggcatttgctttacctgagcacggtgcctgcccgccagccgctgctaaggtggtcgccgaggtgccgagaaacaccggaacattgactgataat

SEQ ID NO: 68206 - DNA, 687 bp, Triticum aestivum
  unsure (1)..(687): unsure at all n locations
  Clone ID: PAT_TA_68206
ttccctccttgctatcgtggcgaccaccgccacaactgcagttagagttncagtgccncaattgcagccgcaaaatccatctctgcaacaaccacaagagcaagttccattggtgcaacaacaacaatttncagggcagcaacaaacatttccaccacaacaaccatatccgcagccgcaaccatttccaggacaacaaccatatccgcagncgcaactatttccacagncgnaaccttttccgccacaacttccatatccgcagccgnaaccatttcccccacaacaaccatatccacaaccgcaaacacatcatctgcaaccacaacaaccaatttcgcagcaacaagtacaacaacaacaacaacaacaacaacaacaacaacaacaacaacaacaacaacaacaacaacaacaacaactactactacaacaacaaatccttcaacaaatnntgcaacaacaacaactgattncatgcagggatgtcagtcgtnttgcaacagcacancatagcggatgaaagntcacaagtattgcagcaaggtagtnaccaagtgttgcaacaatgatgttgtcagcagctgnggntgatccccgagcagtcgcggcgccaagccatccacaatgtcgatgatgctattattctacatcaacaacaacaacaacaacaacaacgacnacaac

SEQ ID NO: 68207 - DNA, 723 bp, Triticum aestivum
  unsure (1)..(723): unsure at all n locations
  Clone ID: PAT_TA_68207
gcagcttcgctccgggctcctcattccgtgcccttcctgctaacatcagcagctccgcccctcctgctaacatcagcagcttcgctcagggctcctcatcccgtgcccctcctgctaaaatcaccagcttccctctgggcttctcatcccgtgcccctcctgctaaaatcatcagctctgctccggactcctcattccatgcccttcctgctaacgtcaccagcttcgcccctcttgctaacatcagcagctcctctccgggcttctcattccgngcccttcctgctaacatcagcagctccgntccgggctcctcatcccgtgctcctcctgctaaaatcaccagctctgctctgggctcctcgncccgtgcccctcctgttaaaatcaccagctccgctccgggctcctcatcccgtgcccctctngctaaaancaccagctccgncccgggctccttattctttgcccttcctgctaacatcaacagctctgcccctcctgctaacatcagcaactccgctccgggctcctcatccgngcccctcatgctaaaatcaccagctctgctctgggctcctcatcccgtgcccctcctgctaaaatcagcagctccgctccgggctcctcattccgngcccttcctgctaacatcagcagctccgctccaagctcctcatcctgngctttnncctggttaacatcagcagctccgctccgggc

SEQ ID NO: 68208 - DNA, 623 bp, Triticum aestivum
  unsure (1)..(623): unsure at all n locations
  Clone ID: PAT_TA_68208
ggagaattcttaattaagnagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagggttccgttactaacatgtttacttccattgtaggtaacgtatttggtttcaaagccctacgtgctctacgtttggaggatctacgaattccccctacttattcaaaaactttccaaggcccgcctcatggtatccaagttgaaagagataagttgaacaagtatggtcgtcctttattgggatgtactattaaaccaaaattgggattatccgcaaaaaattatggtagagcgtgttatgagtgtctacgtggtg

SEQ ID NO: 68209 - DNA, 713 bp, Triticum aestivum
  Clone ID: PAT_TA_68209
ttcggcacgaggcctcgtgccgcgcaaatccaccatgaagaccttactcatcctaacaatccttgcgatggcaacaacaatcgccactgccaatatgcaggtcgaccctagcagccgagtacaatggccacaagaacgacctttcccccagtcccaacaaccattcccccagcctcaacaaccccaacaaccatttccccagtcacagcaaccacaacaaccttttccccaaccccaacaacaatttccgcagccccaacaaccacaacaatcattcccccaacaacaacaactgatgattcagtcatttctacaacaacagatgaacccctgcaagaattttctcttgcagcaatgcaaccctatgtcattggtgtcatctctcgtgtcaataatcttgccacgaagtgattgccaggtgatgcagcaacaatgttgccaacaactagcacaaattcctcaacagctccagtgcgcagccatccacagcgtcgcgcattccatcatcatgcagcaagaacaacaacaaggcgtgcagatcctgcgaccactatttcagctcgcccagggtctgggtatcatccaacctcaacaaccagctcaattggaggggatcaggtcattggtattgaaaactcttccaaccatgtgcaacgtgtatgtcccacctgactgctccaccattcaacgtaccatatgccagcatagacgcc

SEQ ID NO: 68210 - DNA, 628 bp, Triticum aestivum
  unsure (1)..(628): unsure at all n locations
  Clone ID: PAT_TA_68210
gaattcggcacgagggcaaacccgangttcttcatgattcttatggggacacctgaggaggagcgagtcaaaacaaaggcaactgtaagcttttcactatgataatttagcaattcctctttgttctcttcttcaagatcatacagggcaaactctgtcattggaacataaccagcactccttatcttctgaatcaaaacactcagcttttcatatatttctttggtgttcggatgtgatctatctccagcaataaaggtatgaaccccatcacctagggttacccaactgcgaccagcctcttttttcactgctgctccccccattacagctcgggttttggctgtatcttcccaccttcctgttgctgcataaaagttagatgcaagaacatagtttacaggattttgaggttctagttccaaaagcatccttgaagcttctagccccatatctatcttgtccctgtccttccattgtcgacaagcaactaatacagtcctccatatgagagtatttggtttcattggcattcttctgatgtattctcgtatcttgatgagcttgccagctcgaccaagaaggtctataacacaagaataatgttcaatctgaggtaatataccat

SEQ ID NO: 68211 - DNA, 596 bp, Triticum aestivum
  Clone ID: PAT_TA_68211
ttcggcacgagggttgtttcaccctaatctctcccgattcctgggattctccatcgcaatccccttctctaaggaccattgccgctacctgcattgtgtgatttgagccgtgtgtcatagatcatcctgttcctgggatgggggaatcgcagagtattcaagattgttccaagtttggagcttttgttcacaggattcctggtgctgaattgggcaatgttggtgacatgatgatccactacacgagtggtagtacttcacaggcagggggggctaagatgagaaggccattaccttctccacggttcacaatgtatgattctgcgatgattgcaagcaataagagtgttgtggagttccctagtgatggtctacccgacgagcagtcgttagcatctgcttttggggacatgagcttaaagaattatacagctgattctctcacaagtaccagagattttgtgccagtaaatgggtactatccatctggccctgctaattatcactcagggattacgcctccagatgttacattgaacccgtcgcttgtgccagcaattgttcaagatgatttgacgttctgtgctgaacacgtt

SEQ ID NO: 68212 - DNA, 331 bp, Triticum aestivum
  unsure (1)..(331): unsure at all n locations
  Clone ID: PAT_TA_68212
atctagtacttggagnatcataagtatctcgncactctaaactaatattgttgggttgttaattacttcaattaggattgagttggaggaaccttctcaatgatgtttcaactaccatgatagttaaataaaatatattcctttgttgtaggaaaaaattggcttttcgcaaaaactataaccatagagatttccaccagccaaatatgtatgtagtgatagcattattctattcttgctctactgtgttatcttgccagcatatnccatgtgctgacccattttcgggccgcaacgtactatgttgcagactttncagacgaggagtaag

SEQ ID NO: 68213 - DNA, 192 bp, Triticum aestivum
  Clone ID: PAT_TA_68213
gggctatgttattttgataagacataattgcttagttagtatgcttgaagtattattgtttttatgtcaatattaaaacttttatcttgaatcatatcaaatttgaacattcatgccacaatgagaagaattacattgaaattatgcctagtagcactccgcatcaaaaattctgtttttatcatttaccta

SEQ ID NO: 68214 - DNA, 634 bp, Triticum aestivum
  Clone ID: PAT_TA_68214
ttcggcacgaggcacgtctctaccgcctggggcgagtcaccttcaattggaatggcctccagccgtgcagcagcggcaacgagattgtccatcgggttggagtagtgacctggaggtgttgaaacagcctgaggtataacagtgttttgacgaggcagatccatcagacggggctgaaccggcgcgccggtcctaggagcttccgcccggtttccctctagcggattactggttcctgctcctgaggtgttgaaaaggtctctggcctcgaaaaccgaaggcaaacgggatcggtacttcctcttcatgacttcatgcgacgcgttctggtccaacatgagcctgtaggcttgtgcgtctaaagcggcccgctctgcggtcatcctggcattctcagctgccaggtccgccttggcttgggtgatctgttccttcaccttttcaatctccgcgttgtggacgacctgatccaccgggttagcttctgccataagcacaaccattgcatcaaatagatctgatagaacttgagccggcgggcgtacagagcttcctgccccggcagctgtcgccgctactgaaccggaggttattggcacagcggtcgaagaatgaagcgctgcttgtgtgccgg

SEQ ID NO: 68215 - DNA, 700 bp, Triticum aestivum
  Clone ID: PAT_TA_68215
gggcaagcaagcagtagtaaccacaaatccaagatgaagaccttcctcatctttgtcctccttgccatggcgatgaagatcgccactgccgctagggagttaaaccctagcaacaaagagttacaatcacctcaacaatcattttcccatcagcaacaaccatttccaccacaacagccatatccgcagccgcaaccatttccatcacaacaaccatatctgcagctgcaaccatttccacagccgcaactaccatatccgcagccgcaaccatttcgaccacaacaaccatatccacagccgcaaccacagtattcgcaaccacaacaaccaatttcgcagcagcagcagcagcagcagcaacaacaacaacaacaacaacaaatcctacaacaaattttgcaacaacaactgattccatgcagggatgttgtattgcaacaacacaacatagcgcatggaagctcacaagttttgcaagaaagtacttaccagctggtgcaacaattgtgttgtcagcagctgtggcagatccccgagcagtcgcggtgccaagccatccacaatgttgttcatgctattattctgcatcaacaacaccaccaccaccaacaacaacaacaacaacaacaacaacaaccgttgagccaagtctccttccaacagcctcagcaacaatatccatcaggccagggcttct

SEQ ID NO: 68216 - DNA, 834 bp, Triticum aestivum
  unsure (1)..(834): unsure at all n locations
  Clone ID: PAT_TA_68216
agagagaactagtcccgagnatggctaagcggctggtcctctttgcggcagtagtcatcgccctcgtggctctcaccaccgctgaaggtgaggcctctaggcaactacagtgtgagcgcgagctccaggagagctcgcttgaggcatgccggcaggtcgtggaccaacagttggccggtcggctgccatggagcacggggctccagatgcgatgctgccagcagctccgagatgttagcgccaagtgccgctctgtcgccgtcagccaagtcgcaagacaatatgagcaaactgtggtgccgcccaagggcggatccttctaccctggggtcatattatccaggccaagcttctccacaacagccaggacaagggcaacagcctggcaaatggcaagaaccaggacaagggcaacaatggtactacccaacttctctgcagcagccaggacaagggcaacagataggaaaagggaaacaagggtactacccaacttctctgcagcaaccaggacaagggcaacaaataggacaagggcaacaagggtactacccaacttctccgcagcacacaggacaaaggcaacaaccagnacaagggcaacaaataggacaagggcaacaaccagaacaagggcaacaaccaggacaatggcaacaaggggtactatncaacttntccacatcactaggacaagggcatcaancagggacaanggcntcaatcaggacaagggcaacaagggcnctacccannttnatgtncannaggncaggacannggcatcaagggccantancnagcttntnnncnnnangcagnacaagggcnaca

SEQ ID NO: 68217 - DNA, 619 bp, Triticum aestivum
  Clone ID: PAT_TA_68217
cagcagcagtagcagatgcagctggtatggacgccgctgtcgaaggagcctttcaatgggggagagccaccgtggagatgttgtttgcggcgccgacttcaatgtagctgccccatgggggtgcggatcgagcactgtcggcgccgggaggttgagttaaggaggaggtgtgatacgatgagtgtacatcctcattggtggtgccgagtaggcctcagcttcgtccgaggagtcggtgaggatgatgtggttccgatggagcaggttaaggcggctctatggcgacggattagtcgtgatggacgaggcgatcgtcggagcagctccttggaggtggaggaccgtgcggttgaaccggcggaacgacgagatcgatgatggatcctcaactagggaggtggatgagggacttcaagctattgcgatggacggcatcgttggggaagatgctccggttgggcagcggtggggtggcggacggaggagggtggggttttgatgctggacagaggttatcgaggcgtgggatttagaatggcgaaaaggaggtgatgggaggggggaaccatgacttagggacgcgtttgtccaaaatctagggcctgttacagaagtaccc

SEQ ID NO: 68218 - DNA, 557 bp, Triticum aestivum
  unsure (1)..(557): unsure at all n locations
  Clone ID: PAT_TA_68218
aacatcaaatncccccagcaactcacaacaattcccccagcaacaattcccccaacaacagcaattcccccaacaacaccaatccccccgacaacaattcccacaacaacaattcccccaacagcaattgccgcaacaggaattctcacaacaacaaatctcccagcaaccacaacaactccnccagcaacaacaaatcccccagcaaccacnncaatttcttcaacaacaacaatnnccccagcaacaacccccccaacaacatcaatttcncnaacagcagttgccccaacaacaacaaatgtnttcaacagncaacaaataccnnagcaaccacancaaatacnccaacaacaacaaatccnncagnanccaaaacanttnccncaacagcanttcccgcaacancaatttccncancagcaattnccgcancaggaattacnacancaacaacaattccgcgcaacaacnggatggtccagcaaccacaacnacntcccgtgatnacaacaaatcctgtnncaaccacaactnttttgntaacaacancnntt

SEQ ID NO: 68219 - DNA, 806 bp, Triticum aestivum
  unsure (1)..(806): unsure at all n locations
  Clone ID: PAT_TA_68219
aggaattcggcacgaggcctccttcttctgcgccctaggagccccgccgccgccctgctgctactcctccaccggcccacctcttcctcctccccgccttccatcgctcgcgtgcaggccatcgtggccacgcgctttgcgggtgaacccgaccggcccgtcactgttggctcgagctgctgggaagagggaggagtctggagacagcgtgcaggcacaggccgtgcctggtgaggcggcgccgccggccatgggacactggacctcggggagccccatcctaggcccgcgcccaaattcttgggcaggggaggatagatcgacgatggcggatcacataagggaatgggagatcgaggagaagggagacgagggtgggtggtggcttgcagcatggggcgggcacgtccaacgagggtggtgttctgtggatctgctgccccctctcctttggcgacctcctcctcctcatctgctgccgatggctgtgagttcacggctgctccggagctccaacgagccaagttgtgtgcaaatccgacaaagaagagaaaaggaagaatattgaggaagagttttggtgaagaagaacaaatggaaggatcggtttttatggcatggactacaaaggagagaagtggaccgtgtgaacgtagtacaacattgttgttagttcgcgcagtcgaggtctgctcaggaagacacagttcgatcgaataactgttgtgttttcccagttgtttgcaaatccgacgaaaaggagcaaagaaaagaatattgaggaatatttaggtnaagaagaacaa

SEQ ID NO: 68220 - DNA, 393 bp, Triticum aestivum
  Clone ID: PAT_TA_68220
cgtggcaggccccaccgttctccggctccgccccagggccgcctccctgtccgcgccggccatctccgcccctcctcgctgccgcctcagctccgtagcttactcctatcccaagcttgcaggatcatttgcagttcaaagggtaaatggaagtaggatgcagtacttgggcactctaaaagaacaagttctaaggagctccagcaaccatgatggacatattaagcgaattgtttcctgcactgctagcgacaaacaggagccaatcgcttcacttacctcggacacgccggtcttagaagataccaagagcaatactgcagattcccctgcatctttgggctccgattttactgagaggagtgctggaaaaccgggattcatctcatttca

SEQ ID NO: 68221 - DNA, 795 bp, Triticum aestivum
  Clone ID: PAT_TA_68221
caccgaaaacagatccaaccccaccacaccaatccatccgcccccatctccatccccgtcgcccgatccgatccgatccctcgccatggcaccgtcgttctggggccccgagttccccccgcagccggctgcggtgttcgacgacctcgcgcccgtggaggcggaggacgcgtacgaggacgagatggaggaggaggaggagggcgagggggacgaggagcatgagcacggcagcgacggggaggtcgtcccgatggacatcgaggacctgggggaggcgcacctctcctgcggctgcggccgcaacctgctcaccctgtgcttccggggcgttgtgcacatcttcatgtccgcctcccctgacaaggtgtcgcaggtggaagctgcactttcgctgcaggggcgattggatccggcggactctacgactgtgccgcccgccgcgcgcaacacgctcaccatgaccttccggggccaggagtgcagtttcgactctgtaacccctgacgaggtgcaagatgtacttttgtcgctcgcgggaagggagctgatggtccctaggattgagctcaaaatggagttcctgcacgggagctacgacttcgactctgtatcccctgataagttgcaagctgtactttcgctgctggggggaatggagctgacggtctctacggctctgccatgtgccaacaaccagctcactgaacccttgatatgctggatcgacgtgttcgaccctgtattccctgataagatgcaagctttactttcgctgctcgggggaaacgagct

SEQ ID NO: 68222 - DNA, 532 bp, Triticum aestivum
  Clone ID: PAT_TA_68222
gcaggtttgttcctcaatcggcagcttgtttgccggcgtttctctgttcttgatacttcctcgcctgtctggtttttgcttgatctgttccttggctgtgatgatcaaaatacctacctattttctgagggatttcgacccccctgcagagaaaccagttcattcttctgagccttccaagatctgtgcagtttcttgatttttgcgctcgatcttattttgcaaccgattctgaaaaaccagatttgagttgatgggaagataatctctggcagaaaatcgtttttagtgttgaccaaaattacagactacaattatctgatcaactctcgaatctcgctgaacctctctgttctttcgcctctctgtatcttcacctgattatcttggtttctgcgttttatcctttttttgaccgattggggaaagtagatttaattaatggttgatgtgatgataatctttcacagaaaatcatatttagtgttgaccaaattacagactacaattatctgatcaactctagaatctc

SEQ ID NO: 68223 - DNA, 692 bp, Triticum aestivum
  Clone ID: PAT_TA_68223
ggtcgttcggtcctgctctctgcacacgagcgcaaacgttttgagaacgtcatcaaactctgggattggagactcctttccttggatttctggggccgtgaaatgggaaggaaatggcacgccgtcgcggcactgggcatggcgtacgctgtcgccgccgccgtcgcggatggcgacaagggcctctccttcgccggcaccgttgcagggccggaggaagcgagctccccgcgcaagctggccagcttgtacggaaccacttatcaccacgtctggccgcccatgaaatttggatggcgaattgtgttaggatcattcattggattcttcggggcagcatttggcagcgttggtggagtaggcggaggcgggatctttgttccaatgctaacgttgatcattggctttgatccgaagtcatcagcagccatgtcaaaatgtatgatcacgggagctgctgtttcaaccgtgtattgcaatctcaagctgaaacacccaactttggacatgccaatgatagactatgatctagccctcctgatacagcccatgctcatgatgggggttagcattggggttatctgcaatgtgatattccccgagtggcttgtcacaatcctcttgatcatcctctttctagttactgcgattaaagcttttctgaagggtgttgaagcatggaagaaagagac

SEQ ID NO: 68224 - DNA, 603 bp, Triticum aestivum
  Clone ID: PAT_TA_68224
gagcagatctaggcggggatggcgatggcgtgctgagggttgaatccagctcccaatcaaggtatcggctattcttcctctaatcgactcgggtcttattgctttgatctagatcaagatcaaggtatcggctattactcctctaattgactcggtcttattgctatgttctagataaagatcagaagaactcgctaccggtaaagcacctttgtggcccacccaagaatcagatctaggatggcgtgctgtgatggctgaatccacctcccggtgagctggaattggtcctactagccagatggcaactaaggcttccgataaagaacgtgctcctccttgctagatcccccacctttgtcatgtctgtccttctccaccaccagatccatcgaggtccgggcaacattaagcacctcctccttggatcagataattcaagtcatcgtcatcactcgctctggtagcgaaagagttgggagtggcaggcgccatggatggaggctctggtgctattggcctagacaggggctttgtttgccatcgacgtctaccgatgtgccgtccgtttgacgtttcaagcattgttcaccgtcggagtcc

SEQ ID NO: 68225 - DNA, 489 bp, Triticum aestivum
  unsure (1)..(489): unsure at all n locations
  Clone ID: PAT_TA_68225
cccccgacaacaattcccacaacaacaattnccccaacagcaattgccgcancaggaattctcacaacaacaaatntcccagcaaccacaacaactcccccagnaacaacaaatcccccagcaaccacaacaatttctccaacaacaacagattcccccagcaacaacccccccnacaacatcaatttccccaacagcaattgccccaacaacaacaaatccccnaacaacaacaaatcccccagnaaccacaacaaatcccccaacaacancanatgcnccagcnnccaaaacaggttgccccaacaacaattacccgctacancaanttccncaacagcaattcccgcaacaggaattcccacaagcaacaacaattgcccgcancaacaaatngcgccagaaaccacaacaactntccncaacancaacaaatcccccaacanccacanctattttncncaacaacaacaattncccccagcanca

SEQ ID NO: 68226 - DNA, 185 bp, Triticum aestivum
  unsure (1)..(185): unsure at all n locations
  Clone ID: PAT_TA_68226
cttacatgngatacatgacttaggctgagaagatatacncnggcanggtgctactgtcctcttggcaggagtaactgaggtgacgaccgagagatggacgacggtgcaacggcaaccgcaggaggaggaggaggagcaagcagnntttttcaccacctcatcggatcgaggattgaggagcaccg

SEQ ID NO: 68227 - DNA, 682 bp, Triticum aestivum
  Clone ID: PAT_TA_68227
tcggcacgaggcaccgactgacatgcacttgatgcataaggtggctagcaggtgtctgtctctcccactttagtcggatcggattcgatgaagagggtccttatgaagggtaaatagcaattggcatatcaccgttgtggcttttgcgtaggtaagaaacgttcttgctagaaacccatagcagccacgtaaaacatgcaacaacaattagaggacgtctaacttgtttttgcaaggtatgctatgtgatgtgatatggccaaaaggatgtgatgaattatatatatgtgatgtatgagattgatcatgttcttgtaataggaatcacgacttgcatgtcgatgagtatgacaaccggcaggagccataggagttgtcttaatttattgtatgacctgcgtgtcaatgtaaaacgccatgtaattactttactttattgctaactgttagccatagtagtagaagtaatagttggcgagacaacttcatgaagacacgatgatggagatcatggtgtcatgccggtgacgaaggtgatcatgccgcgcctcaaagatggagatcaaaaggcgcaagatgatattggccatatcatgtcactttatgatttgcatgtgatgtttgtcatgtttacatcttatttgcttagaacgacggtagcataaataagatgatccctcac

SEQ ID NO: 68228 - DNA, 691 bp, Triticum aestivum
  Clone ID: PAT_TA_68228
ccaggacgtgaagcgcaagggggctccgtgctcgcggcagaactagagaccaagcggggcagagatcagcccgagtcttccaagggcagccggtactgtgtgtaccacgacctatcaaagcaacgatcgaggctacggctgaggaggaggaaggaacgtaggacgctgggaagaccgcggccctcgccaagggtggcgcaatcgaccttgcgaggatcgctggcaggatcagcctcgtgagggagactggagggatcagcctcgcgaggatcgtccgcaaggaaacgcaggcctccctcctctgccgccgcagccaaggagaaacgaggaccatcatcaggacgagggggctgggggcttccaagagccgcgcgcgatcgcctgcatcctgggcggagctcaggccccagcctctcaaagcatcttcaagcaattcacccgcgaagtgaatgcagtcctccccaagctcgaagccacgcgccctctcaggtggtcagcgtgcgccatcacgttcagctcagcggatcagctcaagtgcacggccacagcccggagtcctcccgatgctttgctccccaatcatcagcaacgtgcaagtcaccaggaccctcatcgatggcggggcagggctcaacatcctgtccgtagagacattaaacaatctccaaatgccttacaatcagcttcagcc

SEQ ID NO: 68229 - DNA, 873 bp, Triticum aestivum
  unsure (1)..(873): unsure at all n locations
  Clone ID: PAT_TA_68229
tttattatgaatagctgcatgtatgcattagctttattggttatatacgaatttactaacagattatgtgattttctttgttaaattgctccctgaataacctttagcaagcagcttgctgcaagctatatatgatcagttttataagttcagtttggtgctacttttggttggttggttgatcaaatgctcatgtactttggagatttatgttacgtgcatttttgttctcttgcattgcacattttcgtttacattgaaattcctgatatgtttgacagctagcccatggagaacaaattaaagaccattatttaggctatccaagccattttacaaggttgttgttgaccggaaggttaagatatactttgaaagacaatcttcatttatttgtatcagtacttgctggccacatattcatatcatgttgggcacacctataatttgatgctacattttgcacgatttttgtgtttgtgcttaggggaggtttattgatgctaacatcactttggaagatgttactgctcagagaactctcggaatcacatccatgacaaggcacgtaattatacagaaggagaacaaattaaagaccattatttaggctatccaagctattttacaaggttgttgttgaccggaaggttaagatatactttgaaagacaatcttcatttatttgtatcagtacttgctggccacatattcatctcatgttgggcacacctataatttgatgctacattttgcaggatttttgggtttgtgcttangggaggtttattgatgctggcatcaccttggaagagntactgctcaaagaactttcggaatnacatncatgacanggcncataattntcngaag

SEQ ID NO: 68230 - DNA, 259 bp, Triticum aestivum
  Clone ID: PAT_TA_68230
ggcacgagggttctttttgccaacatgatcgatgccgaatcaagagcgctgctgctctgtgccggtgtgctttgccattctttctaccaagagactgggatttcagatcggtgaaagatggcattgctctcgtttttgctgatgtgtttggttggtatgatgtgtagatggattcagctactgctgctctttggtttgttagacactaactgctactccctccttcccctaatataagaggtttttgacaaaaaaaaaa

SEQ ID NO: 68231 - DNA, 353 bp, Triticum aestivum
  unsure (1)..(353): unsure at all n locations
  Clone ID: PAT_TA_68231
gctctcaccctttccctccctctggatccaccgccgccgcgcacaactcctccttctggatccaccgtcgccgcccccaaccccactccctccctctggatctcgacgtgccgccgccccctcacactctcaccgccgtgggctggaggtgcaacactggatccagtccagggcaccaccatcatacagnancaccaccagccggcgtcgtgggtggggtgctgcgcccgaccaagtctgccccctgcctccccgtgcccgaccgctcgctccgcctcaacctcgccgtctccaaggacctgcgccgncgcctctaggatcacgtcttcgcgctcaaggaggactccacgctg

SEQ ID NO: 68232 - DNA, 523 bp, Triticum aestivum
  unsure (1)..(523): unsure at all n locations
  Clone ID: PAT_TA_68232
caacaacaacaaccaccattttcacagcaacaacaaccaccattttcgcagcaacagcaatcacnattttcgnaacaacagcaacaaccacgatttttgcagcngacancaaccaccgttttcacancagcgancantttcacagnagcaacaaccaccattttcncagcancaacaaccacaattttcacagcaacagcagccaccatattcgcagcaacaacagccaccatattcgcagcaacaacaaccaccattttcgcagcancagnaaccaccattttcgnagcaacaacnnccaccatttttgcagnancaacaacaaccnccattnacacagcaacaacaaccatngttttcacaanagccaccaatttgacagcagcagcagcagcancaacancaacaacaaccatttacacagcaacaacnaccancattttcacaacagccaccaatttcacagnagcaacaaccaccattttcgcagcaacaacaaccaccattttcacagcaacaacaa

SEQ ID NO: 68233 - DNA, 646 bp, Triticum aestivum
  unsure (1)..(646): unsure at all n locations
  Clone ID: PAT_TA_68233
ttcggcacgaggcatttatgaacttagtgtgatttcaagnatgattgtgcaaatagaacattgttctcaatagtggttctatggctcaatctaaggaatcaaaggtcctgccggtgaatcaatatatactaagcttgtttcacataaattatgaaattatgtgaaagcacgatagatgcattgaaatgcaaatgatacacatggatctgaagattgtcatatttgataagacgaagtctataccataagcaaagcatggactgacaccgtattgccattggtgtaaaagttgaagtgtgcaacatcccaaatttccaatttggaatgttttacaattagagctaagcatctgtgcattttgtttgatttgaatgtgccatttgaatttgcaaggtttcatttgacttcatttcaaaatggcatttgaattatattcaaaaatatttgacaagatacgttgatcaaaaagtatgaaaggaggtaacatgacaccccaaaatattcataagaaataatgccaagatatttgaaagttaaatttggttttatttggactgttcaaaaaaatgtttttataaagtaatttatttgcctctagagaatagttcatgtttcaggatattttctcctcatcattttgatatat

SEQ ID NO: 68234 - DNA, 591 bp, Triticum aestivum
  unsure (1)..(591): unsure at all n locations
  Clone ID: PAT_TA_68234
ggggtgggacacctatgattctttntgcagcatgatgtgcaagagctcaatagagttctatgcgagaaacttgaagacaaaatgaagggaactgttgtggaaggaacaattgaacaactatttgaaggccaccacattaattacatcgagtgcattaatgttgactataaatctaacagaaaagagtccttttatgatctacaacttgatgtcaaaggttgtcatgatgtttatgcatcatttgataaatatgtcgaagtggagcgtctagagggtgataacaaataccaggctgaacaacatggcttacaggatgcaagaaagggcgtactctttcttgatttccctcctgttttgcaacttcaactgaagcgtttcgaatatgattacatgcgagacacaatggttaagattaatgaccgttatgagttcccactacaactcgatcttgataaggatgatggaaaatatcttactccagatgcagatagaagtattaggaacctttacactcttcacagtgttcttgttcatagtggaggagtacatggtggtcactactacgctttcatacggcctacactctcagac

SEQ ID NO: 68235 - DNA, 616 bp, Triticum aestivum
  unsure (1)..(616): unsure at all n locations
  Clone ID: PAT_TA_68235
gtcttaattnagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagggttccgttactaacatgtttacttccattgtaggtaacgtatttggtttcaaagccctacgtgctctacgtttggaggatctacgaattccccctacttattcaaaaactttccaaggcccgcctcatggtatccaagttgaaagagataagttgaacaagtatggtcgtcctttattgggatgtactattaaaccaaaattgggattatccgcaaaaaattatggtagagcgtgttatgagtgtctacgtggtg

SEQ ID NO: 68236 - DNA, 313 bp, Triticum aestivum
  Clone ID: PAT_TA_68236
gcactctcgctcgctccgtccgtctccgtccggcgagcccgcccgcgcctgcggcgatggccgtgagcaacaacatcacggcgtgcctcaacttcctggccctaatctgcaccatcctcggcgtgctcctcctcctcgtcgccctcgcgggcttcgtcggcgcctactggaaccgccagggcctgctggccgcctacctcttcgccatggcggccctcatcacgctcctcctggcgctcctcgtcttcgccttcgccgtcacccacggctccggggcgtacgacgtgcccggccgcgcctaccgcgagtaccg

SEQ ID NO: 68237 - DNA, 101 bp, Triticum aestivum
  Clone ID: PAT_TA_68237
ggggacgccatttctgggtgcatcacctggatcccgaggtcccaggagaagggcacgtacccggagggtgctcagaaggagaggtgggacgagtggcaggg

SEQ ID NO: 68238 - DNA, 552 bp, Triticum aestivum
  Clone ID: PAT_TA_68238
gatgtatctccctccttcgctctggcgccgtctgctcctactgcctcaacctggacaacctgccgcatgatgactcagccacctgccgcagctgcaattgctgcgtccaccgccactgcatccccgctgagcaccgtactgccctgatccagcctgtagatttggagaatttcgtctgcgtcgattgctgccctacagtaaaggtgggtagcaagaatgtgggcgccgaatctgttcctaagctggagttggtcatcagagagcctagtcctgcagtgcggaggaagggggggcctgtcgctgctgctaagttgaattcgccgaggaaggttgtggaggaggtgaggccagcttggaaggatgcgatggccctcgttcctgtaggcgaggagtcagagagcaagggtcccagtgatccggacctgccagacgaggcattggcgctgcagcttcatttggcgatcaacgggtcaccgaggatttcacgttctggcagtgcatctgtgtctgtcttggcagggcagggcaagaggcagggcaagaggcagaatg

SEQ ID NO: 68239 - DNA, 625 bp, Triticum aestivum
  Clone ID: PAT_TA_68239
gctaagacgagggggctgggggcttccaggagccgcacgctatcgcctgcctcttgggcggagctaaagccccagcctcacagcgtatcttcaaacagtttgctcgtgaagtgaatgtggtcctccccaagttcgaggccacgcgcccgctcaggtggtccaagtgcgccatcaccttcagttcggcagatcagctcaagtgcgcagctaccgctggagccctcccaattctttgttcactagtcatcagcaacgtgcaagttaccaagaccctcatcgacggcggcgcagggctcaacatcctatccgtcgacatgttcaacaaccttcaagtgccatatgaccagcttcagcctaccaagcctttctcaggagtgactgacggttccaccacaccgatagggcaggtccgcctccctgtcaccttcggagaatgcaacaactaccgcaccgagctcatcgacttcgacgtcacctacatccgcgtgccatataacgtgatcctcgggtacccggccctggccaagttcatggcggtgacccatcacggctacaatgtactcaagatgtcgggaagcggcggaatcatcacagtcccgtgcgaagaaagagatgcggtgtgctc

SEQ ID NO: 68240 - DNA, 627 bp, Triticum aestivum
  unsure (1)..(627): unsure at all n locations
  Clone ID: PAT_TA_68240
gttgaattctactttntagtccgagnatacaatgtctactgtaggtattgcatgttattacctcttccaaattaagaagccatttgaataaacttgatggacctcgattattagatgttctgttttgcaggttaatataaggtttagaaactaagactgctgtaaaaagaaacatgttctgattcactcagatgcaaaccctcctaattccatccctcaaacctcgtgtaacatatttctagcgcatataggtgcttattttctatgttttctacatttttggagtttccataaatttagtttgtgctacggataatacatggtagtatattaagtttgaattcatgatcatgttctctcgtctgctatatagaatttagtttgacctgcataaatcacttgaagagagggataaaaggagagggagagagatgcatgttgtgaaggagcaagcccatcaattctaaatatgatccatgtgctgagaaatttctgtttaattcaattgtacggttagtacgttcatacttgatatacaagcagttttgtacatgaagaatgcatgtgcggagagaggtttacttagggcagctcaaatcccatcttgagctctaatatctctattat

SEQ ID NO: 68241 - DNA, 648 bp, Triticum aestivum
  Clone ID: PAT_TA_68241
ggtgctgagattatgtgcttcattgcattaaataccctcccctctccgcataatttataagaatttcacatctagcttgtgtcatgtgtgcatttattgaacgcagagcgacacggtaagtgccttggttcagtggtcagaccgccggttcggcggcccactgtgttggttcaaataaaatagtattgcgcagttttttagtatggtagaaagaatgttaagtatgaagaaaacaaacgaactgcctagttagttattcgactgaggtagtcggccttgctgacagtccgattctttgcacatacagaatattttattaacccctggtcccgtgcttgtttggtttgttcaaccgggttttccctggttcacatcaggttgctcggctaaacagccgtaaccgtgatcaagattggaacagggggaacagccttcaccgtgaactagattggaacagggcttggttctcgtttattctggttaaactagtggtctggtcggttttaataatgatgcacgtgtcagcagtagtattgaaaaggtttattttttaagttgagctattgcaaaagttaacttttcaaccttgaacttttgaaactggttgtgtgtaactgtgaactaccaatggatccccaacaacagctt

SEQ ID NO: 68242 - DNA, 564 bp, Triticum aestivum
  unsure (1)..(564): unsure at all n locations
  Clone ID: PAT_TA_68242
gcaatnatctgcatcctatccgnatccaacaggcgcttggtgttggattatgggatcataccacaccccgcatcaccagatatgcactcgtcattcatcgtcgacggtgagacattccatgctcaccgagcagtgcttgctgcccactcaccggccttcagagcagagctcttcaattcaatgtctaaggctacaatgtcatccatcacgctgcacgacatcacacctgaaacattcaaagttatgctctggttcatatacacggatgaattgcccatggaagacgagcatgaggactcttccactgagatgttccaagacctgtttgctgcggctgatcgttatgcactagaccgactaaagattatttgcgcccaaaagttgtgagagaaagtgtcagtagatatagntgcaactatcttagcttctgccgaaacctacaactgtcaggagttaaagaacaagtgcattgacttctttgtagtggaggaaaattgcaagaaggctatgtncacgtatggntatgtgttgatggntttgaaatccatagagattattgntgag

SEQ ID NO: 68243 - DNA, 603 bp, Triticum aestivum
  Clone ID: PAT_TA_68243
gatgttattgatgctttaatttaaacccccctatctgtcagataagtctcatgtatcctgtgtgatgtcttttgaaatgtataatcttcctagtaatttagaagatgctaggctatatgttggcacaacatggattgaaatacgttaaatgctagaactggtcgcacatacttttacttttcttacatcttgacaaggtttgttatctgttgcacaaaattattagcgatcatgacttacatcatgcatttttgtttttgatagaactttgaagtatttttttagagttgtcacatgtttacactgttgtagtttattttttttacagcaccactgtgtcacccctataggttgggttatagagacatgctattatgcatagcatgagtcatgccttctcttacaagtttttttttggcaacatatagagagttgcatagctttatgtgcatatatgcttttgcactattttggggtttctaatgaccttcatgctgccaccgattttgcgttgctggcaccaggagtgtgctgctggcatcattgccgttggactgctgtgggcctccccctgttgactagaatggacctcccccttggtgt

SEQ ID NO: 68244 - DNA, 585 bp, Triticum aestivum
  Clone ID: PAT_TA_68244
ccccccggctccatggcggcgaaggaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggcgtcaagatggagttgatcgatgccgcatttccacttctcaagggagttgttgcaacaactgatgttgtcgaggcctgcactggtgtgaatgttgcggttatggttggtggattccccaggaaggaaggaatggaaaggaaggatgttatgacgaaaaatgtttcaatctacaaagctcaagcatctgctcttgaagctcatgcagcccccaactgcaaggttttggttgttgccaacccagcaaacaccaatgctctcatcctgaaggagtttgctccatctatccctgagaagaacatcagttgtttgacccgcctagaccacaacagggcactcggtcagatttctgagagacttggtgtccaagtttcttgacgtgaagaatgctattatctggggtaatcactcgtc

SEQ ID NO: 68245 - DNA, 543 bp, Triticum aestivum
  Clone ID: PAT_TA_68245
accctcctttttctactatattccaccatcgaacctatctagccattggggttgaaaagatcaccaaattttaccttccaatcccacttcaaatttgtgccctctagctttgtttcttcctttcaacaaacaagctcttctcacttcacttcaaatttcagggacataatcttctattggtattcgatcagccggatcaccaaaaatctgactcggatggaattctagtatatgatgccttggtggttggtttgtgctctcattagttgggggattggtactctcatttgtgcgaggggtagtggtctcatcggctgggggatcaatactctcatttgttgtaggggggatagtgctctcatcgacattggtagagggattagtgctctcatttgttggagttgagtgaattaagttctcaactggggctggttgaacaagaacatcagttgggggagtattgggttcaggaacaatgggggatgcgtttgaattgcttgcaaaccaactgtgcaaggtcctctttcttttcatttctacaaa

SEQ ID NO: 68246 - DNA, 172 bp, Triticum aestivum
  unsure (1)..(172): unsure at all n locations
  Clone ID: PAT_TA_68246
ccttgncctgattgttgccattgncctggntgntgcccttgncctanctgctgnggagaagntggatagtacccttgntgccattgncctggntgntgcccttgntctggntgntgcccttgnnctatttgntgnccttgnactggntgntgnctttgncctgngngctgng

SEQ ID NO: 68247 - DNA, 555 bp, Triticum aestivum
  Clone ID: PAT_TA_68247
cgaaatccgcagcagtcgacaggaggccaaggcgccgccatggcccgtacgaagcagaccgcccgcaagtccaccggcggcaaggcgccccgcaagcagctcgccaccaaggcggcgaggaagtctgcgccgacgaccggcggagtgaagaagccccaccgctacaggcccgggaccgtggcgctccgggagatccgcaagtaccagaagagcacggagctgctgatccgcaagctgcctttccagcgcctggtccgcgagatcgcgcaggacttcaagacggacctcaggttccagagccacgccgtgctggccctccaggaggcggccgaggcgtacctggtggggctgttcgaggacaccaacctgtgcgccatccacgccaagcgcgtcaccatcatgcccaaggacatccagctcgcccgccgcatccgtggcgagagggcctaagctgccccctccgccgacgccgttagtgagtcggaatgagttgattctggttgtagtttgttcctaattgctgtgctaggtctctctgcttttgtgtagaagaaa

SEQ ID NO: 68248 - DNA, 650 bp, Triticum aestivum
  Clone ID: PAT_TA_68248
ggtaatgcatggggccgatcgtgatataatgtggctccagcgggacttccgagtgtatgtgtgcaatctttttgacacaggacaggcttcaagggttttacagatggaacggaacagcctagaacacctattacatcatttctgtggagtcacagcgaataaaacatatcaaaatgcagattggaggtcaaggccactctctgatgaaatgatcaagtatgcgagagaagatacacattatctgttgtatatatatgacttgatgagacttagactacaaagggagtccacatgtgaaaacgatcttcttttagaggttcaaaagcgcagtaatgatatttgcttacagttgtatgaaaaggagctgctgacagataaatcttacctccacatatacgggttgcaggaacatgaattggccgcagctcagctggcttgttgtttctgctctacatcagtggagagattatatagctcgtgaacaagatgagagcactggttatgtattgccaaacaaggctttgattgagatagcaaagaagatgcctacaaccactgcagatttgcgaagaatcgtgaaaacaaaatatccatgtgttgaggataattttgacctaatcttggacatcgtatggaatgcaactgaaaat

SEQ ID NO: 68249 - DNA, 148 bp, Triticum aestivum
  Clone ID: PAT_TA_68249
ggcaaggtgtatctgggcacccatgagccagcgcgggactcacggggccctacctctaggcgggttgcgcctggcactgggccttatcttgtgatgtgtccctgcaaatttggttagatgtcggcactctacgtcctcgggtcccggc

SEQ ID NO: 68250 - DNA, 574 bp, Triticum aestivum
  Clone ID: PAT_TA_68250
ttcggcacgaggcttactctctctctgctcgctcgccttctcttccgcccctacgacacctccgcctcccttcacccgccttgtctctcctccccctccttccccccttccgcctcctcttctaattccactgctaccgccaccgccatctcgtccctagctgtatgggacggtgtccacttcgctcgctctgccgagtgcggctacgagtatgagcagtcattcgccttcctccccctcctcccagcctcaatcgctctactctcccggtccctgttcgcgctgctggtgccgatgctggggtacagggccgtgcttgtgatctccgggcatgttctgaacaatgtggcatttgttgccgccgcggcctatttctacagattatctgtgctgatcttgaaggactcaggagcggcttaccgtgcatctgttcttttttgcttcaatccagcttctgtgttctactcgtcactatattcagaaagtctttatgcccttttttcgctcggagggctgttctacctgttttccggtgctcgtaccgttgcaatgataatgcttgctctatctggtt

SEQ ID NO: 68251 - DNA, 101 bp, Triticum aestivum
  unsure (1)..(101): unsure at all n locations
  Clone ID: PAT_TA_68251
atattgctngacnccattgcgccatttggcatcatgagtactaactgagaagagaagaactctattactagatatatgaaacaccgttttcttaaaacatg

SEQ ID NO: 68252 - DNA, 610 bp, Triticum aestivum
  unsure (1)..(610): unsure at all n locations
  Clone ID: PAT_TA_68252
attaacaaatggtcagggnccaagnagnaacaataccaaaatggacttatctggaaatcattgtgaaagagatactttgacgaccgtaggcagcgtcaacagtggcattgagatgttgactaagctcgaggaggagttgaaatcatgccgaaaagagcttgctgcatcaaaagaagtatcaaagaagttaattatggaaaggaatatgctcgaacagaggattcaaaggcttgagagagcaaaaagtgaagagaaaagtacaatgcaaagagtttatgaggatgaatgtcgtaagttaaaagctcatacagctacactggagcaaaaattggaaagtgcaacacagtcattaaatgttgctgaatcaactctcgccttgagaaataccgaggtggattcattgcaaaatactctcaaggagcttgatgagttaagagagtttaaagcggatgtggacagaaagaaccaacagaccgctgagattcttaaaaggcaagggacacagttggttgagcttgaaagtctttataagcaagaacaggttttgcgaaaacgttactataacacaattgaagatatgaaaggaaaaataagagttttttgtcgcttg

SEQ ID NO: 68253 - DNA, 502 bp, Triticum aestivum
  Clone ID: PAT_TA_68253
aactgtggcacagggcaggcctgcaggggcgtgcaactgggcctggaagaggagaccggtggaggcagacccaggccttgaggtgctgcggtggccacgcggtcaacgtgaccatgacgagcagcgctcgtctcggttgcagaggcgggtcaatgaattcccccagagcagaagcagcggcgaggctcttgccgggaagaatcagggcggcggcagcgggcgtgcagggaaaggccggcgaggaccagactccagtggaggcgcgagggacttggcgtgagggcaccgcgatggagaagggaacatgcctctcgtcctcgccgttcgaagcagagaggcgctcggaggagctctggtttgttgactggtgctcgtctgcaggaggtggacgaggccgggacctggacaagggcgtcgtggatgtggcggtcggtggcagagatccatgcgacagcagcagtactggagaagcttcaggcggccatggcgttgaggcgaagta

SEQ ID NO: 68254 - DNA, 568 bp, Triticum aestivum
  Clone ID: PAT_TA_68254
gttcgtcgttcttcgttggaggcggagcaccggcagtttggtggccgccgttcgtcattcttcgttcgcacgcacgcttcaagggaatgtcgggattgtggttgctgaatggggacattgataggggtcatcgtgctgcgatatggtatgagcgcaaacttgagcctctggtcactcgcactcctaagaaaaactggatgatacactcaggatggcttcagcggttgaaatgggctggccttttacctttcgcgcgtctggttgagtctatactgggtgagaaacgcctcgccatcgatgggtccttgctgagctgcttagtggaccgttggaggccagagacccacacgttttacttcagatggggagagatggctcctactctggaggatgtgtcacttttgctcggactaccgttggcaggtcatgccgtaggaccgttggatgcaccggctggttgggagcgagctcttacacaacgttttcatggtgtttttctggatgctccggatccggtatgggagcatcacggacctaagtatgagtggttgctaaatttttggatcca

SEQ ID NO: 68255 - DNA, 612 bp, Triticum aestivum
  Clone ID: PAT_TA_68255
gccctcgtcccgtgtgcagccacccttctccatcaatccctcctccctctcgagcacccaccagctcctcccagcacagctcccgcgcgctcctcctctcgacccgccgccccggcgaaccatcgctgacgacctccttcttccagcgaggccccgctcccgtgcccgcgagttcgtctccgccatcttgcacccgccttggtcgcgcctccctcgctggccgtcccaagactgctcctcccctgcctcgggtcatggtgcgacgaccacgccggcaggactcccctccgtcgccggaagcactcccgcgcgctagtggagaccaacctccggagactccgatgctgcacctccggtgactaccgtccaggacgacccgcttcctcctgtgagctcccgaggcaccagcctcccatctgcgagatccggcgacgctagccaccaggacccgctgctctgcctcactcctcacccgtctgtccccgcatcgtctgccagtcgcccgcttcgcgctcgagctccctgcttactgccgctgaccactaccatggtttccttgctgctgccaccccggggtccttgcgttgtttctttcatttcagaacatctaga

SEQ ID NO: 68256 - DNA, 669 bp, Triticum aestivum
  Clone ID: PAT_TA_68256
cggcacgaggtagaattcttaattcaagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagggttccgttactaacatgtttacttccattgtaggtaacgtatttggtttcaaagccctacgtgctctacgtttggaggatctacgaattccccctacttattcaaaaactttccaaggcccgcctcatggtatccaagttgaaagagataagttgaacaagtatggtcgtcctttattgggatgtactattaaaccaaaattgggattatccgcaaaaaattatggtagagcgtgttatgagtgtctacgtggtggacttgattttaccaaagatgatgaaaacgtaaactc

SEQ ID NO: 68257 - DNA, 542 bp, Triticum aestivum
  unsure (1)..(542): unsure at all n locations
  Clone ID: PAT_TA_68257
gccgatgcgcgtgctcgtcaccggcgccgcaggnacaaatcggatatgctcttgttcccatgattgccaggggagttatgcttggtgcagaccagcctgttattctgcatatgctggatattgaatttgctgctgaagctcttaaaggcgtcaagatggagttgatcgatgccgcatttccacttctcaagggagttgttgcaacaactgatgttgttgaggcttgcactggtgtgaatgttgcggttatggttggtggattccccaggaaggaaggaatggaaaggaaggatgttatgacgaaaaatgtttcaatctacaaagctcaagcatctgctcttgaagctcatgcagcccccaattgcaaggttttggttgttgccaacccagcaaacaccaatgctctcatcctgaaggagtttgctccatctatccctgagaagaacatcagttgtttgacccgcctagaccacaacagggcactcggtcagatttctgagagacttggtgtccaagtttctgacgttaagaatgctattatc

SEQ ID NO: 68258 - DNA, 245 bp, Triticum aestivum
  Clone ID: PAT_TA_68258
gctcactcccctgaaaaaacaaaacaaacagtgcgcgctccactccccgtcacgcgacccggcgacgaacggccgcgcccatcgagcgcaccgccggcgccctcccatcccctctgccgggccttgttgccgtgttgtgcaacgtctccctgcgacaagccaatgatggccagagctgcacttcttcctgttgcgttgctgctgtgccttgcactggccgtcgtttttacaagcatacactgttg

SEQ ID NO: 68259 - DNA, 644 bp, Triticum aestivum
  Clone ID: PAT_TA_68259
gttagaattttgttgttgaggaagaggtgacctcaaagcctaaaaggaaggttgttgccaaagagcaacaagatcaacaatctaagaagggcaccagcaaagtcaagcagtcaactgttgctaagaagctgaacttgggagaggcagctgcaagcaaagtgaagaaaaccaccaagagaaagaggatagtgcatattgatcctcatgcagatgcagcagtagaggatgaggatgaggaagcaccccagcctcctcctcagaagcagaagctcatgggtgatgccattaaggctggagccacatcaaagcccaagaaatctgctccagctaaggcagctccagcaaagcctgctgccaagcccaagaggaccatcagaaacattccagcgtctgaaaagaacaaggatgatgtgccaccagctgtgtctgatgatgaaggaccagttttgctgaaacttcgtccaaaactgccactccataatgatgctcatcctcaagctgaggatatgaaggcaaggaaagataaaggtctcaagctatggagacaatctgacccatatgccgtgaggagaagaactgctgtagatcccagatttcacaccagagagcagcaggacttctatgagaccgtgctgatggacaag

SEQ ID NO: 68260 - DNA, 559 bp, Triticum aestivum
  unsure (1)..(559): unsure at all n locations
  Clone ID: PAT_TA_68260
atcaccccaacaacagcaatttccccaacaacaattnccccnacaacaacaattactgcaacaacaattcccccaaccacaacaaataccncaacancaacaattcncccagcaacaatnagccccaggcaacagcaatttgccccaacaacaattnccccaacaacaacaatnaccgcaacancaattcccccaaccacaaaaaataccccaacaacaacaaatccgncaacaaccacancaatttncncagcaacaattgcnccaacaacagcnatttnnccaacancaagaattnccccaacagcaattcccgcaacaacaattccaccaacaacnattaccacaacaacaattttngcaacaacaattccnccaacagcaattnccnnaanaacaacagntnnnncaacancancaattgacgcaacaacaattcccccggccacaacaatcccctgaacaacaacaattnccccaacaacantntctnccagcaaccaccacangaaattcctccaacaacantttccaataccatacccaccccagnaatcac

SEQ ID NO: 68261 - DNA, 590 bp, Triticum aestivum
  Clone ID: PAT_TA_68261
gcggagagtaaggtaacccattcgctcatcgattaggtattttgtacattcccatattttgcccattaccctattttgtacattcctatagattttgatgttcagttattgaatggcatgacaaatgatacaacattaggaagctaaaaggtcacaaagatcaaattcttttgatatataatatgccacattggcagcaatggcttatgggtagtatttcttaaaactaggtaagtattgaaaaaaaaactaatcagccatggtctgcttttattcagactgttcagccattacataggtccccttttgatgcattttcataaatatgcatttagcttatgtactaggttggtcttcaacaattaattagtggcaaatcaatttctcttcttgtgtaaacatcttggatctcactttctctagaaacaaaacatccaaactttttcctagagaagcccaaacgaattcatgccccatctagggcggccaagaccatagtcgtggctcatctcttctaaatatttgtttgtgtctgatgtcctcatctcagattgtggtggtgttgcggtaagagtggaaccaaacttcct

SEQ ID NO: 68262 - DNA, 718 bp, Triticum aestivum
  unsure (1)..(718): unsure at all n locations
  Clone ID: PAT_TA_68262
ggnctgcaggnaattcggcacgaggggcaacaaggtcaacagccggnacaagggcaacaaccaggacaaggacaacaaggtcaacagccaggacaagggcaacaaccaggacaagggcaacaaggtcagcagctcggacaaggacaacaagggtactacccaacttctctgcaacagtcgggacaagggcaaccagggtactacccaacttntctgcancagctaggacaagggcaatnagggtactacccaacttntccgcancaaccaggacaagggcagcagccaggacaattgcaacaaccagcacaagggcatgcaaccagaacaagggcaacaaggtcancagncaggacaagggcaacaaggncagcaaccaggtacaagggcancaaccggttacaagggcaaccagggtactacccaacttatgcgcatcagtcaggacaagggcaaccagggttctaccnaacttattcgcancaaccgcncaatngcancaaccaggtcaagggcancaaggtcatcaagtacgncaagggcaacaagctcatcaancaggacaagggcatcaaccgngacaagggcaatccagggtactacnnaacttatgngctncaggcangacaagggcantnaggggttttaccttactttatgcgcacaantaggncaagggcancnaggcaggtacaattgcancaatncagntcaaggg

SEQ ID NO: 68263 - DNA, 611 bp, Triticum aestivum
  Clone ID: PAT_TA_68263
agctaaccccggctccaatggcggcgaaggaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggtgtcaagatggagttgattgatgccgcatttccacttctcaagggagttgttgcaacaactgatgttgttgaggcctgcactggtgtgaatgttgcggttatggttggtggattccccaggaaggaaggaatggaaaggaaggatgttatgacgaaaaatgtttcaatctacaaagctcaagcatctgctcttgaagctcatgcagcccccaattgcaaggttctggttgttgccaacccagcaaacaccaatgctctcatcctgaaggagtttgctccatctatccctgagaagaacatcagttgtttgacccgcctagaccacaacagggcactcggtcagatttctgagagacttggtgtccaagtttctgacgtgaagaatgctattatctggggtaatcactcgtccagtcagtaccctgatgttaac

SEQ ID NO: 68264 - DNA, 334 bp, Triticum aestivum
  Clone ID: PAT_TA_68264
gtgccaacataactaacaggctatattctgacctaccttgctatcatgatcgtgcaaattgattagtgccttcctgctgttaacccacatggtgggctgataacccacagttccacaggatcgaaacctgactctcctatatatcctttattccgaagtatcatttgctcttggctttgtgtgttgtcacgagccaccatccgagagatgatctcttcctgatgctcggaaccccccgtctcacactctattcaggtatcgatcgtttgcccattcgcgtgaaacttcctattgtaccttcatattttgctctcgatgttttcttaagtttcaa

SEQ ID NO: 68265 - DNA, 338 bp, Triticum aestivum
  Clone ID: PAT_TA_68265
ggtctctaggctggcaatgcatggtaaaccggtcgctctaagccggggtgccacagagcggcttctccaggccatgggcgccagctttcagaagctcctggcgctccaccgcacctgcctggacaaggccaagtccaggatggcaacggtggacaaggctgaggcagacctcaagggacacgtcgccgaggcgcagacttggtaccgccaagcctgtgaggagctgaaggccgcccagagcgagctggccaggaataaggtggagctcaccatggagcgggccgacatcgagagggcccaggacacggcgaagaacctggccgccgcagccgaggccg

SEQ ID NO: 68266 - DNA, 557 bp, Triticum aestivum
  Clone ID: PAT_TA_68266
ggccgcctgtttctttttccccaatctccccaccattgttctctgtaggtggacgcagcaccgcgccaaggcagcagcaactcggtgacgttccaggcaaccccctctccgtccggtggtgccacgctaagccactgagcgagccgcatctgctcgttcttactctctaggcgcctggtggagttgcaacgcggtggccgtggggatgcgccgagccaccgccggggggctgcaccgtgttgagacgccgccaccccttcatggccgcggactccgcgtccattgcccacgccgtcctcactgatggcttctccgtcgacatcggcatgtctacgagcaggcaacgacggttatggcatcctcatcggtggagacggtcagctgctcaggagcatgggtcgaggcgagatggtggaagatgtggtgtctccctccgatggcgtccgcgggaatggccggatctgtgtctagaaaggcatgggaacgaccccggttgccgtccggcgagcgctggagtgggggcgggtggtggctgcagagtagcataggtgttatcc

SEQ ID NO: 68267 - DNA, 183 bp, Triticum aestivum
  unsure (1)..(183): unsure at all n locations
  Clone ID: PAT_TA_68267
ggttcggtgggttcttcggatcctgcttctacctcctgtgctgntgctgcctgctccaagtattgctgcggtcctctgttcggacacccggnccctggcggtccgtcgcctcctttntagcctgtggagctgcgggtcatatccaccacaagaaacaatgcacttgagaacaatttctagact

SEQ ID NO: 68268 - DNA, 598 bp, Triticum aestivum
  Clone ID: PAT_TA_68268
cgggctgcaggctgccgcaggcggtcgggtcgctggcgtccgtcgccggggaggccttcttcctgccgctctacgacctcttcctcacctacggcggcgtcttccgcctcaacttcgggcccaagtctttcctcatcgtctctgatccggatgtagctaagcatatcctgagggacaactccaaggcttattccaagggtatccttgcggaaatattggagtttgtgatgggcacaggtctgatcccggctgatggggaggtctggcgtgttcgacggcgtgccattgtaccagcattgcatcagaagtacgtgacagcgatgataggtctcttcggaaatgcttcagaccgtctgtgccagaagctggacaaggcggcatccgatggggaggatgtggagatggaatctctcttctctcgactaacgctggatgtcatcgggaaggcagtgttcaattatgattttgattcattatcttacgataatggaatagttgaggctgtgtatgtaacattacgggaagcggaaatgcggagcacatctcctattccaacttgggaaatacccatatggaaagacatctcccctcggcagag

SEQ ID NO: 68269 - DNA, 579 bp, Triticum aestivum
  unsure (1)..(579): unsure at all n locations
  Clone ID: PAT_TA_68269
gcggaggcggcgtcgaggggctcgganagcagcaacgtgctgtcgcagctcgccgcggagggccagtccaggatcgttggctggaacctggcgagagggtcgggggagagggaggttgtgcacgtgcaggaggagaacctgtcggccgacgggacgctcgtgctctccagctccggcgacagcgcacagtccatcgttttgcagcttgtgaagctgccgctggttgataagattcctccgtacaccacgtggatcttcctggacaaaaaccaaagaatggccgatgatcaatcaattgctggtaggaggagaatttactatgattcagctggcaacgaggctctaatctgcagtgaaagtgatgaagaaattccacaacctgaggaagagaagcatgttttcactgaaggagaagatcagctaatatggaaagctactcaggaacgcgggttaagtcaagaggatttaaatgttatctgtcagtttattgatgcatctccttcagaaatcgagggtagatctgaatttctttttgagaaacacgagaagcactctgaattttctgataagatagagagc

SEQ ID NO: 68270 - DNA, 202 bp, Triticum aestivum
  Clone ID: PAT_TA_68270
tggagctcctgtagctcgtcccctgcctcctcttcatgtgctcgagggagacgcgcctccagcgcatcgagcacaaggcgcaaccgcgccaaggtctaccccggccacctctgcgtccagccggcctaccccgggtccctgcagttatttgtcattggatactttagaaacattctgtaaattggtatcagttgcacacttt

SEQ ID NO: 68271 - DNA, 519 bp, Triticum aestivum
  unsure (1)..(519): unsure at all n locations
  Clone ID: PAT_TA_68271
gccctctccaacccaacagccttcccccagcaaccccaacaaccatttccccagccccaactaccattcccccagcaatcagaacaaataattccccagcanccccaacaaccattccccctgcaaccgcaacaacgattccccnagtanccncaacaacnatttnatgggngncancaaccaancnncgagnancnacancaatgattccccgnacagnnagcaagnatgnnnacnnnctnttgngcagcngnnagnattangtnactgaggcttcaacaacgagttgtgcagcataccagagcaaccatnacctntgctancgcaacaanggggnannanagacaacaggcangcaacttgtnccnncagacatcngcaacaatnatttccccagcaaggggggcgncgnttcccacngcaaccgnaacnncgattcnttcnncnaccacaacggccatttnnttcaacanccacaacaaccattccccctacgaccgcaacaaccatttncccagc

SEQ ID NO: 68272 - DNA, 598 bp, Triticum aestivum
  Clone ID: PAT_TA_68272
gaccagactgaagctcatgcagtgtcctggtccttttagcttgtttgaagaggtgttccagctagaagaggaagaaagaatcaaagaattaaggaacatcaaggaaagaagtatggccaagaagcaacatgttaatcatgggtggtctcctcccccaaatgagtttatgaaaattagcaccgatggatcttttcatgaagtaacaagtacaggcggatggggtttcgtaatcagaaatgatttgggcgatttgattgctgcagggtcaggaagcttggagcacttatcaaatgctctccatgccgaagcactagctatgctatatgctgttaacgccgcatctagaattggatgcagctgaatcatcctggagactgattctgcggcgctgaagcaagcagtttcaactgaagcttataatctagctgaactgggagctctttttcaggaaataaagcaccaattaagagtcgctttgatgatgtaaagttgaatgtttgttcaagaacatgtaacgtagctgcgcatactttggatgcgctaggaactgaattagggaatggcaatttcaacatctgggttggccattttcctgaat

SEQ ID NO: 68273 - DNA, 847 bp, Triticum aestivum
  unsure (1)..(847): unsure at all n locations
  Clone ID: PAT_TA_68273
cgagggggaaacctccgatctaagcgaagccaaggctctctcgtcctcctcctcaagatgcagatctttgtgaagaccctgaccggcaagaccatcaccctggaggttgagtcctcggacaccatcgacaacgtcaaggctaagatccaggacaaggagggcatccctccggatcagcagcgtctcatcttcgctggcaagcagctcgaggatggccgcacgctggctgactacaacatccagaaggagtccacactccaccttgtgctcaggctccgtggtggcatgcagatcttcgtcaagaccctgactggcaagaccatcaccctcgaggttgagtcctcggacaccatcgacaacgtcaaggctaagatccaggacaaggagggcattcccccggaccagcagcgtctcatctttgctggcaagcagctcgaggatggccgcacgctcgctgactacaacatccagaaggagtccaccctccacctggttctcaggcttcgtggtggcatgcagatcttcgtcaagaccctgaccggcaagaccatcaccctggaggtcgagtcgtctgacaccattgacaatgtgaaggccaagatccaggacaaggagggcattcccccggaccagcagcgtctcatctttgctggcaagcagcttgaggatggncgcacccttgcggatacaacatncagaaggagtccacccttcaccttgtcctncgncttcggggaggcatgcaaatctttggcaaganccttactggcaagatatcaccttggaggggagtcatttgaaccatcgacaacgngaagccaanatcagacaggngggattcccccgg

SEQ ID NO: 68274 - DNA, 611 bp, Triticum aestivum
  Clone ID: PAT_TA_68274
aatctaccccccggctccaatggcggcgaaggaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggcgtcaagatggagttgatcgatgccgcatttccacttctcaagggagttgttgcaacaactgatgttgttgaggcttgcactggtgtgaatgttgcggttatggttggtggattccccaggaaggaaggaatggaaaggaaggatgttatgacgaaaaatgtttcaatctacaaagctcaagcatctgctcttgaagctcatgcagcccccaattgcaaggttttggttgttgccaacccagcaaacaccaatgctctcatcctgaaggagtttgctccatctatccctgagaagaacatcagttgtttgacccgcctagaccacaacagggcactcggtcagatttctgagagacttggtgtccaagtttctgacgttaagaatgctattatctggggtaatcactcgtccagtcagtatcctgatgtta

SEQ ID NO: 68275 - DNA, 619 bp, Triticum aestivum
  Clone ID: PAT_TA_68275
gcggacgagcacgccgtcgccgccctcctcgtcgtcctcctcccacttctcacggcagggagatagtgagagcgggcgtgccgatcttctggcgccaacgatggcgggcttgaccagcgacagcgatgataatgataagtttgagtgggaaagtgatggtgaggctgcgccctcatcagctccgaccttgaggaacttggatgctcctggcccgtccacgctggtacgtcagaattctaacgggtgggccaacggggaagcaacctctacttctttagtcgaggaatatgtgacaatgggtttcccaaaagacatggttgtgaagggcattaaggagattgggcacaatgatgtaaatgcgttgctagagctacttctcacatataaggcactaggtgatgagggtgcattgggtgattgctctacgtctggctgtgcctgcccaaatgttcaagatgatgatgatgatgatcttgattccgataactgggataacgacaatgatactggtggtagagagcacaactctgatagttctggtgatgaggattttctaaaagagatgtcggcgaaggacgagaagataaacttattagtagacatgggcttttctgaagat

SEQ ID NO: 68276 - DNA, 134 bp, Triticum aestivum
  Clone ID: PAT_TA_68276
gatttagttggacttacttctgctatcttaattcaaatttatttttagaacggtcatgtttccttcaacaacttgcaaaattgatgtccaagtaaatgacaattccacatcttgaagcctggttaaaaaaaaaa

SEQ ID NO: 68277 - DNA, 240 bp, Triticum aestivum
  unsure (1)..(240): unsure at all n locations
  Clone ID: PAT_TA_68277
gcccaagncgggcactactccggtaatttgctctctacctagttaccatttgaatgacttatcttacctagcattgatatatgattcattaatgagcatcctgcctgaatctatatttgtattttttatggttgtgttcctttagttaaacatcacttttgaatattgctctccatgagttctgtttttgtatcaaaattgagaatgtctagcacactgagattccccccccccccnttt

SEQ ID NO: 68278 - DNA, 173 bp, Triticum aestivum
  unsure (1)..(173): unsure at all n locations
  Clone ID: PAT_TA_68278
ggccgtttctgctctctctttttctttttgagaaaaaggccgtttctactggggtgcctcacggggcctgtgggcttccctggggatcgttcgttcgccccggggggcatgcgccatgggctgcnagcccactggtaaancttgcggcctgctattacntggagcatggactc

SEQ ID NO: 68279 - DNA, 579 bp, Triticum aestivum
  Clone ID: PAT_TA_68279
ttgcaactggtaggtgcagcctattatggtataaaatgggaaactcttttaataagtacaaacccgacaaggatctacaagagtattttcaaaaatttgacgagttatacctcacaaaaaatcaagtccggaaacgtaattacgtcgtctttcgtgtattatgtccgctagccattggattgggcggactgtatgttttaacatacgctggaagacttgcttactacggaataccatcagttcacagcaacgctattatagagggttacaagaaacgagaggagcgtcatttacaatatgtaaaggaaaatccaacctatgtgtcggcattgctcaaaggttacgaggcacttcggccaccaaaggatttctaatttattccaaacatccaataaactctgtcacagcaacaccgaacatttatttttattcttcgcccttgaaaaacttttcctcacctttgtacaacgtggctagtgctccagtgctttctcagagttttcgaaattttcgaacacaggaaaatgaaaccaagcctgtggagcagcaagaaaagcctgagtcctataaaagaaagca

SEQ ID NO: 68280 - DNA, 109 bp, Triticum aestivum
  Clone ID: PAT_TA_68280
agaaacttgtgaccaacattaaatccttcattgaaaagagagggttgccaaaaaatcttgtacttggaagctgcgaaattctcgaaacagccggacagggggcgcttgg

SEQ ID NO: 68281 - DNA, 242 bp, Triticum aestivum
  unsure (1)..(242): unsure at all n locations
  Clone ID: PAT_TA_68281
ctgcaggnaattcggcacgaggcacaaacccctcccctctcccactccacagggctggatctgggtggaagccggccagatcgacccttgggctaggggcatgggcggcggcgagggcgaggtgggcagcgagcctgcgggagcggcctcagatgtggccgcgctggtaccgctgtacatccgggacactagggggaacgatttctcggtgtgggccgacctgggcgacaccgtcggggagt

SEQ ID NO: 68282 - DNA, 499 bp, Triticum aestivum
  Clone ID: PAT_TA_68282
gaagctcacaagttttgcaagaaagtacttaccagctggtgcaacaattgtgttgtcagcagctgtggcagatccctgagcagtcgcagtgccaggccatccacaatgttgttcatgctattattctgcatcaacaacaaaaaccacaacaacaaccatcgagccaggtctccttccaacagcctctgcaacaatatccattaggccagggctccttccggccatctcagcaaaacccacaggcccggggctctgtccagcctcaacaactgccccagttcgaggaaataaggaacctagcgctacagacgctacccgcaatgtgcaatgtctacatccctccatattgcaccatcgcgccatttggcatcttcggtactaactgagaagaaaataactctagtactagatatatgaaacaccgttttctcagtccatggtttggtcgttgtagcggtgaaaaaataatgtgacatgcactatcaggtaagaacccgaa

SEQ ID NO: 68283 - DNA, 128 bp, Triticum aestivum
  unsure (1)..(128): unsure at all n locations
  Clone ID: PAT_TA_68283
gctcccgnnccgctctagnactcgggnggagatccgacaagctggggagatcgcggctagtaagcccgtcttattacaaactaaattcggcgatccaaagtatgccccgcttaatcaaatgtggagtt

SEQ ID NO: 68284 - DNA, 365 bp, Triticum aestivum
  unsure (1)..(365): unsure at all n locations
  Clone ID: PAT_TA_68284
gcgcgggcgaattcgtcgacgcgctgaacaagnaacataacgggggcgtggtcggacaaagtgcaggaatgggaggagtgcgccaagaaccagacggcgtgccctgacaaatatgggtcggagagcatcaccgcggcatgcgactcggcgtacaagggcgtgacagaagattcaacgctgagtgatgagtatttcgggagtagactgccggtggtgaacctgaggctggcgcaaggcggcgtccgattggcggctacgctcaacaggatattcggtcaatccaaggcttagtgattattatgtcgctttttatagactgcaagtgaccttttaagaggtaatatcaccgggagtcaaaaaaaaaa

SEQ ID NO: 68285 - DNA, 580 bp, Triticum aestivum
  Clone ID: PAT_TA_68285
cggcacgagggttctactctcgcgtcccgcctcccccaccacgccctccagctgttcggctccatgcccgtcaggtccgtggtcacctacaacaccatgatcaccgccctcatgcgcaacggcctggtcgccgctgcgcgcgagctgttcgacggaatgccggaaccggataaggtttcctggacggcgctcatcgacgggtgcgtcaagaatgggcgccatgacgaggcaatcgattgcttccatgccatgctgctggacggtgttgagccagactacgtcacgctggtagctgccatctccgcgtgcgctgaggtcggcgtgctcggtctcggtatgtgggtgcaccggttcgtgaccagggagaggctagagggcaacatccgcatcgccaactcgttgatcgacatgtacgctcggtgcggtcaggtggagtttgcacggcaggtgtttgacagcatgaggaagcggacggtggtctcctggaactcgatgatcgtcgggttcgcagccaacggacggtgcacggacgccatcgagcatttcgaggcaatgaggaggaaggggttcaagccagacg

SEQ ID NO: 68286 - DNA, 505 bp, Triticum aestivum
  unsure (1)..(505): unsure at all n locations
  Clone ID: PAT_TA_68286
ctcttgacttggttcttgcgtctcagngggagggatgcaaatctttgtcaaaactttgactggaaagactatcactcttgaagttgaggcttctgattctattgacaacgtcaaagctaagatccaagacaaagaaggaatccccccagatcagcaacgtcttatcttcgctggtaagcagcttgaagacggacgnacactgagcgattacaacatccagaaagagtctactcttcacttggttcttcgtctcagaggaggaatgcaaatctttgncnnaactntgnctggnannacnannactcttgaagttgnggcntntgantctattgacnatgtcaaanccnaganncaagacacagaacgnatcccnccanatcagcaacgtcttatcntctgctggtnagcagcttgattancggacgctcacgtgagcgatgtacaacatccaganggtagtctactcnttgactaggctcttcgtctcacaggaggaatgnannnc

SEQ ID NO: 68287 - DNA, 520 bp, Triticum aestivum
  Clone ID: PAT_TA_68287
gcacgaggttattccctgggccggatatcaacccctccaaagctcctgtccgctccggcgacggcgacggcgacggcggttgccttcctcctcctccgtcgaccaagatccaccaacgccagcactgcctcctttcagctactcgtcacatcaccgttgagcacagcctcctcctatcccctggatcttgcaagcaaacctctaatttattttggttggcaataaacattagatatttgataccttatcatgttcaaaattattataattggagttgtggccgccggttttggctgcacctgcgagtgtgatctcctgtatgtctctaggtctacgtaatttgagttgttttttacctgcaaacccccgtttgggagcattgaactgttacgttggtttcttctcagtaatggaaccggggatttaaatccatgtttatctagtactacaaaatatattgtataatttaaaacctttcatgctcaattcttttcccaattacgctagtgattagtcatgg

SEQ ID NO: 68288 - DNA, 537 bp, Triticum aestivum
  Clone ID: PAT_TA_68288
gcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagcccgcggtaattcc

SEQ ID NO: 68289 - DNA, 655 bp, Triticum aestivum
  Clone ID: PAT_TA_68289
acaggtactataatttttcccctatgcttcttctagattttgttttgagctgatgggtccgagatgtggcagcacttctcggctctacgaaatccatggctcaagtgcgtgtcccgggatccgagcctctatcacttcttcagttccggcttgcttcaagaacaaaaaatttctgtgtgaaagaccactagcagaactgaatgttgtatgcaccttcatcttgcagtccaattacttggattatttgggacaaattcctttctttttaaccgtactacagttagatagcaggataaggatacatgcttgtactgcctctatcgtaaattgcacatgagttgatcccgagtttagacagctagcaatcaatcgctctgaaggtattgctcttttattttatttgagatcatgaggaaataggttcagatatgtgactactctatgctgtactaactattctatgttgtactgactattctatgcgaccaccaacagcaagggttctctcaggtgagatcccctcctctcaatttgttccccttcattcccctatttgcgtgtgtcagctatttttcttgtataaactctagcagaggaaataaatcttggtgatggatttaccttgatggaagatgatttacatattttattttta

SEQ ID NO: 68290 - DNA, 295 bp, Triticum aestivum
  unsure (1)..(295): unsure at all n locations
  Clone ID: PAT_TA_68290
gattgaagttntcatatcttgcaaattcctctgggtttatttctgtttttagggtatatggtatagttaaaattacccacaactaacaaatcaatgtcatcgtgcgtttgaaatgttttgaaaccaatcaataaatttagtgctttcattagattaacaaggcccataaacatttgttagaatccaagagcttttcttctaacatgacgtgaattgtattgagatggcataatcattttccaaaactttgaaccccccccccccanaaggggtttgatttcaggccncccaagtc

SEQ ID NO: 68291 - DNA, 173 bp, Triticum aestivum
  Clone ID: PAT_TA_68291
ctccctctagccaccgccgcaccaactacctctctcctgtcccccttgattggttgcgccactcaaactgaccgcaccaagctgagccaagcacgcccgagcaaagcgggagagagagagagaggaccgggaggagcatcccgacagccgcgcgccgtcggcccgtccggcgt

SEQ ID NO: 68292 - DNA, 260 bp, Triticum aestivum
  unsure (1)..(260): unsure at all n locations
  Clone ID: PAT_TA_68292
aaaaactgatgcnggtctcactgcccttaataattatttggccgataaaagctacattgaagggtatgttccatcccaagttgacgtggtcgtcttcgcggccatgtccgcagcaccagcatccaaattctgccatgcattgagatggtacaaccacatgaaatcctatcaatgcaaatttgccagtctccctggtgttaagaaagcccttgaacaatgcgggccatcagctgtcacaaacggnacagcagctgcagaaa

SEQ ID NO: 68293 - DNA, 690 bp, Triticum aestivum
  Clone ID: PAT_TA_68293
aggaattcggcacgagggcgagaaaggagacgccgtccgccctgagctcccctcctccctgccggtgctcccggtgcccgccgccgtctctgcccggcttccctgtcacggtggccgagccgctcgcttcctttccccacaggtcgcgggccacggcctcctcctctacggatgattgatttgatatggactgctaggagaggatggctgctcgtcagatatgctgctcaacttttgagatgacaacaataccggacttgatgcgatgatatctatgaacaaaagttgctccaggtccaggatggtccctgacaaggcgaaaaaacagagcagttctagattcatgaagatggtggccttggaggttttctgaagagctaaaggatggaaaacagttgggataaaagtagctttggtgcctgcaccggtagtatatgatgctagcttttgctgtcttagctgctggatttcgatgattttgcaagcttgatgtgattatgcaaactgttaggatctgagtctaaactccagcaccttttcttgccttttttttggctttcgttgtgtttttagttcagcattgtactctgtcatgtttagttaattcagctgggtgcaaggcctctgtataatgataataataaaatataagatttctttttgtataaaaaaaaaagggggggcccggta

SEQ ID NO: 68294 - DNA, 545 bp, Triticum aestivum
  Clone ID: PAT_TA_68294
gattgtttccttgacgacggcatcgaggagagcgcgcggcaatggcgatctcctcggcccctgtggcgccgcgccgccgcaggccgacggtgctcctgatggtgaactacgcggcgctgctggtcgggtcggtggcctcgagcctgctgtcccggttctacttcgagcacggcgggcagaacaagtgggtggtcacgctggtgcagtcggcggggttcccgatgctggtggtcgccgtgttcctcgccggccgccccgcctccgtgccgcggccgtttctttggttctcgcggcggttcctggccgtgtgcctcgtcatcggcggtctcatgggcgtcaacaaccttctcttctcctacagctcctcgctcctgcccgtgtccacctcctcgctgctgctctccacgcagctcgccttcacgctcgtcctcgccgtcgccatcgtccgtcacccgctcaccttcgtcaaccttaacgccgtcgtgctcatgacgctctgctccgtgctcctcgccctccggtcgggcgacgccggcgagagccca

SEQ ID NO: 68295 - DNA, 497 bp, Triticum aestivum
  unsure (1)..(497): unsure at all n locations
  Clone ID: PAT_TA_68295
ccgacaggatgaggatgcactcacacgctttgttcgtcctcctcctctgctctctcctcgtcggcgcggcaaccgccgagccctctcgggagcttacttacaaggattgccaccctgacgacaaggcggtgctgctcgccttcccggactcctggtcctcgtcatgggcgcccgacacactctgctgcgactggttcgccgtcgcctgcgaccgctccaccggccgcgtcgtgggcttctccgtcttccaggaccccagcttcacgggcaccatccccagcaccattgccggtctcacccacctggaggacctcttcctgcaccacctcccggggctgtcgggccccataccgccggcgataggcaagctcgccaacctctccaggctcgaaatctcatggacgggggtgtctggccccgtgccgtcctccctgngcaagctcaagaagctcacccagctcgacctctccttcaactcgctcagcggcgccatcccg

SEQ ID NO: 68296 - DNA, 614 bp, Triticum aestivum
  unsure (1)..(614): unsure at all n locations
  Clone ID: PAT_TA_68296
gncaaggccaagatccaganacaaggagggcatccctncggaccagcagagtctcattttcgctggcaagcagacttgaggatggcaggacccttgctgactacaacatccagaaaggagtccacccttgaccttgtcctccgccttggtggangcatgcagatcttcngnaagacnncgnctggcaagaccatcacccttgangtggagacgcctgacaccatngacaacgtcaaggccaagatccaggacaaggagggcattcctccggaccagcagcgcctcatctttgccggcaagcagctggaggatggccgcacccttgctgactacaacatccagaaaggagtccaccctgcaccttgtcctccgccttaggggaggcatgcnagatcnttcgtcaagaccctcaccggcaagaccatcacacttgaggtggaatcctccgacaccattgacaacgtcaaggccaangatccaggacaagggagggcattcctccggaccagcagcgcctcatctttgccggcaagcagctggnaggatggccgcacttctttgctgatttacaacatccagnaaggagtccaccctacaccctggngctccgcctt

SEQ ID NO: 68297 - DNA, 598 bp, Triticum aestivum
  unsure (1)..(598): unsure at all n locations
  Clone ID: PAT_TA_68297
gtgcttaacaacncataaaatctggatccaaatctccgcaaactctccagtattatagtccttcctaagctaatcatcccagacaacaccatttgacccaatctgttccctgttgatcagcagtgcacgtccaagtttactgctgtaaacttcagaggttgcttaccatttaaccactgcgtatttaaccaagttaccaccccagttgcaacctacccaggaaggataaacccccagacattgtttggccgaccatgtggcactgtgtgcaccagtgcacgcggtgatcacgagttttggcatgccatgcgcgcgctctgctggcattggccgcgtccagggcgtcttctagctccgacccctctccctctcgacgtcttagcgctcatgagcatgtctattagttttaccgcgtcgtcgccattctcctggacccctctccccctccgtccgtttcctcactgacgcaagccgccacgcgcccatggacgaacagtggcggtttggctcggagctcgccgtcctcttcctccctgcgctcccttggccgcctcttccccgtgagccactcctcccgttccctctcgtcgcctaactc

SEQ ID NO: 68298 - DNA, 565 bp, Triticum aestivum
  unsure (1)..(565): unsure at all n locations
  Clone ID: PAT_TA_68298
gaggaattcggacgaggcaacaattcccccacagcaattcccgcaacatgaattcccataacaacaacaattcccgcaacaacaaatcgcccagcaaccacaacaactcccccaacaacaacatatcccccagcaagcacaacaatttctccaacaacaacaattcccccagcaacaatccccccaacaacaattacgccnacaacaacaatttccccaacagcanttnccncaaanacaacaattaccgcaacaagaattnccccaaccacagcaaataccgccagcatacaacanatgactgccagcaaaccacagacanattcaccccagcagcngattnccccancancaggantttccncaacagcaacnattcccccaacagcanttncngcagcaatagttcccgngcaacanttaccgcaataacantttccccagcaacaattgcnccaacaacaatnnccncaacaacaacagttcccccaacaacaacatttaccgcaacaacaattcccccggccacaacaatcccctgaacancaacaattcccccaacaac

SEQ ID NO: 68299 - DNA, 651 bp, Triticum aestivum
  unsure (1)..(651): unsure at all n locations
  Clone ID: PAT_TA_68299
aggaattcggcacgagggtntctgtaagggcggacgtagtacaacgtgagcctttgtgtacaatcgtgtagtacataaaatcaagtagaagcgacctctatttgtgactggttcatacttttggtggctgtctgctgaagacagtgttgcatcagccacattacaatggtgtccaaaacatcaccatagaccagatctttgcctcataaatcataataagtagtagcacacaaagattgcagggagatgactcatacaggaccaagagatatgtgcttgtacattgcacaaggtagtataaaattcacctccttgcacttgtgttgtgccacatttctatcatcggcttggagaaaaaataaaatagcacttgtacattgcagaaggtacatgagcaacaaagagcctcataaacaagctcacaagaaatgttgctaagaaatgactccacagtaccaaaagctatgcataggaatagcacttgtacattgcacaaggtacagtggagtccattatatcatcggcttaatggcaatctaaaatcccagtacacccaaaaggtggtctcttagtaccacgaaaaattccatgtctgcataacatcagacactaaaatgacacctctagaaatatgtcagagcaaaaataaga

SEQ ID NO: 68300 - DNA, 598 bp, Triticum aestivum
  Clone ID: PAT_TA_68300
ggttgccttctctcttcctcttgattatcctcccccgctagcaatggaaaacaattggatctgctctatcaaacagaaggcatggattcaatgtggtcgagaagctttttggatcaaataattttactcatgtgcatcagaatcgtattttcacagaatttgttttcttgcaggcttacagtagcattgaccttgactttttcttttgattcacattcaatcttttctgtatcgtgtattctcttagtttctgctctccagagatttgctccagaatcctatcaggtatagttttttggttacctcatggagatcaggtcagagcacaccaactatacccataatccataggctcttcctctcgattatcactctttgccccgatggagaacaaatggtcgtctctctcacagaaggtctatgattgaattaaccatgcctttttcttttggattcaaattttcttctatcctgtcatctcatattgttgtgctcaccatggattggatcctttcccttaccacgtacaatttttggatggcccatggacatcaggtcagagcagacaaattatacccatcagcgctggtcaagattc

SEQ ID NO: 68301 - DNA, 210 bp, Triticum aestivum
  unsure (1)..(210): unsure at all n locations
  Clone ID: PAT_TA_68301
caacgccgctgaagaggatgcagctccatgagggctgnnagaggctggctggagacttggaggacagacacagtttggccgcggtataggccgagaaactcttcagaataaaagccttctcgtagtgaaagtctgtctgtcatgcactgtacaagatctctggctctggcaataaataaacataacaaacataattacgtaaaaaaaaaa

SEQ ID NO: 68302 - DNA, 665 bp, Triticum aestivum
  Clone ID: PAT_TA_68302
aggaattcggacgaggagccagcagcgggggtaataaaaatccccatgaagacctttctcatcctagccctccttgctatcgtggcgaccaccgccacaagtgcagttagagttccagtgccacaattgcagccgcaaaatccatctcaacaacaaccacaagagcaagttccattgatgcaacaacaacaacaatttccagggcagcaagaacaatttccaccacaacagccatatccgcatcagcaaccatttccatcacaacaaccatatccgcagccgcaaccatttccgccacaactaccatatccgcagacgcaaccatttccaccacaacaaccatatccacaaccgcaaccacagtatccgcaaccacaacaaccaatttcgcagcaacaagcacaacaacaacaacaacaacaacaaatccttcaacaaattctgcaacaacaactgattccatgcagggatgttgtcttgcaacaacacaacatagcgcatgcaagctcacaagtattgcaacaaagtagttaccaacagttgcaacaattatgttgtcagcaactgtttcagatccccgagcagtcgcggtgccaagccatccacaatgtcgttcatgctattattctgcatcatcatcaacaacaacaacaacaaccgtcgag

SEQ ID NO: 68303 - DNA, 423 bp, Triticum aestivum
  unsure (1)..(423): unsure at all n locations
  Clone ID: PAT_TA_68303
ggncaagcaccattcacccttgaggtggagtcgtntgacaccatcgacaacgtgaaggccaagatccaggacaaggagggcattcccccggaccagcagcgccttatcttcgctggcaagcagctggaggacggtcgcacccttgccgactacaacatccagaaggaatccaccctccacctggtgctccgnctgcnnggtggcatgcanatcttngtgaagaccctcaccggcaagaccatcactctggaggttgatagctnngacaccattgacaacgtnaaggctaagatccaggacaaggagggcattcccccggaccancagngccttatcttcncaggcnagcngttggaggatggtcntacccttgccgactacaacatctcagaacgagttcaccctntcaccctggngctccgc

SEQ ID NO: 68304 - DNA, 665 bp, Triticum aestivum
  Clone ID: PAT_TA_68304
gaggaattcggcacgagggagttctattcgtttgctccggaactggccgtcccaagctgccttcacacctaacactacttccgaagcactgctaacacaacaggacttggcaagatcagatgaacctcatgagcatcaacaccaagacggtacctgaccgagtcaagttgcagttgcatgctcctttatatgtacactcacagtttgatgtacactaacactttccatattcgttgttgaacttgcaccatcgcgcaagcgcaaacagacatcagggataatgcttgacagattaacaaaatctaaaggaggaagaatggagatccattttgaggcaggtttaaaaaggccacgtgatgctacagagtcagccaagttagtataaaaggcagccgttgccgttaggtgtcatgcacatatcctcccaacatggatccagtacaggaatgagaaagacaatacccagtttaacaccttccttgaccatttatccgtaagtaatgttattgatcgcaattagtaatattgtcttgctctgtcccatactttctaccttcctcataataagactcacattcttttttcaacagacgaggttcaagttggatccgaaagatgatacaactaaacaaccatgcactcatgtttttcagtctgctctgcga

SEQ ID NO: 68305 - DNA, 376 bp, Triticum aestivum
  unsure (1)..(376): unsure at all n locations
  Clone ID: PAT_TA_68305
atagcatcaagnaagctgggcttggcgaatctggtcttctaaggtaggagagacttgaaggttggagaggaaaccttgaggaacaatttgcagattaaatttgcagaaagcttcacaaagctcgggttgataaggcttaagaatcagactgttgcaatatgctttcctgctcaaagcgtcagcaatcacattggccttgcctggagtatactcaatactcggattgtactcttgaatcatctcgacccatcgagtctgcctgaggttgagattaggctgagtgaagatgtacttgagactcttgtgatcagtgaaaatatccacctttccttcccaatagaagatgtctccaagtcaaaagagcatgcaccactgc

SEQ ID NO: 68306 - DNA, 427 bp, Triticum aestivum
  unsure (1)..(427): unsure at all n locations
  Clone ID: PAT_TA_68306
cgccccccaaattccctacctatgcccgccggnaacaccgcgagttgctcgcccgagtgccgtcttccccgacgccgagtcgccgctgccgggggttcgcgatgccgccgtagctctagttgatcggaatctgatctgacggagcaccggcgatcgaccagccaccatgccggtaaccggaggcgcgaccgtcctggacgaccttccagagtggatcgttgtcgaagagatcctcgtccgtttgccgcccaaggacatcctccgctgccgcgccgtccgcaggtggtggcacactgccacctccaccgacaagttcatgctggaccaccaccgccgccagcccttgctcccgatcctcagccacgttgtcgttccgcagaaagcccgcctcctgttttcctttgatgccggtgcaggccagcagaaa

SEQ ID NO: 68307 - DNA, 387 bp, Triticum aestivum
  unsure (1)..(387): unsure at all n locations
  Clone ID: PAT_TA_68307
ttctacttctaccagccgtgggatgctggtggcgcggcacctcccggcggcgacgtcctggcgctgaaatcctccctcgccgtcgaggatcacgagaccagcttcctgcggtcacccgacggtacgttctcctgcggcttccatagcatctacagcggcgccttcaccttctccatctggtactncgactcacccggggaaaccgtcgtctggagtgccaaccgcggccgccccgtgctctccaggaggtcagccgtcaccctgcgcaaggacggcaacatggtcctcaccgacgacggcaccgtcgngtggcaaactgagggcaacctcccnaatgtccagnatgcacagcttcttgacaccggaaacctcgtgctgaataacaca

SEQ ID NO: 68308 - DNA, 619 bp, Triticum aestivum
  unsure (1)..(619): unsure at all n locations
  Clone ID: PAT_TA_68308
tgcaggtcgaccctagcagccaagtacaatggccacaacaacaaccngtcccacagcctcaccaaccattctcccagcaaccacaacaaacatttccccaaccccaacaaacattcccccatcaaccacaacaacaatttccccagcctcagcaaccacaacaacaatttctccagccccaacaaccattcccccaacaaccacaacaaccatatccccagcaaccacaacaaccattcccccagactcaacaaccccaacaactatttccccagtcccagcaaccacaacaacaattttctcagccccaacaacaattcccgcagccccaacaaccgcaacaatcattcccccaacaacaaccaccgttcattcagccatctctacaacaacaggtgaacccatgcaagaatttcctcttgcagcaatgcaaacctgtgtcactggtgtcatccctctggtcaatgatctggccacaaagcgattgccaagtgatgcggcaacaatgctgccaacaactagcacagattcctcagcagctccagtgtgcagccatccataccgtcatacattccatcatcaaggcaccattttccagcgtagtcgccggcattggtgg

SEQ ID NO: 68309 - DNA, 552 bp, Triticum aestivum
  unsure (1)..(552): unsure at all n locations
  Clone ID: PAT_TA_68309
attttgggctgacctcttgctgttctagcaaaaaaatagtattttgtttttctctatgaaagatcnggtaatctgatatcgagctccttattttaaagtaattgaattttgggtttgtaatgattgttcatgactaatagaaaatatatattgtaaaattccaggaccgaatggatttttggtctatattgcaaatatgcataatggattattggtgagctcggtattggtggtctactccctttcatccctgtatttctaagaaaaccaaactaatatgcatccatgtattttttaattcaagttctttcatatgggttacgtaaaaagcaaatgttgcttctttttattcagatgctttgagaaccaagtctacctggttctcttcctttcatccatgtattttaatgtgcagtgtacagtgtgtagaatgagcaaacttgtgaatctagagcacaaactcatgattgatcaagggagtggcactgccggctgggttagagtataatcaactgtacttggagttttttttttgtgatacgtgtagctttc

SEQ ID NO: 68310 - DNA, 679 bp, Triticum aestivum
  Clone ID: PAT_TA_68310
gctgagatctacctgggtgccgatcttttggtgccccaagatggatgatgtgtttctgatttagctttcgccctcttcccctctcctatttgttccattcttgccaacctagctgccttttatgatcccactgtcccacatggacttcacggagattgtatggcagtaacggaactaactgtgttatttggttgtaggtttttgatggccatggaggttctgatgcagcatcctacatgaaaaaacatgccatcagattgttctttaaggattcagagttcccatgagcaatacaagatgtctttttttttctgaatccgtggcaaactcagtccgcaaagctttcttaagtgaagacctcgctcttgcaaatgaatcaatcatcagttgattgtcgggaactacaaatcttacatctttgatctttggaaggtatgatgagtatgcagccaaaactcctacatacacatatgcatgcgaacttttgttttcctcctatcttgcaggtaattgttggatgcaaatgctggggattgccaagcaggtctatgtaggaaacacatcgctatagaaaagtgtcgttgttacaggccgacatgtgaagtagagcatgatgctgacataaggtagcatatatcctttttttattaaaaaaatgtttgattgctaacgtatgtct

SEQ ID NO: 68311 - DNA, 656 bp, Triticum aestivum
  Clone ID: PAT_TA_68311
gccgccgccgccggcgctcccggacgacgtcgtcgtcgaagagatcctcctccgcctcccgcccgacgacccaggttgtctcttccgcgcctccctcgtctgcaaggcctggaggaacgccgtctcccatccccgcttccgccgccgctacatcgggctccaccgccaccgggcaccccccgtgctcggcttcctccacgactgggaagacgggggcatcccagacttcttccccaccaccgcctcgcccttctccctcgccgctccagaccgccggttctggcgccccgtcgactgccgccatggccgcgccctcttcctctccgaccgccgccaggaaactcaggaactcctcttgtgggagccaatcacgggcgcccgtcggggcataccggtgcccgcggcgttcaggtgccagtggccggccgcggcagtgttctgcacagcggactggtgcgaccaccgcgactgtgcaggaggtcccttcggcgtggtcttcctcttcgccggcgaacaagaccggcacgttgtcacatcggcgtgcttgtactcgtcggagactggcacatggggcaagctgaactcgaggcaagatgagttcaccatggaatttcagaaccattccagcgtgctggttgggaggtctctgctctact

SEQ ID NO: 68312 - DNA, 698 bp, Triticum aestivum
  Clone ID: PAT_TA_68312
gaagacctttctatccttgccctccttgctatcgtggcgaccccgccacaactgcagttagagttccagtgccacaattgcagccacaaaatccatctcagcaacagccacaagagcaagttccattggtacaacaacaacaatttccagggcagcaacaacaatttccaccacaacagccatatccgcagccgcaaccatttccatcacaacaaccatatctgcaactgcaaccatttccgcagccgcaaccatttccgccacaactaccatatccgcagccgcaatcatttccaccacaacaaccatatccacaacagcaaccacagtatctacaaccacaacaaccaatttcgcagcaacaagcacaacaacaacaacaacaacaacaacaacaacaacaacaacaacaaatccttcaacaaattttgcaacaacaactgattccatgcagggatgttgtcttgcaacaacacaacatagcgcatgcaagctcacaagttttgcaacaaagtacttaccagctattgcaacaattgtgttgtcaacaactgttgcagatccctgagcagtcgaggtgccaagccatccataatgttgctcatgctattattatgcatcaacaacaacaacaacaacaagaacaacaacaacagttgcaacaacaacaacagcagcaactgcatcaacaacgacaa

SEQ ID NO: 68313 - DNA, 632 bp, Triticum aestivum
  unsure (1)..(632): unsure at all n locations
  Clone ID: PAT_TA_68313
ccgggctgaggaattcggacgaggcttggacnatgtaccctggaagttgtcgaggaaagcgtcttccagtcctcccagctgccaattgagttttcgggcaaactgtttaaccatgctgcgcatgtcccttgagtttcaacgaaaggtatttgatggcgtgaagagcatcaccacgggccatatgaatatggagaagaaaatcctcaatccataccgtagggtctattgtcccatcatatgatttgatgttcatgggtttaaacccttccgttaattcatgttccagtacttcatcagtgaagcaaaggggggtgcggcaccactatatcggccaagtcgcgacgtagctcggatggagttcttctgtggtctttggtccatgcgtggttatgtttgtcacgtccggacgaatggccatcaccgtgcatcggggcacgctcccgcgatccatagatcgatctggtatgacctgctctgttttccaggtcatgccgcaggtcatatgtgtatccccgagctattgtgtctctgtttttatggcgaggtagggaaggttggagtttggcttgagttgccgctttgtcccgggcacgtggtggtcggtcagctgcattgcgagctggtaggacggg

SEQ ID NO: 68314 - DNA, 685 bp, Triticum aestivum
  unsure (1)..(685): unsure at all n locations
  Clone ID: PAT_TA_68314
ggaattcggacgagggtcccntctcctccnccccggcggccgacccccgcccgccatggctccttcggcgtacacctcgtcgacgagctcctggaggagatcttcctccgactgcccaccccggccgcgctcgcacgcgcctcaaccacctccccccgcttccgccgcatcatcaccgaccgctccttcctccgccgcttccgcaaactccacccgccgccgctcctcgggttcgccgacgaacgtgcaggcttccaccccgccgaagcgccccattcctccgcgccgctcgcccgtgccctcgccgacaccgctgatttcacctactccttcgtccccaagcccagtaatgaccactcctggcgtccctgcaacgtccgcgacggccgcgtcctcctcgagagcagccgatacgggaccttcagagagctcgcggtgtgcgatccgttgtcacggcgctacgtgctgcttccgcccatgcccgagcacatgtcagtccaggaacagcgcccttgggaattcaggtccatcctggctcccattgccgaggaggatgaggatgagacgtcgttcaaggtgatatgctttgcggactatgaaaccaagctggatgtgtttgtcttctcttcagtcacacgccagtggtgcattgctgcatctcccagctggatttctttgggcgcgg

SEQ ID NO: 68315 - DNA, 613 bp, Triticum aestivum
  Clone ID: PAT_TA_68315
acccacctcggattcgtggtgcgcgcccgcgagcgattcgacgcgctaccgccccggcggaccctgctcggccggagccggacgtgcctcacgtggttgtgttatataaacctgcactctgatgatacgtgtggtgaccacagagacagcaaaattggctttctgaaaacaaaagatgataaccaatctgatctcgaggggccgcatagaaatgctgggccgtggctgtgctccatttgctcgcagcaaaatgatacgagttgtatgtcctgtgaggtatgcggcgttcttcgggatttgtcgctgtatttcaataacaccaatgaacctgaaggtggagctaaacgcagaaacaagcattctggtgtgtctgtactggcaagatctcttttcacaccatccagtccaaaatcaaaagccattgttttctccgatggatttcgaggcaacaaaaacgcaacaggacatatgcaagcttccttgggtaccctccacaaaacattcatgacacataagcagcgccataacatagtgcctttcaagtttgatataccatctcctgatgacatggtctctataggcttaaaatcgtccagacatttgcgaaaagata

SEQ ID NO: 68316 - DNA, 155 bp, Triticum aestivum
  unsure (1)..(155): unsure at all n locations
  Clone ID: PAT_TA_68316
tttttatncttacgcccgttaattggctgcgtcagggtaattaaccgcatggcgctcgctaaatatatatatagtatgttcttcatctgtttgagaattctttggtgtcgaataaaagaattctttcatgctggaaaaaaaaaccaaaaaaaaaa

SEQ ID NO: 68317 - DNA, 596 bp, Triticum aestivum
  Clone ID: PAT_TA_68317
tccatcctcggcggcggcggccgagcgccggccggtggtgaggttaatgtggatgtcatgagcagattccagcatttgcaagttcagtacaaaattatgctatgcagctaaacagagccacggaggcatcactggattctggccgcaagcagagaacgctgtgctcctaaagaactgtcttcagaaaagctggccaaccagggatctagaagcagcatcacctcaagtctcaagcaatgggcagtgaactgctcacagcaacgcttgcggcaccggtggagcctccgttgatcccatccacgaccactaccaccactaccaccggcaacggaaccaccaccagaaccatcacaacaatcaccaccaccacatgctcctcctctgccgccgatggcaccactaccaccaccaccacaaccaccaccaccaccacaacaacaacaaccatcacaaccacctccaacgccacaaccatatcatccctctgtgatgatgaccttcgcgagatcttcctccgcctcccgaacctcccggctctcatccgtgcggcgctcacctgccgctcctggctcggagccatccgctcttcctcatcc

SEQ ID NO: 68318 - DNA, 287 bp, Triticum aestivum
  unsure (1)..(287): unsure at all n locations
  Clone ID: PAT_TA_68318
ctaaaactttgctgntcaaccatgggnccgaatgctngctcnagaactganctgcggcacnaccctcagnaagaccaacacaagatcntgctggcangggncantttgctcatcaacactnctttgggctcctagtataacgcaangcttncntgggaacctggaaagagtggcgctgcttcactgggatgggcncnctcttaccttcattcctgcngtaacccaagtctgagggcccttaagaaagnnctagaatctcccangngaaggttgagccnntannaatg

SEQ ID NO: 68319 - DNA, 637 bp, Triticum aestivum
  unsure (1)..(637): unsure at all n locations
  Clone ID: PAT_TA_68319
ttcggcacgaggtgagtcctcatgttgacccaccacaactagnaaatgatgtgcccaccacaccacacacgcaatcggacactaagaaaataagcatatacaatagtacaatgttatacatgaaagttaattgcatggtgcatccaaaaatatttgttctgcattgtgaatgtttatatattctcctaaaatattagtcacaggaaagagaaacgaagggcatatctctccttgtctccaccggacatcccctctttctacaccactttcacgtacgcacacaaactatctctcggccctctaaaagtatgcatgcccatgacacattcacgcatgacggtcactgtatttcaagctaaagcactatacggtcactggagttcagaatatgctcattacggtcaccgtatacattctcgtggtgatcatacggtatctagctcacgatacgtctccgtattttcttgatgacactgacggactttgcatttgatgcgtgctccgtattttgttgacgacacttacggtcattgtatttgaagcgaaagcacaatatggtcactggacttcagaataagctcatcacggtcaccacatacattttgtcgtgctaaccaacatgtggttggatggttag

SEQ ID NO: 68320 - DNA, 601 bp, Triticum aestivum
  Clone ID: PAT_TA_68320
ggtacacatcctctctgtttattgcagagacgtgtatcaggagaacagcggggaggtgctgccgaaattttgcgtaggatccggggcatagcatgggaaaatgaacccaatctaaacatactcgggtgggattaggacctatcattacctattagagtgtaggttgcatggacgtaataaaattgacaaagtagatcaactgatgaatacatacatggtgaattatatatatatatttgttgtgtgtctagtagctctgaaagtcaagatgagtgatcgtgcgtggatgtacaccggtcacactggtcagaacaaatggagcactgaatggttcacaaaaaccaaggggtttgtgcgagccgcatttgcaaatggccagaggaaaacctggtgcccctgtttacggtgcggcaattgggaaaagaggacagaggctgaaatgggcaaacacctgcagaagagtggttttacgcccgattatacggtgtggacatttcatggtgagtctgcccaacgtgaccgagctgaggtggatcgtcgtcgcaccgacgagcatggtaccggtatggaaaacatggtgcaagactttgatgatgctcag

SEQ ID NO: 68321 - DNA, 565 bp, Triticum aestivum
  unsure (1)..(565): unsure at all n locations
  Clone ID: PAT_TA_68321
gnccttgctattgtagcaacccaccgccacaattgcagttagagttccagtgccacaattgcagccacaaaatccatctcagcaacaaccacaaaagcaagttccattggtacaacaacaacaatttccagggcagcaacaaccatttccaccacaacagccatatccgcagctgcaaccatttccatcacaacaaccatatatgcagctgcaaccatttccgcagccgcaactaccatatncgcagccgcaactaccatatncgcagccgcaaccatttngaccacaacaatcatattcacaaccgcaaccacagtattcgcaaccacaacaaccaatttcgcagcagcagcagcagcagcagcaacaacaacaacaacaacagatccttnaacaaattttgcaacaacaactgattccatgcagggatgttgtattgcaacaacacagcatagcgcatggaagctcacaagttttgcaacaaagtacttaccagctggtgcaacaattgtgttgtcagcagctgtggcagatccccgagcagtcgcggtgccaagccatccac

SEQ ID NO: 68322 - DNA, 615 bp, Triticum aestivum
  unsure (1)..(615): unsure at all n locations
  Clone ID: PAT_TA_68322
tgcaggnaattcggcacgaggcaagattcttgataggtttagcttcaatccatttggtaaacttatcgactgctatgagcacatgagtgaagctgctcctaccagttcttagtggtccaaccatatccaatccccaaacagaaaagggccagacgactggaatgctgaatccgtggcaggcttcttggctcgcaacaaatcactcggatctacatttttttgatattcctgcaattctactacggccatctgtgcatcggcgatctttgagcccttctagaagcactcttccgcctgcttccgactaccagtgatagtgatcacccctttgggaccaggcatcttcaatttgaggtacacgtaacatggtcaagccataaaacgtgcataagctggcctgcccagaatagcatgataggcactctggaaatccacaacttcaaatgtcaacttttctttgcggtaattcttggaatcaccgaaaaccatgtcgagagcaatctggcccgagtgatgcagccttcttgccgggaatgaccccatggaaactcatattgctttcactgagtctggacatcggaatgcccattcctttcaatgtctctgcatacagta

SEQ ID NO: 68323 - DNA, 531 bp, Triticum aestivum
  unsure (1)..(531): unsure at all n locations
  Clone ID: PAT_TA_68323
gggctgcaggnaattcggnacgagggcgtactgcaacgtgacacagcacgcgccttcgccggcgtacacgacgagcctggtgaagtgcttctcgggggcgtgcccgccggagcagagcatgagcccgcagagctgcgggtgcgcgtacccgtaccagggggtgatgtacttccgcgcgcccttcttcgcggacgtgggcaacgggacagcgttccaggagctggagagcaagctgtggaccaagctggagctctccccgggctccgtggccctgcaggaccccttcttcaacagcgactcctacatgcaggtccaggtgaagctcttcccttccggcggcccctacttcaaccgcaccgaggtgatgcgcatcggcttcgacctcagcaaccagaccttcaagccgcccaaggagttcggcccctactacttcatcgcctccccgtaccccttcccagatcggaacgggccggcgtccaagagcaagggcgccatcatcgggatcgcggttggctgcggcgtcctgctcat

SEQ ID NO: 68324 - DNA, 219 bp, Triticum aestivum
  Clone ID: PAT_TA_68324
gcctattgcaccattgctccgttggcatcttcggtactaactgagaatagaagaactctagtagtagatatatgatacaccgttttcttagtccatggtttggtcgttgtagcggtgaaaaaataaagtgacatgcactatcatgtaagaacccgaactatactagttcaaacatgggaataaaagacaaacacatctcttgtctacataaaaaaaaaa

SEQ ID NO: 68325 - DNA, 647 bp, Triticum aestivum
  unsure (1)..(647): unsure at all n locations
  Clone ID: PAT_TA_68325
gcaggnaattcggcacgaggtaaaggcaagcaagcagtggtcaatacaaatccatcatgaagacctttctcatccttgccctcgtggcgaccaccgccacaactgcagttagagttccagtgccacaattgcagccaaaaaatccatctcagcaacagccacaagagcaagttccattggtacaacaacaacaatttccagggcagcaacaacaatttccaccacaacagccatatccgcagccgcaaccatttccatcacaacaaccatatctgcagctgcaaccatttccgcagccgcaaccatttctgccacaactaccatatccgcagccgcaatcatttccaccacaacaaccatatccacaacagcgaccaaagtatctacaaccacaacaaccaatttcgcagcaacaagcacaacaacaacaacaacaacaacaacaacaacaacaacaacaacaacaacaacaacaacaaatccttcaacaaattttgcaacaacaactgattccatgcagggatgttgtcttgcaacaacacaacatagcgcatgcaagctcacaagttttgcaacaaagtacttaccagctattgcaacanttgtgttgtcaacaactgttgcagatccctgagcagtcgaggtgc

SEQ ID NO: 68326 - DNA, 320 bp, Triticum aestivum
  unsure (1)..(320): unsure at all n locations
  Clone ID: PAT_TA_68326
agtaagtattagttaacgcaaatccaccatgaagaccttactcatcctaacaatccttgcgatggcaacaaccatcgccaccgccaatatgcaagtcgaccccagcggccaagtacaatggccacaacaacaacaattcccccagcaacaatcaccccaacaacagcaatttccncaacaacaatnnccncaacaacaacaattaccgcaacaacaattnccnnaancacaacnacatacctccaacancancnnattcngcagnnaccanannaattncnccagnnacgattccncnaacaacagcaatggcnccaaca

SEQ ID NO: 68327 - DNA, 448 bp, Triticum aestivum
  unsure (1)..(448): unsure at all n locations
  Clone ID: PAT_TA_68327
cacaagttttgcaacaaagtacttaccagctattgcaacaattgtgttgtcaacaactgntgcagatccctgagcagtcgaggngccaagccatccataatgntgctcatgctattattatgcatcaacaacaacaacaacaacaagaacaacaacaacagttgcaacaacaacaacagcagcaactgcatcaacaacgacaacaaccatcgagccaggtctncttncaacagcctcagcagcaatatncatcaagccaggtctccttccagccatctcagctaaacccacaggctcagggctctgtccaacctcaacaactgccccagttcgcggaaataaggaacctagcgctacagacgctacctgcaatgtgcaatgtctacatncctccacattgctcgaccaccattgcgccatttggcatctttggtaccaactgagaaga

SEQ ID NO: 68328 - DNA, 423 bp, Triticum aestivum
  unsure (1)..(423): unsure at all n locations
  Clone ID: PAT_TA_68328
gnaacaaccatttncaccacaacagccatattcgcagctgnaaccatttncatcacaacaaccatatatgcagctgcaaccatttncgcagccgcaactaccatatccgcagncgcaactaccatatncgcagccgcaaccatttcgaccacaacaatcatatncacaaccgcaaccacagtattcgcaaccacaacaaccaatttcgcagcagcagcagcagcagcaacaacaacaacaacaacagatccttcaacaaattttgcaacaacaactgattccatgcagggatgttgtattgcaacaacacagcatagcgcatggaagctcacaagttttgcaacaaagtacttaccagctggtgcaacaattgtgttgtcagcagctgtggcagatncccgagcagtcgcggtgccaagccat

SEQ ID NO: 68329 - DNA, 170 bp, Triticum aestivum
  unsure (1)..(170): unsure at all n locations
  Clone ID: PAT_TA_68329
gctctggtccaacaactggcagatgtgccaggccgccgtcgaggccgtcctcagcggcaagcccatcgtccaggtctcctccgaggatgccgccgccgaccggacaccgccgctcaaggcgtacgacatncgccacgtctccacctcgccagccgccgacgggaggctcc

SEQ ID NO: 68330 - DNA, 106 bp, Triticum aestivum
  unsure (1)..(106): unsure at all n locations
  Clone ID: PAT_TA_68330
ggttcgtgcggccggggcctgccgagcctcgtgggggcattggtcccggttngtccggcccctttggacccggttggngggacaaaccggngaccaatgggccacg

SEQ ID NO: 68331 - DNA, 111 bp, Triticum aestivum
  unsure (1)..(111): unsure at all n locations
  Clone ID: PAT_TA_68331
atcggaaccttggcgaattgnnatgnngttattacctggcgtgngtgacagantctgaagacttgttgtttggcgnttggataaattnaagctggntcatctgctgtgtca

SEQ ID NO: 68332 - DNA, 109 bp, Triticum aestivum
  Clone ID: PAT_TA_68332
ttcggcacgaggctaaaaggcatgtatttactgttctgctgaaggaacaataaacatgtactggtagtatatataaggaacctgtttgagcttcggtttaaaaaaaaaa

SEQ ID NO: 68333 - DNA, 330 bp, Triticum aestivum
  unsure (1)..(330): unsure at all n locations
  Clone ID: PAT_TA_68333
acaacaaccatttccccagncccaacaaccattntggcagnaaccacaacaaantattccccaaccccatnaaacgntncaccattaaccacaacaaacatttncccaaccccaacaaacatacccccatnaaccacaacaacaatttccccaganccagnaaccacaacaaccattttcccaggcccaacaaacattnccccaacaaccccaantaccattttcccaacaaccccaacaancatttccccagnctcaacaaccccaacaacaatttncccagnnacaggaaccacaacaaccttttttcccagncccaacaacaatttc

SEQ ID NO: 68334 - DNA, 406 bp, Triticum aestivum
  unsure (1)..(406): unsure at all n locations
  Clone ID: PAT_TA_68334
ccatatncgcagccgcaaccatttncatnacaacaaccatatctgcagntgnaaccattttcgcagccgcaactaccatattcgcagccgcaactaccatattcgcagccgcaactaccatattcgcagncgcaaccattttgaccacaacaaccatatccacaatcgcaaccacagtattcgcaaccacaacaaccaatttcgcagcagcagcagcagcaacaacaacaacaacaacaaaaacaacaacaacaacaacaacaacagatccttcaacaaattttgcaacaacaactgattccatgcagggatgttgtattgcaacaacacagcatagcgtatggaagctcacaagttttgcaacaaagtacttaccagctggtgcaacaaattgtgttgtcagcag

SEQ ID NO: 68335 - DNA, 185 bp, Triticum aestivum
  unsure (1)..(185): unsure at all n locations
  Clone ID: PAT_TA_68335
tgttttgtgcacagatgacaagtacacanaggagtgagagcgcaaaccacatgctgaagtcttacatgccccctgcaagcccgatgcatgttttcgtccgtcaatacatgaggcttcaattcgaccgngagcgtgatgaaagctacgaggagaagagaacaatgattggcggcgctgtgcggcgg

SEQ ID NO: 68336 - DNA, 631 bp, Triticum aestivum
  unsure (1)..(631): unsure at all n locations
  Clone ID: PAT_TA_68336
tgcaggnaattcggcacgagggttccttcgtccttccgcccgccgccgccgccgcagccgaaatctcagctgaatcttttgcttagctgatcgctggatctcatgctaggcgttacttttgtttttccctgatttcttgtgcggcttgcggcgtttcttgtgatttcttgtctcgattgttcgtgcgaatttggtgggttggggggaatggtgtgatgatctcctttcaagagttgcagaatgaatcatgtgcatcacatctcaattccacacgagatttctgatcattccacctcctcgaatcaattgctctggttcctttctatttttgttcttggtaagagattggttgttgtcaattggtcgtcggtcggcaatgaggagcgaaacctgtgccggaggcggatgcgcccatgtcggtaacacaaccctctaagaagttctgagcccccaagttcgatccaatttttacttgcttttcgttgtttccggctgtgtatttcgatttgatggtggattgatttggattcatgcgaggtgatgatgttatgtatgatagtctgtcaatcccctgatgtcacaaggtgatgacacgcatacatcccgacaggctctgatcgcatctggactg

SEQ ID NO: 68337 - DNA, 552 bp, Triticum aestivum
  Clone ID: PAT_TA_68337
gctagctgaactctccgaacaaacacaacctaggtggttgtctagatcttgctttttcttagagggcaggccgcaggacaaagcaagagcttgaatcatgtttcccgaagcgacactttgtttcactcctttcatttatactctaagcgcgattgctataatatatacttccttgaccactttaagacagatcgatcttaagaagatcatcatctacagtgggagtccctatctactttcgattcccttcttactggctttgccaatacatcatactgatttgacgcttccttacgctttctttcaagcattgcttccaggacaacgctagttgctcaatccgttgcttgcttctcttctgtctaggaaaagtgaggatttcctatctgatccaagggaaggaagagaggtggaaagtgttgctgtgtcaaatcgagattgtgtgggtgtccgctcatgttcgacgctatcgaaaatcatgcattggatgagcaaaggtctcctctttctgtccactcttcccgaggagaacgatcccaaataaatagagtt

SEQ ID NO: 68338 - DNA, 773 bp, Triticum aestivum
  Clone ID: PAT_TA_68338
gactggaaggtacgcgctttctgtgagccgccctcattgacccaatcgacattttaaccctgataaggtcagttcttatttaaagatagacttatcaggagtatgcggggttagagtagcatcgtgcatcacattccgatttatccaagtttcaaggaaggcggctttatcagcctgaacttttccttgctatctgtaagtcggtccctctcatgacagaccggcgttttaaccttaaccagttcagggtcttgttgaaaagattgactgttaagagttcgccgggtcaatcaggattacctgatggagaagcatctggcacacaggcaggataacccggggttttaggtgaatacacctggcttccaagcctgacttttatagcctattgcaagggttatagcaactcttgttctttagaacaaaagagcccccaagcaatatttctgagctatgctcaatgggaacctatgtttgagttgtgcttttgcaacagactctctttggtccctttaacttttctgagaactcgaactttgcgagatatatttcttcttgaaccggatgttaaaccggatattgagagcttcaaagctttatgggagacatctttcccttgaaccggattttaaaccggaatcttcattttcagccggaaattttctgacagcctttacactcaaacttgtgagaaattaattctttgtgaaccagaaattcttaaactggatttgagagcttcagagctttgtgggagaacaaatttcccttga

SEQ ID NO: 68339 - DNA, 620 bp, Triticum aestivum
  Clone ID: PAT_TA_68339
ggagaattcttaattcaagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagggttccgttactaacatgtttacttccattgtaggtaacgtatttggtttcaaagccctacgtgctctacgtttggaggatctacgaattccccctacttattcaaaaactttccaaggcccgcctcatggtatccaagttgaaagagataagttgaacaagtatggtcgtcctttattgggatgtactattaaaccaaaattgggattatccgcaaaaaattatggtagagcgtgttatgagtgtctacgtg

SEQ ID NO: 68340 - DNA, 153 bp, Triticum aestivum
  unsure (1)..(153): unsure at all n locations
  Clone ID: PAT_TA_68340
gttcaggcgtcggcagctccagcggctgncgcgatggagggcggcncgtntncggnggctggggctgnggctttnccggcgacgtccctgnncgtgggggatctggacgtgagtgtgcangacncgcanctctttgacgtnttcagccaggtc

SEQ ID NO: 68341 - DNA, 914 bp, Triticum aestivum
  unsure (1)..(914): unsure at all n locations
  Clone ID: PAT_TA_68341
ctctctcgtcctcctcctcaagatgcagatctttgtgaagaccctgaccggcaagaccatcaccctggaggttgagtcctcggacaccatcgacaacgtcaaggctaagatccaggacaaggagggcatccctccggatcagcagcgtctcatcttcgctggcaagcagctcgaggatggccgcacgctggctgactacaacatccagaaggagtccacactccaccttgtgctcaggctccgtggtggcatgcagatcttcgtcaagaccctgactggcaagaccatcaccctcgaggttgagtcctcggacaccatcgacaacgtcaaggctaagatccaggacaaggagggcattcccccggaccagcagcgtctcatctttgctggcaagcagctcgaggatggccgcacgctcgctgactacaacatccagaaggagtccaccctccacctggttctcaggcttcgtggtggcatgcagatcttcgtcaagaccctgaccggcaagaccatcaccctggaggtcgagtcgtctgacaccattgacaatgtgaaggccaagatccaggacaaggaagggcattcccccggaccagcagcgtctcatctttgctggcaagcagcttgaggatggccgcacccttgcggattacaacattcagaaaggagtccacccttcaccttgtnctccgncttcgtggaggcatgcaaatctttgtcaagaccctcactggcaagactatcaccttggaggnggagtcatctgacaccatcgacaacgtgaangncaagatcaggacaagggngggcattccccccggacagcagngncttatntttgctggaagcagcttgaggatggccgcaccctggcagatacaacattcanaaggngncaacccttcacttgg

SEQ ID NO: 68342 - DNA, 211 bp, Triticum aestivum
  unsure (1)..(211): unsure at all n locations
  Clone ID: PAT_TA_68342
catctgacttggtatatatgcgtatgagctagtggctgcatgttcctgagcatgcatgcgtgagtggccttgtggccggccaagtgcatgtggcgtggctgtgggtgttctcctcccttggtggatggatggatgcccatataaataggcatggctagcttagcatgggtggtggtggcgtttggtttgtaagctaccttgngtagcttac

SEQ ID NO: 68343 - DNA, 605 bp, Triticum aestivum
  Clone ID: PAT_TA_68343
gcccggctccaatggcggcgaaggaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggtgtcaagatggagttgattgatgccgcatttccacttctcaagggagttgttgcaacaactgatgttgttgaggcctgcactggtgtgaatgttgcggttatggttggtggattccccaggaaggaaggaatggaaaggaaggatgttatgacgaaaaatgtttcaatctacaaagctcaagcatctgctcttgaagctcatgcagcccccaattgcaaggttctggttgttgccaacccagcaaacaccaatgctctcatcctgaaggagtttgctccatctatccctgagaagaacatcagttgtttgacccgcctagaccacaacagggcactcggtcagatttctgagagacttggtgtccaagtttctgacgtgaagaatgctattatctggggtaatcactcgtccagtcagtaccctgatgttaac

SEQ ID NO: 68344 - DNA, 576 bp, Triticum aestivum
  Clone ID: PAT_TA_68344
cacaattcttacaaaggttgtaacatcgtactgatgccgccatcagttcatgaagcggcgatcaatcctagctgcctaggaggaggtgaacttggtgacggccttggtgccctcggagacggcgtgcttggcgagctccccggggaggacgaggcggacggaggtctggatctcccgggacgtgatggtgggcttcttgttgtagcgggcgagcttggccgactccccggcgagcttctcgaagatgtcgttgatgaaggagttcatgatggacatggccttggaggagatgcccacgtccgggtgcacctgcttcagcaccttgaagatgtagatcttgtacgtctccacgctcttcttcgccttgctgcccttcttcctgccccgctgcttcgcctcgccgccggcctccttggacgccggcgcccgcttctccgccttgggcttcttccccgccgtcgtcttctccgcggccaccgccgcgggcttcttctccgccgccttgggtgccatgggtgctgctgctgctggtggttcgagcgtgtggggagatgggatgtgaggtgggaatgcggc

SEQ ID NO: 68345 - DNA, 154 bp, Triticum aestivum
  unsure (1)..(154): unsure at all n locations
  Clone ID: PAT_TA_68345
actcctctgtactttttttacaagttactccttcgtactatgcactgtactgcaattctgtccatgaaagaatgcacgttcagagcagtgcaaaacacataaaatttcctncaatcaaaacaacacaaccagggacaacagaaaaaaaaaangc

SEQ ID NO: 68346 - DNA, 639 bp, Triticum aestivum
  unsure (1)..(639): unsure at all n locations
  Clone ID: PAT_TA_68346
caataaaagaattatcgaaaactcctcctcggtggatgtgatgaacaatgcatcataccaggattgagctgaggtgtacgaagaaaaaaaaacatgatatgctcaggcaagtgccccaaatgcccactgattagtgattactgtcagcaagaatcactacaatgtactcacatagatcatacgcactattgctatggcaggaatcgcatatcaggcgctgcacatggagaatcaatggaggaggtgccgcgcaacaaacacacaaaagaccagaaccggcacaaacgattgccaagccataatcacgaattctggcacatttctaaaacgaatctcacactgccaaaacaagtctagaacatctgaagccaattggaacttgccagaaggaaatggcaggtacgattatccttcgagttactttcatactgttgtggtttcaaagttctgccaacatatagcaacacaaattaacagccaaagactgaattcagggcgactgtcgtattttcctgtacacgttcattccttttaggctgtcatggctttcagtctccaatgagtancaaactgatttggcagcaccctgcacaccctnctnanagatccancggnagcctataacggncanngactcca

SEQ ID NO: 68347 - DNA, 270 bp, Triticum aestivum
  unsure (1)..(270): unsure at all n locations
  Clone ID: PAT_TA_68347
taatgcaatcccactncttcaatggtgtgtatgccattgagtacaattaggtaactcttgaaattcaaatatctcttgaactcatgagccaaactatcttctttcatcgttgccatcatcctcaaaacttgggccccaatagctgattttccttcttctcctgtttcttgaagagaattaacataaatttgcctaatgatgcttcnaataaaatctgtctgattgaaagggtacatcaatgtgatccaagcacaacaatcaaaattcgng

SEQ ID NO: 68348 - DNA, 186 bp, Triticum aestivum
  Clone ID: PAT_TA_68348
attgtcttgatacaactttatttgtattttatttagaatttaaacaactagtttgggcgggtcacacacgacgttgtgtgacactttatttgtcaccgctgcatcgacatatccatcgactaaacaacggtgatccaactatatattactagagacctttccttatcagtaggcaccaactccagc

SEQ ID NO: 68349 - DNA, 380 bp, Triticum aestivum
  unsure (1)..(380): unsure at all n locations
  Clone ID: PAT_TA_68349
aacggtgtatncatatatactactactagnagttcttctattctacagttagtaccgaaggatgccaactggagcaatggtgcaatatggagggatatagacattgcacattgcaggtagcgtctctagcgctaggttccttatttcctcaaactggggcagttgttgaggctggacagagccctgggcctgtgggttttgctgagatggctggaaggagccctggcctgatggatattgttgttgagactgttggaagcagacctggctcaacggttgttgttgttgttgttgttgttgttgttgttgttgttgttgttgttgttgttgttgttgatgcagaataatagcatgaacaacattgtggatggcttggcacc

SEQ ID NO: 68350 - DNA, 131 bp, Triticum aestivum
  unsure (1)..(131): unsure at all n locations
  Clone ID: PAT_TA_68350
ggggctagtaaactgcttnagnaggnnctacagcatnccattccaacgggtatgaaaactcggtcggnannccttngnactgatagagcacagcctacaatgtncanggcctgcatgaagttctcttggga

SEQ ID NO: 68351 - DNA, 529 bp, Triticum aestivum
  Clone ID: PAT_TA_68351
ggaatcgagacaaacaccgcgggggtatgtaaaaaatcttgtaatgctttttctttgaagtttattattcctagtatgagcttgcaattgtgtgtgtcgctctggcattgcttctcctttttgttctcccggttgcttatcactctacgccggtaggtcccaatccccaggcaggcttcagccgtcgctagtatgctaggtcgcgatgccgtggtcaaggccaggaggtgagcgtcccgaggtccggaagagctcccgaggtgcgatgctcaagatgtcccctttggcatgcaagcagctccctagaggccgaaatgggaagtagcgttgccggagcaagattacgggagtggaaaacatcgggcggagagattcacgccgacatgcacgggtaacttatcttttggcaagcctgaggcgattccttcatgaagcgcctggcagtattagcggcgatgcttccaggtagggctcctactggccttcccctttccgctcatctgagtgctctacgtccttgggtcccgac

SEQ ID NO: 68352 - DNA, 328 bp, Triticum aestivum
  Clone ID: PAT_TA_68352
caaggtagcactcacactgataaatctattggcaagagaatgtgttatgccaacaactgtttcagctctggttgcagacaaggtcatatttgcattccttcctgattatacacacatacatacatatcaatggatgctcttgttcataaagtcgaataaacaatgcaatttggacatctgcagcaaaatgggcaggcaggctgcggttgcagccggacacccccggagctccttattccggcgaccggcctagagctttgccggcgaggaggaggacggttatatacaatggacagagcacgaccttctatgtatgtacatgtcgtca

SEQ ID NO: 68353 - DNA, 143 bp, Triticum aestivum
  Clone ID: PAT_TA_68353
ctttatttgtcttttattccaagtcttgaactagcacaggtcggggtcacacatgatggtgcacgccactttatttgtcatcgttacaacgattggtgcataagctaagcaacgatgattcatctacctattagcataactcc

SEQ ID NO: 68354 - DNA, 113 bp, Triticum aestivum
  unsure (1)..(113): unsure at all n locations
  Clone ID: PAT_TA_68354
tactcaagngaaacataacgcgtcncananaatggtaaatatgnatgcntgctataccanantaaantngaccacagntgccaccgtgcaatntattanctaatnagaaatag

SEQ ID NO: 68355 - DNA, 306 bp, Triticum aestivum
  unsure (1)..(306): unsure at all n locations
  Clone ID: PAT_TA_68355
gagaagtagaagtaccatttgaacagtaactcgcatataattttcccatatgcagctaccgaagggcattggcgcagctgtatggtaaatgagctctctgctcagttactaaatcccattatttcagtagcttggacatatgtcaacagtaccagctaggaacaaccttntatataacatatatagctagctgcatccagcggcaagtaaaatgggaagaaaaactacatattatgtgttgcagtgcaatgaccgaatcaaaggatgtaatctctgcagtttcacggcttgtcgtcagcttgttcg

SEQ ID NO: 68356 - DNA, 244 bp, Triticum aestivum
  unsure (1)..(244): unsure at all n locations
  Clone ID: PAT_TA_68356
gnaaagccaaaaggctacaggctcctgtatgaactctagaatctaaaccgaagtgattcatacaactggttgatctggaacgcctacaaggctacaagctctggtatgaaccctagaatcaaacttgaaatagttcataaaaccgataaatctggaaagcctacatacaggctaaaagctctagtatgaacgannngtgtnaaatctgaaccaatgtaatcatctcgaaagtaaataacggaag

SEQ ID NO: 68357 - DNA, 263 bp, Triticum aestivum
  Clone ID: PAT_TA_68357
agaaaacggtgtttatatatctagtactagagttcttctcttctcagttggtaccaaagatgccaaatggcgcaatggtggtcgagcaatgtggagggatgtagacattgcacattgcaggtagcgtctgtagcgctaggttccttatttccgcgaactggggcagttgttgaggttggacggagccctgagcttgtgggtttagctgagatggctggaaggagacctggcttgatggatattgctgctgaggctgttggaag

SEQ ID NO: 68358 - DNA, 581 bp, Triticum aestivum
  unsure (1)..(581): unsure at all n locations
  Clone ID: PAT_TA_68358
aattttgattngtnctttaagatctgaatagagaatcttatatacgaggacagatgcgcatcctgcaaagttttgttcatggccatagcatataatttcattacgatccgagaagaaatgaaccccacacacatctagtcccgaagaaacagacgagttttgggtcagagcacgcagtggatttcaatgccttcaaggcgtttagacttgtggttgatcatcttgagcccgtcgccacagcgcacaacctcgacgcctgtcaagatggtaaggtcattgaccaccatctcatcatctagcccgtgtaaagggtagcctgctgaattacatggtgtgcggcactcgatattttgaaagctggtggcgatgcagaacttgcctgagccaaggttcagtaggtgcctctgccatgtcgaccactcgtcgggcagcggatcgagatagttccagctgcggtgctccaccggcggccaggaagacaggtcgaaggcacccaggcagtggtgggtgttgccaatggtagcattgaagccaaaccagaggccgagttcagggacgtacttggccgcgccatggaaggg

SEQ ID NO: 68359 - DNA, 660 bp, Triticum aestivum
  Clone ID: PAT_TA_68359
atgctgaacccattggtttcgttctactagtactaaatcactacttagcactatctttatttgatttgacccaatagttactggcttcaccgtacccctgtcaggcgtgccacatcaaccattctttggctagctaaggatacagctcggtgacggccatacaccccataacaggccttgtcttgtagtggctgaaccctgcatccttgaatatcttgccccactcatgctcttcacgctccttgcccgatgtcatcaccatcatcaacagatcgaacaacacttgggcttcgaacatggatttagaaggagacccgacgaccatatccacgattatcactttcccccctggtttggggatcgccttcttgcactgcgttaggattttcacacaatcctcatctttccagtcatgcaacacgtacttgaggaacaccgcatcagtccttgggatggaactcatcatgtcacctacaatgtactcgactgttccgtcggacgagatggaattgataacgttagggaggtctagaaccgagcacttaatgtgtgggaaggccttggcaattgccctcgccgccgtacccgtcccaccggcaacgtcaactatcgaggtaaccccctcaaacacctcgccacaattgctgacgatgaagttca

SEQ ID NO: 68360 - DNA, 421 bp, Triticum aestivum
  Clone ID: PAT_TA_68360
gtgtttgtcttttattccatgtttgaactagtatagttcgggttcttacatgatagtgcatgtcactttattttttcaccgctacaacgaccaaaccatggactaagaaaacggtgtatcatatatctactactagagttcttctattctcagttagtaccgaagatgccaactggagcaatggtgcaatatggagggatatagacattgcacattgcaggtagcgtctctagcgctaggttccttatttcctcaaactggggcagttgttgaggctggacagagccctgggcctgtgggttttgctgagatggctggaaggagccctggcctgatggatattgttgttgagactgttggaagcagacctggctcaacggttgttgttgttgttgttgttgttgttgttgttgttgttgtt

SEQ ID NO: 68361 - DNA, 388 bp, Triticum aestivum
  Clone ID: PAT_TA_68361
tagtatagttcaggttcttacatgatagtgcatgtcactttattttttcaccgctacaacgaccaaaccatggactaagaaaacggtgtatcatatatctactactagagttcttctcttctcagttagtaccgaagatgccaaatggagcaatggtgcaatatggagggatatacacattgcacattgcaggtagcgtctgtagcgctaggttccttattgcctcaaactggggcagttgttgaggctggaaagagccctgggcctgtgggttttgctgagatggttggaagaagccctggcctgatggatattgttgctgaggctgttggaaggagacttggctcaacggttgttgttgttgttgttgttgttgttgttggtgggg

SEQ ID NO: 68362 - DNA, 306 bp, Triticum aestivum
  unsure (1)..(306): unsure at all n locations
  Clone ID: PAT_TA_68362
ggttcttacatgatagtttcnngggactttattttttacaccgctacaacgaccaaaccatggactaagaaaacggtgtatcatatatctactactagagttcttctcttctcagttagtaccgaagatgccaaatggagcaatggtgcaatatggagggatatacacattgcacattgcaggtagcgtctgtagcgctnggntccttattgcctcaaactgnggcagttgttgaggctggaaagagccctgngcctgngggttttgctgagatggttggaagaagccctggcctgatggatattg

SEQ ID NO: 68363 - DNA, 664 bp, Triticum aestivum
  Clone ID: PAT_TA_68363
acattaagctgtcggcaataattttataacaaaaagcatctacccacctaaaagttcatacaagataatactacgtacaacgaaacaacattgaagtcaagacaatgaagcagctcatttcgacctattgcatcgtcgagcaatgatctcattctgcaagctcatgtagaactgttgttgtcgcccagtcatagcactaatatccatatccattattctcgcatcttccaaccttctctgaagttctaactctctttcccttacttccagcttctttctcttgaattctaactctctttcttttacttcaagcttttttctcttgtgtgctatcatgtctattccatttgcaatcctctcttcttctagtgcacatgcttgttcaaagtgctcatcttccttgagctctttcacgctctccgccactctcttatttgaccacagatgatttgccgcttccatgtaaatattatcatttggagagacagaacttttacaaggttgtaattgttctttctccgccatactacctattggtctttccaaaggctcattttctggagtaggaacctccgcttcaccatcaggccaaccttgagtttgggacggtgtctggacttgaattggggtgtcgtcttctgttttttctgagataacatatcag

SEQ ID NO: 68364 - DNA, 649 bp, Triticum aestivum
  unsure (1)..(649): unsure at all n locations
  Clone ID: PAT_TA_68364
tatgtgataatgtggatacaagcaaacaacatttattgagttntaagtacataaaatacgagcaacactcggctacgcatatatacagtcattatgatttaaagatttatctatagtacacattctctcgatatggccacaaactgtcttgggtggtagtcctttatttagcgtcaaatttgtatcaatatgctcgactgataccttttgattttgtacattttctttcaccgctaagtacttcgaatccatatgttttgctcctttcgagtacttgtcattctttgagaagaccacagcggaaatatcccaataaatcctcaatggccttacagtattatcaataatttgaaggcatgacacaaaattccagagccacaatgattgaatagtggcctcaaatgatgccacaaattcagcctccatcgtggatgtagcaataacaggtcattttccactctcccatgaagttgctcctccagccagcaaaaacaaatagtcgaatatagacttccttgggtcgacacatctggaataatacgaatctgtatcaaatcagctcaagatggcctggtcacatttatgtgagcatgtgatccttggtccattgcaagtacctaagaaactttttcgcaggcttccaatggcc

SEQ ID NO: 68365 - DNA, 643 bp, Triticum aestivum
  Clone ID: PAT_TA_68365
tattttgacatgccctcgattaaggatggcgcacaacgatcttaaacatgagtgactaatgatcaacgagtagctaatgaatggtacaagcctcgtcaccactcggacggggcgggctcggtgtcgtcttcacagctctctgggtggatggtgatggtgttggccctgaggtcgaaaatgaaacgcgtatccacctgctgcatggcgccaatgaccgtggggtggcgcgaggtcgtggggtacaccccaaagcacaacaactgcttgttttcaacctttacaaagaggcgtcgggagccgatttccaggtgcgcacgcgtgggctccccgtgccgagtaggcggaccctcatagtcgagcctcaaccttgggatgcgcgaccagatcccgggctcctcccggaaacacaggaggaagtcgcgatcgcgaacgcgcttgtacccccactgctgcaccatatgggccaccgcctcctccacgagcgtgtacgccgctggcaccagacgggtggtctctgtgccggcatccaggaagcacccgcctgacctgtcatgcctccgctcgaacatagtttggtggataccctggatcgggggacccgttgaggctcacgcccagaagctttcacgtagtaggccgagtc

SEQ ID NO: 68366 - DNA, 114 bp, Triticum aestivum
  unsure (1)..(114): unsure at all n locations
  Clone ID: PAT_TA_68366
cacatcattaactcaactagnggtaattaaatccctccgngaagaagtntacgagcacttaggtcactaaagnagngttgtaaacgctnttatntttntttacagagggagnnc

SEQ ID NO: 68367 - DNA, 158 bp, Triticum aestivum
  unsure (1)..(158): unsure at all n locations
  Clone ID: PAT_TA_68367
catgcatgnnnatgnagaaaccagacttcntacttcatgaacccntgagccatcttcatgaacccgccgccgccgccgctctncttntcctnctcgncactcttcttccccgacagcgatgcancccccttcatgacgtcgcatgagaccgaacccat

SEQ ID NO: 68368 - DNA, 667 bp, Triticum aestivum
  unsure (1)..(667): unsure at all n locations
  Clone ID: PAT_TA_68368
tatatttncctttgtgntggttgtttcaaagncatgcgatagnagcagcctaagtagcggataatcgatagctaaatgcacagcagtgtcttaggggattacataagatcaaaaaggaggataaacatagatgtctttgtaggcatttatactaatactatgttatatagaaaggggctcctgcaacttgcttatattgagtagacaatcaggtgcaatcccttggaagtgcatttgaagccgaaagcatatgcttgcccttcgttcatgtgggtccaacggaagaagtcgctccagcctttagtgatggtggcccttttgtcaactccctttataaagcgggccgtgacagtggttcttccatctccagttgtgattggaagttcaccgtggtcagcatccatgtgtgggaaaagggaaccatagaaaagtggacattaaaatacattcttttgccttgtgttgcaaatgtttctgtcatgtgtcacacatagtagttattaggcgtggtggtgctgtggatgatcttttgcagtgcacgaacattatggttgtagagcctaactatgttgccccacacaacgtggcgactaaactcatctaagtagtgcttgcaaggctcaccatggagaatgaactttctaggctttanatggattttcttgcc

SEQ ID NO: 68369 - DNA, 305 bp, Triticum aestivum
  Clone ID: PAT_TA_68369
aatgacatacaaattactatttaggaattcatctcaaggacggttattcttatcaacagatgcactaagtttcttgggagagcaacaacattgggcagaaactccgtctatctgtttgcaatagggaattagaccgtcgcagttacgcttgcacaagtccagattgcattccacgaaaggcatgaagcatcctccttctgggccaaacgcatcagaagacgaaatgacagtagccacgagcacaagagccaacaagcactggccacttgtgttcttcttgaatatttccatcagttcctttttct

SEQ ID NO: 68370 - DNA, 680 bp, Triticum aestivum
  Clone ID: PAT_TA_68370
gtttatacataacattagagacatatatgaagtgttatacaacacaaaaagagtatatacacaaacatatgtgcgaatcttggcgcagatcaacggcccacaaagtgcatgcccccgcacttgcgtgccctaaatcctctgtcggcttgtcgtgccatccaaaaagagccatgatggcgtttacgaagtcgtgtttggtattcctcggcctggataatttcttcaaaacctcttcaatcactcttgaatgaagattctgagaaggcaggggccttgaccacaaacttgaaagttatttaataccatccgttcatgcaaagaacaagcaatgcaaaaaaagggcactaaacaataaccccggcacagtgcatatagaacgagcttgtcaaaaacatgaacaacaagaacaagaagaaatacatgcaaatagccaacacccaaccaaaacaaaagtacataagaacgccgaaacaagaagatgcacaatggacaaacaccaactgctaaaaggacctaaaaccaagacaaggaaagaaaaaagatgacaagtgacgagaagaggcagaaagcaaaccagacataacaaaccctgcagaaagaaagagaaggcagcaggagcatcgtaggaaagaacttacctcgaacaatagccaagtaacagaaacaagtacagacaccgc

SEQ ID NO: 68371 - DNA, 166 bp, Triticum aestivum
  unsure (1)..(166): unsure at all n locations
  Clone ID: PAT_TA_68371
ctgttacacttttttattcatggctacncccccacagtaacagattcagntcatgctgcaccctncttgggtncaccgaaccaaccgaggcgggtgagcnactggttctctcctccttttccatctacatgctcggcttaatcttgagcngcgatgccagcttctg

SEQ ID NO: 68372 - DNA, 675 bp, Triticum aestivum
  Clone ID: PAT_TA_68372
taataaacagcgaacctatattttcagggtgtcaatgaatctcttcccttgacggaaatgttcaaagagcccagccacaaaatccttggccaccattttcatcacaacaaccatatctgcagctgcagccatttccgcagccgcaactaccatatccgcagccgcatctaccatatccgcagccgcaaccatttcgaccacaacaaccatatccacaaccgcaaccacagtattcgcaaccacaacaaccaatttcgcagcagcagcaacaacaacaacaacaacaacaacaacagatccttcaacaaattttgcaacaacaactgattccatgcagggatgttgtattgcaacaacacagcatagcgcatggaagctcacaagttttgcaacaaagtacttaccagctggtgcaacaattgtgttgtcagcagctgtggcagatccccgagcagtcgcggtgccaagccatccacaatgttgttcatgctattattctgcatcaacaacaacaacaacaacaacaacaacaacaacaacaaccgttgagccaggtctccttccaacagcctcaacaacaatatccatcaggccagggctccttccagccatctcagcaaaacccacaggcccagggctctgtccagcctcaacaactgccccagtttgaggaaa

SEQ ID NO: 68373 - DNA, 463 bp, Triticum aestivum
  unsure (1)..(463): unsure at all n locations
  Clone ID: PAT_TA_68373
ctgtgtttgtcttttattccnagtttgaactagtatagttcaggttcttacatgatagtgcatgtcactttattttttcaccgctacaacgaccaaaccatggactaagaaaacggtgtatcatatatctactactagagttcttctcttctcagttagtaccgaagatgccaaatggagcaatggtgcaatatggagggatatacacattgcacattgcaggtagcgtctgtagcgctaggttccttattgcctcaaactggggcagttgttgaggctggaaagagccctgggcctgtgggttttgctgagatggttggaagaagccctggcctgatggatattgttgctgaggctgttggaaggagacttggctcaacggttgttgttgttgttgttgttgttgttgttggtggtggggggtgtttgttgatgcagaataatagcatgaacaacattgtgc

SEQ ID NO: 68374 - DNA, 225 bp, Triticum aestivum
  unsure (1)..(225): unsure at all n locations
  Clone ID: PAT_TA_68374
ttttgcttttgctnaatatatgctttgtctctttagacattcgaatttatgcactcagatgaaacttccatccctctatctagacccattgggagaagagaaaggtaaatctagagagggaggggggggggggtaaaagctggggttngnttttgtnggccnctttncntttngggngtttnttgnaanccactcctcctatgctgntntncctgnnctttttgg

SEQ ID NO: 68375 - DNA, 120 bp, Triticum aestivum
  unsure (1)..(120): unsure at all n locations
  Clone ID: PAT_TA_68375
ccatcatggcttannagcatcaaaacaaaatcaacgcacatgttcttattacagcaggtnaaatctggagtgcaaagagctcctttaagtgagtgcncatctgttntgacgatcgccttg

SEQ ID NO: 68376 - DNA, 512 bp, Triticum aestivum
  unsure (1)..(512): unsure at all n locations
  Clone ID: PAT_TA_68376
tncaaaaccacaagncagcacaattcttacaaaggttgtaacatcgtactgatgccgccatcagttcatgaagcggcgatcaatcctagctgcctaggaggaggtgaacttggtgacggccttggtgccctcggagacggcgtgcttggcgagctccccggggaggacgaggcggacggaggtctggatctcccgggacgtgatggtgggcttcttgttgtagcgggcgagcttggccgactccccggcgagcttctcgaagatgtcgttgatgaaggagttcatgatggacatggccttggaggagatgcccacgtccgggtgcacctgcttcagcaccttgaagatgtagatcttgtacgtctccacgctcttcttcgccttgctgcccttcttcctgccccgctgcttcgcctcgccgccggcctccttggacgccggcgcccgcttctccgccttgggcttcttccccgccgtcgtcttctccgnggncaccgncgnggncttcttnt

SEQ ID NO: 68377 - DNA, 700 bp, Triticum aestivum
  Clone ID: PAT_TA_68377
gagatgccggtggaaaagaacaaatgtgacgggagcgtgtcatgcgaagaacggtggggtgctcccggttaccgggttcccacgtgtcgacggcatggcaacgaggaggaacaactaaggttcacgagcgaatacaacaaccaaccatgcatctcatacaacacaagcattcagtccacgggcgtcatctcggggttataccttcggaacgtgcaaagggaacgtttcccgttcgtagagggaagtaggctttctcgcgacggcggtagtggaagtagtcgatctcgcatgctctagggtcgacggtagaggttctcgcgatctcggtgacggtagtagttcagggtcttggcggttcgtcgtgtagccgcacatgttcaacgtggtacacggttcgaaggagaacttgacgaaatcgaatccctttggggttgtcgtggtacttggggtcttcggacccgccggtctcgttcttgcaacaaaagttgaacttgaagttattggttcatgggtcttcggcgacggtagtcgttccaggcgccgggtgtcgaggtacttggcgatcttagggttccgaagaaggcggtagaggtacttggcgcgtcataatgtagttgaacttgacgaaaaatgggtctccttgtggacttgacgcatccgagttcttcgggtttgtagctgtacttggcgttcttagtcc

SEQ ID NO: 68378 - DNA, 286 bp, Triticum aestivum
  Clone ID: PAT_TA_68378
cataacaagagtatcaagccctaggaggactatgaggtttcctaccgcccaagaccgaattcagtcacttgatacatcatcatcaccataatacagtcatcaaatctatagactaaactagcaattaaggatcaacatccatactatatcatgctcagcacacgcacaaaatgtttcaccgagcactaaacacaaccatctagccaaccaaacagcccgcaaggctcacccgagcacctcttgcggcaaaattctcccctatcatcaactagcaacacaaatcttg

SEQ ID NO: 68379 - DNA, 466 bp, Triticum aestivum
  unsure (1)..(466): unsure at all n locations
  Clone ID: PAT_TA_68379
cgtgggtcgaacaactggttattaaaaatataggttgaaaaggtggaatatgtacttttttggcgtccttaacaaccgtatgcaattagtggagagaaggtctgtgaaaatgcactggtggctgcccctgaggcagttcaggtcaaactaaagtgtgatggaaggtcatctgcaacatctaggctgtcgcccggtgacgaggaggccagatctttgtcaactncaaccgccatacatcaggagcccctccaacaaccattgtaccctatctccaccacccatttttattgcttgagatccatgcacatgactggaaatagagattgttcatgtccttcagtcttcctattagtactgcttataaattgcttatcacagaccattgcatctcaaagtggggtacatgtccttcttgctgcacgtgaagcaaaagttctgcagcttccaggttggacctacagtagtt

SEQ ID NO: 68380 - DNA, 128 bp, Triticum aestivum
  unsure (1)..(128): unsure at all n locations
  Clone ID: PAT_TA_68380
cttnaacactntctggaacacaccatagctaacttatcacagagacactagncacacgagggctgccggagcaccattagttcaccggcacggccggatctaggccttggtgnccttcttgggggact

SEQ ID NO: 68381 - DNA, 415 bp, Triticum aestivum
  unsure (1)..(415): unsure at all n locations
  Clone ID: PAT_TA_68381
tattacttgtncttgaatttgtactacatacggatgtatctaacctagactacaaacttcagaaagtggcacgcgtggatgacccgactactaacaagattacatcacanaaaacgatataactgtggagaggaagcaaggagccacagagcaacaatgaatagtcgagcacaacacctaggacatgacagtttcaattttgcatacgggcttcataggagaaggttgcaagccacgcaacgacgtagttcaacgcaacattcggggagcaccgcttgctgaaaactgtcctcatagagtcatcgttgccgcagtcgcctcgccgtccgcagctccgacttntttgtgacagtcagaaaccagcaaaggcacacccatgggtgcaccggaccttcaacgcaagaaggacaagacg

SEQ ID NO: 68382 - DNA, 283 bp, Triticum aestivum
  unsure (1)..(283): unsure at all n locations
  Clone ID: PAT_TA_68382
acgtgaataagttttaaccctataaaaaggtatacatgtctacgacacagnagtaaacagagacttgaaagagaaaccacttgaatcacagctcaaggaaccagatccacaccgacccaaccctagaaacaagagcattactgagccatgaaatcaaaacggcaattccgtaccagaattccccagcctaaaatcttctacgctncattcgcctatccaaaaatcttacaaaaatatgcctacgtgtaacgccccatcgtcaaattaactctttnttgactnc

SEQ ID NO: 68383 - DNA, 171 bp, Triticum aestivum
  unsure (1)..(171): unsure at all n locations
  Clone ID: PAT_TA_68383
tcntagaaacctaagcagacggnggtnggataaaganattaacttnctaaactgggtncacaaaaaagtcgaagaaacctgatgcagaacaaatctacatnttggcctncttggggtcctggtattnagcttncggagtctggncgccaccaccactgctgccgctgtcgg

SEQ ID NO: 68384 - DNA, 619 bp, Triticum aestivum
  unsure (1)..(619): unsure at all n locations
  Clone ID: PAT_TA_68384
aaatgaaagttgaaaacagggactngcaacatgctggcaacataaatgtacatactagtgcgtcaattgccgagttgctttccaagattatcaacatccaagagaaattgggcaaacgccacccgcgacgggccaccttcctccagggccgccttggcctcttccctgagagcagctacccgggccctgagatgcctcccttcctcaccctcaatcacgagccgcaccttggcctccacctcgcctgctttcacaaaacctgtcatgtatccctccagctccacagcgacgcccatgccctctgtcatggacaccttgttcatcctttgctctccttccagcagcagacacaacatcggcaccccagccacaatggcctccagtaccgagttccatccgcagtgtgtcacgaacgcgccggttgccctgtggccgagcacgtccatctgcggtgcccacgacttgatgaccagacccctgccattggtccgctctaagaacccttgaggcaggagcgcgtcaagttccggctcagggaacccttccaagtatttctctgggttgtcgctactgcaggcatgcgcacggaccacaagaaccgctgccctgacctctcaaa

SEQ ID NO: 68385 - DNA, 100 bp, Triticum aestivum
  unsure (1)..(100): unsure at all n locations
  Clone ID: PAT_TA_68385
agagtgccctcgaggaggacatgctggtcgttgagggccttgtagcaggcagcaaggacgatctcggtgacgtaagcacagcggtcaatgtcatgangtc

SEQ ID NO: 68386 - DNA, 188 bp, Triticum aestivum
  unsure (1)..(188): unsure at all n locations
  Clone ID: PAT_TA_68386
tctagtactagagntcttctcttctnagntggtaccaaagatgccaaatggcgcagtggtggtcgagcaatgtgganggatgtagacattgcacattgnaccgtagcgtctgtagcgctaggntccttatttccgngaactggggcagatgntgaggttggacggagccctgagcctgtgnntttanc

SEQ ID NO: 68387 - DNA, 626 bp, Triticum aestivum
  unsure (1)..(626): unsure at all n locations
  Clone ID: PAT_TA_68387
ctaatnctcttggtagcacatggatgtaggagcaacaaaacaaagaagaacatataaagaaaggaaataagaagacacctatttcttccgagcaatgtacatgctatcacacaacatgatcatgcctatgaattgaacatcaggaaaaaagaaaatatcatatgccaatgcggaggtaagggccacgacacacggtgaaccaccgggacacatagtgagccaggcaaggtgctcttcctcgagtcctactggtctgtcaaaagcacacggccaaccaccgggacacatggcgagccgagcaaggtgttgttcctagagtccttctagactatctgaggagggttggcatggggggaggcacattgacggggagaacacaccggtgtcggggatgatgctggcttaaaaagctttggcatagatggcgaagggattctcatctagcacggtggacttgaccaatgtgacagcatcagatccagaattcccagcatgtatgtctctctcctctccttcgcaaacattatcttctccttttgatatttgatttctaccacgtaataagcaccgccatccatctttcaaagtcctggttgttattttgcatcatggtttgtggcaatctg

SEQ ID NO: 68388 - DNA, 683 bp, Triticum aestivum
  unsure (1)..(683): unsure at all n locations
  Clone ID: PAT_TA_68388
tcacccgaaatgtatattttttattttttatttttntttttatttctcttgtttttgctatatgaataaaattcaatgcaaagtttgagaatatgaatcatggtgtcgatccaatgctcattagttttatgtttgcgtatatgtagtgagcaatcatatctcaacgtgatgaacgagtcagtcggcatagatagcatttcactgtcgactcagcttgaggttgatgaagctcccattggggttgccccaccaaactccgagcttgtcgacgaccaccaacaaattcccattggaggagctggatttgtgttgaagacggcagtcaaagagataatagcaataaagaaagagttggaggcaaagaaaaaacaagaggaagcaaggttgttggaggtcaaggccacgtaggagcacaaggtgacatgtgaggagcgcaaggaagcaattgaagaagagaagttgagggtccttggagaggaagtgaatgcaaagatggagaagaatacaagatcatgttcatgaacaccactaggcttgatccaaaccaaatcaagtaccttgagttgatgaaagcacaaattctagcatcaaagatgagaggggatgcgagtgggagtgcaaatgggagcgagtgatgctctatgttcaattttcatgtttatgtgaatcgtatgttgcacttt

SEQ ID NO: 68389 - DNA, 105 bp, Triticum aestivum
  unsure (1)..(105): unsure at all n locations
  Clone ID: PAT_TA_68389
cttttggcacagnacacagtacgacagnacgaagtgacgaaacccggcaacaccggctcacaacacccaccaacattgttcatcgggtattacacacgatattca

SEQ ID NO: 68390 - DNA, 260 bp, Triticum aestivum
  unsure (1)..(260): unsure at all n locations
  Clone ID: PAT_TA_68390
gctcgccntcaaccttgncaaacccccgcagnggggcgngcgagattgcggntcctncaatccatctggatctagcgnggccctcggcncctaancgtnccatcttttatgctgattcacaactgcagngncaaatcgccaacttancctccgcctganancatggnttccacgaggtctnaacctccccatcagcnccggnaanacncctccccatnaacnccnttaanactgctgcctgctaatctccaccacctnag

SEQ ID NO: 68391 - DNA, 155 bp, Triticum aestivum
  unsure (1)..(155): unsure at all n locations
  Clone ID: PAT_TA_68391
atggcctaaggggcagttttaacctntttttaacangctcctaaggcctcctccaaacacccanttgntttaaattataangagcgcactntgctcaactnacattttnttggggnccaagccgntttcattttggtngccttgaaaaattgngc

SEQ ID NO: 68392 - DNA, 339 bp, Triticum aestivum
  unsure (1)..(339): unsure at all n locations
  Clone ID: PAT_TA_68392
tgtgtttgtcttttattccnagtttgaactagtatagttcgggttcttacatgatagtgcatgtcactttattttttcactgctacaacgaccaaaccatggactaagaaaacggtgtttcatatatctagtactagagttcttctcttctcagttggtaccaaagatgccaaatggcgcaatggtggtcgagcaatgtggagggatgtagacattgcacattgcaggtagcgtctgtagcgctaggttccttatttccgcgaactggggcagttgttgaggttggacagagccctgggcctgtgggttttgctgagatggctggaaggagccctggcc

SEQ ID NO: 68393 - DNA, 102 bp, Triticum aestivum
  unsure (1)..(102): unsure at all n locations
  Clone ID: PAT_TA_68393
aagggaagctcttgagaggccacacacatatnatgnaaaagccaatgcttctactcccgcggntaaactagaatcactacgccagaggaggaaatgtgtaac

SEQ ID NO: 68394 - DNA, 156 bp, Triticum aestivum
  Clone ID: PAT_TA_68394
catgacaagaacaacacaggcacattctgaaacactactagcacacgcacttcctaacaaggatctaacagacgacgcatggattgcagatcgcggcctaggccctctcgccacggatgcggcgggcgagctggatgtccttgggcatgatggtgc

SEQ ID NO: 68395 - DNA, 236 bp, Triticum aestivum
  unsure (1)..(236): unsure at all n locations
  Clone ID: PAT_TA_68395
aaatgcgcagcttacaagttgagatggattgtactgcaactgccaccattgatcgctcctgcccactccagaaaactacttttgctgccggtcccattgatcgctaaaaaccaccgcatgccaccgtcgccggcggccggcctctctctctctctctctctctctctctctctctctctctctctctctctctctctctctctctctctctctctntntntctctctctctctnng

SEQ ID NO: 68396 - DNA, 213 bp, Triticum aestivum
  Clone ID: PAT_TA_68396
aatatgatgtacatctaaagtctgaattgttctccttttaagacatctatgaacattcaatagacattttagttccatagcccaagacaaattgtcaatcatgaaccccaagaaacgggatcaaggagtcaatattgaacatcaaaatcgaaagatggccatgttatagtacatatgtgtagctctggggctttgttggctgctgggtggctt

SEQ ID NO: 68397 - DNA, 657 bp, Triticum aestivum
  unsure (1)..(657): unsure at all n locations
  Clone ID: PAT_TA_68397
acaacagttgagccttgaagtgtttgaagtatatttatgaggagcagcaaaccttgctaacagataatcctactggtattttaactctacaacaaatgcaacctttattcctgaacaatcccactggtattcatttcccttttgtgcaagtgccaaattacatggtgggtcaaaaaattacagaacatacacatatgaaaaatggaaaattttctgccatacagctgtttctccagtaaaaagaaaaaaagaccaatcgaatcttgttgctaaggatgctttcctgtacacgccgctatgatgcttttactgtggttaggtacttctcctgaattgtcaatgcccctctacatgccttttttgcatccaggcttccagtgatttcattcaaaatcttgacgacatcgtcgagaccttttgcctcccccagtaaccgcttgtttctagcctctatgacgctagctacaacaaagaccgatagagggatctgctcctcttgcttggctgcctgcaattttttcctttcaaactttccacactgttttagggtattttcatctttttcatttggtgggcccgtgttactctccaacattgaaaaaaaacctggattgtactncatanaccacatgagctcccaaaggtacattgngtcta

SEQ ID NO: 68398 - DNA, 619 bp, Triticum aestivum
  unsure (1)..(619): unsure at all n locations
  Clone ID: PAT_TA_68398
atgtttatttagaaacctgaccaaaaaactgctagcaaagacatttcccctgatggagaaagaattattctaccatttagacttgacaggcttgaagtctctaccaaactctgtaatattgcgctgcgcacttccaaaaaatatacattaggttcatcttaggatctttttgcagtacgtttttgcactgaggtagttgctatagtcttgcaaatactatttctctcttagattcttaaatgcagaagcaaatacacactacattttcttatataaaattgtgaaaagagcaaatatggaagcaggacaatgttcaagcatcattaaatcattgttgaaatcaacataaagttgatcgagcgtgagaaaaggtacctatacttccaggccggtgtcatgattgaggtaggaagggatgcccagaagcccacgagcatgttgccctatgtacatagttaattgtgcaatgggaccagaatttggaattttttacccacttttgttcatctggaccagagtatcttcctttatcctgattgacatattncaactcaaacttttttccaaaaatcatgattctaaagtgtgccctggatgagatatgctcactatgcagcaa

SEQ ID NO: 68399 - DNA, 430 bp, Triticum aestivum
  unsure (1)..(430): unsure at all n locations
  Clone ID: PAT_TA_68399
acatttgtnagcaaccaaacgaagtattaagtaacttttgaaagtaaaacaaaattatttgcttccgcccttgcataccatccttcacccttctacagtaacgataccacgcagaaaagatgttcgctccagcgtgtgcgtaccaaatgccaaacaagagaccagcaagatgaccagcatggtccagcaccatgtatcgccacttggttgccatgccaaccagaagaccaacagcatcaaaagtagcaatgcctttaagagcagaatcagcagtgaaactccattggggaaggaaaacaatactaagacgactttcagggatttttgancagatgtaaccaattaaacccatgattgctcctgatgcacccagagaaggcacggttatcccaccaagaagtttcanaacaaaactgtcaaagcttgatgc

SEQ ID NO: 68400 - DNA, 176 bp, Triticum aestivum
  unsure (1)..(176): unsure at all n locations
  Clone ID: PAT_TA_68400
gnttcgtacaacggnacattgacactgnacattgttggcagggtacngagtgcaatggaagtcatnacctnaagctgagctatntggtgtggctgcaaaaaggtaccatgtgccaattgttgttgttgaggttgttgcccgagttgctgctgcaactgctgttggggttgggcctc

SEQ ID NO: 68401 - DNA, 110 bp, Triticum aestivum
  unsure (1)..(110): unsure at all n locations
  Clone ID: PAT_TA_68401
gccaaatcttcanatgggctctggtaagcatgngtgctttcgccaatgcaagcataaaaactcctcnaacttggtgaaagcaatgcatccttnttggtttgccgcanagg

SEQ ID NO: 68402 - DNA, 182 bp, Triticum aestivum
  unsure (1)..(182): unsure at all n locations
  Clone ID: PAT_TA_68402
cttgncctntttcagcccatgtgcnaaggacaggaaagntggatcagcagctccctncttgnagtaggngaacaccacgccgncatcatnatgcatgctctngccaacaaagaactgaaggnccttgagcttgctaagaagatactttgtggnggactcaacattcttnttgaaagcatcta

SEQ ID NO: 68403 - DNA, 159 bp, Triticum aestivum
  unsure (1)..(159): unsure at all n locations
  Clone ID: PAT_TA_68403
acggcgtctnggatgangttntcgaggaagatnttgagcacgccgcggntctnctcgtanatgagcccnnagatgcgcttnacgccgcccctacgggccagcctccggatcgccgnattggtgatgccctggatgttgtcgcgcaggaccttgcggngg

SEQ ID NO: 68404 - DNA, 127 bp, Triticum aestivum
  unsure (1)..(127): unsure at all n locations
  Clone ID: PAT_TA_68404
anctaaaaagacccaanctccaaacctttccntgataagagcagggngaatntgatagcnctgntcactgancaaattnggggaangcncgttcagggtcganccacgtccactaatatgccttgnt

SEQ ID NO: 68405 - DNA, 242 bp, Triticum aestivum
  unsure (1)..(242): unsure at all n locations
  Clone ID: PAT_TA_68405
ttgtcttttattnccntgtttgaactagtatagttcgggttcttacatgatagtgcatgtcactttattttttcaccgctacaacgaccaaaccatggactaagaaaacggtgtatcatatatctactactagagttcttctattctcagttagtaccgaagatgccaactggagcaatggtgcaatatggagggatatagacattgcacattgcaggtagcgtctctagcgctaggttccc

SEQ ID NO: 68406 - DNA, 291 bp, Triticum aestivum
  unsure (1)..(291): unsure at all n locations
  Clone ID: PAT_TA_68406
tttggtgtngttttgctatttgntttttgcgatattattattatttattggtgttnttaattagtagtattttcccaatgttcagaatcaaatttaaatttgtcaacacatatttcaaattctagatcagtntttttaattttaatttaaaaaaatcagacacattttcgaaacgttatgatttaaaaaatagcaatatttttaaattcacgtatatttttttaaatttatgtgaatatttttaaaatctgaattttgcaacaaccgaactagacttgccgtgggccgctg

SEQ ID NO: 68407 - DNA, 406 bp, Triticum aestivum
  unsure (1)..(406): unsure at all n locations
  Clone ID: PAT_TA_68407
ctaaactaacttactaagttaacatgcatggtacggcacgtgaaggtcaatccttgcttgtaagcagtgcaaattctgtagtacaaccgtctgattgaatttttttgggagaaaatggccaagtctaacatgagcctccgatgcattaggcaacgtatttgcgacatggtgactgatgacatgcatagctctgctacatagttctgcttcaactcggtctccaactctgtccaacaatgatgctagctcggggaaatcatttttgccacctagagacaaccatagacagcaatttatgggctcaccaatcaactggccgcccttagagaaataactcctncattaattggggttcattgcatcatcatgtnncacaccactgttttaaacgctatacacttgntta

SEQ ID NO: 68408 - DNA, 109 bp, Triticum aestivum
  unsure (1)..(109): unsure at all n locations
  Clone ID: PAT_TA_68408
aatgatttgtgacgaggccgtgatggctgctgctcccctcctttcgtcgattccggatcgaggccacgcttcctcngctcgagctccctcctgccccagctggatcgag

SEQ ID NO: 68409 - DNA, 443 bp, Triticum aestivum
  unsure (1)..(443): unsure at all n locations
  Clone ID: PAT_TA_68409
cctcaaaaaaaaatgatagattgcagggagtgtttttatttgtacagggattgattttatttgctcctgatatttgccttctcccggatagcattcatgtaaactatatcaagaggagcttggcgcagcagcatggttggcttgtcctagatccaaactgatcccgaacgagaggccgattctaaagccatgaaggccctgaaatcgccagatccaggtgcatctcaagatggcagaggagcggaggagctgtgggccgacccgtttgtagggtgcctgttggcttggaagggtgaggcggcgtccgtggtggaggagaaaaggagctgcagatccatggcgtccttcacatcttcgtgaagaagcccttgacggcgacaaccatggtggatggggaactcccatggcgtcgaaggtgaggtgtangggtggtggatcccgac

SEQ ID NO: 68410 - DNA, 112 bp, Triticum aestivum
  unsure (1)..(112): unsure at all n locations
  Clone ID: PAT_TA_68410
gcntttatgcgcnaaaacaagcgaagctaacaaagaaagcaacancatctgcntttgaaggtggancgncactaggtcccnggtttaaacagtnccagaaacagctagccaa

SEQ ID NO: 68411 - DNA, 287 bp, Triticum aestivum
  unsure (1)..(287): unsure at all n locations
  Clone ID: PAT_TA_68411
cgcacgcgaagtggacctangggattttagaagtcaaaacaccgaagatgaacacggagggctatcactaaagtaaaatgctggtataaacacttggggatgtttcgcctaactggcacttgcgacattcccaaatatttctcgctgaacagtgctgatacatctgtatgttacaaaagaatacaggaacaaaactgttacatnatcatcaggagcacaatctgtggtcatctctgttaacaacaccgtatatatgccttgcagcttttaccacgacgacaagacgg

SEQ ID NO: 68412 - DNA, 305 bp, Triticum aestivum
  unsure (1)..(305): unsure at all n locations
  Clone ID: PAT_TA_68412
gtttcagntaatattacagtgacctgcaggcgcaattcctgctcgcctccagctcattaaaatttcatatacatcttgaanggggtcataggtcgatgtgtgtgttcttcgacaacgtgtttatcataataaccgtgtgcttccgacttcgctggtaggcgatcccggttcaaaactcctctccctttgatctaatccttaaagttcaaaacgtgtctcacttccctgcccatttcctcttggatgctcatgatcatcatcatcacaacatcttcgttcgactccgacgaatctaagcctcganc

SEQ ID NO: 68413 - DNA, 121 bp, Triticum aestivum
  unsure (1)..(121): unsure at all n locations
  Clone ID: PAT_TA_68413
acatttttatttattnaatacaaatggnaaacacaactttgttgtcaaccaatacaaccacttggtccaccataattgaatgtataacccttcttaaattcaagaaataaatcatttgcat

SEQ ID NO: 68414 - DNA, 510 bp, Triticum aestivum
  unsure (1)..(510): unsure at all n locations
  Clone ID: PAT_TA_68414
tgtttgaactagtatagttcgggttcttacatgatagtgcatgtcactttattttttcaccgctacaacgaccaaaccatggactaagaaaacggtgtatcatatatctactactagagttcttctcttctcagttagtaccgaagatgccaactggagcaatggtgcaatatggagggatatagacattgcacattgcangtagcgtctctagcgctaggttccttatttcctcaaactggggcagttgttgaggctggacagagccctgggcctgtgggttttgctgagatggctggaaggagccctggcctgatggatattgttgttgaggctgttggaaggagacctggctcaatggttgtttttgttgntgttgttgttgttgntgttgctgttgatgcanaataatagcatgaacaacattgtggatggcttggcaccgcgactgctcggggatctgccacagctgctgacaacacaattgttgcaccagctggtaagtacttt

SEQ ID NO: 68415 - DNA, 131 bp, Triticum aestivum
  unsure (1)..(131): unsure at all n locations
  Clone ID: PAT_TA_68415
atatgatatttattagagacggtggcnggctgcccatgaaggcaggggcttattantgatcctcgttggtgtcatcaancatcancatcttcttcttcctctcctcatncaattatcgcgagncttcacgt

SEQ ID NO: 68416 - DNA, 723 bp, Triticum aestivum
  Clone ID: PAT_TA_68416
ctccggttaataggttagtcccaaaataatataaaagtggataataaaacccaataatgtctaaaacagtagataatgtagcatgaagcaataaaaaattatagatatgttgaagacgtatcacaccacctgaaaaaacttcagtcggtacaatcataaaatcgacaccctttaatctatattccataacccaccccatcagttatactgtagcatatatatgttccaaggtcttctctaagctccttcagcttatccgttgccattgtacaaccttcaacattcgtgacaccgagtttgacaatccccatgtccataaggtgcaggtttgggtgtatatatgttgatgactttggttggctctggtccttttggtatcagaaaaattcagcaggcaatatagcgctagcatcctttgtcgagcacttcattacaggtttgggagagattttgacaacgtccggatgcaccactgaatctcttgcaacgatgccgccatggtagagatgatatgaaaaatctcagctgggctgtattccttgatggggccgcgtagaggcagcatgcacaattgcagcagagcgtgacctgacaccgcgagcgcaggcatcatagattggcgcacaagtggaggccgatgaatgcccgtgcatttactctaatgcgtaaacaagactcatatccatcacaatttctgattgttaggttgtaactgactggagt

SEQ ID NO: 68417 - DNA, 693 bp, Triticum aestivum
  unsure (1)..(693): unsure at all n locations
  Clone ID: PAT_TA_68417
cattagtagaaatcnttctcacaattagcatcctttgtaacaaatctaggaacacatacaaatactaaaagtgtatggaattcacaactaaaacaaatcagacatgatgtaaataattaaagagaagacactacaaactagaactaagctttacatacattatacataatatacattcgtttaaaaactgattcttgtgtagttgctccttgctcctgcaatgctttccaattctaaaatctcagttacccatacaaatgtcttgagggtgtcttggagcaccaatgtcttaggttgtgttggagtggtcggctcactttttgacttggtcgcactgctatttccagcatgagcatttgccgattcttgaccaccatgtgcttttgcatttgaggttcaatgcaactgtaagtaaacttgttcaaaaattaggcattgtatggtaatgaagaaatttatgcacacagacacaaataaactagtgtaaccctttccttgttagtgaatagttggttccgtaagttgattcttcaaggccttgcctttatcaaacttttcaagacgtgctttcgcaagtttagtttcatttgtaagtaaacataaacaaatcacaatcattatttggtatttcaaaaataattgataaatgagagttatgagaattattgtcaccttctctttgatatgatcgac

SEQ ID NO: 68418 - DNA, 230 bp, Triticum aestivum
  unsure (1)..(230): unsure at all n locations
  Clone ID: PAT_TA_68418
cttctcacgtgtggggcttggagtagggaggctctgggctgcgccggatggaggagcagagcggccgcggcggctggtggtggggcggcggaggcggcggatggcgaaacgantgactgttccaagaagtaggcgggtggtggtgtgggggcggcggcggccgatggcgaaacnactnantgntncaagaantacncgggtggnggnttnggngcggnggnggcacgatg

SEQ ID NO: 68419 - DNA, 152 bp, Triticum aestivum
  unsure (1)..(152): unsure at all n locations
  Clone ID: PAT_TA_68419
ggtgcatgcatgcccaagcaccatgcaagctgcagagngttctatcactggctagccgncaatgcgtcgcccccctccatccgacacactgttnggcagctgtgtcgcggnctgctncgcctttgccaccattnngctggccgcttgctgnt

SEQ ID NO: 68420 - DNA, 349 bp, Triticum aestivum
  unsure (1)..(349): unsure at all n locations
  Clone ID: PAT_TA_68420
gcaaaaaaaaaaagtcgagactcccggggatcaacatttccctcaaaagaaaaaaaaaactgcatggntcaacacggccgnggntnctgaaataggcaaagaacttcaggtcgcnccaatcctntntggcttagtatcctccttggcaggggggaacttnttgaanaatgggttcttnttgatnaacggcaggagcttnttgaanagctgagggtccgtntccgggtnttgcnccatnttntggtcagcggnagggtggtanatcggtgtcgggtgcgtgtncnccggcgtcggcggtttgtgctccggcncgggcgtcgggtgcgtgtncnccggggngggtgtcggc

SEQ ID NO: 68421 - DNA, 185 bp, Triticum aestivum
  unsure (1)..(185): unsure at all n locations
  Clone ID: PAT_TA_68421
aagcaacacacaanntaggngctnatactcgcctgatacactcgtagtacatgactgttattctgaaccctcaattctgtaatgcacatagtaaaacggancancgaatggcggagcaccaaacaattcccacgcatgcaacgcatcataaatagcaacgacgtcgntnantnactgaccatgaa

SEQ ID NO: 68422 - DNA, 648 bp, Triticum aestivum
  unsure (1)..(648): unsure at all n locations
  Clone ID: PAT_TA_68422
gagcagaagcatattgtttgtggctgcaaccacaactaggtccaggcatgtgaacacaccaccacaaataggtttagggtgtgtcattctcccaacacatgactcttacatattagagttcgataaaattaagcttgcctacaacaaagtacatatacaaattcacctcctacaacatgtctcgctgaaatatgctgcacacggacatatatagtgaagtacataatggatagttcctgataaataataccagggctcgagtactatatctagccagcatatttgcatcaccatcttgtatatcctccatttcttctcaaaagcatcgcatagcccaaacaagagactccaaatgtgtttgtcccgcttcatatacttggttttgacaaagatggagggaagccaaagtaccagtaaacatcttcatagtggaagaattccctcctcctcctacaaacctttgcaagttcagaagtcttgacatccagcgaaaaataatctacatcccagtcagtcttcgacaaccacactggtgagtcttcatcaatatccaactggtcttctgaagtggctccaaggaataagaatccctcanccgcgcccaaggtgaaataatcatactggccaggcaactgtataatgttctcc

SEQ ID NO: 68423 - DNA, 463 bp, Triticum aestivum
  unsure (1)..(463): unsure at all n locations
  Clone ID: PAT_TA_68423
aaaaattagccgcctatctaatttgtatcncaataacctttatccaagaagaccacacaagttcacaagtcttccaacattaataatnattttggcaacctatcgagtatttttttccctgatgatcattgattactcaaaatatagaaagaatgactgcctctgttacctatttgttggtaacttgagatgagccttccntngggttgccagatttcatcaaacaattatcttgtttgcttcctgatgagaccagctctgatcaccatatcatgatggggtcattataattgacctcaaccttaagctaggagcctagggctcgatttacttatcttgcagattccaatcggttccatgtttgatcagcacagatgacattttgctggcagaatgcactgcaattcaaacatacgctttnacaatacgaaccacattgntaccaccacaaatatccccanaa

SEQ ID NO: 68424 - DNA, 143 bp, Triticum aestivum
  unsure (1)..(143): unsure at all n locations
  Clone ID: PAT_TA_68424
atgcatnggcgangacatcaacgggcaaggcgccgagganngagctctttcccgcgatgggacnaaccanggagcncgcantaggcnngaantcaangnacncgctnccatcangcgcgtgccatnncncataataacataga

SEQ ID NO: 68425 - DNA, 172 bp, Triticum aestivum
  Clone ID: PAT_TA_68425
ccttttgctgcctcaaattcactaacctatattgaaccattcaatatatagcacactttttttgggagcggatatatactcctagagtcggtgcctccatttttctatggttctcattgactgaatactacacatcaagtgcaccttgatactggtagcaactggtcgcgtc

SEQ ID NO: 68426 - DNA, 800 bp, Triticum aestivum
  unsure (1)..(800): unsure at all n locations
  Clone ID: PAT_TA_68426
acataattnaacattagtcncacgcacgttggctactacattgcaataataacaactaatttagagatagttcctcccagcgatgaacacactaagcgttcagcaaaaatacacggaggcgcaaacacaaaatacacacagttaatttctaattctagccaattggtccattgactcgatttagcgtctagcagatgaagcggatctgaatgcataccatgtagaatgcttcattgtcagcactccaagccaagcctgatgtgaggacgccggagctcggccaactgatggatggagcaatcttcttcctcctgccaccactgctgcaccactctcctctcccaaccatccgcagaaaacttcctttatacattttgtcttcctgacattaagcctactttttccataatatctaatggtgaaaccatgcttccatgaataaagattgtaaaaaccataggtttcttacatagggtctagtgttagcccaatagcaccgtgctcacccaactaatctgtatacccctaaatcatttgctccagtgcacaaattcttcccagacatagtgtccggtcctgtaatttcagcggagcggagagtgtcgagcctgctgggacagggtgtcctgtaatttcagcggagcggagagtgtgccgagcccgctgggacagggtgtcctgataccaaaaccatgctcccacgaataaaggttgcaaaaatcatatgcttcacccaaggagttgaatgntaagccaatagcangctcaactacatggtctnccaatttatctgcatgccc

SEQ ID NO: 68427 - DNA, 215 bp, Triticum aestivum
  unsure (1)..(215): unsure at all n locations
  Clone ID: PAT_TA_68427
caaatgcactgctaaaccctggcctgggtattattacattatcnattttttttctattanatncantatctaaggcaagggatcttgaggtagacatatccggaggtgtccccttgcgcgttctggcagagggcctcggntcttccgtacggaaatgtgatcgccacggagntgacgtgnatgttggtgcagctgccgctctcnctgcagtanaa

SEQ ID NO: 68428 - DNA, 535 bp, Triticum aestivum
  unsure (1)..(535): unsure at all n locations
  Clone ID: PAT_TA_68428
acatgtgtttgtcttttattcccatgtttgaactagtatagttcgggttcttacatgatactgcatgtcactttattttttcaccgctacaacgaccaaaccatggactaagaaaacggtgtatcatatgtctactactagagttcttctcttctcagttagtaccgaagaagccaactggagcaatggtgcaatatggagggatatagacattgcacattgcaggtagcgtctctagcgctaggttccttattttctcaaactggggcagttgttgaggctggacagagccctgggcctgtgggttttgctgagatggctggaaggagccctggcctgatggatattgttgttgaggctgttggaaggagacctggctcaacggttgttgttgttgttgttgttgttgttgttgttgttgttgatgcagaataatagcatgaacaacattgtggatggcttggcaccgcgactgctcggggatctgccacagctgctgacaacacaattgntgcaccagctggtaagtactttg

SEQ ID NO: 68429 - DNA, 321 bp, Triticum aestivum
  unsure (1)..(321): unsure at all n locations
  Clone ID: PAT_TA_68429
gtagccttgatgcccttgtcctggntgtgtgcccttganctggatgccacagagaagttgggtatgtacccttgttgccctatgtcctgattgatgcccttgtcctgactgctgtgaagaagttggatagtacccttgttgcccttgtcctggttgcagncattgtcctggctgctgctcatgtcctggtngttgnccttgtcctgactgctgcggagaagttggntagnatccttgntgcccttgtcctggttgttgcagagaaatngggtagtatccttgttgtacttgtnctgattgntgtncttgtcctggctgctg

SEQ ID NO: 68430 - DNA, 305 bp, Triticum aestivum
  unsure (1)..(305): unsure at all n locations
  Clone ID: PAT_TA_68430
ttgttgacctcctccanctcgttgatnacctgnntggcgtcagtgcacccnaacataggcagcttccacattgtncaataccgnccatcgtagtacccangagatgcgttgtgctcacngaagatgaacccaaccttgctgaactcgangcaaggcacccacttgnagcggatcangtanncnacctgcttgangangncctccnnnctnancnnnnncanntaanacannnnctnnaacttnttnatnccctnnatngnccacacctnnatncacctnatncttncaccnntnntnacnctnnc

SEQ ID NO: 68431 - DNA, 209 bp, Triticum aestivum
  unsure (1)..(209): unsure at all n locations
  Clone ID: PAT_TA_68431
acaatntgaatcaggctgcctttcttaaaacattnggagctcactctactgtcaaaaagaaagacaccgaaccctacaaataaacataagcatcnacaccttntcgntgngnnagcnaaccagangcaagngtcggcgaccttcgngtgagaaacaacacagctccnccttcgagaaacacattaataaaggatcaaccttcacatggg

SEQ ID NO: 68432 - DNA, 348 bp, Triticum aestivum
  unsure (1)..(348): unsure at all n locations
  Clone ID: PAT_TA_68432
cgggttcttacatgatactgcatgtcactttattttttacaccgctacaacgaccaaaccatggactaagaaaacggtgtatcatatgtctactactagagttcttctcttctcagttagtaccgaagaagccaactggagcaatggtgcaatatggagggatatagacattgcacattgcaggtagcgtctctagcgctaggttccttatttcctcaaactggggcagttgttgaggctggacagagccctgggcctgtgggttttgctgagatggctggaaggagccctggcctgatggatattgntgttgaggctgntgnaaggagacctggctcaacggttgnt

SEQ ID NO: 68433 - DNA, 340 bp, Triticum aestivum
  Clone ID: PAT_TA_68433
cacgaacaaaataagataactgaacgctggctaggaatgtcgacagaagtactcaagaaatcagccatcaaaactgactacaaagttcacgacacccaggtggcacatatatcatcttctagatatgaagcagcaaaatagcgacttctattttctactcagcagcagcaacctcctccgctccaggaatcacctcatctccatcagcaggcctgtcaagcttcacaccaacatcctccttgtagtcaccgtgcacctccatgagcttccccaggtcaaacttgggggccttcaggatcttcaccttgcggacgtacacgttctggagggggaagatgcc

SEQ ID NO: 68434 - DNA, 334 bp, Triticum aestivum
  unsure (1)..(334): unsure at all n locations
  Clone ID: PAT_TA_68434
tattngatgattgcatngggtttaggtacaacaacacatgcatacaactgatacaaatgtaacccagcaaaaaaaaaaatntccctaanggtcgnggncaaaactttagaatacagaaaaangttctgggngtccaactntttcctccgngnggatttcaccttgctgcttattatcaccatcggangtagaagtncatatccttgngtaaactcttcatccttgcattgaatagatagatactccctccgaccaaaatacttgtagttggaggaaactagtacaagttcccccaactacaagtnttttggtacagaggtagtanatactatat

SEQ ID NO: 68435 - DNA, 314 bp, Triticum aestivum
  unsure (1)..(314): unsure at all n locations
  Clone ID: PAT_TA_68435
ggcgcgtctccctcgagcacatgaagaggaggcaggggacgagctacaggagctccatggtggaggtcatggcaggttgggcggcgccagatcgggtagaggaggtgcagggcgcatggatccgggagggaggcgccggatctggccggtggaggtcccgtggcggcgttcgaacctccaaggtgagctcgagcaatgggcatgggggtccatggtgctggcactgtgctcctggagagaaggaggcaaggagattagagagagagagagagaggggagagagaaaaggcagtggagcggcggcgtgacatang

SEQ ID NO: 68436 - DNA, 181 bp, Triticum aestivum
  Clone ID: PAT_TA_68436
cctcatctacgtcatcgatccggatcgtcttgggcacccacaccttgccattacccttggtatctctttcctcatcaccatctctaggatgctttcgggattggaagcaactggacattgtcgataccggagaagcagcactaggtggtgagttagattgacactgagactgtggctgcgg

SEQ ID NO: 68437 - DNA, 671 bp, Triticum aestivum
  unsure (1)..(671): unsure at all n locations
  Clone ID: PAT_TA_68437
caaaaaaacccgtccatgccaacnaaaaaaaaagacacgcccgagccaaaccaaacaaagaaacaagtgcgacagctccatcgcacgtcgctnggaacgccagttcgtcgccaggaacgccagtttttctntcgctggacccatactcgccctccggccacatccgccggaacggaaccagtccggccacgttgccaggaagccagaatttcctntcgctggacccatactctccctccggccacatccgccggaacggaaccagtccggccacgtcgttctcacgccaggtgggtgagctgcggccagctgcggcctntgctgccgccggaaccagcaacctctgctcccttntnatggngcagcctctgctcccgtctcatggngttgctcaccagggccatcggaaccagccacctccgcgcgccggctgttcctgcacccatctcctcacgccgcaggtacatcctcctgccaccatcctcctgccaccatcctcaccatggtctgacagtaactccctctcggccaccatgtgcactctttctccattggtagcccttgtcttcaactgcacaaacgacacgaaaattggcacatgcatagtgacatacgatgtcctttctatgtcaaatattcggtaaattggatgttgaatgatcccattagat

SEQ ID NO: 68438 - DNA, 423 bp, Triticum aestivum
  unsure (1)..(423): unsure at all n locations
  Clone ID: PAT_TA_68438
ttgttttgtttngtttctacttacaacaagaaaattatttattttatttctaattacttatgnattnnactttaattatnttattttcatttattntactgctgctatnttnatttaatntatnaaggtttattnattttagttactagtagcntattttattttattgtattaaggttnatttatttgtatttattntagnaaggnttatttattttatttactataaaaaatgaacatagatacgcctatagagaaaattcaacctaaattcataataaatttctatgaaattcaaagaaatttactatgaatttaggtcaaattccctgtataagggcatctattttcactttgagaggagctcaacaaggcagagagggacgggcttataaactggngtgagcgcccttcggntggnga

SEQ ID NO: 68439 - DNA, 227 bp, Triticum aestivum
  unsure (1)..(227): unsure at all n locations
  Clone ID: PAT_TA_68439
gttaatancagatntatcantgcnggttnaacctggntncttgctactacagaaataattcagngaacaacgcncanggctgatcagatccagagtncaaanggnggcatatggagtncacagagctagtcttggntaatgctaacctggncctnattttgatttccgttttntgagaaggttaaagtcaancttttnatgcttgttcnacttgccagacccacnac

SEQ ID NO: 68440 - DNA, 210 bp, Triticum aestivum
  unsure (1)..(210): unsure at all n locations
  Clone ID: PAT_TA_68440
ccgtgcttttcgtacnaataatgcatagataacacgaaattatcccgggcccagcaggcctctttacttaatctattaacaaattattaaaataataaagaaatcgacctcgaagagttctttaatagcaacaggtcaagatccaaaacttnacaatgcagcaagcagcggcagnttggaaaagccnaaacagncggcatagaaagggga

SEQ ID NO: 68441 - DNA, 220 bp, Triticum aestivum
  unsure (1)..(220): unsure at all n locations
  Clone ID: PAT_TA_68441
cctatatacattttgagttcaacagcgctacgccgatacatcatcgtnatcgatcacagggtcatgagataattaacatcgatggatccggcgcttcgntctgctaacacactacttgcaaaaacacaacaagatgatgatgatgatgtacacatgcagncatccatccatcctcctaaagagagattttacaacatgcatgatcgtngccttctttntc

SEQ ID NO: 68442 - DNA, 316 bp, Triticum aestivum
  unsure (1)..(316): unsure at all n locations
  Clone ID: PAT_TA_68442
taggattccacatcacatcccaatccatgacagaagggattgctgcatcaccgacgaacacgaccgactgaaagataacacatgttgtttcttcctcgcgtaaccagctctaattaaccccggacagagcgacactcgagctcgcgatcaaaaacaccacaggaccgaacgacacacacgactcaagactgactgacacaggaacacgacgacgacgacactgaagataacttgctgacgaagacgacgagatggtagatagatcgataactggagggccccgccgctcagttcctccactggccgncgttttaca

SEQ ID NO: 68443 - DNA, 462 bp, Triticum aestivum
  unsure (1)..(462): unsure at all n locations
  Clone ID: PAT_TA_68443
gatcctacagaagatagcgaacaacagacgagatgctgcgattacagcaacgaccacgaaccctaggcactctaatctggtggtggtggcggnctagcccccgaaaccgtanagggtgcgtncctggcgcttgagggcgtagacgacgtccatggcggtgacggtcttgcggcggncgtgctcggtgtangtgacggcgtcacggatgacgttctcgaggaagatcttgagcacgccgcgggtctcctcgtatatgagccccgagatgcgcttcacgccgncccgacgcgccagcctccggatcgccggcttggtgatgccctggatgttgtcgcggaggaccttccggtggcgcttggcgccgcccttgccgagccccttgcctcccttgccgcgccccgacatcttctcgcttctctctcttcttctcctgggtgaggttgacctgtctttctttgngag

SEQ ID NO: 68444 - DNA, 642 bp, Triticum aestivum
  Clone ID: PAT_TA_68444
gcgccgtttagctccaccgccgccgcccgcgaaccgctccccccgactagcgacgcacccgccgacgttcagcccgccgcctcagtctaacacacgcctctaccacccagtcggcgaccgtcaacccgccgaccgccagccatggcagaggccaccgagaacgagcaccacaacgacgaagaggaagaagaagagcgtggacggcttgagcaagcgcggggtgtgctacctcagccgcgtccctccccacatgaacccgtcgcacgtccgccagatcttctccaagtacggcgaagtgcagaggatctacctcgtccccgaaggtcaaggtcatcgcaagcatagtaacgttaaagcgaaggcttactccgaagggtgggttgagtttgcaaagaaaagcgtcgccaagagggtggctaatctgcttaatggtgaacaaataggtgggaagaagaggtcgtcattttattatgacatctggaacataaaatatctcaggaagttcaaatgggatgatctggttggtgaaatagctgagaagactcatatcagggaacagaaattaacgttggagataacagctgcgaagaaacaacgtgatcattatctctctaatgctgaaaagtctcgtacacagaaatt

SEQ ID NO: 68445 - DNA, 665 bp, Triticum aestivum
  Clone ID: PAT_TA_68445
ttcggcacgaggcatatgcttgtctcaaagattaagcctgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggactccgacgccgacgacgcccaagtccccgccggctcgcccagcgcccacagcagcagcaggaggagagcggccgttgaccttgcccgctgccttcggtaggcctggtctcaaagctaggtggattaatgagacacgcgggagtagttgattagtagctacagaccagggatcccatctcctttgtaccgtaggtactagcattatatgtac

SEQ ID NO: 68446 - DNA, 694 bp, Triticum aestivum
  Clone ID: PAT_TA_68446
gtcccaatcggcaggccagatatgctaaagccgaaattcccaaacgtggatgagctagaggatgacagggatagacccacagttggtctcagatgggttgtgggggcgtgcacgtatcggtcagctccagcacgttgctatgagcactttacaaatgagttcgacttattaacagatgaccaggttgtttggagcccatatagggacgaccgtgtgaagacactacatcttgcacctatatgtacccaggactctcatttgtggctaactcaagcacctctagtttttttctttatggtggaggtttacacaccggagagagtgatgcgtcaatttggtctccatcaggaatgcccgccaccatttcgggacaccagcgtggaactccattggtgttgccgtggaaaggtccgtagtgattgggcagataagcataagtcttttgtggatatgtgggaagtaaaggagcagcatgttatcatggaagaacgaccatacgatcatgccaactacatggattatttgcggtggtacagacggttgacacgtatccgcctctgcacaccgagaataagtaatggccaccaggatggggcatccgtgcgaactgcaacagctgatgatgaagattctttgcgtgcttcaaagcttcggtacacccccagagctcatctgatccactcagtgactgaca

SEQ ID NO: 68447 - DNA, 602 bp, Triticum aestivum
  unsure (1)..(602): unsure at all n locations
  Clone ID: PAT_TA_68447
aacactcttcgctcactctcaggatnacgtaaggggaggaatcatggataggctaaagacctcggcacgtcttatgattgtttcagatcttgatcatacgatggttgatcatcatgattctgagaacctctctctgctcagatttaatgccttgtgggaatccaattatcgtcatgattctctgctagttttctctactggaagatcacctgttctttacaagaagttgagggaagagaaacccatgttaactcctgatataacaataatgtctgttggaaccgagataacatatggcaacttaatggtgccagatgctggttgggttgaaatcttaaatcagaaatgggataggagcatagtcatagaggaatcaaaaaaatttcctgagctcactcttcaggcggagacagagctacgaccacacaaggttagcttttatgttgagaaagacaaggctcaggctgtgtcgaaggctcttatggagtgttttgaaaagcatggactggatgttaaaataatttatagtggaggaatggatttggatatattaccacaaggtgctggaaaaggccaagctcttgcatatctgctaaaaaaat

SEQ ID NO: 68448 - DNA, 441 bp, Triticum aestivum
  unsure (1)..(441): unsure at all n locations
  Clone ID: PAT_TA_68448
gagaaagccaagnagcggcggcggccccatgcgtgcgtacgtactgctacccctcccccttcctccctggttggccggttccgcctcccgccccgcatctccacccaccgcgcgtggctatcgaatcgcaatcgaaccccgattcatcccggcccaggagtccatctgtgactgcgtccgacgactttcttgatacgtatttctttttcttttttgggttgttcaccatttgtatcgcactctgtgtatgcaggatgttggccaggtcgccggcgctgcccgtcccctacctgacggccactgaaactgccgccgcctcctcggccttcttccaacccgtaagatgcgatgccctacctacctgactaagactaaccaactagcctagccccttgatttggtttcaacagcttgcgcgcgctctttactctgtttattggg

SEQ ID NO: 68449 - DNA, 525 bp, Triticum aestivum
  Clone ID: PAT_TA_68449
tatgcttgtctcaaagattaagcctgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcctagcagagggctctgctc

SEQ ID NO: 68450 - DNA, 196 bp, Triticum aestivum
  unsure (1)..(196): unsure at all n locations
  Clone ID: PAT_TA_68450
ttcggcacgagggcgacacgccgccagnacgtggagatcctgtacgagggcgacgagaagacggacgccggttcaaggaagcttctgcacactaaaggcttcaggttcttggaccgcgcggcactcaccaccgaagacaccaactccaagctcgccacctgcagcaaaacgcgcgaccagtggaagctgtgcacgg

SEQ ID NO: 68451 - DNA, 565 bp, Triticum aestivum
  Clone ID: PAT_TA_68451
gaggaattcggcacgaggctcgtgcgcgccggggcagggattttttgagcccagcgagcgagcgagcgaggagtctgccggagcggcggcggcggcggcgggcgaggggggatggagagctacctggaggagaacttcgggggcgtcaagggcaagaactcgtccgaggaggcgctgcggcgctggcgcaagctctgcagcgtcgtcaagaaccccaagcgacgcttccgcttcaccgccaacctcgacaagcgcggcgaggcgcaggccatcaagcacgccaaccacgagaagctgcgggttgccgtgctggtgtccaaagctgcactgcagtttatacatggcctcaaacttcgaagtgagtatgttgtccctgaagaagtcaaggctgcagggtttcagatttgcgctgatgaactggggtccattgttgagggtcatgacagtaaaaagttgatcatccacggcgccgttgccggaatagcagcgaagcttgcaacttcgccgacagatgggcttgatacagccgaggacagcatgcagcgtaggcaggacatatatggaa

SEQ ID NO: 68452 - DNA, 596 bp, Triticum aestivum
  unsure (1)..(596): unsure at all n locations
  Clone ID: PAT_TA_68452
ttcggcacgaggggaggctcggggtggtcgcgggttcggcgccatctccttccttcccgtacactgggatcaaacagcccgcggcctggcggtgccggcctggatccggaggcagatggaccagatcctggagctgggcacgaaggagctcgaggtcgacgactccggcttcgtcctcctcctctgacgtcgccaccttgctcagccacacctcaaccctcccgacgcacgcaataatcagcggtgccaaaatgatttggtgtttgcaaaggtcgcttttgttgcattttctacgtgagaaaccatctcaggctatttggatgcacctgcacagtactgatagtacatgaaattcatcaacctgctgttgccgcaaccaaccaaaatttgctctaacagagtgatgaatacaatatgcatgctaagctttcttcaaattatgctaattgatcttaaaaagctggctactggtgttatttgctgcaatttatttctgacagccaggtagacttggaatgctttcgtaatgcaatttatttctgacagacaagctatgctaattgatcttgaaaagctggctactggnggtatctgct

SEQ ID NO: 68453 - DNA, 414 bp, Triticum aestivum
  unsure (1)..(414): unsure at all n locations
  Clone ID: PAT_TA_68453
gaggcgccgcttaagnaagccgggagtctgcagctcctgttgcagactcttcgaaaacaaagttgaagcccttcttctgggataaagttactgcaacagatcaagcaatggtgtgggatcaaattaaagcaggatccttccagtttaatgaggagatgatcgagtctctttttggttgcaaacctgttgacaaaagtaatgatagcaaaaaagagccagcaaaggaagctcctcaagtcgttaggatcctagatgctaaaaaggcacagaatttatcaatatcactgaaggcactcagtgttacagctcaagacgtgcatactgcagttacagaagggcatgatctcccagccgatttgataacaaccttgctacggtggaccccaaccagtgatgaggagctaaagcttcggc

SEQ ID NO: 68454 - DNA, 119 bp, Triticum aestivum
  unsure (1)..(119): unsure at all n locations
  Clone ID: PAT_TA_68454
gaggccgccccgagacgtcgcgagggagacanacagaacanacagccgcgcgganggaagggggccatggattttctgcaggggcggagcgtcgagaccatggtggcggtcgccgtanc

SEQ ID NO: 68455 - DNA, 337 bp, Triticum aestivum
  Clone ID: PAT_TA_68455
gggataacagtcttcttgatgtcgatcagcttctgcaatcagtttcggagacatctcagattgttggaagattgtccgtgtcaacaaaccagggtttgccttttaaggaggtggccagccaatgcgaagctctcttaatcgggaaggagaaaaagctatctgccttcatgagtgcccatctacaagaggttggcactgggatgcccaagtcatctgagccagattctccaatagctgggataatcctgaacactgacgatgaccagtgctactccaatttctgcaagctaccagtcctgaatccctatgacaagttcctcccatctgctggttgcta

SEQ ID NO: 68456 - DNA, 553 bp, Triticum aestivum
  unsure (1)..(553): unsure at all n locations
  Clone ID: PAT_TA_68456
tgcaggnaattcggcacgagggtnatatatgcttttcatnctgcagaagcatcatgcatctaaaagactttccaacggcaagatgcacttgccgggatgtttcttcgtagttgtatttaaggtccttttggttcatctagcactgtgtttgtgaatatcttttgcttcttttagcttttacacgtactgattatgtgtccatttgcttcgtcacaattctacactattcggagaaaaacttggatggctactatcagaaagtagatatatgtggccattatactttcaactagagcagaataattgagttgacagtaatgcgtcatatatgcttttcatctgtagaagcatcatgcatctaaaagattttccaacgacaagctgcacttggcatgatatttctttgtagttgtatttaaggtcctttttgtttatctagcactgtgtttatgaatatattttgcttcttttagcttttacacgtactgattatgtgtccatttgcttcatcacaattctacactattcggagaaaaaacttggaccgctacta

SEQ ID NO: 68457 - DNA, 561 bp, Triticum aestivum
  unsure (1)..(561): unsure at all n locations
  Clone ID: PAT_TA_68457
gnaatgtatatttgtgggagaaaggatttggcattagatatggaaagagcaggctaaatgtgaaccggacgaagtgcatgcaagagatagtctgtggatgtgcggggaagccaatagttgaaaatactcgttcttgccagtgtgaatgcgctgccctcataagatttttgctaccggcaagggccgtgtcaagtgcagacgctcagatctatgcggtggatgcgaaggcctggcatgtgttgggtcatcaccaccacagggttttaggagcacatcagaaccagttcagtctggtgaagcaagaggcaatgcagctagggcggatgacatgctgccacctgaacacatccacaacagaagctgttaggaggcatcagaattagatgtgcgtcaaaagagatatgcaaataggggcagcaggaagtgtcgccagagaatacggcgtacaccatcaagcaggcactcatcatcctcagggagctcagctgaagatggagataatgttgacatctgcaaacaaactacgagatttcgatgacagaatgcttcatcccatgttgc

SEQ ID NO: 68458 - DNA, 597 bp, Triticum aestivum
  Clone ID: PAT_TA_68458
ccccttgcggcggcagctgggcgtgcgaggaatcgccatgggataggcttgagttcttcgaggaagacgaatcaggggatctcttggggggagatgtggctgttgtgcaatccgtcgttgcttcaatccataaagcatcccacaactgtgtgtgcaaaatgggctaaaaactacaggattaggattggcaaagtgtcagatcagacggaaagcaatccaagtcgagttcctacgctcgaggcttcgatgcgtgcttatgcagacaagaaagctggtactattgttcatcccgtattggggacaagttttgacttggtcgaagaaccttacgagttttacaatattactcatgggatactgtgttttggtgtcaggtgtgctaaaagccggttgaacgttcatcggaaaaaatgcatccaggaaattgtgtgcatgtgtgtgggtaaaccattgcaatcaaatagccgttccacactttgtggcttcactgccatgatgagggtccttagataagatgataagggattaagggctggtacgtttgcaaacacagggcagagcacaaccagactttctgtcaactatatggagaaatta

SEQ ID NO: 68459 - DNA, 465 bp, Triticum aestivum
  Clone ID: PAT_TA_68459
gcacgagggaagttttcccctccgccgccgccaccaatccgcctccgcctccgcctccgactctagccctcgtcggacacggagaggggaggagcttccatacatatactccggcgaggcaggggagagttctcttcagggagaggagagggagggatggcgtggacgcgctaccacgcctcctcgacgcatcctccttcaatccccgctcgccgtcgtcccaagtccggcgccgacgatgccccctttcctccatgggtcctgctcgacgaccgcgcatacctcgccggcgaatccaaccacaccacggccgtctcccgcacaaggcacggcgaccagatccaagccaccttcttcctcgccgacccgccgctcgtctcctacttcgccgtctcgtgcgccgccgagcttggctgcgagcccagggtcctctacacagaggccaacctcgtcctcctcgtctcg

SEQ ID NO: 68460 - DNA, 342 bp, Triticum aestivum
  Clone ID: PAT_TA_68460
agggagtaacgcatcatccgaagaaagtgtcaagattgcaactgtatgtataccaaaacaagaggccttatatctggcacatgctttggttcatcaagtagatgcgagtgcaaccggcgtttgctctacgagaaagtttgctattccatgatctcggaggttagttgccatttagggcataaactggactaactagtgactagagataatctagtgcccagtatatattagaaaatgtggcattactggctggaaactccgagccggtggtttaccttgtatatgctacagcatgccggtgtgaagtggcaatataaatggtaacattgtgtaaaaaaaaaa

SEQ ID NO: 68461 - DNA, 416 bp, Triticum aestivum
  Clone ID: PAT_TA_68461
ctcagttggactgatccaacatatcaacattgtgaaattgatcggtttctgctgcgaaggtgatcacaggttacttgtgtatgaacacatgttaaatgggtctcttgagggtcatctatttgagaagagcagttctcctgtcctagattggaacaccagatatcaaatagccctaggagttgccaaaggattgtgctacttgcatgagagttgtcacaaatgcatcatacattgtgacattaagccaggaaacatactcgtggatgcatcatttgttcctaaaatcgcagactttgggttggctgcgtttgtgggaagggattttagccgagttatgactacattcagagggactgctggttatcttgccccagagtggcttagcggagttgcaatcacaccgaaaattgatgttt

SEQ ID NO: 68462 - DNA, 134 bp, Triticum aestivum
  unsure (1)..(134): unsure at all n locations
  Clone ID: PAT_TA_68462
ggactataatggggagtaggcaccatgatgttttcttgctagggaaaaacagattgataccaggttcttggctcttgntattggcatgtgcctttacaccaagctgaagttttcagtgttcagctgccttccaa

SEQ ID NO: 68463 - DNA, 554 bp, Triticum aestivum
  unsure (1)..(554): unsure at all n locations
  Clone ID: PAT_TA_68463
gttcctgcacagcatccaaaacatatgggaggtgctgcccggnagctgtgggaggaccgcgtcgtgagacctcggtgactgcggacatggtccagggtaggtgctaatggagagttggagggtgaatgggagaggtgatagctaattatggtttgactttagtaattatatttgttccttgttcgttgccattttgttgtgctaaatgtagtatgtgatctagaggatatttaggtatcagattagtaacagtgcagtagcatcagacacttggtgttttctcatgtgatatatctaagtggtaatcagttgtacaactagacaaatgcaaatgtccatagtaataaacttgtggtcacaaaactgctgcttaaagtttgttcaattatggaaatgggcattttagttctgctccttaattttgttcaattatgtaaacgcatgggcacgcgatgccgtttccttacctcacaaaatcaaactgaaggcatccaattctggtggtaataactgatcacgtgtattgccatttttacagaacaatttattctcct

SEQ ID NO: 68464 - DNA, 416 bp, Triticum aestivum
  Clone ID: PAT_TA_68464
gcagtatcatatgtggatcatctgggctttgagtcgctgcgggtggcaggctagaatgcacaatgcaaaacatagcagataattttatgaacacatatagctacaggtgcagcaaaggaatagaaagtgagctcgacacgttcattgtgtacaatgaaaggaaaaaggttacttcatcagctaaaaggaagctgaaatcagaagacagatcattgcaccagactccagagggttcactcctcgacattatgcgcaatgctcatgatctcctttctagctgcagcatagaggttccagaggtgaaagacaataatgagtacttgcattccggactaccattcatcatatttcttcatcctgctttaggaccattttgggatatcgtaaagcaaaagttcataggtggctccatctct

SEQ ID NO: 68465 - DNA, 280 bp, Triticum aestivum
  unsure (1)..(280): unsure at all n locations
  Clone ID: PAT_TA_68465
gaatcatttgtaggagggcgaccagctgccgtgatcttccattgcaacgatagtagtatagtagtaacagtaggatcaatccaaaactagctctatagcgattctaccgattggtttctcttcttcaaaattcatttcttttttctttgctntatttctccctggatcaagttcagtggagtacatagattatggtcgggttgaggaaagaaataacaactggtgtaaccaaagttcgatccttgaattgaaacagaagttcagttcatcaaaaaaaaaa

SEQ ID NO: 68466 - DNA, 403 bp, Triticum aestivum
  unsure (1)..(403): unsure at all n locations
  Clone ID: PAT_TA_68466
gaggcncgccatgagcatggacgagatcatcgacgagtgcaagacatttttcttcgccgggcacgacaccacctcccatctccttacctgggccatcttcctcctcggcacgcacccggaatggcagcagaagctcagggaggaggtcctccgggagtgcggcagcaccgggacgccgcttcacggcgacacgctcaacaagctcaagctgacaacaatggtgctatacgagacgctgaggctgtacggtgcggtgatcatgatcgcgaggcaggcgatggcggacacggagctcggcggcgtggagatccctaagggcacgatcaccatgataccgacagcgatgatgcaccgggacgaggaggtgtggggcgcggacgccggcgagttcaagccggaccgg

SEQ ID NO: 68467 - DNA, 443 bp, Triticum aestivum
  unsure (1)..(443): unsure at all n locations
  Clone ID: PAT_TA_68467
gncttctgtcccgcaaacccccgangatcacaccatgttcggcttcggtcaccacggccaccatggccagaaccccccggcccacgctccggccgccgccggcggcaaccagcccaccttcaagatcttctgcaaggctgacgagggctactgcctctccgtccgcgacggcaacgtcgtcctcgccccctccaacccccgcgacgagcaccagcactggttcaaggacatgcgcttcagcgccaccctgtgaagctggtgccatacaacgccaactaccaggacgagtcagtgttgtggactgagagccgcgacgtgggcgccggcttccggtgcatccgcatggtgaataacatctacctcaactttgacgctctccacggcgacaaggagcacggcggcgtgcgcgacggcacctccctcgtgctgtggaagtggtgcga

SEQ ID NO: 68468 - DNA, 338 bp, Triticum aestivum
  unsure (1)..(338): unsure at all n locations
  Clone ID: PAT_TA_68468
cctcancctaacattcttggcctacgcgccgggcatcatctacgccgncngggngancgnaaagnagaganngcacccangaacgnnaggaaaacagggannngagnctnctctncgaancccagncatactagaaaagaaagnctncacagaggcnggancaannngggaaancctagggggaaangangcagnnggaanggggcgaccaaaggagnnggcgcctcagnnnnaggcnangnanannnnncaccnnccatgnnnnggggcngagaanngggnagnggnancngggnannnaacaanaacagggnggggnggcanngacanaaaaaaaa

SEQ ID NO: 68469 - DNA, 365 bp, Triticum aestivum
  unsure (1)..(365): unsure at all n locations
  Clone ID: PAT_TA_68469
ggcggctccatggnattccggtgcgataagcgtccaaatgcccgtgaccggccaagaatgcccgcctcaggaagcgaagccagtcaagggcaagtcgccggtggacaagacgctgtcgggcgcgtcggacttgctgaagctgctcccgacgggcacggtgatggcgttccaggcgctggcgccgtccttcaccaaccacggcgtctgccacacggccaacgggtacctggtgctggcgctcatcggcgcctgcgcgctctcctgcgtgctcctctccttcacggacagcctcgtcggcagcgacggcaagctctactacggcatcgncacgttccggtccttctacccgttcaacttcgccggcg

SEQ ID NO: 68470 - DNA, 558 bp, Triticum aestivum
  Clone ID: PAT_TA_68470
gagggtaacctgcagaatctctcagtcactcatatggagaagggcatgcatacaaagcaagctgataatacttctcattctgaattacttcgcgaatgtctagatatttggagaagaagaagattaaggaaggaaagcagtgctgaagctaaaaaactagatcaaacaggtactgcggggcatgaatggtctgcttcttcttgtagctcagaaagtgatgatgaaaatgtcaatgcatctgagagtgcttctgggaactcagaaagtgcggctgaaaatgatactgaattggagaattcccaaaaatgtagaggtgcaacgtcgcttgatggagtacaaaaccgtggtgagggaagagcaatgataaatacagagcagcccttgagatgcctcagtggtacaaactacaacaaaagctcagccaagcaagggctgaagtgcaatctggaggttttgcaagaaccacatccaggtgaaatcatgcagcaaaaggaagagaataaacttccatgctgtctaccatcaactgttcatccaaatggcatgatacaaactagt

SEQ ID NO: 68471 - DNA, 179 bp, Triticum aestivum
  unsure (1)..(179): unsure at all n locations
  Clone ID: PAT_TA_68471
aaacacccgccnccccaacggccggnnccnaccgccccncnnnaacnacaagccncacgagcngaaggggcnnccganggagancgcggngaagcnggnccccgagcacgcgaggagccagngncccgnccnagggcngnaggaaaaggncngcnggccacangngcgaaaaggcgcng

SEQ ID NO: 68472 - DNA, 470 bp, Triticum aestivum
  Clone ID: PAT_TA_68472
gcgataccgattcaacagaaacaggcggcattcgctgctagtaaactcggcgtcgcgagctcagggaagaacaagattttcgtgggaggggatgcgcagcagtacaagattttcgatccgtcaagtgacttcatcttgatgtggaaccgcattttccttttttcgtccttccttgctctatttatagaccccctgtacttctacgtgccgaaaatcgtctatggcgacacctattcctgtgttgggacagaccgacatttaaccatcatcattacattcttccggtcaattgccgatctcttgtatgtggttcacatcataatgaagttcagaactgcttttgttaaaacgagctcaaccttgcgggtttttggaagaggagatcttgtcacagaccccaaagagattgcatggaaatatttgagatctgactttgcaattgatgtggtggctgcgttgcctttgccgca

SEQ ID NO: 68473 - DNA, 502 bp, Triticum aestivum
  Clone ID: PAT_TA_68473
ggcattcctcatcgattagtacaagggttatgcgcgattacaaaggtcggtcggttaatacaagataggcaggagcaatcgcctctttgtacaaatgcaggcggctggctccgatgcctgtgacaggaactctatactagtcaggtcatattagacatgaacgagcacgtacagggggaaaaaaggcagcaaaatcttcgagtaggttcccctccatggaaaaaactcagccagcgcagtggcaagctatgcgacggcgaccgcgggtgctagggcgagctccatcgccggcggtggctcgggccacgagaactcgaacggggcttcgatggcgagggcttgaggcggcggggcaacctctgccgggaccgcctcggtgtagtggaactcgatctggaggcggtggtgcagcggtgttgatgccaccgttcccctcttgatgtccccctgtagctccctgatcggtatggccgccaagaagctcttgatgtactctttgcac

SEQ ID NO: 68474 - DNA, 610 bp, Triticum aestivum
  Clone ID: PAT_TA_68474
cgagggcgcggcagcgcggaccgacccgacgtcccgaccgatgcggcgtaaggaggccaaggtggccctcggctcgaagatgaagcgggcaatggaggacgagcggttcacggcggcgcggacagacccgaggttccgacagatgcggcgtaaggaggccaaggtggccatcgactcgaggttcacccccatgctcacggaccccatgttcgattcttcgttagtggacaagcgaggcagacgccgcaagaagagcgccggggagaaccccatcctgcattactatctcaacgaagaggcgggggacgaaaaggacaaggataagacggagcaagaggagctgatttgtgaagaggaggatcatgcgctggaacaagagagtcctagtagcgatgacgaggaggacggccatgaccagtactttgtgggctgcgacgttgctcatcacttgatgtctaggcatgatgatacacatgtgattgacaaggaaactcacaggcttgcttgttgtgaacatggactgggatcatattaaggcggtggacttgtatatggtcatgacatcttgtattccggaaggtgggcgagttctatcagtctcgatatatcc

SEQ ID NO: 68475 - DNA, 435 bp, Triticum aestivum
  Clone ID: PAT_TA_68475
cacgagggtctgctccctgctcctcctcctctggtcttctccggcgagctctgcaccaccggccccgccgtcgccggcgccgtaggcgggatgacgacggcctcgaggctgtcctacaagaacgccaccgtcgccctgtgcgccatcaacgtcctcgcggtggcgctcctcctgcgcagccacttctcgtcctggccgcggatcgccggcggccaccggttcgattcagctcagctacggtacatatgggagtccgaagagttgcgccgtgccatggagcctgtggatttgattaggagagtgaaagaaattgaacaagaagcttatggagagcctggcatgtcagcaacgcaagaagggacggctgctgttgacttgtcgaaaaggttgaaagatttacggcaagggaatgacggcagcagccaaagagcactg

SEQ ID NO: 68476 - DNA, 325 bp, Triticum aestivum
  unsure (1)..(325): unsure at all n locations
  Clone ID: PAT_TA_68476
gcaggnaattcggcacgagggaatgttgttaacgaggaaggccattttccggctgaaactgtctccagcgaggggccactggacatggagattcatcatggcggtgaggccgaggatcatcagttcactgaagagactgaaatggtgcccgtggaagcaccggaatccggtgaggccactgaggaagctgaggagattcatcagtcgagtgaagagaccgaaatggtgcccgtggactcaccggtgccgcaggaggctgctgtggaggacctggaggttggtttcacctgccatgcagacaccgccattgagaaggagaatgaag

SEQ ID NO: 68477 - DNA, 630 bp, Triticum aestivum
  Clone ID: PAT_TA_68477
cgaggcagcaacgagcgatcagctctcgccgagccctctcgaccggccgtgctcgcctccggtgctgcgccctgcttggtcgagcagttccctgcagagaaaggtaactgatttaactcgaaatgtattcgccagggtcgagcgagctagccagttagttgctcgcactgctgcgatcttatcatcacttatcatatctagcgatcgttcgtgcatcgtgctagagcactgtggagaggtaggtatactctgtttcaccattgactggctgaaaaagttacgggtggtgggcttaggtatgatcgtcagtcggctgtgagcaattagcatgtgcctgctctgttgactgctgtgccgacgaggtagggcaaaaggtgatggttggctccttctcggaagactaccctgtcatgtgatcatgtccaccaccaccaccatgcttagcaaatgcttaggttacgacgtcaactctagttttcaaagagggtttggatttccagcccgcgcactagcagcagcttcccgcgtccaccgggcagcggcggccccaggtcgagcccggcagccggcacccactttgctcagtgcgcaggctcctcctataaattgcaccggtaccccgggcaccca

SEQ ID NO: 68478 - DNA, 612 bp, Triticum aestivum
  Clone ID: PAT_TA_68478
gaaagaaatggagaagttgaaatctctcatcgatgacttaaatttgaagtatattcaaaacatgaatgatttcaccaaatttcttctattaagcgaggaagagttagctggaatgcctcttgagttcttaaaggatctggaagaaacagatggaaagcgcaaggttctgttgacaggttactatgtcactccgattcttgagcattgcaaggttggctctaccaggaagcagatcgctgttgcttatggccagaaaggtggaaaccagaacgtagccatcctagaaaaattggttcagataagacacaggcttgcgagattgcttgggtactccaactattctgattttgctattgaaccaagaatgccaatgacatcgaggaaggtgttggaatttttggaggaaatgtcagaacagttaagtgatctagctaacagagagctgaccgtactcaaagaactgaagatgaaggaggaaggagatgctcaatttggcatggaagatttactatactacatgaaaagaggcgaacagcacaaggttgatcttgacattggtgaaattaaacgatatttccctgttaagctggtcatatcaggaatgctgaagat

SEQ ID NO: 68479 - DNA, 650 bp, Triticum aestivum
  unsure (1)..(650): unsure at all n locations
  Clone ID: PAT_TA_68479
tatggcggcgccaatcgggcaagnaggcagcatcaaagccctcatcctttgcggattttgatgaagacgatgacggtgtcagcgaggagaaggagaaccgtgctgctgatgactctgacaaggatgttggctgggagaaaacagaggatttcaagatggagcccaccgggtgcggcaaaatggtcaagccctacaagctcccaggaagcattttcaagatgctttacccccaccagcgcgagggcctcaagtggctctgggttctgcattgcaggggaactggagggatccttggggatgacatgggtctcggcaagaccatgcaggtttccgccttcctggctggattgttccattgccgcttaatcaagagagtgttggtggttgcgccaaagacacttctcactcattggacgaaggaactttcagttgtcggccttaaacataagattagggattactctggtgccagtgtaaatgttcgcaactctgagcttcaatatgcattcaaggagggcggcatcctactgacaacatacgacattgtccgtaacaattacaagttgatcagaggtgacttctacaatggcaacgtggaagggaagtatgacaagctgatcagaggtgactcatataatgatactgatgaa

SEQ ID NO: 68480 - DNA, 638 bp, Triticum aestivum
  Clone ID: PAT_TA_68480
acgaggggcctgctctgccctgccctcttcttcctcctcttctcttctccatccaggagaggactgcttcaggttctccctcttccaggcgctttcctcacccccaatcgcggccgaaattccggaccttttccagcggcagaaccgttgagtgcggcggcggcgaccgccgaccgagccaagaatccatagatttccttctggcgagctaggccttctcctagaggcgtttcttgggagccatatttggttccggatccatgctggccgacgacatcttgggctaccctttccccgcctagtattattttcttcgcgagggtttcttggttcctcggaggtcctccaagttcttgccaatctggccaatctggccccaaccccggggcgcggccgtgttagggttcggggggctggatggggtcggtcgtggattttgtggagatcagctccgacgaggaggaccttcccatgcccaggaagccagctgacgactggcttgggaagcttttgaatgatgatgagccaaatggagacgatttctttgatctcgtggtgatgggtgagttctcgccgccacagaagaaggccaaccccgccgccggcggtggtggtggtgatgatgaggatgatgatga

SEQ ID NO: 68481 - DNA, 640 bp, Triticum aestivum
  Clone ID: PAT_TA_68481
tcggcacgaggcacccgccactctcagcgccgagctcctccgccttctctccgccgcccccgcttggacacacgacctggcccgagccgtctcctccaccctctccgccgcccctcccccctcccccgatgttgtcctctccgtcctccgctccctacagaacacctctctcgccggtcccttcttcctcctcgcctcctccgcctcctctccccactcactgccccccgaagcgtataacgccgtcctcccattcctctcccacgacctagcggctctcgacaaggtcctggaagagatgtccctcctgggctacggccttcccaaccctgcctgcgccactctagtctccaccctcgtccgctcccgccgcctcgtcgacgccttccatgccattggcatcatgcggcggctcaagttcaggccggcgttatctgcgtacaccgtgctgattggtgctctggctgaggcgcggcagcccgagcgtgcgctggaactgctgcggcagatgcaagaggtcgggtatgaggtgggcgtgcctcttttcacgacgttggtgcggaccctggcccgcgagggaagagtggagggcgcgttgatgctggtggacgaggtgaaggggagatgccttgagccagat

SEQ ID NO: 68482 - DNA, 624 bp, Triticum aestivum
  Clone ID: PAT_TA_68482
agtaaacctcacttcctcatcacgattcttgcgaatcggcttaagagcattgcacatataaggtttggcctttgaggatcaaacaaattcagtagtatagacatcaacctcatcgtccgaattatcatcattgtgttcaaccatatgcattctaggacgatcggttgtagacatatggaccactttacttcgactctcttgggccaaagctttttgtaagacttggttaatgctcaaaaactcataagtttctagcttctctttaatgtgagttttcaaaccattaagaacaagatccgccaagtctttctcagttatcactaagctataacatcggttttttatatctctaaatctcttgacataatcggtgaccgattcatcatgtttttgcctaaccgatgtaagatgtgacaacttcagctcattatcaccgctataaaaatgatcatgaaacttttgctctaattgcgaccataagagaattgaaccatgtggtaaagcagcaaaccatgaaaatgtggtgccagttaaagacaagggaaataaacgcactttcaactcttctatggaacctgcttcacccaactgtgctagatactgactcacatgctcccaagtcgt

SEQ ID NO: 68483 - DNA, 635 bp, Triticum aestivum
  Clone ID: PAT_TA_68483
gttaagctttcgcctagggtttaaccgagaccgctcgccgctgctcgtccctccaccaagaagcaatcggccatggcgacccaggcgcgcgagctccctcccaagcaagagctgccccgggacgacggcgacgactacgaggacgactgggagtcggacggcgacgacgcggcgggcggcagcggcggcctcctctgcctgttctgcagcgcgcggttcgactccgacggccccctcttcgcgcactgcggctccgtgcacgggttcgatttccacaagctcgtgagggagctcgggctggatttctacggatgcatcaagctcatcaattttgttcggtccaaggttgcagagaataagtgttggagctgcgcagagatttcccaacttgagggcaaggttccatgggcggaggactcgtacctgaaaccgttcatggaagatgactcgctgttgcacagcttgtccatctttgacgatgaagaggacgaggactgtggaatgccagtggtaacaggggagtgttcagtgggcaatgggaggtcaggtgaactgcaggggaatggtctaaataccattatcgacgattgttctgatatcagtgctaggtttgagaaagcagttactactgaaag

SEQ ID NO: 68484 - DNA, 628 bp, Triticum aestivum
  Clone ID: PAT_TA_68484
gcttgtcctgtctcccacctcccttgttcttccgttcttcccagccccgagccatttgcagttagttcctgatcccgcggcggcggcggtggtggcggcttccatctgctgtcttccgccttgtccctgagttgcgtttcttgatgtgttggtggtgacggtaaggtggaggaggagcttcttcctggccgggtgcccgccgcctgaagatccccttttgaggggcggcaggtgaggggagatgcgctggactgatccccattactcgcgcatccatttcttgtagccgaaagatctggtattccagaggtagaagcaccatgggactcctaggtatgatgggtgactcatttggctgctcagctaccggtgagcggctcgtctctgccgcgagggatggagacatccaggaggctagggccctattggagcttaacccccggcttgcacgatactcgacattcggtatccgaaacacacccctccattactcggcggcaaagggccaccacgagattgtttccctgctaatagaatctggcgttgatatcaaccttaggaactgcagaggacagactgctctgatgcaagcttgtctatatggtcattggaaagttgtacagatcct

SEQ ID NO: 68485 - DNA, 299 bp, Triticum aestivum
  Clone ID: PAT_TA_68485
ggtcgggcgggacatggcgcggcgcacgctccgggcgatgcgcggggaggacgacgaggtggcgctgacggcctccggcatactcgggagggagtgggacgacgcgagcgtggtgtcggaggggatggtgtcgctcctgcggccgccgcaccaccggagcaactacgccgggccgtccgggtcaaacacgacccagttctgacaaagtcaaaagtctccgctctccccacgcttctctctctctctctctctctctctctctctctctctctctctctctctctctctctctctctctc

SEQ ID NO: 68486 - DNA, 591 bp, Triticum aestivum
  Clone ID: PAT_TA_68486
ggaccgcgccacgttcagcacgctcgtcgacgcctggtgcgcgtcggggaagctccgggaggcgcaggcgttcctcgacgacatgtcgtcccgcgggttccggccgccggtgcgcggtcgggacctcctcgtcgacgggctcgtccgagctgggcgcctggaggaagccaaggcattcgccctccgcatcaccaaggagggcgtcctccccgacgtggccacattcaactcgctcgcccaggcgctttgcgatgcaggtgatgtggaattcgccgtgggtcttcttgccgatgcttccagtcgtggcatgtgcccagatatctcaacttacaaagtgatgctaccggcggtggccaaggctggccgaattgaggaggcattcagattgttctatgcagctattgaggatggccaccggcccttcccaagtctatatgcggcgatcgtcaaggcgctctgcaaggcaggtcgtttcgctgatgctttcgccttttttggtgatatgaagtccaaggggcacccacctaatcggcctgtgtatgtgatgcttgtcaaaatgtgtgtgaggggtggtcggttcttggatgctgc

SEQ ID NO: 68487 - DNA, 695 bp, Triticum aestivum
  unsure (1)..(695): unsure at all n locations
  Clone ID: PAT_TA_68487
tgcaggnaattcggcacgaggcaaatttcccctcctcctgcccgangttgaacagagcaggcgctgtccgcccacatggctccctccgtctcctagaagccgcggagcggagccccggatactcgccaagggatccagctgctgcgagccgtcatggaccggacatcgaatttcatgcctactcctgatcaggatgtcctggatatccagcccctgaggactttggctcccatgttccctgcgcctctgggggtcaacacgtttaacgtgcccaacaccaccccaccattgatatttgtcacttcagctgggcagtttccagggggggttggtgctccgggccatcctgctttcaggtcattcgccgccgctttcggtgctcaagatgcttatggagggcagcctgcctcttctggtggccagcatgacggtggagggcatcctgcctcttctcgtcgccaggatggtggtggaggccaggctaccacctttgctgataagtacgctgctaatggaggccagactgctgctaatggggctacaaaccttggcgccagcgctgacagcccaattgatgtcatccctatatcagcttacaggccgacaccgccacctgttataccactggacgacgatgacgatgacaatgagcatttcactggcaaccagacatcagcatctgggcggaagatcaa

SEQ ID NO: 68488 - DNA, 155 bp, Triticum aestivum
  unsure (1)..(155): unsure at all n locations
  Clone ID: PAT_TA_68488
cctttcttctcccgcacgacagcccgccctcccgacgccgccgccgccgccgccgncgaaatggcgtnccgcatcgcctgccncctcctncgacgctccagccccacattangcctnctgaggagctatacacatgtcagaaactacagcagtca

SEQ ID NO: 68489 - DNA, 620 bp, Triticum aestivum
  Clone ID: PAT_TA_68489
gcaactagctagctaggagagtagaaatcgacaagaagattgatcgatggccgccaccctagtcatggtggcggtggtgttggtggtggtggtggccacatcatccatgccggtggcgaggggggaagatctagagaaggatgatgcttccaccagctgcccgggcgagtactccaagctctgcggcaaggatcccacgtgcatcgccatggtcgagacggcctgccgcaccgatgccgacagcgtggagtccatcaagggcatgttcgccgagctcgccaaggtcggtggagacagcaagggttttgctttcacggaatggccgtgggggcacgtggccctctgcgcggccgtcaacgagcatggggcctgccccggcaacaagacggtggaagaattggccggcgagcactgcatcaacgacctcagcgtgacatgcctggaccctatctgccacgacggtgcttcgcgtggagtgctaccgtacagccgcgagattttgctacatcaaggccacccccgccgacaagaaagccatagaggagaagttgaaatgcttcaagggctgttgcgcgcagaagaagaagggtgaagagtgccgtaaagaatgcatcctcaag

SEQ ID NO: 68490 - DNA, 245 bp, Triticum aestivum
  Clone ID: PAT_TA_68490
cggcacgaggtccggctgcgcacctcaccctcgtcgctctccctggcccaacaacatcacccactccctgctcttcctcccgacgcggaagtgtcctttcgagtctcgtctctgtcttcgtggtcctcagatctggcagcctgcggccacaacgctgccggatctaaccaaccaataggtgctcgacgccgctcctcaggaccgcgtcggtcttcttcgtctgctctctctctctccctcaacct

SEQ ID NO: 68491 - DNA, 717 bp, Triticum aestivum
  Clone ID: PAT_TA_68491
tcggcacgagggtcctcctcccacctcccttctcgccgtcgtgagtcgtgaccctccgttctcttctcctacaccgctccttcacgtcggcatgctcgcacctagcacctcgtccacccccagtcatctttgttgcgcaagaccgcagaaggacgaacggcggcggtccgagcgccgcctccttcgccagcggcaacggtgaacacgggagcagcggccccgttcgcccgttccaaggtgaggaacggaccccctcgacctgtcctctgcggcgccgctccccttcctccgtttccttgatcgccggcggtgggaggatacccgggggaacagaggagggagttggacaatggggtgaagaggcgcaagtcaagcaggaggtgggcatcaccggaggagcacaaccgcatggggagcggaggaggtcgatgcagggggctcaataggatggttagagagcgcgcagcatcttgtgagacaagtcgtctgctaagcagaggatgcagcagcgctggctcctcctctccccacgctatcgccttcctgcgtcgtcattgccgccacggccttgctcgccatcgacctccccgagtgcttctctccgctacatccccctttccacgagttcttgccttcaatgctaagcatcccgggtacatatgtgaggctatgggaatccttttttcgtgtgatgatgagaggaatatgacaggacaa

SEQ ID NO: 68492 - DNA, 547 bp, Triticum aestivum
  unsure (1)..(547): unsure at all n locations
  Clone ID: PAT_TA_68492
acagncagcancgactacggccagtcctcatacagttcagcagcagcagcaacttcgccagttctcatacagtcagcagcaacttggccagttctcatacagtcagcagcagcagcaattcggccagcttccatatgatcagcagcagctctcatcaagtagtctggcccagcagctgcagcagcagcagctctcgtcaactggtcaggcccagcagctgcagcagcagcagctctcaacagccagtaagatccagcagcagggacagggtcagatctcctccgccagtcagtcccagcagcagcacgagagcccatcagattcagcagcagctgcagattcacaatcatcatcccaggaggttcaccaccagcagctgctcgtaggctcatcacctgagacaacatccagtgtgcagaatgtaccacttctttggacaattggtctcaatctgcctccccacattgaggaaagcaatctatgcttcatgttcaggaagataccagagcatgttctgaaggtgggaaaaagaggcacagngcaattt

SEQ ID NO: 68493 - DNA, 553 bp, Triticum aestivum
  unsure (1)..(553): unsure at all n locations
  Clone ID: PAT_TA_68493
gtgtggccgcctctgcctcgccacggnacgcatggccggcctgggacgggagtgctccaaggccatcttcctggtcaacgaggccgaattatttcagaatatttaaggattcatggagcgaagatggactggaggggggccaccagagcgtggtacgacccagtggcgccccctagggcgcaccatgtgggcatttgggctcaccagttacagccttgcggttattccactggcaaaaattcacatatataccagaaaaaacctagaaaaatcaaggaagcttttcgcgatatggagaaaccaccaccacctcctgttcttcctctaaagatctgatctgtagtctgtttctggctccggagatagaaattcatcatcatcgtcatcaccaacccttcaccaacaacaatactatgatgcttctatttatgtgtgagtaattcccttgtagacacatggcgctaggtgagatttggatgagatttcttatgtaatcgatgtcatatttgatagggcttgatgcctagtatccactattttctgaaaaaaaaaa

SEQ ID NO: 68494 - DNA, 529 bp, Triticum aestivum
  Clone ID: PAT_TA_68494
ggcaacattcacgcctgcgctgcgcttccgtcccgtgacttgcctgccttcccctgccgccgcggctgcgagcttcagggcgccatggcgcaaaccccaccgattccccgcgtcagcctcggcacccaaggactggaggtgtccaagctggggttcgggtgcatgggcctcacaggctcctacaactccccggtcgaggacgacgccggcgtcgccgtcatcacgcacgccttccgccgcggcgtcaccttcttcgacacctccgacgtctacgggccccacgccaacgagatcctcctcggcaaggttcaggtggccaccaagtttgggattcagcgggatgcccagggcaagagcaccatctgcggccgcccggagtacgtgcgcgcctgctgcgaggccagcctgcaccgcctcggcgtcgaccacatcgacctctactaccagcaccgcatcgacaccaccatccccatcgaggacacgattggtgagctcaagaagcttgtggaggaggggaaggtcaagtaca

SEQ ID NO: 68495 - DNA, 637 bp, Triticum aestivum
  Clone ID: PAT_TA_68495
gcaccatcccgccgccgccgccgcccccaaccatcccaccgccgctgtcgcacccgccatcccgtcgccgcggacagccctccaccccgaccattgccgcagtcgcccctaactacccaacagcagcactggcagcaccccactaacccggaccaccactgtcgccgagccactcaaccggcgactaccctcctcgaatgccttccctcgccaccactctacttcgcgagattcctcccccgagcaggcttcctccctaagacgatggagccagtagttcttcggatgagatgggtgagtgcaatggtgttggtgtgttcttcggatgagattgtgtctgcaatgttgttggtgtgttcttcggatgagagaagaacaagtaggtaattcgaaccagtggtctgttgattactcttatgtaatatttgtattttctctaggtgctgatttaatccttctgaaccccaatgaggctgatagcctaaataaatctttgctccaggtaacttctacaagttttgtatttagtcttctgttgcatcaggggcaaacaagcgctctcttgtctgagttttactttcctatattgtagagtgcatgattgtaggactacacagtttacagaatttctctcaaa

SEQ ID NO: 68496 - DNA, 579 bp, Triticum aestivum
  unsure (1)..(579): unsure at all n locations
  Clone ID: PAT_TA_68496
cacgagggcacagcagnacctctttttggagcgcgcaacagtatgcaagagtattcttcttcttttagtcccacttgcactaggtataaccttttccggagttctttcatagggtcgttttcagcttgtgtcacaatgtagtatttgtccttttcttgctcaaagacatgcatccttgttgtgtctgccattttaaactggaatttcctaaatattccaatgttgtgtagctcatgtgcttgcctttctatgttgtattttgaccaaaatgctttctgtgcaactttcttgtttctacaaacatggtcgcattcttcttccctgtcatgcacaacatcaagtatccggtcatactctttcaaaaagctagtagcaccaaatttagctccaaccccttttttgaaaagggaattcgttccttcacttcttgttgtagtttgtatgaatgggaagaatttgtccttgaaatacactagtatgaactttttcctgttttcccacatgtcgttgaagtacttgatgtggtgaacttgatattttttctatcatttcttgccactgtgtttcaaattcttcaac

SEQ ID NO: 68497 - DNA, 654 bp, Triticum aestivum
  Clone ID: PAT_TA_68497
gcggctcaagctcttcggccccaacaagctggaggagaagaaggagagcaagctgctcaagttcctgggcttcatgtggaacccgctgtcctgggtcatggagatcgccgccatcatagccatcgcgctcgccaacggcggcggcaggcccccggactggcaggacttcgtcggcatcgtcaccctcctcttcatcaactccaccatcagctacatcgaggaggccaacgccggggacgccgccgccgcgctcatggccgggctcgcgcccaagaccaagctgctcagggacggcagctgggaggagcgggacgccgccatcctcgtccccggcgacatcatcagcatcaagctcggcgacatcatccccgccgacgccaggctgctcgagggcgacgcgctcaagatcgaccagtcggcgctcacgggcgagtccatgccggtcaacaagtacgccgggcaggaggtcttctcgggatccacggttaagcagggcgagctcgaggccgtcgtcatcgccaccggcgtgcacactttcttcggcaaggcggcgcacctcgtcgacagcaccaacaacgtcggacacttccagcaggtgctcacggccatcggcaacttctgcatcatctccatcgccgcgggcatgctcgtgga

SEQ ID NO: 68498 - DNA, 599 bp, Triticum aestivum
  Clone ID: PAT_TA_68498
gcctcacttcacctttcaacccgcatcggtgaggcacgcgagaagatgagtggcccccgctcgtcggcggcgccgccgctggacgacgacgacctgctcgccgagatcctcctccgcctccccccgcagccatcatccctcccccgcgcctccaccgtctgcaagttctggcgcagcctcgcctccgacccctgcttctcccgccgcttccgcgcgcaccaccgccgaaaccctcccctcctcggctgcctcgtccatgatttttgccaggttcgcttccagcctaccctggagcgccccaatcgcgtcccgctacccagcttccccgtcccaatcgccgccggcggccgcttccggatcctcggatgccgccatggcctcgtactcatcttgcacgactcacagaagcagctcctggtgtgggaccccgtcaccggtgaccagcacagcctggacattccccgggggttcgccgagaaaacctggatccatgcggcggtgcgtcgtgctcccagagatttccaccatttccaggtggtcttggtaggcaacagcgacattcaaagtacacaagcggtagcctctgtttacttgtcagt

SEQ ID NO: 68499 - DNA, 326 bp, Triticum aestivum
  unsure (1)..(326): unsure at all n locations
  Clone ID: PAT_TA_68499
cagcgagcgagcgatggcggccgcgggagacgccggcgagaagaagatgatcacgctcaagagctcggacggcgaggagttcgaggtggaggaggcggtggccatggagtcgcagacgatccgccacatgatcgaggacgactgcgccgacaacggcatcccgctccccaacgtcaactccaagatcctctccaaggncatcgagtactgcaacaagcacgtccaggccaagcccgccgacggngccncggacgccggcgcccncaccgcccgcgcggaggacctcaagaactgggacgccgagntcgtcaaggtcgaccaggcca

SEQ ID NO: 68500 - DNA, 687 bp, Triticum aestivum
  Clone ID: PAT_TA_68500
ggggatgccctggcgtcctcctttcctccaccctcatctgctcctctccctacgatgctccactaacggcaagcagtccaggctgctccctattgcaggtcggctgggtcctctcctagagctgttgtcactacgcctagagcagtctacatagcaggcacacgtggccatcgtagactccccgtgtagtacacttttgtgctatgaggcgggtgtcgtcgggattcgtcagtaggctccaaatcttgtgttcatccttttttctctcttggtgcatttcattggaacctccagtgcagctctgtcgtgtgcacattgacgcctcctgtagttcactaacgccggtgtgcacgatagccccggctctctttcacctatgctcctcttgttttgttcttcactgatgttgtagtccgctgatgcatgtcgtctcgatcatcggtgcagtccaccggcgcacaaaattgtttgtgcgggcaaaagtagagtaggtacagaggtgtcgcaattccaggtaagggtgtctacaacttgagggtccagaacaatgtgctgcacttcagccatagcgagatgaattgccgaagctgaattatttggctactttcctcgatcggatgtcccgctaccaggattcgagcagatgggggcggcgtccctctccggatctggctgttccggctacaa

SEQ ID NO: 68501 - DNA, 677 bp, Triticum aestivum
  Clone ID: PAT_TA_68501
gcgcggacggcgatctctcatccacagccgcacccaccgccgacgccgacgcccccatcctctcccccctccttctctccctggcggcggccacatcgggggctcctggatccgcgccgccgtcgagctgggccgccaaggtcagctccttccccacaaccaccgtcgccgcagggaggaggtgattgacggggcagccaccatcgagctcaccccgtctacttcttctcgggacgccgcgctccttctccgcaaccaccgccgccgccgctgcagggagacgaggattgacggggtcgccaccatgcaacctcccccgcgtacctcttctcgggactccccctccatggagctccgaccccaccgccgcctccatggatggaccatctcaagttatacatggagatctaagtgcctttcaggaggaaatacaatcagttcaccatgttgtccgcactctggaaacaaagcttggacgccttgcatatactcaagatcacacaacacgagtaatacatgagttatgtgagttcagtaaaagattggatcggagtccaaagccgatactcttaaggtcacagcatcaactcctctccctgcaatcgagtcttcagaaggaattaccaggaccgcttctttgccgtcaggttcggaacccgtgtctcctgtagctcaat

SEQ ID NO: 68502 - DNA, 641 bp, Triticum aestivum
  Clone ID: PAT_TA_68502
ggagtgagtgagcacgcaagccagtgtttgtagccagcagccacaatggccgggaacatgctagccaactatgtccaagtctacgtcatgctcccgctggacgtcgtgagcgtcgacaacaaattcgagaagggcgacgagatcagggcgcagctgaagaagctgacggaggccggcgtggacggcgtcatgatagacgtctggtgggggctggtggagggcaagggccccaaggcgtacgactggagcgcctacaagcaggtcttcgacctggtgcacgaggccgggctcaagctgcaggccatcatgtcattccaccagtgcggtggcaacgtcggcgacgtcgtcaacatccccgacattttctacaccaaccgcggcgggacgaggaacatcgagtacctcacccttggagtggacgaccagcctctcttccatggaagaactgccgtccagatgtatgctgattacatggcgagcttcagggaaaacatgaagaagttcttggatgccggtaccatcgtggacattgaagtgggacttggcccagctggagagatgaggtacccatcgtatcctcagagccaaggatgggtcttcccaggcatcggagaattcatctgttatgataagtacctgga

SEQ ID NO: 68503 - DNA, 730 bp, Triticum aestivum
  unsure (1)..(730): unsure at all n locations
  Clone ID: PAT_TA_68503
ggnctgcaggnaattcggcacgaggctccgattcgccgccaccggcgagccttccctcctccgctgatccctcttccttcgttcttctcctctcccatgtcctattcctcaccttccccttccctccacccgacccagttgctccgccccgtgctccgtcctgccgccgggagcagcttccggtgacccctagttgctccgtcctgctgccgggagcagcggtcggtgacccccagttgagcaccacagtccctggttcagtaccggatcgacctcaagcacaccggatctggacacctcgagaggagattgacatcttgaccatccctgcacctcatccctgatcttaaagcgcaacgtttttgcaaggccctggtaaacgtgaagctcgagaacaccatggattcacaaatcaatagcccgtacggatctctcaccagacaacaacaacaacagatgcagcagctgaggcaccagcagctactgcagcagcagcaacagaagcagctccagcaacagcacgtattgcagcttcaacaacaccaccagcaacagcagcagcagcagcaacaactccagcagcaccaccaccaccagcagcaacagctccagcagcaccaccaccaccagcaacagcagcttcagcagcatctgggcatgtctggaaaccagagcgcccaagcccagctagcgcagcagttcaaacaagcgtcgcagtcgatgaactcgt

SEQ ID NO: 68504 - DNA, 642 bp, Triticum aestivum
  Clone ID: PAT_TA_68504
gagaagatcctcctcgccccctcccaatatctgtcagcggcgagcgagccctcgtccgctccgcttcgggaggatcgccgtcgtccttcccctcgacggcaacgcgtgcagcggctgagcgggaggagccgcccgctgctctcctatcgatttgacggaacaccggtggcagtcaatcaccatgatgaaaagaagccacacgaccgtcctcgacgacctgcctgagtggattgtgatcgaagagatcctcgtctggttgccccccaaggacctctttcgctgtcgtgctgtctgcaagttgtggcgcagtgccacctccaccgacaagttcatgctcgacaattgccgccgccagccattgctccctgtcatcacacaggatatccctggacaggaaggagtcaggttcgttgtcttccgtgacaaaagtgttggagccgatcaaaagctctgtccaatcatccagcactctaagttccataatctcctgggcgcctgtgatggctttctcatcttgttcagtgagtctgatttctggatctgcaacccggccactcgcaaatgtgctatactaccgcaacctcgagttccatcatcatcggcaggggttccccgcatctacatagctggattctaccagca

SEQ ID NO: 68505 - DNA, 649 bp, Triticum aestivum
  unsure (1)..(649): unsure at all n locations
  Clone ID: PAT_TA_68505
gctgacaacagggnaaaaggctactttgctttgtggactgttaccatatatgcaacgctacatctataagacgcatagagatgcatatatcaactttcagcaaaatgagatcatgaagcttagcaatcttcagattattgttgttgaaaagttgttccacaagtatatgcttaaaggacatgagagttcttctaagaaaagattcaaatgccattgtcttctgcagggaaatattctgtatgctacgcaagaagctgattcacattcattgtttctggaaacttctagaattttctttgatggatcccctgatctgcactttgcgaattttctgcacatggtcaaaaccatggccatatctggcacctcagctgaacaggttgagtcttttgtcgttaataatcagaatgtgcctgcgttgcctgaagaggaagcggtttggtccttttcttcctcgtttgtgccagagtttgtacccgaccaaggtgttgattccaaaccggttgaaacctcatctgcctgtgttctcaatattcacaaacaacatcagaggtcagacggaactgtttcaagttggccacctaataattggagaacagctcctgattttagaacatcccgcagaagtcagcatggacccctgcaagat

SEQ ID NO: 68506 - DNA, 658 bp, Triticum aestivum
  Clone ID: PAT_TA_68506
ttcggcacgaggggaattcaagggcatgtgggagagagaggaggtccatggagaagatgctctgctccaaccctcactcactcctactacaagatgtctttttttgtgtgtgcttgtattgcagcagccatggagggttggcgatgattagcacgaggggtaggctgctgcttcaacctcgttaagtaacgagcaatttcgagtcgtggctctgggggaacaagttgagcaagtgcagccattgtcaagcttcgtcacttcaccagcaactcaggagaggtgttttttccgggtattgacgcttcggccatagtcgcgttgatccaccactcacatatatagataatagtatctggacgcagcagctggacgccagtgtcggacactctggctgcgacggccgcctcagcagttccacacatgagccgggagaggtgttttttccgggtattgacgcttcggccatagtcgcgttgatccaccactcacatttatagataatagtatctggacgcagcagctggacgccagtgccggacactctggctgcgacggccgcctcagcagttcgacacatgagccgggctggaggacccagactcggaggagatgatagagttcatggcgagcgaggcggacttgaccgagtccatgcttg

SEQ ID NO: 68507 - DNA, 678 bp, Triticum aestivum
  Clone ID: PAT_TA_68507
ggatggtatcatctctctcgaagcgaactgccgcggcacaaaggggagcaaagtcaagtatgaacttgacaagaagactgggatgataaaggttgacaggattctgtactcgtccgtagtctatccacataactacggtttcgtaccacggacgctgtgtgaagatggagatccaattgacgtcttggtcctgatgcaggaaccagtcatacctggttgctttcttcgagctaaggctattgggctgatgcccatgattgatcagggtgagaaagatgataagctcattgctgtttgcgttgatgatcccgagtaccgtcatctcaacgaccttaaggagctctctccccaccgccttgctgaaatccgtcgcttcttcgaagattacaagaagaatgagaacaaggaggttgctgtcaacgacttcttgccaccggagactgcacaggctgccattaagcactcgatggacctatacgcagaatatatcctgcagagtctgaggaactaatcatagttgcaaactcgcaaggctgcagaaaccaccaacatgggtctcgtaaaaggacaataatcgactgcgtggattttatttaaagacccattttttctatatatttaaataatgggacaatgctattcccatacatatttttctgcagaacattgtaatcaagg

SEQ ID NO: 68508 - DNA, 665 bp, Triticum aestivum
  unsure (1)..(665): unsure at all n locations
  Clone ID: PAT_TA_68508
aggaattcggcacgagggctngttggcattttgaccggttttacaaatgctgcttcataattataaaaggtgttctaaatgtgcaatttccgaccaagttttacaaatgaggtcttatgcaagtaatggaatcattggcatattcagtacaagccatttaaaagtaactcttagcatttcgggttggacaaatggcacaaaaccaattgccccgcattacactataaaattgtgtaatagctgtacatgtggcatttacatttacttttcattgcttagaccttctacctgtagctatgcagtaatgccagaattaagttgtttctatgacataagttcctctttgtgctgcaatctaatgccaggcaaatccttttatcgtcgtttttctttccgggctcattcggtttggaggaaattttggaggattcctatgggattttcttcatatgtttagcattcgtttcataggaatagaagtacttgattccttaggattgtgtccgtccatattgaccctgattccttaggattcttagtatttggtaagacctcattgaaaattccgaaggattagagagcacggtaatcctgatgagtaggatccagaggaactcaggcagaagtactgcgtccttgattgggtcgcacatgtcaactggttt

SEQ ID NO: 68509 - DNA, 561 bp, Triticum aestivum
  Clone ID: PAT_TA_68509
actcggcatgacgaggaggccgacagctccggccggtccgccgtcgagccgtggcattccaagcagccgcgcgaacgcagccgcctctcccacagcagcggccggagcgtgtgggccggcttcaaggagctgcatgagggtgaatatggtttttaaattgcagtatgaacaaacgattctgcagtaccgatttatacaggatttgctagagtcgctgcgagagttgtcatatcagtgcgtcgtcgtcactgcctgtatatccagcggggcacggcgagccacgagggtaggccccagttgctgggatgttctcgcatggcttgttctttgccgctgccggccgagcggtgcgggtgggccggacgaatgcatgtagtactgtgtcgtacctaccgcattataatcgtttaaatcgcaaactcccccattgacgaccaaatcgcacggttcttatgcaaaatcagtgtagctagttgagcaattaatctaacgaacttactgaatatttcggatctggatcacaagttggtcctatgtacataatttatctttgtaaaacag

SEQ ID NO: 68510 - DNA, 538 bp, Triticum aestivum
  Clone ID: PAT_TA_68510
gaggttagctcctgtattgatgaaacagctcggtgcagccatcccgtcgccatgcctcgagataaacacattgaccccatactcccacgcacaggcactgggactaaacctgtcacgcactatggcctgcgtgaagttgagatacttcctgtacctcctgaaccccccgaagcacatctccacggcgccattcaccttcccatccaagtcgacatgccaaagggcagccaaatccttctgcaccaccacatcatcttccaagagcactaccctctgcagcgccgggaacatgtccgggaggtagaatctcaggtaatcgaccaacgtcacgtccctcttgccggcctcaatctgcctgaacaccggcgaggatgaggcgttgaggaacgggaagtcggagtaggcgatgagctggacgtgcacgccaagcggcggcgggcggcgcgcgaaccagacgcggaatgcaggcaggtacatgggcgcggtgaccacgtggaagacgtggcgcgaggggtcagcggcggcgcgcgtcgcggag

SEQ ID NO: 68511 - DNA, 503 bp, Triticum aestivum
  Clone ID: PAT_TA_68511
gagggagagccgcacgcgtccggggagtactccttcgccgtggcgcaggccaacgagaggctggaagaccagggccaggtggtgacctcgcaggcgtccacattcgtcggggtgtacgacggccacggcgggcccgaggcctcgcgcttcctctcctcccgcctcttcccgaacctccacaagtttgcatcagagcaaggaggcatgtccatagacgctatcaagaaggcattccatgctacagaagaggagttcttgcacctagtcaaggggacatggctcaaacggccaaagatcgcctcagtcggctcatgctgccttgttggagcaattgccaataataaactgtatgtcgccaatttaggcgactcgagagccgtccttggtcatagaggacccaatggccggggagtagtggccgagaggctgtctaatgatcacaatgttgccgacgaggcggtaagaaaggagctcattcagcagcatcctgatgattcgcaaat

SEQ ID NO: 68512 - DNA, 535 bp, Triticum aestivum; identical to SEQ ID NO: 67692
  Clone ID: PAT_TA_68512

SEQ ID NO: 68513 - DNA, 369 bp, Triticum aestivum
  unsure (1)..(369): unsure at all n locations
  Clone ID: PAT_TA_68513
cgaggacgcgacctgtttcctctcacctgctgccgcaacaacgcaacgcgacctcctctctctctctccctcgtgtgatccgctctcccacacagctagacgaacgccttcatctcgagcgggtgagtgggtgatcggagagggcggcgctggcggtttcgatccgtgatctttctcgacgcggatggcggcgtatcgatccggttgaagcggctggcggcttccggcccaggaggcttggggtgttcgtggcggctgctaggaggtagcgatggggttcggcgaccggatgaggaaagggcgccgatctcgctcctcctgctcccaatcgctggcgcggncacccccccccccccccccntttttttt

SEQ ID NO: 68514 - DNA, 573 bp, Triticum aestivum
  Clone ID: PAT_TA_68514
aggaattcggcacgaggcgacggctggctcggcaccacaaaagaacacgcgcttcttccccgcccaaatcgaaagaaggagccggcacacaacgccccggctcgcctcggagggctcaccgaatcccgatccccacggcggagagttcgtcggaaaacaagatatcatcgcttacagctttttcagcatggagctctgcacagcttctgtatctatttcaccacatcgccccagtctatcaacgtctagccgtcaagtgccatatactcgatataccggttcaagatcctgtatttccagaaggacaaagcgattttcactctatgtcatcaatgctgcatcaactaatgccccgctctcttctcggaccctacccacgcaaactaatggcgcagctgcgaaaggcatgcccagcaaaaaacccaacagtgcactggagcaacttgatatcgagcgtggtgtctgcgtgcctttccgaaagtactccccggaaatggtcaggagtaaagtcttgggatcaagtggctctgtactatccctcgctagtcggggagtggagatcatttggaaact

SEQ ID NO: 68515 - DNA, 500 bp, Triticum aestivum
  Clone ID: PAT_TA_68515
gggcagctggaggcggccaacggcaagctggtgaaggagctggcggaggccaaggcgtcggcgaagcaggcggcgcagagctacgagatggagcgcaaggcgcgggagatgatggaggacgcgtgcgaggagctgacgaaggaggtggaggaggaccaggcggaggtggagctcctgcggcgcgaatgcctgggcatgcgtgaggagatggaggaggagcgccggatgctgcagatggcggaggtgtggcgcgaggagagggtccagatgaagctctcggacgccaagctcgcgctggagcacaagtactcgcagctcaaccggctgcaggccgagatggagtcgttcctgcggaaagacggcaagagcatcgacgccaacaactccacgttgcgggaggcacggatgatcagcgaggcggcgagctccgttcggctccgcggcgtgattcttgtgcttcggctggtaccagcgaccgttcagtggcgcgagcgagcaac

SEQ ID NO: 68516 - DNA, 590 bp, Triticum aestivum
  Clone ID: PAT_TA_68516
gtgatgctcctctcccccctcgtcgctcccgtcgggtgaagaccaccacctcctcctcccgggcttctcccgaatccaataaaaggagaccacatgctcatattacaaagcgaggacgaggaagaaagcgacctcaccatgccgtgcgaccttgctcctccagccacccccccccttggggaggaagagcgcacgcacggctgcggcggcggcgctcagtaccagcgaagatgagcaccctggcggatcacttccatttcctccccccggccctcagatccagatccagatcaagaccagccatttggcttcggagccaaagaaacgtcagaggctcctccggcgcccttgctccagccagccccccagtcattgggggccgaagcgcgcgcgcaccacacagccccgctgccgccctgctcttcctgataataactggagggactgggctaatcttgacgatggcccgttggggctgattgctgagctcgtccttgcctatgatgttgccgactacctccgcttccgtgccgtttgctgcccatggcgacgttgctctgttgacccacgcgcccatggtggtctggacc

SEQ ID NO: 68517 - DNA, 517 bp, Triticum aestivum
  Clone ID: PAT_TA_68517
atctgcaaatgttaagcatggaagcaacaattgcccagtttgtcgcaccgaatggaaggaacttccattccgtggcccgctggttgctgcaatccctcaaggaagtgcaaggattaatcctgttaatgggcagcaaaatggcggccacatgacactattgcgaccactccctcgtgctcgttcttctggccgccttcatcatgtaacttgtttgttgcctgacactgaccgaagtgttttcaatgatgatgagcccttggatttgtgtgaagcaactgatgaccatcagcaaggatgttcaagaacagtagagataacgacacaccctgagttcactgaaataccagaaagtacttcagaaagaagcttcactgttctaattcatctaaaggcaccccttgctcagaatttgcatgtacctggagatgacagtagcccaaacactggtcgagccccagttgatcttatcactgtgcttgatgtcagtggtagcatggctggtaccaaacttgcattg

SEQ ID NO: 68518 - DNA, 495 bp, Triticum aestivum
  Clone ID: PAT_TA_68518
ggaatagggaccgatggctgcgatgtgctgatctcctccgccgccgtcgctcagctctgtttggtcgagagggagcaagggtggcgttcgtctggcaatctcaccgccgccaccggccaccggccaccgccgcgccgacgaatcgacctaaggactgagagcttccagcgcgcaccacctgttcgacggaatgcctcacacaagcagggcagagaaatcgtcaaagtcctgcaacgaggacaggatcagcgccctgccggacgacgtcctgcaccatgtccttggcttcctgcgggcggatgaggcagtgcacaccagcctgctcgccaagcgctggcgctacctttggaaatccatgcgccgtcttcgcatcaacgaaatggggaggtgggggacgagcaccggcggcgttttccttaccaagtttgtgagctgcctgctgctcctccgagaccctggctcgactctggatgaggtcgagatcaagtatgatta

SEQ ID NO: 68519 - DNA, 223 bp, Triticum aestivum
  Clone ID: PAT_TA_68519
actttaagcatttgcgtgtctttcactgccccttggttcaagagataaatttgaattatggcttgacaacacttgaatataaatatgaaggtccatcaataccgatagcacctcctgtaactttgacaaacttaagcatagagtcatcagatgtttgctcagctcttgcatatatctccactgaattgcccagtacggtgcgtcgactggagatgctgtctct

SEQ ID NO: 68520 - DNA, 478 bp, Triticum aestivum
  Clone ID: PAT_TA_68520
agttaagagttggttcacactgtccgagcagccgaggcggagagaacaaagccaggcgccaccatgccctccggcggcgcgggcgtgctcctcctcgccctgctatccgcggccgctgccgtcgccaatgccgccgtgtcctacgaccacagggccgtggtgatcaacgggcagcgccgcatcctcatgtccgggtccatccactacccgcgcagcaccccggagatgtggcccgacctcatccagaaggccaaggacggcggcctggacgtgatacagacctacgtcttctggaacggccacgagccggcgcgcgggcagtactacttcgccgaccgctacgacctcgtccgcttcgtcaagctcgccaagcaggccggcctctacgtccacctccgcatcggcccctacgtctgcgccgagtggaacttcggtggattccctgtttggctcaagtacgtgcccggcatcagcttcc

SEQ ID NO: 68521 - DNA, 569 bp, Triticum aestivum
  Clone ID: PAT_TA_68521
aatggagatctattggactttgtttacatagatgaggtgcaggatctaaccatgacacaaatagcacttcttaagtacgtctgcagaaacttcaaggaaggcttcctttttgctggtgacaccgcacagactatagctaggggtattgatttcaggtttgaagatattcgttcgcttttttataccgcatttctctcagaaacggaagcatttaatcaaggacgtcaacatggaaaacaagtcaaactctctgatatgttccaacttactcaaaatttccgcacacattgtggcatcctttacatggcacaaagtatcatgagccttttgtacttctttttcccgtcaagtgttgacaagcttaacccagagactggacttgtgtatggagaagcacccgtgctgctggagtctgataatgatgaaaatgcaattatgactatatttggagaaatcaaaagtaagcatggtagcatgcatgggtttggtgctgagcaagtcatattagttcgtgatgatgctaccaaaaaacaaattgttgatcttgttggtaaacaggctcttgtttt

SEQ ID NO: 68522 - DNA, 355 bp, Triticum aestivum
  unsure (1)..(355): unsure at all n locations
  Clone ID: PAT_TA_68522
aagatgtttcatatgatgatctatatgtacaagaaggctggggactatacccaagcgcgtaagctattcgcacagatgcctgagagaggaatnccccagtctacagtgacttttaatagtttgatgtcatttgaagcagactataaggaagtgtcaagtatttatgatcagatgcaaagagccgggctaaaaccagatgttgngagctattctctgctcatcaaagcttacgggaaagctaggagggaggatgaagctttggcggngtttgaagagatgcttgatgctggaatcaggccaacacgcaaatcatacaacatcttgnttgatgcgttcgcagtatctggattagtag

SEQ ID NO: 68523 - DNA, 529 bp, Triticum aestivum
  Clone ID: PAT_TA_68523
gcagtgggtctcaattatctgtattcggtggtgaaacactgaaactagagatacagtggagtgactttcctgtagagggaattagggaggtttattctgatgagattatttcccatgagatatagacacgatgcaaaaccaaggtctatgttccggtggaatcgttgatttctaaggaggagaggaagagaatacaggggactgcgtcttcagattctcagtaatggataatggaacatataaaagctgctagagtacccgccatcccagcgccatctccgtttcgaacgattcctgtacgctcgatctgcctcgctggctcgtttttacggcgctgtaaaaaatccagccactcgtttatctgcacattgtgctcttctgcataagtgaatgactggtgggcctccttttctcacgggcccagttttgcggtgtgtctcgcgtgtacgctgcgtgcgaaaagaggggatccgcatagagcgtggggttcgcacggtaaaaccaagccaccaatcccctcgagccctgc

SEQ ID NO: 68524 - DNA, 598 bp, Triticum aestivum
  Clone ID: PAT_TA_68524
gcggacgcagtgctctcctgctcacagccgccgccgccgcaaacacccagctttcccacgccggagagcggccagccccgatggactcgccgcagatccccgacgatcttttcccggagatcttcctccgcgtccccgacccagccgacctcgtccgaatctccgccgcctgcgcctccttccgcagcctcgtcgcctgccgctccttcctccgccgctaccgcaagcgccacgcccagcccctcgtcggcttcttcgataatcagcgagtcttccaccccgccgaacctccttacccctccgcttcggccgccaaagccgtcgccctcgccgccgacttctccttccccttcctccgcgccccagccagcgcctggcacattttccagatccgcgacggtcgtgtcctcctcggccgggacccctacgacttcgaggagctggtggtgtgcgaccccttgcaccggcgccacctcctgctgccccgaatccctgcactcgacgagtggcttccttcggccacgaccggcgggataggatggcagatcttcctcctcggcggcggcgacgacgacgacgaggaggctgcggaagagac

SEQ ID NO: 68525 - DNA, 573 bp, Triticum aestivum
  unsure (1)..(573): unsure at all n locations
  Clone ID: PAT_TA_68525
gaggcttgtagnatatcatttctggccaaggatccctgaggggtacatactcatgcagaataagatgaccgcaaagaagaatgtcacaccatcagaagggtcttctactaaccagaaggtatatgatgaatattgccctatcctgctgacgcaatgtaactcaagggaatatgataaatttganacatttgatgatgcactagatgagttctacagcaaaatagaaagtcaaagggtgaatcaacagcataaagcaaaagaggattcagcagtccataggctcaacaaaataaagttggatcaggagaatcgtgtgcatacattgagaaaggaagcagaccattgcatcactatggcagaactaattgagtacaatttggaggatgtggatgcagcaatcaaagctgttcgtgtttcccttgcaaatggaatgagttgggaagctcttgctcgcatgattaaagacgagaaaaaggctggaaacccagtagctggtctaattgataagctcagttttgaaaaaaattgcattactctacttcttagcaataatcttgatgacatggatgagga

SEQ ID NO: 68526 - DNA, 568 bp, Triticum aestivum
  unsure (1)..(568): unsure at all n locations
  Clone ID: PAT_TA_68526
tgcaggnaattcggcacgagggcctcccgtgcttcttccccggcttcctctgatacagccagcgcacttgttgagcccgccaggaaggacaagtaccaagtccggcgacacgaacgtcgtcgttctctgctccatcgccggcctagagactttttgaagagggacaccatgttctaatctaatgctgcagccatttagacccttcagttttggtgccatcagccggacaacagaggctgcgccgtaacctccctgttcggctaccaccacttgcaaggattaccaactcctcggcttcctcctcacttctccggagacttttgaagagggacaccatgttctaatgctgcagccatttagacccttcagatttggtgccatcatcaaccggacaacggcggctatgtcggaacatccctgtttggctacctcctcctcggccaccactggcaaggacgaccccctcctcggcttcttcctccattattggtggtcaccgaatgggcaccgccattccccttcggctttggtggagacacctataggatggtgatggctgcgtcataat

SEQ ID NO: 68527 - DNA, 682 bp, Triticum aestivum
  unsure (1)..(682): unsure at all n locations
  Clone ID: PAT_TA_68527
tgcaggnaattcggcacgaggcacgattttggttgcaggctcgttcattgcaggccagtcccgcttgccgcctagccccggcgtccgcgaccaaggccggccagccgtcgacggcgtccacactgtcggatgccccctgctcacggcaggcatggtcgcacggagcagcatttgaggtggagggaaccaggcaaccaggggggcatcctcctcgtctccacggcagacgcttgccatgtgttcgtgcaaatgcttctgtaggcgtatgcgctccgatctgtcgaaatgaatcgtcggtccgggtacatgctgctattgcttcaaaaggaagaataaggatccagtttttttcccgcaattgcgtggcctgtccatgcctcggtcaagcttgatttcacacaagcaaagagagcaatctaacactcttttcgctcactcatggaggaacaatagttctctggatgatattggtccacgttgtgaaccttcttcccatccgtttggtctgtgcaagacaagagcagcagctttcggctatccatgtgaagatcacatggtcacaacagaagatggttatattcttagcctaaagaggattcctcatggtgtttctaactcgaccaagaatacaacgaggataccagtactactattccacgggctcatggtggatagcgtttct

SEQ ID NO: 68528 - DNA, 648 bp, Triticum aestivum
  Clone ID: PAT_TA_68528
attcggcacgaggcagagctgggagaaaactgttgactgttacagccctgggcaaggcttgatgccagctagttttaagattaggaccattccacttgatgaaaacaatgaagcatttgaggagattctggatcctgactttggtgaatcagctattggccgtgtagctccagttgattctggactttggtggattatcttactgagagcatactgcaagattacaggagactattcattgcaagaaagagtggatgtgcaaaccgggattaagctgatcttgagtttgtgtttgtctgatgggtttgacatgttccccactttactggtcacagacggatcatgcatgatagacaggaggatggggatacacgggcatcctcttgagattcaagctttgttctattctgctctgagatgctcaagggaaatgattgttatgaacgaaggctcaaaacacctcctccgagccatcaacaacaggctcagtgcattgtcttttcacattagggagtactactgggtcgatatgaataagataaacgagatctacagatacaagacagaagaatactcacatgacgcaactaacaaatttaacatttatcccgagcaaattccttcctggcttgttgattggattcctga

SEQ ID NO: 68529 - DNA, 659 bp, Triticum aestivum
  Clone ID: PAT_TA_68529
gctgcaatggagccctaggcggttgaactaactcggttgagctcacctcgccttcttaaggatccagcctcaatcgtcgatctgcgccgccgccgcttctaaccccgcggctctccaccggcaagcacggcgatctgaccctcaccccccacccacacagacgcatcgaagtaagtgcggcggcgcactgggagcgaagagatggcggtgaccatggcgagcgtttccaccggtgtgatgaactccctcctcgggaagctcgccacgctgatgggggatgagtaccgcaagatcaaaggcgtccggaacaaggtggcgtcccttctggacgagttcagtagcatgagtgctctgcttgtgaagctcgcaggcatggacgagcttgacgttcaggccagggagtggagggaccaagtcagggagatgtcatacgacattgaagactgcgttgacgatttcatgcgtgacctcggacaaaaatgcgcaaccaccggctttctgaagaagactgccgaacgcctgaagaagctgagggtgcgccatcagatggccaacatgatccataggatcgagactcgtgtaagtgaagtgcatgaccggcgcacgaggtacaaaattgatgagtacgctccatcatctggcattgtcgccgtcgatcc

SEQ ID NO: 68530 - DNA, 691 bp, Triticum aestivum
  Clone ID: PAT_TA_68530
gaggaaatagtgtgcggttgctcggggaagccagaagcagaaaatagtagatcgtgcaggtgtgagtgtccagctttgataagattgttgcgagcagcggacaacagctggtacattacagaacacagagagaaccataatcattcaatgtcattgacaatgggtgagaaagttcaccggccgtcgcacaagcacattgatgtgtacactaaggatctcataaaacagctacggaagaacaatgttaaccttggcaaggtgtacagcataataggatgtttcttcgggtcggttgagaaggttccattcactaagaggactctgaggaacatatgcgggaagatcagtcaggagcaggccgatgatgatgttaggaagacacttgaagtgttcgctgacatatagtctggtgaccctggtttcacatacagagtggtggctgatgatacaagcaaagtgaagaacctgatgtgggcaaacgggagcagccgtatgcagtaccgtttctttggagatgttgtcactttcgacacaacatatagtactaacttgtacgacatgccttttggattacttgttggggtaaacaatcattttcagagcatcatcctcgctggggtgctgatgtgcgacgagcagcaagagagcttcgaatgggttttcgccgagttccttcgaatgatgggaggac

SEQ ID NO: 68531 - DNA, 667 bp, Triticum aestivum
  Clone ID: PAT_TA_68531
gcaagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagggttccgttactaacatgtttacttccattgtaggtaacgtatttggtttcaaagccctacgtgctctacgtttggaggatctacgaattccccctacttattcaaaaactttccaaggcccgcctcatggtatccaagttgaaagagataagttgaacaagtatggtcgtcctttattgggatgtactattaaaccaaaattgggattatccgcaaaaaattatggtagagcgtgttatgagtgtctacgtggtggacttgattttaccaaagatgatgaaaacgtaaactcacaaccatttatgcgctggag

SEQ ID NO: 68532 - DNA, 620 bp, Triticum aestivum
  unsure (1)..(620): unsure at all n locations
  Clone ID: PAT_TA_68532
ggagaattcttaattcaagnagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagggttccgttactaacatgtttacttccattgtaggtaacgtatttggtttcaaagccctacgtgctctacgtttggaggatctacgaattccccctacttattcaaaaactttccaaggcccgcctcatggtatccaagttgaaagagataagttgaacaagtatggtcgtcctttattgggatgtactattaaaccaaaattgggattatccgcaaaaaattatggtagagcgtgttatgagtgtctacgt

SEQ ID NO: 68533 - DNA, 591 bp, Triticum aestivum
  Clone ID: PAT_TA_68533
gagtccatgattccagctcatccgggctcgctgggtgtaattcctgggagactacgcggacccatccacgatccttgctggacccgatcgaggagcgcgaggagctagccggccggcggagaggttggatctcactggcttcctccaaccacgttcggttcgagtaggccgccccccgatccaaggccaagccccatcacgcaccacaatcttgttctggttgacacacagatctggcaaaaggaagctaagccggtgtcaagctgaacaatggcaagctgtttcccctgcttgagcgccaggaagaaggaggtcccacgttctgccccagccaatccacacaccagcagcgtccctggcaccgtggcacgaactttctccttcgaggagctcgcggcggcgacaagaaacttcagcgatgcctgccgcatcgttggtcgggaggatggtctttacaaaggcttcctcaagagcatcaatcaggttgttgctataaagctgcagcatgcagttgatccaagtggatcatcggagcaagataatggagagtttcttgcccttgcgctgatgatgagcgggctgcgccaccca

SEQ ID NO: 68534 - DNA, 631 bp, Triticum aestivum
  Clone ID: PAT_TA_68534
cggctccggcagaccctcgccttcgtcgtccccgtcgtcgagatgctccgccgcctcccctcgcctcccaagccccaccaggtccttgccatcatcatctctccgacgagagaattgtcgtcgcagatatacaatgtggcgcagcccttcttcgcgacgctgaagggcgtgtcctccattctactggttggtgggttggacattcaggtggagctcaagaaagtggaggaagagggcgcgaacatactggtgggcactcctgggaagctgttcgacataatggagcgcctggacactctggagtacaagcatctcgagattctgatcctggatgaggctgacaggctcttggatatgggctttcagaagcaggttacctcgattatttcaaagttgccaaagctgaggagaactggccttttctcggctacccagacagaggcagtcgaggagctggccaaagcaggattgaggaatcctgtgagggtccaagttaagacagaggcgaaggatggtgctcagcaagatcttggtccatccaagacgccgctggggctccggttggagtatatgatatgtgaaccagcaaagaagtcatcacagcttgttgatttccttgtgcaaaacactg

SEQ ID NO: 68535 - DNA, 416 bp, Triticum aestivum
  unsure (1)..(416): unsure at all n locations
  Clone ID: PAT_TA_68535
gaaatgggacgagggattgaggcatggttagcaaggacaatcagaaagntggacaaccatttactgggagtctgtcagaccttcagtgaagaaagctatctaaccgtgattgatgcattcgcattgatgggtgacattggtggcatggctgaaaagatgcagagtttctttttgcaagaagtactctctcgaacacatattgacctgaaggaaatgttggaagaggaggtgggaaacaatacgcanagaaatagatttacatatagtgatctttgtgttcaagttcctgagtccaaactccgcccctgcttgttaaaaactcttgagagcatattttcattgatgcggtcatattatgctattatgagcttttgcccagaagcaaagaataacacatctcagagtgcaagtggaac

SEQ ID NO: 68536 - DNA, 542 bp, Triticum aestivum
  unsure (1)..(542): unsure at all n locations
  Clone ID: PAT_TA_68536
atgctgatttttgtgaagaccctcaccggcaagaccttcacccttgaggtcgagtcctcggacaccatcgacaacgtcaaggctaagatccnggacaaggagggcatccctccggaccagcagcgtctcatctttgctggcaagcagcttgaggatggccgcaccctcgctgactacaacatccagaaggagtccaccctccacctggtgctcaggctccgtggtggcatgcagatatttgtgaagaccctcactggcaagaccatcaccctggaggtggagtcgtctgacaccattgacaacgtgaaggcgaagatccaggacaaggagggcatccccccggaccagcagcgtctcatctttgccggtaagcagcttgaggatggccgcaccttggcggactacaacatccagaaggagtccacccttcacttggtgctccgtctccgtggtggccagtaaagctcctggcgatggagctctgcttcggtctctgggttcgcaagtctcgtctttgtttctgtactgtacattgatgcagt

SEQ ID NO: 68537 - DNA, 190 bp, Triticum aestivum
  Clone ID: PAT_TA_68537
tgtcactcactttcttcagttagctagcatggtcatgtcagtcagtttcttcagttagctagcctggtcattttcagttagtgcttagtactatagttgtttcctgtaatatcgtggctcacggcagtatgtaagccggagagtgggtggagggcggcacgatatgaataaaaccatagtaaaaaaaaaa

SEQ ID NO: 68538 - DNA, 281 bp, Triticum aestivum
  unsure (1)..(281): unsure at all n locations
  Clone ID: PAT_TA_68538
ctccttttcgcaaaggaagaagaagttcatcgcctgaaaaagcattcatgggaacaagcaaagaataataaatctaccacggatctccagaaatacccaccagcgtgttccttccttctcctgctccccgcgctgctccccgggccgccgcgtcgctccaagaagccagcggcaccagagccctgcctagtgagtgagggatagcagagcaggagcgtcccgtggagcctnctgcggctcgaggaagcggtggtggcctcagctccgaagcagctccgccg

SEQ ID NO: 68539 - DNA, 674 bp, Triticum aestivum
  unsure (1)..(674): unsure at all n locations
  Clone ID: PAT_TA_68539
ggaattcggncgaggcgcctcgcccgccgcgcaaatcccgtcgccggcgctgccgattcgccgcccgagctccgtattggagcgctcctgaccgagagacgttaagcgcctatggttggaactggttgatatgatatctggtcacattgtgggatgcaatccccccttagtggggggtgattgaagaagtcaacaataggagaacttgcatcttgctgaagttttctgcttctgagtttcttgagcaggctcttaaactaccaagtatgtcaggtgtcaaatgggaagtggattgatgggctccagttctcatcactgttctggcccccgccacacgatgtgcagcagaaacaggcacaaattttagcctatgttgagtactttggtcagttcacatctgatagcgagcaattcccggaggatgtagctcagctaattcaaagttgctatccatcaaaagaaaagcggttggtagatgaagtattagcaacttttgttctccatcaccctgagcatggtcatgcagttgtacatccaattctttcacgcatcatagatgggacactgagttatgatagtcatggttccccattcaattccttcatctctttatttacccaaagttctgagaaagagtactcagagcagtgggccttggcctgtggagaaattct

SEQ ID NO: 68540 - DNA, 679 bp, Triticum aestivum
  unsure (1)..(679): unsure at all n locations
  Clone ID: PAT_TA_68540
tgaggaattcntgcagtcttgtcgcgtagcgaggtgtttcgttgatcgaggtgttggttgcgattgtggttttagcgtcggcgtgctgggtttggcgttgatgcaggtcaagggtgcacagttcaccaaagaggcgggttctcgcagcaacgtgatcattcaggttcgtagcctgatcgatgccatgcgcgccaatcccgttgcctccaaagggccggtcaaagctgcgaatccttcggcgccgaccgcgagtgagtgtccatactgcttcaatggaaccgccaccttggtcaattgtgtttccgattgcacccctgccgccagcgcgaacagcgacctctacaattgggttgaccgcctcaacaaagccgcgccgcgttccatgggtacgggccccaaggccaccgtaacctgggagccaactcttggaatgtacgcgatcaccgcgacgtggtcaggtggcgccatggacgggggcgcctccaaagtctccgacaatgtttcgtataccttgaattacttgccatgaatgccagtcgtcgaaattgcgcacgtggtcagggcggcgtttcgctcattgaattgatggtggcgatgcttctcggtgcgatcatcgtggcggggctaattcagatcctgatggcgaatcgcaaggcgtatcagttgcaggaaggaaaca

SEQ ID NO: 68541 - DNA, 874 bp, Triticum aestivum
  unsure (1)..(874): unsure at all n locations
  Clone ID: PAT_TA_68541
gctcgtcgaatcctcctcccccgccgcctcaagatgcagatctttgtgaagaccctcaccggcaagaccatcaccctcgaggttgagagctccgacaccatcgacaacgtcaaggccaagatccaggacaaggagggcattcccccggaccagcagcgccttatctttgctggcaagcagctggaggatggccgcacccttgctgactacaacatccagaaggagtccaccctccaccttgtcctgcggctgcgtggtggcatgcagatcttcgtcaagaccctcactggcaagaccatcacccttgaggttgagagctccgacaccattgacaacgtcaaggccaagatccaggacaaggagggcattcctccggaccagcagcgcctcatctttgctggcaagcagctggaggatggtcgcaccctcgctgactacaacatccagaaggagtccaccctccaccttgtcctgcgtctgcgtggtggcatgcagatcttcgtgaagaccctcaccggcaagaccgtcacacttgaggtggagtcgtctggacaccattgacaatgtcaaggccaagatccaggacaaggagggcattcccnccgggaccagcagcgccttatctttgctggcaagcagctggaggatggccgtacccttgctgactacaacatccagaaggagtccacccttcaccttgtcctncgccttcggggaggcatgcagatcttcntcaagaccctcaccgggnagaccatcacgcttgaggtggagtctttttnnacaccatcgacaacgtnaaggcccaganccaggacanggagggcattcccncgggaccagcagggccttatttttgcaggcaagcagntgg

SEQ ID NO: 68542 - DNA, 128 bp, Triticum aestivum
  Clone ID: PAT_TA_68542
aatgcatccgctcgtgcatcaagcggctggttttccatgatttccgaggggatcgaagtgagattgctttcctcaaattcttctttgagggcgcattggtgctgaaggaggtggtgttagtgttggcc

SEQ ID NO: 68543 - DNA, 245 bp, Triticum aestivum
  unsure (1)..(245): unsure at all n locations
  Clone ID: PAT_TA_68543
aaccccaacacggtcaccgaccgcggcctcttcagcangagcagcaaggacgacgccgccgacaagaagaagaagcaggaggagaagacagaggaggaggagggcggcggcggnttcatcgacaaggtcaaggacttcatccacgacatcggggagaagatcgaggaggcggtggggttcggcaagcccagcgccgacgtggcccggatncacgtgccccacatcggcctccaccgcgccgacct

SEQ ID NO: 68544 - DNA, 562 bp, Triticum aestivum
  Clone ID: PAT_TA_68544
ccctgccactgccacaccggtggctgcactccacctcttcctcgtggtgcggcggacggcggctcttgcggtcgtgcggccgacggcggcctcagcgggctctcgatccccgctcctcattcggctcctcttctccatgccgccgccgcctcctccttttccccgtccctcacggccgcctcgccacctccgccttcagcacctcctcctccccttcctctcctccttccctgcctctggatccagccagttaactctggaggggaaccaacctacaggtaaagggcgacggcggcggccctcgagcagatgagagggagagagaaggacatggcggcagatgagagggggcgtgcggcgcggcggtgagcgtctccggcagcggcggcgacctgtgggcaaagggtgacagctggggtgctcgattcgatccagcgccatgagcctgtactttacttgctagagagagagagcagatgagggaaagagagaaggagaggagggagaaaggtagaggaaagaggagagggagccgcaacggcagatgggagatgaacacggt

SEQ ID NO: 68545 - DNA, 660 bp, Triticum aestivum
  Clone ID: PAT_TA_68545
tcggcacgaggcagcggccccaaatatctgtgttcttttgttcttccgtgagctttgagaggtagctagaggaagaagaagaggggttgaaagattcagctccaacatttggtatcagcgctaggtgatgacgaagacgatgccgcgtgactcttcagcgagtggagcgttggtgccgagcgactcggcggcgatggcggctgccgcgacggcggcgacgacggcggcagcggggaagctcccattcccgctgctcacgaggacgaactacgcggcatgggcgatgaggatgaagtacctcttgcgcgccaatggcgcgtggggtgccgttgatcgcgaggcctcatcggaggtcgacaagggcaaggaggagatggccatgacgatcatctcccagtccatcgatgactcgacgctgctgcgggttgcggagaaggagaccgcagccgatgtgtgggcggcgctacgctccatgcatgtgggcgtcgagcgcgtccgagaggcgagggttcaatccttgcgctcggaatttgatggcctcaagatgggtgatgcggagtccgtggatgatttcgcggcgaggttcacgacgctcgtggggcgcatccgtgagcttggtgatgcgatggaggagaagtacgtcgtgaagaagctgctccg

SEQ ID NO: 68546 - DNA, 574 bp, Triticum aestivum
  Clone ID: PAT_TA_68546
ttcggcacgaggcgggggcgggcgtggaacttccgagaactcgagttgcaattgcgggagacggcgaccacgggcagggctggttgcacaaactccccatcttgtggtgattgttgcgcctcccggggaagagtggtggaaaccacgaggaggaagcatccagggaacgggaaagatacagaaactctggattctggacctggtatcagtttggtggtagctggtagataactactgcctggaaatattgtgctccgggtgatgcccttggtctttcttgtttgatggcaagtgcaaacacaggcggctttcgccttgtgaggtgcccaaagtgtcttaacattctacctgaacctgcaaatgtttcagtctaccagtgcggtggatgtaacaccactcttagagctaaaatccgtgtcagcgatgcacaaaatgtggctaccaaacaagttcgacaagactctggggattactctgttgttccctctgtgagcaatggggtgtcgacaaaacaagttcggcaagactctggtaattactctgttgttacctctgtgagcaatggggtgtctcc

SEQ ID NO: 68547 - DNA, 672 bp, Triticum aestivum
  unsure (1)..(672): unsure at all n locations
  Clone ID: PAT_TA_68547
tcttaattcaagnattatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagggttccgttactaacatgtttacttccattgtaggtaacgtatttggtttcaaagccctacgtgctctacgtttggaggatctacgaattccccctacttattcaaaaactttccaaggcccgcctcatggtatccaagttgaaagagataagttgaacaagtatggtcgtcctttattgggatgtactattaaaccaaaattgggattatccgcaaaaaattatggtagagcgtgttatgagtgtctacgtggtggacttgattttaccaaagatgatgaaaacgtaaactcacaaccatttatgcgctgg

SEQ ID NO: 68548 - DNA, 207 bp, Triticum aestivum
  unsure (1)..(207): unsure at all n locations
  Clone ID: PAT_TA_68548
ggtcacgcaacgtgtcactttcttgccattgacatctttaatggaaagaagcattgaggatatcgntccttcatctccacaactgtgacgtnccccatgttgaccgccaagattatcagctgtattgacataactgatgatggatatgtcagccttctaactgagagtggtaacacgaaggatgacctgaagcttcccactgatgat

SEQ ID NO: 68549 - DNA, 617 bp, Triticum aestivum
  Clone ID: PAT_TA_68549
gctttgctcgaagctcctttccaaactgtattggtggattgctacttgtggcggatacaggatcatgcgagaagacatcgtcgcctaccggaacaactaggcagcggctaaggaggatccttaggagtgggatgctcaggtacccgctccacaacacttcaacataggacctgatggctactatgagtggtgattatcaagttaggccaaaagcctaagcttgggagagtacatatttccacttacattacattcatgttcacacatttcatttcagttgtcggtgtccacactttttcattgtattatccatgctagatttattttctcgccttcttcttgtgtgtttgaaaaactttgaggaactccaaaaatgtttcctgcttcttttcggtttttctttctagtttaaattagttgtagtattaaaagaaaacccaaaaatatttctcgattcttcttcttgtttgttgggagctttcatgtgtaaatatttttttctcattttttggttttcctgttttaatttgctttcttctagaagaactaaaagctccaaaaatattttagtgtgtttctctggatttattttttccatttgttgagtcataccaagg

SEQ ID NO: 68550 - DNA, 594 bp, Triticum aestivum
  Clone ID: PAT_TA_68550
gaggaaatcaccgcgaagccaggaaccccaacaaaacgtccccctccgtcgacaacccgacgccgacgccgacgcccggagccatggccctcctgccgcttctgggttccccctccttcccgttcccggcctcgcgccctgcccgcccgtccaggagaaaatgtggccctgccgcgcgcatgaatttcagatgctccgcggaagagagagcgccggtcaggaacagtgggatatccaagcatgtcctctcttgtcttgctgcgtctctcctcttcatctctccacctagtcaggctgttcctgcagacacctttgcccggcccagcttgtgccaggttgcggtggtggccgccatcgacaaaggcgccgtccctctcaaattcgacgccccttccgatgatgcgatgatgatgatgaccaagggcatgaccgccaagaacttcgatccggttcgctactccggcaggtggttcgaggtggcatcgcgcaaaggcgggttcgctggtcaggggcaagaggactgccattgtactcagggagtgtatacatttgatgagaaggcgggcgcaatcaaggtggagacattctgtgtcc

SEQ ID NO: 68551 - DNA, 560 bp, Triticum aestivum
  Clone ID: PAT_TA_68551
aggaattcggacgagggtccgatgctcctccgctgccccttgccccatctctcttttcaatcgtgaatcagcgcagtacctgtctggtgcagtggtcagctaggagacgatgaccgctggaagcccgcccgtagacgctggtgcacgggggatcaccgcgctgcaatggagtgtcacgcggcggtgctacaatgggcggagagtcgcgcggtggtgctacggtggatcttcaacggcggctgtcggtgctgtcatgcagcgcccggtgctgcaatgtagcttcatcagcgctgccggtgctgccatgcaagtggttggtgctgcaatggagcttcaccgacgactgccggtgctatgatgcggcgctcgccggtgacccggagctgcgatgcagcgctcaatgctgcaatggagcgcgctttccggcagcgtcgagtgctccgatggagcgctgccgcgccggggttggcgctgcaatgaaaacgttgtggtctgccgtcggtggagcattactgcgctgccggcgagggggaggggtgtggctcctgctgcgagccggg

SEQ ID NO: 68552 - DNA, 577 bp, Triticum aestivum
  Clone ID: PAT_TA_68552
aggaattcggacgaggaccgcgacatctacagcagacgccagcccatgagcctggagctcgtgcctaacatcaagaggtacgagcgccgtgccatgcgcgccctgaacagctccgtccagggcttcttggaaggagctcgacctcgctgcggcgtcaagagactgaacctcgagttcttcgccaccggtaacggctacggctgctgcatcaatcggctcatcgcggaggccattgatgcttggggcgtcgacgacctcgaggccatcgccaagccactgtacaagcaacaagacctcgtccacgcctttccgagccatggcctgtgcaaggagccccgtgcgtcacgcctgcaaagcctcaagcttggaggctgcgtgctcccgcctctgcacgagtacagttcacttaccatgctcgtcctgcgagacataccggaatccacgcccccggccgcctacgagggtgtcttcacctcgtgcccaaagctttacaccctgcacctcatctcctgtggctgcagcagcgactcaggcatacgcttgccggtggtggtgaacgcccccagttcagagatca

SEQ ID NO: 68553 - DNA, 103 bp, Triticum aestivum
  unsure (1)..(103): unsure at all n locations
  Clone ID: PAT_TA_68553
tgtcaggttcccggcaggcacacnaacgaacccgctcctaggtatagaggatgttgnaacctagagccctcgcatacgaggcactgaaatacgactgctatnc

SEQ ID NO: 68554 - DNA, 636 bp, Triticum aestivum
  Clone ID: PAT_TA_68554
aggaattcggcacgagggcctatcccctacagagactccagctcactcgcatattgcagtcgtctttgggaggcaacgcgaggacagccatcatctgcacgatgagcccggcgcactgccacgtcgagcagtcgaggaacacgctcttgtttgcaaactgcgcaaaaaatgtagtcaccaatgcacaagtaaatgtcgtaatgtcagacaaagcattagtgaagcatcttcagagagagcttacgaggttggagaatgagctcaagtttcctggatcagcctcttgcccaactcatgctgaggttctgaaggagaaggatgaacagattaaaaagctggaagaacagttgaaggaattgatggaggaaaaagacacggttcaatcagaacttgagaatttccgcaaagttgcaagtgatgatcatctgaattgtcttaaagcaaggcgatgggatgcacatagtcgatcttcagaatccctaccacgtaatatgtctgaagatgcactttcatgttcagatacttatgacctagtcgatcaagatctattaatagatgcacagccagggctctttccacgccgacccagtaaccatgttttcgacagcatagatgaatgccaagaaaacttggtgg

SEQ ID NO: 68555 - DNA, 610 bp, Triticum aestivum
  unsure (1)..(610): unsure at all n locations
  Clone ID: PAT_TA_68555
aggaattcggcacgaggggtnttgcaatgacttttnggtatttgtactgagtccgattatgaagcctttgattcttctcaagaccattacatcatggcctttgaggtggccctcatgagatacttgaggcttgatgaggacctcattgctgactatatgttcatcaagatgaatttaggttcaaaacttggcaacttggccatcatgagattcactggtgaagctagcactttccttttcaacactctggcgaacatgctcttcactagtctgagatatgacctcaatttttctgagtcaatatgctttgctggcgatgacatgtgcgctaacacagaactgagaaaaagcatgaggtttgagagcttcctaaaaaaactaaggttaaaagcaaaggttgaaatgacttcaaaaccaactttctgcggttggaatttgtgccctgatggaatttacaaaaagccacagcttgtggccgacaggttcaactttgccaaggaaaaagggattcttaaagactgtattgacaactacgcaatagaggtctcttttgcttaccgtttgaaagatcagctgcacctgtacatggatgaggatgaaatgacaaacc

SEQ ID NO: 68556 - DNA, 459 bp, Triticum aestivum
  Clone ID: PAT_TA_68556
cctaataggatgttgatatcagtgaaaaacgaggttgacaagttacctttttgttctattgcttgttctctgttgtctgaaagtagtatacctcattccatactaccatgaatctccataatacatgtcagcaagaacagctatcgggctcaaattccgcaaggctgcaaacattttggaccatctgtccagcttgtgacaccaaatatcagtaccaccatgcaagtgcacagaaaactgtccgctgccaaaattgctcgaaggcctttatagcacatgttttaacggaccaacatgttcctactggtccagagcaatctgtgtggaaaaatgcaggagtattttcagaaattagattgcttcagaagttcaaacctgggcagatctgggctctctacagtgacatagataagtatcccaactgctatgccttcatagagaaagttgaactggagaata

SEQ ID NO: 68557 - DNA, 571 bp, Triticum aestivum
  unsure (1)..(571): unsure at all n locations
  Clone ID: PAT_TA_68557
gcacccacgccgtgagnacggatgggtagccggggcggcaggacgatgaaccgggacaagcgctacgactcgttcaagacgttttccgggaagctggagcggcagatcacccatctggccggcggcggcgtgccggttagtacccccgaggaggaggagttcgcccagggacagggagaagccgtgagtggcgacaacgttgatcgcttcttcgccgcactggagggacccgagctggacaaactcaagtcgtcggaggagctggcgctgccggcggacaagaagtggccgttcttgctccggttccccatttcggcgttcggtatgtgcctcggagtgagcagccaggcgatcctgtacaagacgatcgcgacggcggcgccgaccgagttcctgcacgtgaaccccaaggtgaacctggtgctttggttcatctccgtcgggctcatgtccatcatcacggccgcgtacgcattcaagatcatcttcttcttcgaggccgtccgtcgcgagtactaccaccccatccgtgtcaacttcttcttcgcgccgtggatcgcctgcctgttcc

SEQ ID NO: 68558 - DNA, 495 bp, Triticum aestivum
  unsure (1)..(495): unsure at all n locations
  Clone ID: PAT_TA_68558
gaggccggactcncccgccccgacaccatgagtaaggtgcgatatcggcgcgtcgaccgtcctggtggtggcggtcgtcgccgccgtgtgcgtcgtgtccttcaagggcaacggcggcgacaagggcgatggggagctcaccacctccgtcaagtccgtcaaggccttctgccagcccatggactacaaggagacgtgcgaggcggagctgaccaaggtgggcggcaacgccacgtcgccgacggagctcgccaaggccatcttcgaggtgacctcggagaagatcaggaaggccatcagcgagtcggccaccctggaggagctcaagagcgacccgcgcacgtcgggggccctcgagaactgcaaggagctgctggagtacgccatcgaggacctcaagaccaccttcgaccgcctcggcggcttcgagatgaccgacttcaacaaggccgccgccgacctcaagacctggctcagcgccgcgctcacctacca

SEQ ID NO: 68559 - DNA, 642 bp, Triticum aestivum
  Clone ID: PAT_TA_68559
attcggcacgaggcctaatggccgcctccgtggagactcgccgtcgctcacacccgccgccgacgatgaacaacaaccagcgcagccaccggattcaccaccccaccgtttggggggacttcttccttggtttaggccattcactccgacccagtgtctttccatgaaaaacaaggctgaagtaatgaaagaagagctgagggcgacgatagtagattcaggttctgctgatctgcctcggaagcttgagcttgtcgatactttacagcagcttggtttggactaccactatgggaaagagatcaatgacttgctgtgtgggattcatgataccggcgatgaagaccgtgatcttcacacggcggctcttgggttttatttgctcaggaaacagggattcaatgtttcgccagatgtattcctaaagttcatagatgccgaaggaaagattacctgcaacgacacaagaagcctcttgggcatgtacaacgctgcccatgttcgaacccatggtgaagaaacactcagcagcgtgatcgcttacacaaaagaccatctcctccgtgtcgtggagcaacaaacaatttcaccacctatattactcgaggaggtgcggcgtacgctggaaacgcctcttttcag

SEQ ID NO: 68560 - DNA, 673 bp, Triticum aestivum
  Clone ID: PAT_TA_68560
gcacgccgcccatccctctccctgctcgtcccctcatctcctctttcctcgatgccggatcccctgcctctccgacctaggccagagcctcgccggcagctcccccaagtcggcgcccgctagctgctggtgtggagccgagcttctctgacggcgacggcgacggcgacaagcttgtccaggtcgtcatggccggcgacgacgaacgggagggcggaggtgtttccatggccacctttgccgagagctcgcacatcttcaaccctcagccatgttagttttggggtggctattttttggatccgctgctgccgtgcgccgtgcgtctggatcaggcgcaggtcgccgccataggagagcagggtggcgtggtctttgtggtgggcatggagcaagggaggatgaggcgctggtatgaggaaaggagcaggaaggtcggagttccaggcggtgctggcccgtcgtcacatgtccccagtctagatctaagaaaaaagagaaggggatgaatctggaggaagagcttggtgaagaacaaggtgttcgtaatggcaacggtggtaatcaacgatgagaaaaaaggaccgagattgtatttgtactagcaggtgatgccttaatttagttcatggcattatggcgggatgcatgtggtaaatggttacaatggtgg

SEQ ID NO: 68561 - DNA, 316 bp, Triticum aestivum
  unsure (1)..(316): unsure at all n locations
  Clone ID: PAT_TA_68561
agagggggcagaggaggccgcgccgctgtcgtctccactctccgtcgccgtcaccgttgccctcatctgcctccgccctccccagtgctcgcctcctcctccgccgtcgccgtcgccgttgcggtctcctccgcggctccacctccgcccttcctcgtgtgcttgcctgctccttggccgtcgcgctctcctccgtggctccacctccgttcttcctcgtgctccccctccccatctttaccgcagagagagagagagagagagagagagagagagagagagagagagagagagagagagagagagagagagagng

SEQ ID NO: 68562 - DNA, 125 bp, Triticum aestivum
  unsure (1)..(125): unsure at all n locations
  Clone ID: PAT_TA_68562
tgggtcaagggattgctggacgctgacgcagatcctacatcagtttgttgtanattaatgtagaatgtgccatctgcctgctcccttcctgccttcttgtatgattactgctttgccaatagatt

SEQ ID NO: 68563 - DNA, 553 bp, Triticum aestivum
  unsure (1)..(553): unsure at all n locations
  Clone ID: PAT_TA_68563
ctgcaggnaattcggcacgagggggcaatgccctgcaggcatgtgtgtcgacggaccttggtgtgacggcgtcgcagtgcgctgttgatgagagaaagaagatacttaataagtatctctcgaagagacagagcagacctgcctcgggcagacccgccaagattatctcacgccaagctttggcggaaaggcgtaagagaggtgatggaggtagatttctggcaagcgacggaccgctgccgttagaaaggcgatcgaaacgtcttgagaagcaaaatcttcaaaatgaaaagaagcctgagagtaaagaagatgaaatagttgaagcggaacaggatccagaaactgaagtagtagctgggcctggaggagagccaaaagttggtatggttttcctgaatgaagacaaggcttacgagttttatgtcagctatgctggaactgcaggattcaatgtccgaaaaggatgctctgagaaaacagcaaataatgttacgaaatctcgggcttatgtatgttctaaagagggattccgccctaaaagttttactgc

SEQ ID NO: 68564 - DNA, 600 bp, Triticum aestivum
  unsure (1)..(600): unsure at all n locations
  Clone ID: PAT_TA_68564
gaatattcttggcaacctcggtgacccgccctcgcgccgatgtcgcctactgcatatacgccttgtcgagaaggctgtccaagacaaagaattggaccgtgggtgtccttcctccttgcctcctactccatgggttccataaacactcttatattatgggacacaggagtatcaattttctcatcctccactcatgttctaggcttatgcgagaaggcgatcctactttcaaggaggagttcctggcccactcccacaaaagaaaccttttgcacatggcgcgtttcaaggatgactcgagcccattaggttggtcccttgcaatgcctccttttcctcccaagaacagggaaaaggatatgcaacatccttgcatcaaggagcttgggattgctccgcgtgggttcgcacctacncgctctttctggaggaacggcttgagtgctttaggaatctaaaatacgacatcgaaaccgagcgtccgatgagatctccccagcattctgccatggcacatagtagaaccaggacgctgccctgccttgatcttatggagcatttgccttcattgcagcagctgctcttccggcttatgggctg

SEQ ID NO: 68565 - DNA, 561 bp, Triticum aestivum
  Clone ID: PAT_TA_68565
gcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagccgcggtaattccagctccaatagcgtatatttaagtt

SEQ ID NO: 68566 - DNA, 620 bp, Triticum aestivum
  unsure (1)..(620): unsure at all n locations
  Clone ID: PAT_TA_68566
ttcggcacgagggtgaatttccccgtcgttctccaaggnactgtgccccgaaccatccgcttcggaggggctcgctttgagtgagatccagttcttgggccgccattgctgcggcgcccgcgtccgttcccggcaacaggaggaggtctctgtgcatgcccgtcatctccccccttcctttctcgcttttgccagcgccggctgctcccgcggcgtcgcgagctcgctggaacagcttcccgcaccaccggcttttgcgaggcatgtgcagcaacggttttgattcaactaactgccttcgtatggaggaggttgagccgaatttatccccatttctccacaagctttttaaagagtgggatgactgcaaggcgaggggattgtttcaccacaacatcactacctgtgagaccaaggtgctacctggagaacacaattttgttgcaacattgatagaagggcgtgaccagaagaagcggccaactgaatttggaatgaaccaagtcctccaaccatttcatagtgacaagttcaatttcactaaagttaaaccggaggaggtgatcttcaggttccaagaaactgagaatgattctgcccagtattttgacggagctcct

SEQ ID NO: 68567 - DNA, 615 bp, Triticum aestivum
  Clone ID: PAT_TA_68567
acgagggttttcatctatggcgttcctctcccctggcccctgctccgattgcggaggtggtggtagcgctggcgccggagggatgacccggagccgacggctattccccctctcgcgcttggagtaccgtgcaatgatccggcggagcaagaggcgataatgggtcgggtgtcctctctccggtaagacctccctcctcgttttcttcccctctcctccatgattttctgaatttctagagttaggatttttggtttttgggagcggggtagaggaagaggaagaaggccatgtggtagagaagaggaggacctcaaggctgtggagaaggaggaacaacgctaggagtttttttcttcgatcgggccaaaggtgatagccctgtttcttccctattttagatgaacacctccttctttcttccttagatgaactgctaattaagaaagaactgggagtctacaagctgccccatggttgccttcgtttccaccaaggctaactaattttcttgcatgttcgatttttgatatcttcccgatctcccaagttcacaatattttttacaaagaattcatagaaatatacagcctcattttagctaggtctagatca

SEQ ID NO: 68568 - DNA, 623 bp, Triticum aestivum
  unsure (1)..(623): unsure at all n locations
  Clone ID: PAT_TA_68568
ctgcaggnaattcggcacgaggnccggcacccgcgagggcccgtcgccgcattgggtgggagatcaccggagcgcgccgagataagatttcctcctccgcccgagcggggcaggacgacaagaaaggccgctgtacgcgcacattcgcgcccccatccccgtctccttttccgcgcccgagcttttccggctgcgaaatcagccatgatgagctccagtggctccgaggtgggggagcgcgcctcacatgaagggggctcaggataggaagcagaagaagaagcaggagctgcaggtgctggcgcccttccccggctgcctcggcagggtcatcaacatgttcgacctcagcaacggcgtcgtcgccaccaagatgctcaccgacaaggcgcaccgcgacgtttctccggctggtaaggaccgcagcggtggtctcaagatggcgggtaatcagttcccgagtcacatggaggataaacatagagacagtcagcaaagaaggagctctccaacgaaaagatcaaactcacccaccaaccgatctggcgtgtcgcccgtcaagatgctcatggagcaggacatgtggcgagaaggggcgcccgacgacgagcccctcaatgttg

SEQ ID NO: 68569 - DNA, 550 bp, Triticum aestivum
  Clone ID: PAT_TA_68569
ttcggcacgaggctgaacttatgcaactctttggtctgatctataacttcataaggaagtatgttctgagaatgaaagaagatacagagtttgtcccctcgttcccatatcacactgaagtaccaaaagttctgttgtttggactattgggattcacatgctctgtactggcgcccttgatcttaccttttctgctagtctacttcttcctgggctatgtcgtataccgcaatcagctgctcaatgtgtaccgcacgagatacgacaccggtggtttgtattggccgattatacacaacacagtgatattttctctcgtgctcacccagatcatctgcctcggcatatttgggctgaaagtatcaccagtagctgcaggcttcaccatacctctcatcatcttcactcttctgttcaatcagtactgcagaacccggcttcttccactgttcagcactttcccagcacagaatttaatcgacatggacagggaggacgaggtgtcgggaagaatggaacatattcaccacgggctccacaccgcgtattg

SEQ ID NO: 68570 - DNA, 497 bp, Triticum aestivum
  unsure (1)..(497): unsure at all n locations
  Clone ID: PAT_TA_68570
gcaaagacaagtcaacctcaccgaggnagaagcagagagaagggagaagatgtcggggcgcggtaagggaggaaaggggctcggcaagggcggggccaagcgccaccggaaggtgctccgggacaacatccagggcatcaccaagccggcgatccgtcgtctggcgcggcggggcggcgtgaagcgcatctcggggctcatctacgaggagacccgcggcgtgctcaagatcttcctcgagaacgtcatccgcgacgccgtcacctacaccgagcacgcccgccgcaagaccgtcactgccatggacgtcgtctacgcgctcaagcgccagggccgcaccctctacggcttcggcggctaggccaccgccagattagctagcctgtgtctagggttcgttgtccatgatgtaattgcagcatctcgctgttgtttgctatcttctgtagaatcgaatggaatggaaattgaactagtttatcattggaaaaaaaaaa

SEQ ID NO: 68571 - DNA, 479 bp, Triticum aestivum
  unsure (1)..(479): unsure at all n locations
  Clone ID: PAT_TA_68571
gatggaatcgaaaatgaaaacgtgaattgggtgaatgcccttattcctaaaggtgttgaagaggccgcaatgtcttttaccagcaccgatgaagggaacagtggtgattcgtctgacagcttacctcccccacccccaccaaagaaagccaaggtaaaaaacgatgacaggctgctatgtaccatgacccgtgttctcgatcgcctagcagaagccatagagaaatgcagtaggagagacactgatgtccccgacgacctttgggcgaacatgaagagcctcccagggtttgaacaggagcatcttgcccactactatgcttatttgtgcgagaatgctcacgttgccagggcatttgacaagcttagcgtgcctcacaaaacgatctgggttaataggtacatcaagaaccacctctcggcctanttggtacctacgatggtagggttgggctatggtaatacttactccctccgtcc

SEQ ID NO: 68572 - DNA, 304 bp, Triticum aestivum
  unsure (1)..(304): unsure at all n locations
  Clone ID: PAT_TA_68572
cagctgctgtcaagcgacttgatcaggcaatccaagtcggagcacaacgaaacatgtcatatacattagggatatctacggngatggttgatctagaatctgctggttctagaaagcttgaatcaaaagtagatcgaaagaaacttgaanaggcagagcggaagatcgcggctaagcagaataagaagatgttcaaaactgtagagtatgaagcgtctcgcctcatcaaccagcctgatgatgctgagtcatacgaggaattntatatggccgttaatcctttgcagctaggatcgaattctca

SEQ ID NO: 68573 - DNA, 667 bp, Triticum aestivum
  unsure (1)..(667): unsure at all n locations
  Clone ID: PAT_TA_68573
gctcgcgccaagttaagcgcctctggnaccaagggtgggtgggttgggggttggaagaacctgaaggcggagcagttgatgaagttgccctgcaatggggaaatttaagatgaaatttgactaaaaggacgccatggagagggttgaggttgacgcggactttgttgttgctggcaattggaagctacatggtgaactatgtaagaaactttacactgtagttcatgaagtttcaattgccatccctgcccttgagagtacaaaacctggaagtaattctggacttctggcgttgagctccttgcgcatagctgttgataaagccaagaatctacttcagtattgctcagagtgtagcaagctttacttggccctaacagcagaatgtgttcttacaaaatttgagaaagcaagatgcgctcttttagaaagtcttcaccagttggaagaaacacttccagaagcaattaattctcagatcccagagattgcaaatgagctggagaattcagtttttgctttggatcaggctgaaaagcaagttggtgatcaagtgaaacagataattcagaatgagaagaaatccaatggattccttgatgacaatgaacttgaattctttcggcaaactattttgagagctggcattacatcatctgctgcggct

SEQ ID NO: 68574 - DNA, 624 bp, Triticum aestivum
  Clone ID: PAT_TA_68574
ttcggcacgaggctcattcttcttctcttctatctgtctacacaaacagacaccaacaaaagggtttgcaagaggccatccatcattacttgattgcgtatatcccattcaagctagctagccggacaaaagaagagatttatcatgttcatggcgcaggaagagcccggcctagccctgggcctctccctcggctccggtgccgggcaccaccaccaccagctgcctcagccgaaagaagcggtgcctctggagccgtacctgtccctgagcctggccggcgccggcgcggtgaagagggaggaggaggagagggccctgatctactgctcggcagcgtcgtcggcggcggacgacctggtcgaggggtacaacagcagcggtggcggcagccggaagaagctgaggctgaccaaggaccagacggcgctcctggaagatcacttcaaggagcagagcaccctcagccataagcagaaggcatctttggcaaggcagctcaacctcaggccaaggcaggttgaggtttggttccagaacagaagagccaggacgaagctgaagcaaacggaggtggactgcaagctgctcaagcgctgctgcgagacgctaacggaggagaac

SEQ ID NO: 68575 - DNA, 663 bp, Triticum aestivum
  Clone ID: PAT_TA_68575
cggcacgagggcagctgctactcctgtctcttaccttccagggaactgatgcaactgatacatgaacatctcgttggatctggtttggctgctactgctgccatgttgcagaaggaggctgaccttgcacctttgccatcaactgctgcagtgctacctgtccaccagcccgctgccctggaaccatcatctgttcaagttcaacaacagtggccttctggccgtgttcagggatttctgtccgacaaaacaatgattgctgcagatcaagctggccaacgatcagattctgttgtgccttcgtctaagaagaaggcactggtattctcatccagtttctctaaacgaaatcaaccctttgtttcgttttctggtaatagagcaagcaatagcctgaaaagtcctgtacctgccggaaatgtggacggtatgacttgctctgcctctgctgccaatactggagatgtggagacatcgcataaaacaccaatgcccttgccacttaagaggaagcttgcggatatggagtttagttctgcatcagcagcaaagcgccctgcaataatggatcaagcatcccaatctcctgtgttccaaactcctgctcctactcgcagaggcctctctgtggcagtggattctcctactgcagcatttcatcca

SEQ ID NO: 68576 - DNA, 116 bp, Triticum aestivum
  unsure (1)..(116): unsure at all n locations
  Clone ID: PAT_TA_68576
ggtttnagnactgtgcctgtgttgttcttgtcatggtggatgtggtatgcctaatgtgatggtaccgtcttgttgccattagcaatggaaatgaaaaatgtttctcaaaaaaaaaa

SEQ ID NO: 68577 - DNA, 536 bp, Triticum aestivum
  Clone ID: PAT_TA_68577
gcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagcccgcggtaattc

SEQ ID NO: 68578 - DNA, 643 bp, Triticum aestivum
  Clone ID: PAT_TA_68578
gaggttgcccttgagagggggatcccgtcgacccttggtgtgctgggcacaaggaggctgccatatccaagccgctcattcgagctggcgcattgctcacgctgtcgaatcgactggttgcagagggatgggatcttgttgctggaagtggatagggttttgaggcctggagggtatttcgtttattcctcaccagaggcttatgctcatcatgatccagctaaccggaagatatggaagcagatgagcaatcttgctcagaggatgtgctggaggattgcttcaaaggagggccagacggtgatatgggtcaaaccattgacaaatgggtgctatatgaggagagagcccagagcacttcctcccatgtgtgcccatgatgatgacccagatgctgcttggaatgtcctcatgaaagcatgcataactccctactccaagagagttaacaaggctaaaggagccgaactgcttccctggccacaaaggctcacagcaccaccccctcgtttggaagagattggaatcagttcaaagaatttttctgaagacaatgaaatttggaattctagagttgctcagtactggaaacttatgaaatctgagatacagaagtattccttcagaaatgttatggatatga

SEQ ID NO: 68579 - DNA, 126 bp, Triticum aestivum
  unsure (1)..(126): unsure at all n locations
  Clone ID: PAT_TA_68579
ttcttctcacgtatggctgntgcgcccactnggngctcaactacnccggntccttggccaaagcctncaaggctagctggtcatggntncctgncaaggccacatggtacngttcgcctaccgnng

SEQ ID NO: 68580 - DNA, 574 bp, Triticum aestivum
  unsure (1)..(574): unsure at all n locations
  Clone ID: PAT_TA_68580
attcggcacgaggtcaggatgccnttgaggtgttccaccgccagccgaggaggaacgtccagatggacgtcggctgcttcaacaacatcatcgggaagctctgtgagaaggggatgcttgcagaggcagagaagctctttgaggagatggagagcaagtcggtgcttccagatgtgtacacctacactttcctggtcgacttgtgcttcaaggaaggtcgtgtggatgacacgattcagtacttttacaaaatggcagacgggagggagcacggcccaaagttcaacatcggctttttcaatagaatgtttgaaggactttcacaagctggccggattgatgatgccttgaaggtgtacggaaggatgtctgacaaggagatcaagccgaacacaacaacatttgaaatcctggttaatgcactgtgcaaggaaggggaattggatagagcactggacctggtgagggacatggcaaggagtggtgttgtcgcaactcctgagttccgggagtntgtcggtgagattttcaagaatgccgatcggcacgaagagatcgagaaagcttttgaaga

SEQ ID NO: 68581 - DNA, 147 bp, Triticum aestivum
  Clone ID: PAT_TA_68581
cccgtttgttctggtcttccactgttcggtggcttccggatatccgggcttcggccgtatgtccggccgatgtagcttcgtggcgactccacttgaggcacttcttgttacatatccgtggtggcttgtcatatgctccgagctcct

SEQ ID NO: 68582 - DNA, 454 bp, Triticum aestivum
  unsure (1)..(454): unsure at all n locations
  Clone ID: PAT_TA_68582
tcgccgtccaagggctgggtacgncgggagctacgacttctggaagaacgagggcggcgggaaagggggaggccccgcgccccgcgtcgaggacttcagcttcaagaaccggccggcgcagccgccgacatcaccgcaggcatcgtccccttcgttctcaccgaagcagcaggcgagcgccccggtggaggtcgccgaggacccgcccacgcgcctcatcgggaacttcctccggaagcagaaggcggccggggccgagctgtcgctcgacctcgacctggagatggacgacatcgggaggtcgtcacacccgtccttatccaactcccgagagcgggagacgccgcgtgtctccttcaagaaccgccagtcgtcctcgtcctcttcatccgactccgacaccgccggcggccgtaggcgcgccggcgacgacggaatacgcaacacctccact

SEQ ID NO: 68583 - DNA, 606 bp, Triticum aestivum
  Clone ID: PAT_TA_68583
ggaattcggcacgagggcctgacctcctgcttgtgctccgttcgcttcttcaccttgatagcaagcaatggtggccaagaggaagggtcgcgacggccggtagaagaccgtcccccaccggatcatcaaggaggacgcccggcatgtgtgcttctccgagcgtttccgggggatattcaacaaggccagcgagcaggccctgctcactagcgcccaggtggccattgtcggcttaatgcccggcggcaaggccttctccttcggcgattcatcaatagacgttgtcgtcaaccacttcagggtgggggacggcgctgccgacaacaactggttgcaaacgttgcgccggcagcatggcgaggtgcgcacagagctggcggagcggaagaagcggatgaagagtgcggacgaggccctgcttcaggaacacgctgtggggaccacacggcagcgtgggtcgaactcgatgtgagcaacatggggtatgaggacatggcggtgttcgccacagtgctcatccaggagcaggccgccggacgcaccaaccaggttctcatggaggtctttcatgtccacatcagccgtaacctccaggtgcccccgccg

SEQ ID NO: 68584 - DNA, 119 bp, Triticum aestivum
  unsure (1)..(119): unsure at all n locations
  Clone ID: PAT_TA_68584
acgagaagctcgccaagctgcgcgaggtngtcaccgggntgggccagatcnccgacaaggagaagtncgggttcatnagnctngtntcccgntacctnagnggnnncnaggngnntntt

SEQ ID NO: 68585 - DNA, 588 bp, Triticum aestivum
  unsure (1)..(588): unsure at all n locations
  Clone ID: PAT_TA_68585
ccatcctcctcctgctcgggcagtcgccggnanatcgccggcgccgccgcggagttcgcctacggcctcatcccgcagatcttcgcgtacgcggccaacttccccatccagaagttcctgcaggcgcagagcatcgtggcgcccagcgcctacatcctgacggccagcatggcgctgcacgtggcgatgagctgggtggcggtgtataggctgggcctaggcctactgggcgcgtcgctcacgctgagcctgacgtggtgggtcctggtggcagggcagttcgcgtacatcgtgctgagcccgaggtgccgggagacgtggaccgggttcacgtgggccgcgttcgccgacctggcggggttcgccaagctgtcggccgcgtcggcggtgatgctggcgctggaggtgtggtacttccaggtgctcatcctcctcgccggcatgctgcccgacccacagatcgcacttgattcactcaccgtctgcacctcgattcagtcatgggtgttcatgatctccgtgggcttcaacgcagctgccagcgtgagggtggggaatgaacttggcgccgggaaccccaggtctgcc

SEQ ID NO: 68586 - DNA, 135 bp, Triticum aestivum
  unsure (1)..(135): unsure at all n locations
  Clone ID: PAT_TA_68586
gggtcgtcagaatgcaacttgctgcgcattatgtccataagcaatctntgagcctttctggaccatcagttgccatctcaccggaagatggatgttccctcgagttcttccccaaacggnggaacaaatctgtcg

SEQ ID NO: 68587 - DNA, 124 bp, Triticum aestivum
  Clone ID: PAT_TA_68587
acggggcgtgcactctcacgccgcttctcttcgtagcaacatttctaggagttatccagaaagagttatacaaaacttcagagggcagcccacgttacattccaacacacctgctgcaaataca

SEQ ID NO: 68588 - DNA, 619 bp, Triticum aestivum
  Clone ID: PAT_TA_68588
ggcgcgacatgtccccgcgcctcgctgttgtttcttgatttcttctctctgctccttgtgttgtttggtcctctttggtctaacctgagatctatcaacgagcgttattgcggctcttgtccttgttcgtgggtgaggagaggacgccggccgtttctagcaccgggtgctgctgatcctgttcttcgtcacggcggcggccttatcgctctggtctccgggaagccgcggcggtgcacgaccgccggggccaacgtgcccacgccttgcgcatcaagctcgaggcggtgggctgggtgatggtgcggttcctccggcggcatagccttgacaagagcaactcgcacacccacctacggaaggaggaggaagagagcaacagctgtatagaaagcgacacggcggagatgcaagagcccggtggcaatggtggcggggggtgctcccccgctgcccaacggccggacggcgcctcgctcccgtctcgcacgcgacgggccgccctcagatttggacgtgatgaaggagagattcgcgaagctgctgcttggagaggacatgtcagggaccgggaaaggcgtgccgtcggctctagcgctgtccaacgccatcaccaacc

SEQ ID NO: 68589 - DNA, 203 bp, Triticum aestivum
  Clone ID: PAT_TA_68589
tgcgagccggtggttgcagatcttagctcctgttcgtagcttgctaggccacagattgcagatttctttctttctaggtggaggattcgttagttaggtcgctcgctcttcttggatcgaatctcgaacgacgagaggagattcttgcagattcactagtgtagaaattggatcttggggggcaatggcgatggagccggcgg

SEQ ID NO: 68590 - DNA, 629 bp, Triticum aestivum
  unsure (1)..(629): unsure at all n locations
  Clone ID: PAT_TA_68590
atttctttgcctgatactnaatgaaggagagagatatagagtaggatgatcttgtttcttgcttgaatctgatgctgatacaatgttcatacaattaaactcatccttagatacaaagctaagcttatttctacttactgaatgagacagataagttttcactagtagacttatgtgatgaccaaaacatggatactttagctcaacataaaaaacttggtatattagctccaacatctaatcaggataatggagttctattggtccttactgctattccaaatccctcggaaggaaaaactgctatactaaataaactatatggtctactatttctattgtttagtcttacttccattcatgtattttgtagtaccctgggtatatacaatagtaatagtacagatgaatatgtagtggtacttgcattattgcatagtaagttaagcatgttgtagtacatgtcaaacactcgtgccaatgatatttagatatgctgttgcagcgtatggtggcacactaggacccttcactgttatcatgtgcagaatcttgagtttccctctccccatatgtttgttcattctgacaaacatctacaacaattttataccgcaacatatcacaga

SEQ ID NO: 68591 - DNA, 604 bp, Triticum aestivum
  Clone ID: PAT_TA_68591
ggaattcggcacgaggtcccgctgctgccgccgcccttcgcttcttaccattgatcgccgccgaagctccgtcgcccggtgtgcgctctccggcgggaaaggaaactcatttagctggaaagaatgtgcaatttctgtagcattgtctgttggattaattactgtcccaccaacatttggatggtcggcccatgcttatcctctcgaacctataataaagctattcgtgaagttcaaaaaccgctagaggatattaccgatagtctcaaagtttctggtgttagagcgttggattcagttgaaagaaatgtgaggcaggcctcaagagcgctgactaatgggaggagtttaatactttcgggtcttgctgaatcaaaaagagcaaacggagaaaaaacattggataaattagctgttggacttgaagagcttcaacgaattatcgaggatagaaacaggaatgcggtagctccaaagcagaaagagcttctcaattatgttggaactgtagaagaagatatggttgatggcttcccctatgaagtaccagaagaatacaacaacatgcctcttcttaaaggaagagctactgtggatatgacgg

SEQ ID NO: 68592 - DNA, 648 bp, Triticum aestivum
  unsure (1)..(648): unsure at all n locations
  Clone ID: PAT_TA_68592
cgaggggcggctggtcttcttctcngcctctgccgcccttctccccttccattcgctgccctactctaccctcccgcccctaatcttctctggcactacccccagcctcctgctgccgtgcctcgatccatacaggcgccaccgcgcggggggcggtcttcttctccagccatccgccgccctcctcccctcccctccctcttaatattcttcttcttctccggccagccgtcgccctcctcaaatcccgcggagtttgccggaggaagaacatccgccgtccgaatgtgctacaccagagggaagcaccggaaagaggatgtttctatgcagcataacccaaaagtttaatttaaggtattccatcaagcgtatgttccatagcctccatcctgtagtttatttcctttgcttcaggttgtacagaggatttcctttgtttcaggttgtacagaggagctcaaggacaactgaggtgctgctagaattacatcagctactaacttacatacatataaaaaaaactgcagctttagctccatgtagtaatgactaagtatattctaatgctcatagacactgattactattttttacaggttaatttaatcaattccttggcgtactttagtaaacgaggatatattg

SEQ ID NO: 68593 - DNA, 678 bp, Triticum aestivum
  unsure (1)..(678): unsure at all n locations
  Clone ID: PAT_TA_68593
ggcacgnaggcttctccanccactatnacccagtgatgctcttcctcttctacacgcattgcatggacgatgcactccactctcctggagtgcacgccgccatggttgctggccagagccaaggcagcaccccttatcagcgcgaggaacccagagacgccatggatggcgccatggatgctcctctgccgttggtctgatctggccgtcccgccccagtcgtcggcccgctccggatccggccagcagccttgcctccgatccgactcggatggccctgcctacagcctccgccacctgcggcatgccccccagaggtccgactgatctagcctgtccacgaagtccagccggccctcctcccgggcgcgttcctcggccgttgccatgtgctcggccaacaacttcgttgaactgggcagcatcaacccccttttccctgtcggtgaggaactccagcagaggatggactgtgttttggagctcctcgatctggcctcccccgctcagttgccgctccatgctccggatctggccacagtaggcctcgcccccgacgaccaacaggctcagatccatcccttccctcctcctgtcctccacatgcgtaggggctgtggcgccagatcaagggagcctgccaatggaggtcaccgcatctccgtctcgttccgtccg

SEQ ID NO: 68594 - DNA, 223 bp, Triticum aestivum
  unsure (1)..(223): unsure at all n locations
  Clone ID: PAT_TA_68594
ccctccccggccggcgccgaccttcctgggctcgtcggctcctccgagcccgagcgcctgcagagcctcgaggttgcccaagttgtgcagctgcggtactcgatggaggatctcccggagccactgcttgcagatatcatcaagaggattaccgngtcgagtgatctnanttttctttgcctcgtgtcaaagcgcctctgcgccggnggggnggagcatagga

SEQ ID NO: 68595 - DNA, 518 bp, Triticum aestivum
  Clone ID: PAT_TA_68595
atgacgcatcaatttcagttggagggaaatgaatggctgtccaaattatacgaggtcagggcacagtgggctcctgcttatgtgaaggattttttttgggcgggaatgtccgtcacagacagaactgacagtgcaactgactattttgatgggtggttgacgtctgatacatctgtgaaaatgtttgttgagcagtatgaggcagctgttagaactaagttagaaaaggaaacctatgaggatttgcactcgtctcagatgaggccacagttgatgactggattgcctgtggaggagcaagcagcaaagatgtacacaatggagatatttcaaactttcttgaatgaattagggcgttcatttcactgcaactatagtatacttgatcggagtgattcagtagttacatacatagtatcagagcatgtaaatcaaacaaaggtggactacaaagttgcttatgacaatgctgaagatgacatatggtgcttctgccgcttgtttcaatttaaaggtat

SEQ ID NO: 68596 - DNA, 666 bp, Triticum aestivum
  unsure (1)..(666): unsure at all n locations
  Clone ID: PAT_TA_68596
caggcgggtcagnagtaaatatcatgcagctagnaatggtgctagagtgaacccctgttacctcgtatcatacaagaaaactgaaagcacaacctgtcaaaggaagtaattctaaaagttcctagaaatggaggagaaccaccctggtataaagtggtcatcgacggctacccatcgcaaaaacaataccccttatgaactatcgtcgttacaccatcgctccgttggaattcatgaaaatgatggtgatgatgcgagccagttcaataagcgaagaagttctactctctctgattactcaatgaaagatgtccgaaacgtaattcaaacatcaaccgacgaattattactcccaaagctcgattccacaaaaattgagcatattcaacgttcatctgcatggcactctgcaccattggcatttgcgcttttgcctgcattgggaggtatcttctttaccaacggaagcggctttgttactgatatcttgctcctcgggctggctgccatctttctaaattggtcggttagactaccctgggactggtatcatgctgctcgctatattcagtactctgatgatgactcaattggagtattaccaataccagaagacgacaagaataaagaaatatctcaatcagcaacttctatggggcacgtaca

SEQ ID NO: 68597 - DNA, 645 bp, Triticum aestivum
  unsure (1)..(645): unsure at all n locations
  Clone ID: PAT_TA_68597
ggcacgaggcggataaggttgagcaagacaaagcaggaccttgatnagagagaggaagcgatccgcaaagcttatgtaaggcaacaaggaatagagaaagcactgaaaaaggcaagtagagatctggcgttgcgagtgaagcagatcagtgatctgaagcttctggttgaggggcaagacaggactattgccaggtcacaagctttgctttctcagaaggtaactgaagtggaaaatctcaaacgagatatgttcaagaagaacgaggaagcagacctgatgcgttcagagatcaggtccaaagaaaagctgcttcttacagctaatcaagctattgcgcagcaagaagcaacagttagggagctgcagagtgaaattaaaagaaagacaatggatatcgccagatcaaatgaatcgaggaaaactaatgaagagaaactgaaagttgctgaacaggaacttgagaagcagagtttaggatggttagcagcacaacaagagttaaaggaacttgcacaactggcattcaaagatacagatgatatcaagggtattatcactgacttcaaacgtgtgaggtctctgctagatgctgtacgctctgaattgatctcttcaaaagatgctttcgcttcctctcgcaga

SEQ ID NO: 68598 - DNA, 680 bp, Triticum aestivum
  unsure (1)..(680): unsure at all n locations
  Clone ID: PAT_TA_68598
gggttacctttgcactcaaccctcccaanncttccggnactggataggatcacttgtgaacctgcagaagttacgcttgcaattggagagaatccggcatgaagatttgtgcatccttggagcattacccgctctgctcactctgggccttgatggaatgaatgatcagtcttcttgtgaagatagaaggctgacagtcagtcctgaagctggcttccgatgcctgagagtgttcacttatatggtacaggaagataggatgatggatctcatgtttaccgcaagatgtatgcccaagctggaaaaactggagattatttttagcggcaacattgaaaatgaatctctcagcagtgctggtgcttttgatttcgggatcgaaaacctctccagccttgttactttcagatgtgagttagattgccggggtatcaaggggagcactattgatgctgcaaaggcttcagtggagagaatagtcagcacacatcccaataaccaccttaatctaatctttgatgatggcattcttcggttatgaattaaggccaggcgtgcactcctactctttggatgcatcagtagcagattgggtatttctgtggcctggctgatgttggacagacactctagtctcccttgttgaatgggctaaagatgctgctgcacttcatgatgaa

SEQ ID NO: 68599 - DNA, 573 bp, Triticum aestivum
  Clone ID: PAT_TA_68599
tcctggcggcggcggcggcaataatgctgcttctgcgttagggctctgctgacttttcgggcctgcttacaagtgggagaagatgaaacgggccagatcaagggaaacgaagaagccagacaaagaatttgctgacagtagaaaaaattattgcaaaaccagaactgacaaagtgagacttggtctagagcacaaatccggtaattaaatccgtttgttactgaaatagttgctgacaagtcgaaaggctttggggaaatacaatttgaacctgtaaatttcatataaatattttgataagttgaataattgtttttgaaactttcaagtaccttgaactcctgtgcccgcggaaggatattgtgaaactcaaggaattgttaggctcagtttattatctgtaaagacgtaactattttaatttggcactgatgaaatgatagaacagaatatgtatatataacaatagtaaaagagagtaaatactaaatacaaaaattataactaagtttgttgtatgctcacatagcaaaagtatatttgtgcttatgtccgcattgagcatttaactcg

SEQ ID NO: 68600 - DNA, 637 bp, Triticum aestivum
  unsure (1)..(637): unsure at all n locations
  Clone ID: PAT_TA_68600
gttgttcaatgtcaacggnaaaaaaagaagcaatttctgtgtcggtgaggtgatttgctggatcacctggtgcagtttgggatcggcgggactggtattttttgcagaatttgctgggaaagtatgtttatgatttcatagggttttgtaggacgatgattatgtgctgattatacagctcgaattctaatataatcatatgtaggagaaattgagtgtcttttatgttgcaatgtacttccatttggctgttggcatagatggtgtataggattatttacatcaatgcccacttcttttgcataaaatcagtgtaaaccatatggagtcttaccgttatgttctgctgcttgcattttctttcaaatgcatatctatttatttgaactagacaagcgtgctattgttgatatcaaacaattcaatctattgctgctgttgtcttggagcttaagtactccttaccttgtcccatcctttttttgttcaacttagcatttcagtaccattgagtattgacttgatatgcatattagctgcatattgagtttggtaacatgctttccttggtcatgcatatctctgcgctatcatatgggaggatatgcatcagcagttgagtactgagcgtatgact

SEQ ID NO: 68601 - DNA, 661 bp, Triticum aestivum
  unsure (1)..(661): unsure at all n locations
  Clone ID: PAT_TA_68601
ggcctcacgcccccccactgccgccagnattcagtcccctccgagnacgacgacgcttccgagtggggggtcgatttctccgatccttcgattgcgtacgatgaaggcttcatcgctctccagcatcggagcaccaagcaggaagtttactacaacccccaaacgatggctctgtttctccacccccaggagcaccatgacatgcccgacggcaccacccttgagttccacacactctcccccggagaggatcagaggccgccccgtgtggtctctgtccgtcatgactactcgcggccttgggcacgcgtcgccgtcttctcatcggacaccatggagtggcagattttcccggagacggccgcgctactgcctgagggattcaggcgtacaacccgcacgctggtggatgggtttatctgttggcaatgcgagtctgtgggcggggcatctctcagcgagtacattttggtgctcaacacagatacctttcagttctctctaatagatctgccgccgcccttgagagtggtatacccagaatttaagattggtcagaccaagaatgggaggctctgtatcgtaaatgagaaggaatgcacactttctgtttggatcttgacagacagtgatgacggcgtccagcgatttgtgctgcaca

SEQ ID NO: 68602 - DNA, 616 bp, Triticum aestivum
  Clone ID: PAT_TA_68602
gcctccctccagtgacgtgcttcgccgccttctctccctctcgcccgtgtcgcctttccctcccccccgtgctgcgtcttgcgtgctccaaggccgaggaggagcgcgggcacggcggccttatcctactcgacaccggctgtgacaaacgccggcgctcctcgttaccctctatctgcaaacaggagctcccgtactggacgctaccgtcccccacgggctatctaagccggagcccccctccatctcgacggcacccgagattgaggccgcaccggaatcccaatcgcctaccacgctctacgctcgacggcaagacccacaagataagagtagggatgcgtgttgcagagggaagaacgatgtgatatggacaatgatgcagctcctgaagaagcggttgcggcgtctgcactgattagctgtaagacagttactccagcacttacagtactgcgtctcctcaatctaggttttgcagtacagtagggatggactctgtaactgaaaggagtagcactgattgtgtcggggcaaggagcgggcgcggcgagcaggagcgggcaaggaggtggtgagcacctggagctgcaagcaccgggcgaggcgtgagttg

SEQ ID NO: 68603 - DNA, 597 bp, Triticum aestivum
  unsure (1)..(597): unsure at all n locations
  Clone ID: PAT_TA_68603
ggccgcccccgtcgcccaaacttccacggnccatcacctccacacgccgccgagctgcagcgccggcagctgccactgccgcagcctcgcagggttggggacgaagggcacaacctagccaagggacggccatggagggcagcaggcacgagaaggggagccaaagggaaggaaggagggcggcgcgacggctgaaagcttcaccgaaaccaggcggacggcggcgcttccgcgcgaggcatgacggggggtaggggcgggcctccccgaccttcgatcccctcgcttcaacggcggcggcaccccgtccttttctaaggcttgcaaccacgtccagctcgacgtcctgtgcttcggggatggtggcgcttctgctcctcgtgcgggaggatgatgcaaaatcgtggatgaagttcgggaactcctggtcttgaccgacgccctctgctccggtccccgacacagcaaccagatcgtgggtgccatcctgccctaaggttacatgcactacctgtctctccttgatctgatctctcaaagtcccgatctatttcagcaaaactatcttctatctatttgatactcttttttggtaaa

SEQ ID NO: 68604 - DNA, 615 bp, Triticum aestivum
  Clone ID: PAT_TA_68604
cttgctggtatgaacgtagctgcggggccaaaattagctgctgcagtaacaaacgctggaggtctaggagttcttggtggcattggctacacaccagaaatgcttcgtgaacagatagatgagttaaagtccttcctaaccgacaaaaacgcaccatttggtgtagacctcttaattcctcaagttggtggaagcgctcgaaagacaaattacgattataccaagggcaaactcgacgagttaatttcaatcattattgaaagtggcagcaaactctttgtttcagcagttggcgttccccctaagcgcgttgtcgatagactccacagtgcaggagtactctatatgaatatgatcggacatcccaagcatgttagaaaatgtcttgacttaggtgtcgatattatctgcgctcagggtggcgaaggtggtggacatactggagatgtccctacaacagtcttgataccagcagttgttgcaatgtgcaagggaaaaacaagtcctatgactggtaaacctgtgcaggttgttgcagccggtggtatttacaacggtcagacagttgctgcagccctgatgatgggtgccaatgccgtctgggtcggaactcgc

SEQ ID NO: 68605 - DNA, 107 bp, Triticum aestivum
  unsure (1)..(107): unsure at all n locations
  Clone ID: PAT_TA_68605
atgatcatacagacgcgcttgggctgantgatcanggcgtggtgttctgcanatcaattntncatgaatttgctgntaagacaaaagctgaacagnccacttactcc

SEQ ID NO: 68606 - DNA, 594 bp, Triticum aestivum
  Clone ID: PAT_TA_68606
ggccccgccgcgtgctgccgccatctagcggaagcgcaggccgacacacggacgcacacctcttctctccccccttccccttcccctgccattgccgagctcggatacgctgcgaggtcgcggcgtcgacaggggtggccgggaggaatgtctgaaccggccacgcaatgcaggggaaatgggggcggcggcgagggcggcgccggcggtatgaggacggtggagtgcctcagagggaggctgctcgccgagagggtggcgtccaaggcggccaaggaggaagccgaccagctcgccgccaggttggacgagcttgagaagcggctctccgacgaggtcaagatcagggacagggcggagcggaggctgaggagggccatcaagaggctcgagtccctcaagattctggatgtggggagctccatcggctcgctctcctccaactccaacgcctgctccggccaacaggcggcgccggagacagaggagagcaacggtcctgcagtatcgctgagcaccgtcgattcggtgctgtcagaccctcgcgccggcggcgaggacaagggatgggacggcgagagcgtcaagggctcc

SEQ ID NO: 68607 - DNA, 253 bp, Triticum aestivum
  unsure (1)..(253): unsure at all n locations
  Clone ID: PAT_TA_68607
gcccggcctcatcgagtccggnaagctcgccttcggngccaccaccaccagcaaggccgaccgctacaacancgtcagcctcgccgacgccaagccctacgccaacgccaacgccaacgccaacggacatgtacggtgccaagcccaacaacaccaacatgaacaacggcttngggctcaacaatgatggntgccggcggcgggggctacggcaacttcaacagcggcnacgagggggtgaagagctacttca

SEQ ID NO: 68608 - DNA, 631 bp, Triticum aestivum
  unsure (1)..(631): unsure at all n locations
  Clone ID: PAT_TA_68608
ggnctgcaggnaattcggnacgagggcttcgtcggtggggtcgtcggtgtgagggtctgattggttgcgcctctggaaagcccattgtcccccaatccccacagccgcccgcccgcaccccttcctcctcccttgtctcagccgccacccccacgaactctagccgcgccctcctgcatcctcccctccctggtccgccccaagctcctcctccgtcctcacatgctccaccctgagcacgccggcggcgaagcgcaccgcgaggccccgaagcaactcagccagagcccctccgtacaggaggaaccccgcggccagcgcagccaacaacagtggcgcgtacaagagctcgaccttgatgggccgcgtgccttacgcgagggtcacgtccacgctgaagggcagcaacgagcatatggtgcggtacgaggaggtgcgcagggagaaggtgcacggtccgcctagcaccatgtgtgcggcggcggggacaggcaatcacgggcagattttggggagcggcacaagcatcaagcaatggctgattccaaggcatgtcaagatcaaggatatttaaacttgtttcttctattgatggaagatttcagatacttctgtagatgaatttctggct

SEQ ID NO: 68609 - DNA, 637 bp, Triticum aestivum
  Clone ID: PAT_TA_68609
gctccgacgtcgccatggcccgtctcttcctccgaccgatctgatcctcgccgggctccgaatccacaatttcatcatcggcggaatgtggtgatgggccgccgccacgcccacgtccttgtctgcgtcgccacgaggatctgaataggaggagggaatggacgaggagaacagtctcctgcattttcttgatgatacacccagttctcattacaggaggacatgcggtggatattcatcccaaaacgacggcgatgatcactccgatacatcagacgcagatccatccaatgcaagggacagattggaaactctacttaaccaacctgccaacaagttctgtgcagattgtggcacgccagatccaaaatgggcggctttgcctttcggtgcgttcatttgcatcaagtgctctggaactcacagaagtcttggagtacacatatcaaaggtgatttcagtgaatctagacgaatggacagatgaggaagtcaattgtttagctaattcaggtggaaatgctactgtgaacaccaaatatgaagcgtttttacccgaaaactacaaaaagccaagacaagattttgcgacagaggaccgtgctgttttcattaggaaaaaatacgagcttcaacag

SEQ ID NO: 68610 - DNA, 697 bp, Triticum aestivum
  Clone ID: PAT_TA_68610
ggccgaggtgacttcgcgcgcggagatcacatgcgcatcggagatgaaggggaggacgcttttcaagagccctctccccagcaaccacgtctccgacgcctccagctcggccggcgccggcgccacccaccgcctgtaccaagtttggaggggaaggaataaatttctttgtggcgggcggtgcatctttggccctgacgccaactccatctatctatctgtgtctctcatcatgacgccgctcgcgctcttcgtggccttcgtctcgttccgcctcgccgagctcatggggaagccgctcggccccttcattccaaggacagccatggccgtgggcgcattcgatcttatagtgttggtgctcacgtcagggcgagatcctgggatcgtcccgcggaacacgaagccgccggatcccgaagacctccagctagacggcatggcgtccccaatggccggagcgccatcgtcggggacacttccgccgacgcgtgacgtgtacgtgaacggcatggtggtgaaggtgaagtactgccacacgtgcatgctgtacaggccgccgcgctgctctcactgctctgtctgcaacaattgcgtggagcgcttcgaccaccactgcccctgggtcggccagtgcatcggcaagagaaattacaggttcttcttcatgttcatctcgtcgacgacgtttctttgc

SEQ ID NO: 68611 - DNA, 360 bp, Triticum aestivum
  Clone ID: PAT_TA_68611
tccggacattgcgcaggttgttcaaggttgatgcagcagattatatgttatccctttgtggcgaccaggctctccgggagctatcatcccctggtaagagtggaagcttcttttatctcacgagcaatgatcagtacatgataaagacgatgaagaaagctgaagtaaagatatttctgaagatgcttcgagcttactacaatcatgtccggtcattcgaaaacactctagtcaccaagttttttggtctgcattgtgttaagttagccggagctaaccaaaagaaggttcgttttgtcataatgggaaatctgttctgttctgatcactttattcataggagatttgatttgaaaggct

SEQ ID NO: 68612 - DNA, 559 bp, Triticum aestivum
  unsure (1)..(559): unsure at all n locations
  Clone ID: PAT_TA_68612
ggnctgcaggnaattcggcacgaggnctcctttccctttgtctggagatacaattttgtcaatttccgacgttactttgttgtagtgcctctcacaatagagctgcaacatgcaagtcctagttattttatgcaaatatacagttgaatcatttgggaatagaaaggttcatggaatatccagtgcatcccttgagttcagaatatgttttcacttttgttagtacttccgtgttgtgctccatatccttcttttacctttggagtttagattatttagccagtgtcctttaagatcttgagtgatatattttgagtttctgcagactttacctttggttgcaattagatatatttcctaacttccactatggaaggtgttgcatgttctcttcttttttcagagagaacacgcaagacgcataaactcacacacaccacgccccatgacgctcacacatcttcactggcttcacttaacgtgggcacatgcttttctactaatgcgtaacatgcacctgcatgcgtagggatcagtcaaccagatatatatggtcaca

SEQ ID NO: 68613 - DNA, 441 bp, Triticum aestivum
  Clone ID: PAT_TA_68613
ggcggcattgcggggagctccgccgggctctgagcgggggccgcacgcacgcagggtgtttgctgaaaagcgcggcgcgggcgagccatgagggacttcccgtcctgcttcggggagagcggcgtccagatcgcggacgcggcctcctcctccagcagcgccggcaagggcgcggcgcagaacctggtcacctgcctctaccagacgcagctcgccggccggccctgcgtcgtctccgtcacctggagcaagagcctcatggggcagggcctcagcgtcgccgtcgacgccctctccggccagagcctctgcaaggcggacatcaagccctggctcttctccaagaagaagggctccaagaccctcgacgccgacggcgccaaggtcgacatcttctgggacctctccgccgccaggttcggcgccgggccggagccgctg

SEQ ID NO: 68614 - DNA, 762 bp, Triticum aestivum
  unsure (1)..(762): unsure at all n locations
  Clone ID: PAT_TA_68614
gctccgacgaacggaaccaacaaatcccccagccgatctcgtctccggtcgactccagctccccctcctccggtcctcccccaccgccccaagatgcagatctttgtgaagacattgacaggcaagaccatcacccttgaggtggagtcgtctgacaccattgacaacgtcaaggcaaaaatccaggacaaggagggcatccccccggaccagcagcgcctcatcttcgctggcaagcagctggaggacggcaggacccttgctgactacaacatccagaaggagtccaccctccaccttgtcctccgccttcggggaggcatgcagatctttgtnaagaccctcactggcaagacaattacacttgaggtggagtcgtctgacaccatcgacaatgtcaaggcgaagatccaggacaaggagggcatncccccggaccagcagcgcctcatctttgctggcaagcagcttgaggacggcnggacccttgctgactacaacatccagaaggagtccaccctccaccttgtnctncggcttcgggggaggcatgcagatctttgnnaagacccttactggcaagaccatcacccttgnaggggagnnctttgggacacccatcgacaacgttcaagggcgaaagatccaggacaaggaagggcnttccccccggaccancannggcctnatctttgctggcaagcaagttngaggacggcncggacccttgctgactacaacattccagaaggaggtcnccct

SEQ ID NO: 68615 - DNA, 613 bp, Triticum aestivum
  unsure (1)..(613): unsure at all n locations
  Clone ID: PAT_TA_68615
gggcaanatacacagtagtaagagtaggggacagcagtcaaagagcgagcgagcgaggcggaagaaatccctcgagatggacgcaagaccgcgacgggcgtcgtcctccccggcggcggcgacggcggcggcggccttgtccctgctgctcctgttccccatgttcctaggcggcatgacggcgctgcagaagcacgcggccttcttcgaccgcgacaaggacggcgtcgtcaccttctccgagacgtacgcagcgtttcgggccctcggatttggatttgcttcgtccaccttgagtgccaccttcatcaatggcgtccttggcccccagaccagaccggaaaatgacacggcgcgcatgtccatctacatcgagaacatccacaagggcatccacgggagcgactcaggcgcgtatgactcccaaggaaggttcgttccggacaagttcgatgcggccttcgccaagcacggcaagacggtgccggacgccctgacgtccgcggaggtggacgagctgatcgccgcgaaccggcagcccagcgactacgcgggatgggcgggcgcatcggcggagtggaagctgctgtacagcatcggcaaggacgaggac

SEQ ID NO: 68616 - DNA, 502 bp, Triticum aestivum
  Clone ID: PAT_TA_68616
acaccaggccaagacgttgagcgtgatccacacttggggtggctataccatccgtgtcctctcgccgctcgccaccgtcacggcactctgtctcttccacggtgaaaaaggcttggccctggtgaatgcagaccggatgaccacatacatcttgctggttggtttggtaccctggtgctggatgggagatggctgctgagagcgttagggtctacctggacatatgcattgttggttgataaacaacaagaccaagaagaagaaggcaaacaagtaaggccgcttctaggtcgccggaccttctggtacaatttcaatttgccacggtgggtgaagcacgcatgtcgccgggctgggaggcaattatggtatttcccacgttgccttctcgtctctttggatccgtcccggctgtcactgagaagcggcccaagtggccacaggttgctgtcgggctcgagcgtcggacagcgcaacttgttgcacgagtgcagtactcctc

SEQ ID NO: 68617 - DNA, 464 bp, Triticum aestivum
  Clone ID: PAT_TA_68617
gtccgcctccaagtcgtattacttccgtaaagaaaaagtgataaaaagtccaacttccctaaattcctcctcaacacctcaaatcgccgcccgtcgtctcgccggcgctccccgccgccggcacagtttctcctcttcctagccacggccagtgatccttcatgcgccggttgagtctcgatgactcgccggtacgctcgggctcggttgaggcctcctgttggacagatgatcacgacaccgagccacatcggcacggccggctcccggtcgctcctccttctgcctgcgttgtcgccgtcgattctacggccatctgtcttcctcttctcagttatacgatccggacggtgaagcagagtcaaatttagaggcgtccaaacatctttattctactagtacttattatgcaacagtttatctctctgaccgctagctagtagctacctctctaacaagatctg

SEQ ID NO: 68618 - DNA, 291 bp, Triticum aestivum
  unsure (1)..(291): unsure at all n locations
  Clone ID: PAT_TA_68618
cacccgcgcacccccctacccgtctctctccgttagccagcccctccacccgaggcgcacgcctccgccgccgccagccaaggggattcagtcgactgaatccccatgccccctgctacgtccgcccccgatgctccggtggccgagggggacgcggaggcgccgccggtgccgacttaccggtcactggcagcgccggtcagcaatccggtcgacaagttcgcgctcctccctgccttcctcaaggttagaggccttgngaangagcacattgactcttttaactacttc

SEQ ID NO: 68619 - DNA, 524 bp, Triticum aestivum
  Clone ID: PAT_TA_68619
aggaattcggcacgaggtgagcttgagggcgcgcgcagatatggcggagggcgcccctgacgatgagacgctcgagctcacgcccacatggatccttgcgatcgtctgtgccctgatggtggtcatctccatggccgcggaacgcggcctgcactaccttggcaagaagttgaagcgcaataaccagaaacagctgtacgaggccgtcctcaaggtcaaagaagagctgatgcttctcggcttcatctccctgctgctgacggtgtgtcaagggatgatcgaggagatctgcattcctcctgactggagaatgcatatgctgccatgcaaaagacaggaggtggcgcccgcaaaggagcatttagttgcaacccagatcattggcagaatcgggaggcggctactcagcaaggatgcaacgggagccgagacctgcaggcagaagggaaaaattcatctgatgtcccttgaatctgtgcatcagttgcatgagttcatatttgtgctggctattacacatgtcg

SEQ ID NO: 68620 - DNA, 545 bp, Triticum aestivum
  unsure (1)..(545): unsure at all n locations
  Clone ID: PAT_TA_68620
ggtntatgcttgtctcaaagattaagcctgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcaaattcattcattcatgcttctttctccttctttacccccatacatatactatattacacaggcagcgatcagttggtatacttgcttgtactctacattaattctattctacagacaaacgtactacttgcc

SEQ ID NO: 68621 - DNA, 879 bp, Triticum aestivum
  unsure (1)..(879): unsure at all n locations
  Clone ID: PAT_TA_68621
gcaatctcgtctccgatcgactcgagagctcgtcgaatcctcctcccccatcgtctcaagatgcagatcttcgtgaagaccctcactggcaagaccatcactctggaggttgagagctctgacaccattgacaatgttaaggctaagatccaggacaaggagggcattcccccggaccagcagcgcctgatctttgctggcaagcagctggaggacggccgcaccctggccgactacaacatccagaaagagtccacccttcacctggtgctccgcctccgtggtggtatgcagatttttgtgaagaccctcaccggcaagaccatcactctggaggttgagagctctgacaccattgacaatgttaaggctaagatccaggacaaggagggcattcccccggaccagcagcgcctgatctttgctggcaagcagctggaggacggncgcaccctggccgactacaacatccagaaagagtccacccttcacctggtgctccgcctccgtggtggnatgcagatttttgtgaagaccctcaccggcaagaccatcactctggaagttgagagctccgacaccattgacaatgttaaggncaatnatccangacaaggagggcatntcccccggaccagcagngcctgatctttgctggcaagcagctggtaggacggncgnaccctggcccgactacancatccanaaggagnccnccccttcacctggtgctccgcctncgnggggggnatgcacnatttttnntgaanaaccctcaccgggctagnacntcacccttngggttngnnnanttcgnaaancnatnnanaangnncaaggggcnntatcnaggacanggaggggctttnccccgnnnca

SEQ ID NO: 68622 - DNA, 525 bp, Triticum aestivum
  Clone ID: PAT_TA_68622
aggaattcggcacgaggccgcatcgccacattttccccttcgtagtatctccatcgccaccgccgccgccgccgccgccgccggcatgctccgcctgcgagaatccatcgtttcccatctcctctcttcaccctccgcccctgccacatccccactccgccgcctcctctccgctgccgcggccgccatttctccgaaccccgctggattcgccgtcgaggagtacctcatcgacacctgcggcctcacccggccccaggcgctcaaggcctccaccaagctctcccacctcaagtcccctgccaaccccaacgccgtcctcgccttcctctccggcctcggcctctccggcgccgatgccgccgccgtcgtcgccaaagacccgcttttcctctgcgccggcgtggagagaaccctggtccccgtcgtcgacgggctcgccggcctccgcctgtcgcgccctgacatcgcccgcctcctctcgctcgtccgcagcaacttccgctgcagatccatcatctccaa

SEQ ID NO: 68623 - DNA, 184 bp, Triticum aestivum
  Clone ID: PAT_TA_68623
acagtggtggtgaggagccagcggcggcgccggatggacctggggaagcgggtggagatgcgggatctggccgccggcaaggaggacgaacaccgggacggggagcgcgcgttcgaggaggcgctgctgcgggagcacgccgtgtcgacggacatgggcagcctggactggaggtggatgaaga

SEQ ID NO: 68624 - DNA, 599 bp, Triticum aestivum
  Clone ID: PAT_TA_68624
aggaattcggcacgagggcccctgactaaccgcgccgcccgcctgttatcctcaaagcgcaccctcccccgtttctctctcctctcctctcctctgttccccctcgggggcctcctcaacaagatgctccgctcatgctggaatctgcaccgtgtttccagatctgctcatgaatccttcttgatggccagaaacattgcagcacatagccaaacgaatcggcccagccacctcccttgggcttggggcaatgctttttcctattgcacctccagtaataccctcggtgagcaatttgcctttatcaaagggaaagatggagcagaaattatgaaggaacccaagctggtcaatgtgaggtcggccgacatctatcctaatagcagccatcgcgatgggtctatatacaaaaactctattctccaaagcataggtcatgttacaaagcgtgatgagaggttctctcattgagatgactggccctaagaggggcattaatatgctcggtgatgttctagttgagtttgacatgaggatcaagacaggagggcaaaaagaagatgatgatctgcaacttatcgacggtgtagtagagtaca

SEQ ID NO: 68625 - DNA, 472 bp, Triticum aestivum
  Clone ID: PAT_TA_68625
gcatctaacaaagattggtgcgagactcgtctcaaatctcccgaactctcctccaaatcgcccccaaatccagtccgatgtgtaccctcgtcgccgccgcccccaaacgcgatgtgcccttgccgccgccgccgccgcccccgcccccaaccaccgcacccagcctcctctatctgactatgtcctcacccccaagcagcggaccgtccgtcccctctcgcccgtgttcgccgcctcctcctcacacgcgtcgccgcagcccttatcttctcaccggcggcgcctgtttctttcgccccacgccgcctctcggtcaagttaaagatgttttttttgtgaagaggaggtgtggcagcggcaaggagcaacaaaatgagctatgcagccggatgattctgaagttgctggatctgaagcgggaggacgtcgccatgtagctcgagcgggaggagcgtgggcacgcggcggcctt

SEQ ID NO: 68626 - DNA, 204 bp, Triticum aestivum
  Clone ID: PAT_TA_68626
tgcgggagcggggcttcggccggcgcgcggcggccgcgctccgctacttcttcccgttcctcgagtgggcgccggcatacaggctcggcaccttcaagtcggacctcatcgccggcatcaccattgccagcctcgccatcccgcagggcatcagctacgccaagctcgccaacctgccgcccatcctcggcctctactcgagct

SEQ ID NO: 68627 - DNA, 634 bp, Triticum aestivum
  Clone ID: PAT_TA_68627
gcctttcggagcggaagcgggaccaataaaaacccttgcctccgccgaaccacggtgcggcggtcccgggatggcggcgccggcagaacccggtgaaatcgagggctacctcggcctccgcgacgtgcgggtcaagctggacctgggtaaggcccgaggcaggggagaagaaggcgcgggcgcgggcgcgggcggaggattcgccgtctgcttctggctctacctctccggctccgcgaggccttccccggttatccttcaccagataactgcaggagatggcaataagttgccatttcttgctttaagtgaaggaaataagctgcttctcttcccattgctgaggttgcacaagcaagctcctagttcctctaattcctctccatggactgacacgacgtatatatcggctgtaaatgaatgccctcttgagcactggatacacattggatgcgaggttactgaaaatgttatgcgccttcacattgatggcgatctagttgccgaggctcatctttgttcactatctagccagccagacaatcaagatgatgcataccaagtttgcttacttggaaacaatagcaaggtcgatggctatgtctacaatgtccaagtgctatctatgctaggg

SEQ ID NO: 68628 - DNA, 253 bp, Triticum aestivum
  Clone ID: PAT_TA_68628
gcggaggtgtgtacacgattggaggctacaacgagggatacttttatccaacatgggtggcagcatgatcttaggattggcccccctctgctttaggcgttatacagattctacatgtttctttgcatttccttttttttttgtgtgtgtgtatgagaagaccttgtttggctgcgtgcatctcagttatgcagaggccgggtgcagtacttaaatcttccaagtaataaagctctccttttcaaaaaaaaaa

SEQ ID NO: 68629 - DNA, 627 bp, Triticum aestivum
  Clone ID: PAT_TA_68629
gcagcaccaatggctgctctaggaaggatcgccggccccgtgccgttcaaggacgtcgtccagaaagaggaggatgaacacccgccggaagagtacgcggacatcatctccaccttgccgggcatcaccaccggctttgggcagttgctgtgctaccagggtgtctggctgcgcccgtggatggtccctggggtgatctctgtccagcagcgtctcgtgccgcgccccgacgacgtgctcctagcgagcccgcccaagtgcggcaccacctggctcaaggctctgtccttggccaccatggcacgggccacctacgcgccgaccagcgccgatcacccactcttccgcctcaacccgcacgactgcgtcccccaccttgaggccctcttcggtgccgtccaggaagccaagctggaggcgctgccgtcccgtaggctgatgcacacgcacatgcaccactccctgctgccaccctccttgccgactgcaaaatcgtctacatatgcaggtagctagcacgtacaacttttgcttgtaaaatagtactccctccgtccagaaatacttgttgaagaaatgcgtaaaaatagatgtatctagaactaaaatacatctagatacatccat

SEQ ID NO: 68630 - DNA, 104 bp, Triticum aestivum
  unsure (1)..(104): unsure at all n locations
  Clone ID: PAT_TA_68630
ctttacccccatacatatactatattacacaggcagcgatcagntggtatacttgcttgtactctacattaattctattctacagacaaacgtactacttgccc

SEQ ID NO: 68631 - DNA, 607 bp, Triticum aestivum
  Clone ID: PAT_TA_68631
ggtcgagttctgatctcatgctgagttgcgaaggatttcaaaagcatggctatgagttcccaacgacacatgtcagccatcggttgctttacaccactggtgctgaaagttgcctcagtgataatggcaacgccactgctgctaaggacagccttagcaacaatctcgacctaaaaaatgatgacagtcttggaaacatcccttgttacgatgattttctccctcttgaggatgattccggtgatacgcttacacatgatgatgcgataggaattatccaaagggttagtcctatggaatatatcaaaaggctactattgaagagatctgcgttgagtatctcttctgctgagttaggtgtcaatacgaagttaagtatgattccagaatcttcaagagattttaggcatagtggtgatctttgttggcacgagtattatcacatgagtgaagtatctcagactgttttgccaccaaagcgatatactcagtgcgaaccattgactgcggtgcggtgctttcacgagccacaggctatgctccaggttttttctatcaagctgaaggcatatctccaagctataggcagttcagtcgatgtatatgg

SEQ ID NO: 68632 - DNA, 673 bp, Triticum aestivum
  Clone ID: PAT_TA_68632
cgaggagaaaacgaggcataggcttcatgctctccatctcctggtaaaggggagttaagctctacggccacttggatgtggatgctcacgctcctccactgggcgagctcccagggcaccacgaggattgatattgtcatctctatccctcggccatgaggaccaagaggttgcctgtaccctgctgagtgaaatgccacctccgaccagcacctggcctgatgtcggagatgttccctcagtcctctctcgacaaatccaatagtacaggttctccggcgcgccaagtattgccggcggcgatgcctgcatcatggcccattgaggagatcatgcccgtcagttgtacttggtggtgtagacttggtagcggttatattttggttcgattatatatcaacaacagtgcaatgactgaaagatcatcagtccaaaatatatatgcaggcaccaaattctgctactgctccgaccactcatgccaagaaaagggagcacaattcgcaaggttcagagcaatctgtcatagttgattcagtgtctaggtccagtggaatccccaagcacaccacctgtttgtgcaaatacctatgagaggataccatacagtggagatgaaaagtttggggattttatattatatggcatttggggattttgcagcagtttccca

SEQ ID NO: 68633 - DNA, 686 bp, Triticum aestivum
  Clone ID: PAT_TA_68633
gcgcatgcgaagcatttcctaggcattgttatcttgttgcttgcatgcaccatcgtccacaacgcgacagagctgagtcttcccatgccgctcctgcgctggtttcacgatttcccatacacccaccacctcctcctgatgggtcttcttcccgccaccgtggccgccatattcctgaccatgaagttgcgtccctgtaccgcatacctcatcgactatgcttgctttaagggtagtaccaactgccgcgtcccgatttccaccttcatcgagcatatgcacctgacaccgttcttggacggtcgcagcatcaagttcatgacgcgtttgctggaacgcagtggcatcggcaacgagtcgaacctgccccccactatccactacatccccgtgtaccgaagcttgatggaagcccgtgctgaagcagagctggtcgtcttctctgccattgacgacctgttcgcgaagactggcgccgcccctgacgccgtgagcatactcgtcgtcaactgcagcgtattcgccccagtgccgtccatcagcgacatgatcgtgagcagatacaagctccaccatgacatccgctgcctaaacctatcaggcatggggtgtagcgcgggtgtgacggcggtgggcctcgcgaccaggctactgcaggcgacgcggcggcaacatggtgcgcagtt

SEQ ID NO: 68634 - DNA, 474 bp, Triticum aestivum
  unsure (1)..(474): unsure at all n locations
  Clone ID: PAT_TA_68634
attcggcacgagggagatntgtcccctggtccttgtgcataatgagttgatcacaagttgaaatggaccctcctccagttgccgatcctggacaaaccaaggataaaggtgttggatctaagggtgaaatggatctcccagttgccgatcctggaccggtgagggatgaaggtgagcttctccagtgcccgttttgcaattctgaagcagtgtacaaactagcacaattcttgctccctggtttggctgcggtctgtgtcgacggtacaactggtgatctgttcaggagcccatctgatgttgctgttgacctcagaaaagaaatggtggacagcattacacaaagaagtgaaacgttcatagcccgatgttgaggcggaacaaaacgctgacaatgaaatgtcggatgacccttatgagatcgtgtcaatattcatggatgatttcagtcgcacgaaaaggaatatcattggc

SEQ ID NO: 68635 - DNA, 316 bp, Triticum aestivum
  unsure (1)..(316): unsure at all n locations
  Clone ID: PAT_TA_68635
cggcacgaggnctcctccacccggcctcgctccctccgctcctcctcgcagcgctcctcctcctcctcttccggtcagccctctttgctggcacgcttcgcctctcctccttcgcggaccgcgatcccgccctccgctccctccttctccgcctctcgcctcccgcccagccctccccaccggctccgcagcaccacctcccccgccgccggtcccccttcacttccacctcgtcctccctctccgacgacgacttcctcgtcggacccttcgacccggtctcgtccgccccctccagccgacgcaacgcctncta

SEQ ID NO: 68636 - DNA, 531 bp, Triticum aestivum
  Clone ID: PAT_TA_68636
gcaaggttcagcatcccaacattgttaccttgagggcctactactggtcgtttgatgagaagttgctgatatatgattacatttcaaatggcagcctctcttcagcaattcatggtaaacctgggacaatgacattcacaccattgacatggaatgcacgtctaaagatcatgaaaggagtcgcaaatgggatgtcttttttgcatgaattcagtcccaagaagtatgtacatggggacttgaggccgaacaatgtccttcttggaaaggacatggaaccgtatatttcagatttcggcctcgggcgactagcaaacattgctggtggagcagcaccttcttcgcaatcggatcggattggcgtcgaaaaggctcagagtctgcagccagattcctcaatgagccctcttgtgagcaaagaaggttcatgctaccaagcaccagaagcactgaaaacattgaaaccgtcgcagaaatgggatgtctactcctatggtgtgatcttgctcgaaatgattactggtagatcgc

SEQ ID NO: 68637 - DNA, 456 bp, Triticum aestivum
  unsure (1)..(456): unsure at all n locations
  Clone ID: PAT_TA_68637
gggtggggatgagcggcgcctatggcggccncagcaatggtggcgagagccgggcgcccaacgaggcagtggtagtcagggcgcccaaggaggccgtggtagtgggggcgccgccgtcggagatggagatggcgggggcgatgggggtggtgcacaaggtggcggcgcagccggcgcagagcacggcgagcaagatgaagggcaaggtgaaggagaccttcttccccgacgacccgttccggagcttcaaggggcagccgctgcgggcgcagtgggtgctggcggccaggtacctgttcccggtgctggagtggttgcccggctactcgctgtccctcttcaagtccgacctcgtcgccggcctcaccattgccagcctcgccatcccccagggcatcagctacgccaagcttgcgaacctgccgccgatcataggcctgtattcgagcttcgtgc

SEQ ID NO: 68638 - DNA, 578 bp, Triticum aestivum
  unsure (1)..(578): unsure at all n locations
  Clone ID: PAT_TA_68638
tcggcacgnggtctcgctcggcccaccaccattgacacagcacagnanatcatgaagagatcccctcctcctcctcctcctcagccatctccttcttcttcgccggcatgctcgctgtcgccgtcgccgtcgtctccttcctcctccgactcgtcctcgatcgccattccccgcaagcgggcgcggacgcagaaggccgggagcgccaaggccaaggcggcgcccaagcgggccaagaaagacgcgagcaggagcagcaaggagtctgacgcctccgccaatggcgccgccgcggcagggaagaggagctccatctacagaggggtcacaaggcacaggtggacgggcagattcgaggcacacctctgggacaagaactgcttcacttccatccagaacaagaagaaagggaggcaagtctatctgggggcttatgatacagaggaggcagctgctcgtgcttacgatcttgcagctctcaaatattggggccctgaaaccacactgaatttcactgtggatgagtacgcgaaagagaggtcggagatggagggggtgtcacgggaggagtacctcgc

SEQ ID NO: 68639 - DNA, 567 bp, Triticum aestivum
  Clone ID: PAT_TA_68639
agctatggcgacgacggaggcgggaggcaatggattcgagtatctatcagatccgattgacaggtatgtttgctggcgcaaattaggagtgctctgttgttttggcaggttcccgttgccggatctcgtaggcggcgactgcccaccggacggcgaccccgtccaaactctggccttcgcggccgccgattcgagcattggtgatgtgggcgatgcggcactgacagttcaactaggcctgaacagcacctgcgatggcctgagcttgtcagcgccagacttggaacagtcaactggcaaagacgatccgcatgcgccgggctggacaaagagtttaacaagagcatcccacggattgattggttggaaggagaactgcaacaagatatgctgctgaaaaatcaatatggagttcgagtcagatcagtgcagggcgatgaaggtagcaatagaaaaagtgatgccaagcagcacgcactggtggtgcaagtgtcacgtgcttaagaaagcaaaagaatatcttggtccgtattacacaaagacgagcaaattcagatcagatttcca

SEQ ID NO: 68640 - DNA, 681 bp, Triticum aestivum
  unsure (1)..(681): unsure at all n locations
  Clone ID: PAT_TA_68640
ttacatncgatgaactggacgagnagtacatatatgctagtacctacgtacaaaggagatgggatccctggtctgtagctactaatcaactactccgcgtgtctcattaatccacctagctttgagaccaggcctaccgaaggcagcgggcaaggtcaacggccgctctcctcctgctgctgctgtgggcgctgggcgagccggcggggacttgggcgtcgtcggcgtcggagtcctccccgtgtcaggattgggtaatttgcgcgcctgctgccttccttggatgtggtagccgtttctcaggctccctctccggaatcgaaccctaattctccgtcacccgtcaccaccatggtaggcccctatcctaccatcgaaagttgatagggcagaaatttgaatgatgcgtcgccggcacgaaggccgtgcgatccgtcgagttatcatgaatcatcggatcagcgagcagagccccgcgtcagccttttatctaataaatgcgcccctcccagaagtcggggtttgttgcacgtattagctctagaattactacggttatccgagtagcacgtaccatcaaacaaactataactgatttaatgagccatttcgcagtttcacagttcaaaattggttcatacttgcacatgcatggcttaatctttgagacaagcatatggc

SEQ ID NO: 68641 - DNA, 666 bp, Triticum aestivum
  unsure (1)..(666): unsure at all n locations
  Clone ID: PAT_TA_68641
gttgataattattagtnagaggaagcaagcggcttcccctttgattccgattacatcaggggcgcaggatacagagtgaaacagcttctacatctaaccacactggaaccatcagcacaccgcactactacgatctaggccttggtggccttcttgggggacttggtggccttcttgggcgacttggcggcggtcttctcggccttctcagcggtcttcttggggagcagcaccgcctacgtgccctttacgcccagtcattccgaagaacacttgccccccccgtcttaccgcggctgctggcacggagttagccggggcttcttcctcgagtcctgtcatgatcgcgcactcgacgaaagagctttacaagcggcattgcccttcttcactcacgcgatattgctggatcgggctttcgcccattgtccaagattccccactgctgccccccgtgggagtccgggccgtgtctcagtcccagtgtggctgatcatccgaaaagaccagctaagcatcattggcttggtcagcctttacctgaccaactacctaatactacgcaggctcatcaaacagcgcttttgagctttcttcaggatttggcccgaactgttcggcagattcccacgcgttacgcacccgttcgccactttgttctcaact

SEQ ID NO: 68642 - DNA, 613 bp, Triticum aestivum
  unsure (1)..(613): unsure at all n locations
  Clone ID: PAT_TA_68642
atatatataatgcggcgatncgaacaagtacagagtactgatagcgaatgcataaatacattacacacgtggaaatttagcaacagaacatagtagtagtgttaccagtgtatcttggttgcttgtaacgagtgcatatcttgcttgcgttgcgtgtaacgaggtgcatgtctttgtggtctactagtaagacgataaagtcggcgacgcaggtttctgactctgccccatggcagcagcacaggcacccacaaaggcggcgttgatgtaggtcgccggctcggagtgcgcggagtcccccctgttgtccccgaactggtcgttctcgtcaggccctccgacgatggcgccgacatggacgttcgggttggggtcgctcgtcggcagccacgaggagaagccctcgttgcaggggaccctcctgctgaggacctcgatggaggggatggacgccgcgcggtggtggatgcgccgcgggaacgcgccgccgaagcccaccatgtacgacatgcccatcgggttgctccccaggatgtagtcgacctgtgatgcggcgaacgaggcgatctggtccggggagaagcttgcggcgctgcagtggactccgtcggag

SEQ ID NO: 68643 - DNA, 671 bp, Triticum aestivum
  Clone ID: PAT_TA_68643
gttgacactgtattaacaaatgttatacgtgtattacaagaatgttcattggagtgatcccaattggagtcggtaaatgtagccaagaagacagttttggcctggcttcaccaaggttctgcatactcctctccttgatgttgcagataccaagatctttctgtaacatcgggttgtacaaggaagcctcgtttgtgaggtaggcgcaatttggtttgaacactttaaagtcgtttgttggaacacatacagtagtgttgagaccgaggaagagcgcgtggtctccaatgtcccttagctccaccagcttctgcctctcaacgtcaaccttgaagacaatgacctcattcatgctgacctcgtcaacaagtcgatgaggcatgtcaacaccttcacagagcaactgcgatagtgcaatgtcgtggtctttgcagtcggcttcagaaagatctttgtcttcatcgttttcggcctcagtgggctcatcttggtcattggtgccgacttgagggagctcatcctcttcatcgtttgtctctagctcatcaattagcttgtcgttgttatcttcgccaatcaaatctgctccatcatggcatatatggttcacacttttttggtaagtcttgtgataccttgagtggagtatccatatgttccctgttcctcca

SEQ ID NO: 68644 - DNA, 662 bp, Triticum aestivum
  unsure (1)..(662): unsure at all n locations
  Clone ID: PAT_TA_68644
taaactttatatatgcngccacccgaagtttatgtataatctcgattttaacataatnatcacatccatgttataaagaaaacatataaaatgtacactgtatcatccagatacatttatttgacaggaaaagttgtacggcattctggaacttgaagttaagctgaagccgcagcaatctagaatatgatggttgaattatctttaagatttgtttcttcttgtgaccatgtctgatgcacatgcatccaagtgaatccatccgatgcaaccgcggcatcctttgaacttattataacagtggttatgcaacaattgcgttcctcaccagataactcccacttattgaacttcacaagccatgtgttcgaactgatttgtgtgggcaacacccgatcaatccaaacccgaaattgctttccctgtttgtctccatagatcgatctcattccatctacgccatcacaaagagaatgttcaaagccagttggttcgacatgaaccccagatggatcacaagctgctttcagacttgccagatatggctcaaaattctcaacttctgcacgcctccttctctcatagaacaagtaaaatttcactacttcatgtccagggtttacattttccagcttgcagtccaaaaagtccatgacatctct

SEQ ID NO: 68645 - DNA, 522 bp, Triticum aestivum
  unsure (1)..(522): unsure at all n locations
  Clone ID: PAT_TA_68645
gaacgccctttttactttncctttttgaatnggnatagcagcacatgtacatgcaattcttgatggaacttattgtatattggaatatcacatcggccccgggagcggtggcaggcccttgatgcctccctctaaccgtgcggctggcaaagctgcggcagtagctcgtcgtcgcggacggtgacgaccctccaggacacggtgttgatggaggcacgagggagatgttgagcttggtctacaggtcccttatggtagccctagtcctctcgatggcaaactgctccgcaccgttggggtcttggttcctcaacttccttgccttgtggctttgaaagagctggaatggctccggtgaaggtttacagacgccaacttgctcgtgaagatagataccctgcttccggttcttcttttctttgttgtcccattggctcgatagacatcaaagtggtgtcaactgattcagtctccgtctatctacaacgttattatatcgcctgcagtgattttgtagcattg

SEQ ID NO: 68646 - DNA, 491 bp, Triticum aestivum
  unsure (1)..(491): unsure at all n locations
  Clone ID: PAT_TA_68646
tagttggcgaagactaagtaaaagtacagaaggtaagattacaagcagtcaattgacctgacctaccatccacatccccttaactaccctacctacgctgggatcttcatcccatcccattgctctaacaaaagtgtgatgtgaaatgcagaatgatacatacatacagacagacatatatacatacatagcagaggtcaaggctgctcctcctttccttcatgtgtatgctgttgccatccatgaggtaccttgccatgatcatgattgatgtagctagcctagaaagctaggtgttagtcagaatcagagctggagctgctgtccggctttgccctccggccttggatcgcgggcttcagagcttgccgagggtcgcggaaggattgctgtgactgggacggctgcttgccccctttcgccggtgctgccgctgccgccggtttcttgttggcagcggctgctttggcggccaaagcanccgcgtcttt

SEQ ID NO: 68647 - DNA, 237 bp, Triticum aestivum
  unsure (1)..(237): unsure at all n locations
  Clone ID: PAT_TA_68647
ttcatattgtactgtgacgacagcganggtgggaagttggtatatatgtgtgcgcgtaggatgtgatgcttcaacctgcagatgctctcaagctgcaatgtcttgacatccagtgagaaacattccaagtctgacatctttaatgatgatgaacttgcggagncatcttctgatcttantagtancaagnacctctctgttgcacctctcaggaaataccggtanccggattccaat

SEQ ID NO: 68648 - DNA, 573 bp, Triticum aestivum
  unsure (1)..(573): unsure at all n locations
  Clone ID: PAT_TA_68648
cgcgcagctagcgagaggacctctcgctcgctcgatntggtacaaataaacacacaaagtacgtgcagctacacgttgatccacgacgtacaagtacacatgcatatctcgtccgatggacggacggacggacggacggctaaacacatttagcttccgggggcgaagttggtggcgaaggcccaggcggagtgtttcacgcgttagctgggcccctgatccgcgtagaccaagggcgaacactcatcgtttacggcatggactaccagggtatctaatcctgttcgctccccatgctttcgcaccccagcgtcggtagggacccagagagctgccttcgcttttggcgttccttcgtagatctacggatttcacccctacacacgaaattccactctcctctgtctcacctcaagtgaattggtttcgagagcattccgccactttttggcgactttcactttcaacccgattcaccgcctacgtgccctttacgcccagtcattccgaagaacacttgcccccccccgtcttaccgcggctgctggcacgggagttagccggggcttcttc

SEQ ID NO: 68649 - DNA, 528 bp, Triticum aestivum
  unsure (1)..(528): unsure at all n locations
  Clone ID: PAT_TA_68649
aaccctgccgtcttgtcactgcaatgcagatcacacagacacacacacacacacacatgcgcaaccacgggcactcacacagataacagaacccatcaaagccactctacttgccattggagagaccggccttgctgaggatggtggtctcggcgatcatggaggtgacgacgtagggatccatgttggatgccggcctccggtcctcgaagtagcccttgccttncttctcggtgtcgcggcccacccgcaccgacgcgccgcggttcgccacgccccatacgaaggtgttgatgtcggcggtctcgtggcggcgatgtgctccatgtgccgcgcctccagcttctggatcgccttcttgatcacctcgtacccaccctcgctcctcatngacttggtgctgtagtttgtgtgggcaccagcaccattccactctcccgggatcggtttggggtcgaaggagacgacgacaccggcaatctcagtgatcctctncangatgtagcgagccgcccagagctcgtcgcc

SEQ ID NO: 68650 - DNA, 187 bp, Triticum aestivum
  unsure (1)..(187): unsure at all n locations
  Clone ID: PAT_TA_68650
aagcagtccacactcgcntacgaaggtactagacatatacattgncccaagcaaaatagcatgaactttangtctctagattatgcaggcgccgttgtancaggccacaggcgacagatactatnggtaaagagagggtnngggggagtgactgaagtgcttagtcgancagactgaaacccatgtc

SEQ ID NO: 68651 - DNA, 667 bp, Triticum aestivum
  Clone ID: PAT_TA_68651
aggtcttgcagatttccaactgaaaggtcaactaaacgtcacctgctcatagcaacaccacaatttcagtgtattacaggatttaatcaaggactcgacaactgcgacacaacaaggaaatcaaatcacacccaaagaagcattatagtgcaaactcgatacgcagcggatttgttcagttagcaatctgaattttcaaatacgagccattctaaaatcagtctccaaagtctgctttgggcgggttggtgcaagtgttcttcccgtgacctcaacagctgcatctggagcatcgaggcgacttcctcgacgcctttggaagatctcctcgttgcggaaaagtggtgctcttgtgaccttaacctctgcagatagaacagaacctagacctcttttttggttgctcatatggtgctttgccgcgacttgtgctagggcgtccagctgcccttttctttgttggtgctgcaaaacaatcagaacattgcgaggcactctgtgctggattttggcctccacttttgtgttggatttttcccattgtccacatcagatttttcactcgatccacctcgttaacctgtacactgtatgtgaaatcaggatcttcacccctcatcgcgttgaacacctctatggtctttgttgcatcatttcctgattgctc

SEQ ID NO: 68652 - DNA, 594 bp, Triticum aestivum
  Clone ID: PAT_TA_68652
acgtcttcaagacaaacgctcaagtgacagcacaggatgtacactaaatcatacaaatacatttttttgtgttacatttttttgcggggaataagtttatccataaccggcatcaccaaggccacaaaggccactacatcatttttcagactactactactcgacactcacatctaggtcacagtcagctaccagcatccgggcggtctccctcacttcctcaggctctttagttgcttctggctcataatgttcctctggagccttgtctttcctttccctttggccttcacctttggtttcttcatcggcttagcttcttcaaacaacttttcatcaaggaaatcatcagcgctatctttgttgctatagtcatcatcatcctttggccacctctttctacctttctgcttctccttcatttttccttggtgcatttcccatatagtcttcgtctcaataccctttctctcaaggatacatctgctgaagtccttgagctccatgttgaatgttacctccatgtcttggtcatgtctttgttccacatcagatttatttcctttctagtaaaagagccaacctgtccttatt

SEQ ID NO: 68653 - DNA, 624 bp, Triticum aestivum
  Clone ID: PAT_TA_68653
tacttttttgctttgcggaatcgatgactgcttgagaattacaacacgacccacgcatatttaacatgggcgagtactaggcgccggcgcaccggccgaaactttcggccggtccgctctgcaccgtaggattagcatattgtcaaccgtttaaactttatcccctacccccaatacgcatcgtctttctccacaaaccaatgcacgaccctgtagaactcggcgcctagcttgccgtagcagcaccgactagacactcccatcgctaatcaccgcctcgccgtggccgctcgccgtctcgccagatgcagcggaggcccgtcaaaacaaatatgtccccaacggtttcactggccgttgggctctggaagctggttgcaacataataaattgctggttccagcaaacaaattctctggttccagcaataacatggatccggcaaaaaatcaaaagatgggatggtggcaaaaatcaaagacggtggcagcaaaaaacacagacgatggtagcaaaaaattgaaactgggtttcagcagcaaattatagacgggcggtagcaaaaatcgaaaaggccagtggtagcaaaaatcatagacggtggtagcaaaaattagagatagt

SEQ ID NO: 68654 - DNA, 164 bp, Triticum aestivum
  unsure (1)..(164): unsure at all n locations
  Clone ID: PAT_TA_68654
acacgngtgnangaggnacacgttctagcncatattgcacgacaggtatngaacaaagnaaaancagcacgagcggcagcggaaaagaacatctcttgaaaaancnccacacaacagacaaanccacagctcaggctgctnccnccgacngnggggggccctnc

SEQ ID NO: 68655 - DNA, 600 bp, Triticum aestivum
  unsure (1)..(600): unsure at all n locations
  Clone ID: PAT_TA_68655
attaagcatgttttttacaagaaaaaaataatnattccgagtctatgaaatgcaagacaatgctgtatctcatcatcaaccccctccctcagcttctcgaatttgcgttcctcagcggtgtgatcagtcataggatcatagctgacctcctgatttcaaaacatttctgcattccccccttttgcagtcgtgcccgtacgcttactaacaccgccgtgacagtagtttgtcgacagaaggcaggccatcgaacgggaggcaaattccttccccaaatcactgggaaattcttgagttctgcagtagtatgttcaggagatacaatagcctgtaatcagcttgtgaacgtcgagccaccgcatgcccggctattctggccacatgatgtaacaacataggttcattcagctttgatctcgttgggtgcacccggatggttccttgtagaaggtattaggacactgtaaggctagtccaattctgcatgccaatcgagtatctgatgctcacgaagggcaaagtaaagttgaaacactgaaaattcagaacctttaccatgcaattcacagcaccccactagacggcatctaattcctggtt

SEQ ID NO: 68656 - DNA, 634 bp, Triticum aestivum
  Clone ID: PAT_TA_68656
tctgtttcttctgcccttgataatttacacgtacggcacattcgtactctcaaacttttcccggtaaaattcacacagcacatgctgctgcatcgcgcgcacgcagctgatcatcagcaaccgacggcggcggacgggcaataaacggccagctcacaggctgggcaccctctcggcggcgccggagatgacggtgagcaggttgttgccgaaggggtcgctgaggtgcgcgcacaggttctcgaaggggccctcgccggtgacgtaggcctggtcggggtcggtggcgaggccgagcgggtcgaatgggccaccggggtggagcttgtcgtcaaattccagcccgttggtgatcctgtagtactcggcgcctccgacgaggacgacctcggcgacgacggcgaggatgaggttgatggggatgctgttgccgaagtagttgagggtgttcccgtcaaggagcagggcgccggtcttgaaccaaactgcctcgggacccgcagtttgcgccgaacttgttgagcgcctcggggatgatgaatccggcggcgccgagcatggcccacctggcatggatgagctcaaaggcctggtacttgggcgaagtcctctggcttcttgcccaggccaaaag

SEQ ID NO: 68657 - DNA, 273 bp, Triticum aestivum
  unsure (1)..(273): unsure at all n locations
  Clone ID: PAT_TA_68657
acagtacaaaagtggaaaaaatatgatcngtctacaaatacacaatggagccgacaaatcaaacaacactccgccgcggtggacaaatcaattgtagatgaccagagcggcgacggggttgcgagctcgctggtcttgtacgtcgtgcgtatgccaggtgtaaccaccggatgagacggcgcaccggcgtggtgagtcgcacgcacacagggggggggggggggggggngggnttttttttttngggggggnnnnnangnnttnaaaantttt

SEQ ID NO: 68658 - DNA, 374 bp, Triticum aestivum
  Clone ID: PAT_TA_68658
gttaatgcgaagtacagcattacagctatctcagaaactgctcttcctgcccagtacaacagtacaatgctatacttccaggaaacatctaccatacaaccacctggtgcaaaacaacatctacttccatccacgttccactttgaaaccccatcctgcagcttctctgtctggctcgtttctaatgaattataccatcaatgtgttgttaccgccgcttcaaccttcgtgcaatttggtcatatgtgtgatgcctctcagccttgtaaaatgctcgcttcattttttcaatggtgggctggggcaactcaattcccatgtcaagcatctgatcggtatatttcttcacctcggcgaacctgctaaagtcgaga

SEQ ID NO: 68659 - DNA, 153 bp, Triticum aestivum
  unsure (1)..(153): unsure at all n locations
  Clone ID: PAT_TA_68659
antttttccttttngataaggtgtatgtncaatggcacaaatattcaccacgttcacatgaacactttgaactagcagtaaaagtttggaacagagcaggacaatctcaacgttttttttttttngnggggggtttnanagggggngcngncc

SEQ ID NO: 68660 - DNA, 722 bp, Triticum aestivum
  Clone ID: PAT_TA_68660
aagtgtcctacttggacacgactcctatcctatctaaacgcaatacaactacaagtccaactgtaacctatctttgtacaataatattcgacacaactctaacagtctcgatgaaaaaaaaatccctatcctatgcatcaaatgaaatctatttttgagatacatgccatctcactgcctatgatgtttctatttctatgatattcctacatcctatatgaaccaaagcaagccttggtaggttctttctttggtaataataattgtgtgcaccttgcaaaagcgaagcgaacataaatagtatcagggagcacacattacagtgggtgccgtacaataaattgttgcccaggcactgtcggtgcttcaccttttatggcacccagaaccagctcaagatgaagctgctgctgcagcctacgtacctgccatgcacacgcgtcgttcaattcttcacgaccgctgcggagaacaagcagcaggccatcttcgccgacagcatgaaccacgtcttcctcgctcgtcgatgctcctgtcccgccctggtcacgtgggcaccatgatatttatttggatattgacatctaatcgctccctcaattcatttcacaggtacagtaggtcacagcacaagcaacaacaaaatgagatgaatacatgcatgcattccatctcatttttcaagcggcgggaggactcttcttgagggatgcattctttac

SEQ ID NO: 68661 - DNA, 102 bp, Triticum aestivum
  unsure (1)..(102): unsure at all n locations
  Clone ID: PAT_TA_68661
tagccattgccatcgttccaaatgcattaaaaggaagctttgtttgagccttgtnaagaccaagttcctcaagtgnttcaccatatataggcgccttgtcac

SEQ ID NO: 68662 - DNA, 566 bp, Triticum aestivum
  unsure (1)..(566): unsure at all n locations
  Clone ID: PAT_TA_68662
tcgaggaggagcacctcacctcgcatggagtgaactgcacatgccgctggtggagctgccagactgctgtgtgaatgaacacatgtggataagaaggagagagcagagtggtggccatcgctgctggccaaactgcctgtagctggtcgtcgcgggagggccattggtggccctgttgaactgcacgaggaagccaaaatcgccggcatcgggcgagggagctcggtcgcgctccttgcctccttcggtggggtgaactgcacctgttcccttctgcccccgccatgagcgcgctcctccggcatcgctcctttcctccccaagcggcatggcgagtggaaaggagagaaggcagcacccgagctgcacggggagcggcaaccgagctgcatttgggggacgacgccctgagcagctggtggtgcaggggcggaagatgggagcatggcggcgtctcgcgttgctgtgagacacggcnaggtggcggaaattgtccgggcagctagctgggcgccggatctggctgacggtggctggatctgacacgagaaaccatggtgacggcc

SEQ ID NO: 68663 - DNA, 711 bp, Triticum aestivum
  unsure (1)..(711): unsure at all n locations
  Clone ID: PAT_TA_68663
gtcgcacatactatnccaaatgcagaggcacagttcctcacagggtaaggcagagttaacggctccgacaggcttaagcagcacacactacattgagtgtatatatgtgtatatatataagtggcagtggcggtcgccatggcctgtctagaggcggtgaaactgcagcttctcaaaatagagaagacattagtgatgacccgacgaagcactccaagatgagcttggcgacgaataggtcgtcagcgaggaggtgctcactgagcgtctgagcccttggaagtgcagcaaccagcaaagcagtggcaagcaagcctacatctgatcgccttggcgagattgggcagcaggctctcaagctttctcctgtcttgcgcaacaacgttcctcaccaagaaagagttgataaccttgtaataatgttattagtttgaaaaaagagctaacgtaaaaaaattaagaatgatgcattccaaatagcaagaagcatgcacaatagaaccagccgaagcgcggcgacaacgtgatgtgaacaacaggaattgaagtggagtgttgtgtcccctccccgcatcatattctcccatcgcatcacatagcaagactgaatacatatcagtatttggaaggaaaccggcaaggagggcgaggcagagattgagtccngatgtggatacgacccagtttccggcgaggccgttggcggcgacg

SEQ ID NO: 68664 - DNA, 732 bp, Triticum aestivum
  unsure (1)..(732): unsure at all n locations
  Clone ID: PAT_TA_68664
cnttgtttatttgagcatcctttttgngcttgtatggctgcttaattatcacttcataagacaaaatggcaccctgtatttctagccatcaattcaaacctactgatgtagcaaagccccaataatacactatacatacacaatgttaggaaccccagcctcctctttcccccgacctcccccaatccctgcctcctcccctaaccccctcattctttttgtcgccgccgcctccttctctctctcctccgcgagcaacgatgccaaggatgaggagaggccgacgatggggaacaaaaggagtgggggcagctctcgttccctccgcggcgagcgcgcgcacctgtccccggccctgtggaggcggccataccggaccatcacgtcctagagtcgggcgtcaaaccagcacaccgccgtcgtgccccagcacctcgagctccaccagcggctcacacgctcgcccttgccactctaccggtggagagctcctccatggcagcatcaaccggatcccggctgacccagatccaagcgcttctatttagtactcaaaaccttctgttcatttatgtaccaataactgctgcttcttatgatttctgaggatcgtacttcaggtagccatcctatttgattttgaacatcttcaaatgttgattttagtcgctttctttcagattttggcgcattgaccagcttatcccccagcaattgtgttcacatggtaca

SEQ ID NO: 68665 - DNA, 613 bp, Triticum aestivum
  Clone ID: PAT_TA_68665
cgaagcttatgaccatgttgagaaccataaagcagagcatgaacatcttctagctagagctagtctacaaaaatcacggtgattattcaggttataatctatgtgcgtgctggctgctcagccgaagcagccgaacatttcttcggtgggcctcgcagccgtctcctggaacctgatcatctcctcccaccagctagcttccgcggcctggttccaccgcgtcttcttcgcctactctgccgttttcttctgcaatctggacgaagaagatcagtacacaaagttatttagcatggtgacaagttacatgtgcttgttttcattttgtgtgtacagcttccaatttttttaccatgattctgtcacaaaagagatagcatgagcacatcctgacgtggtcctctgaatctgaattttgtgtatatgaaggaagcaagtgcaacacgcagttctctagctggggatggtgggagtagagtatacacggtaaccagaataattaatgatataggtttgactaagtaccttccagcagggaggcagatccatcctcgcagaggatgacgaattgttcgatctcaaaaatgcagtgatgacgaacctttggaattgc

SEQ ID NO: 68666 - DNA, 717 bp, Triticum aestivum
  Clone ID: PAT_TA_68666
gatagatggcaaaaattgtgagggacatacaaggccaactccacctctgtcgatcaggccgcactccaggattcaccattttcaatgcgacccaccagcttaagcttcagctgctgccacttggggcataggagtgtagaagccgacaacaggaatcaggttaccatatccatgatcatcgcacaccctggttatctcctctgattggacttgaactctgaagaggccggcagcagtggtcacgacaatgacgtttgctccctccgcaaagcccaacacgtggaccggacatgttgcacccatttgagcaccatttagagacaaacttcccaagttgataatccggctgggtatccatcgggcatcagtcatctcccttgaccacaatttcagatgcggatccaattcttcaacgagtcccagtccaccgtcctctgccggcatgagaatgtaactgggtatacccttagagtagcaagagtatggtgccttgaaccaagtcagcccatgcattgccatgtcatactccaggatcaacccaccatcagtcatgaagtagagcaaagactccccaacaagcacactggaagaatatgtgaagtgcatgtagaactccccatgcatcacggtcagctcgccccaagcaccggtctctgacgagtatacacatgctggccgtgtcatattccccgtcgtcaggatcttcgctgtcgacgg

SEQ ID NO: 68667 - DNA, 628 bp, Triticum aestivum
  Clone ID: PAT_TA_68667
ctccggaaacctaacaatttcatagagttacacaccacacgcgatacatagaaactgcctagcagaatcgagacctgcatcagggaggacgaggcgtcctttttgtacataccctgaacacaaacacaccaagcacaactaaaacacatcgccatcggaccagatcaagcggcggcgactttgcggcccttcttggcggccggggagcggacggtcttgggcttcgccttggccttgcgaccatactccccccggaacccaaagactttgatttctcataaggtgccggcggagtcctataagcaacatccgccgatccctggtcggcatcgtttatggttgagactaggacggtatctgatcgtcttcgagcccccaactttcgttcttgattaatgaaaacatccttggcaaatgctttcgcagttgttcgtctttcataaatccaagaatttcacctctgactatgaaatacgaatgcccccgactgtccctattaatcattactccgatcccgaaggccaacacaataggaccggaatcctatgatgttatcccatgctaatgtatccagagcgatggcttgctttgagcactctaatttcttcaaagtaacgatgccggaaac

SEQ ID NO: 68668 - DNA, 105 bp, Triticum aestivum
  Clone ID: PAT_TA_68668
acattcttcagtcatcttagcatagtgcacccagtcatcctggtcaaacgggtcctcaatcgacacaatgggggtactcgctcacgaatgacttgtatacgttct

SEQ ID NO: 68669 - DNA, 685 bp, Triticum aestivum
  Clone ID: PAT_TA_68669
tttctagatgtgccgactacaaaaatgaagtagtaccacaaaatgagtacataaatttctagatgtgccacaaccaaaatgagcaaagcaatctccagattcaacaaataagacatatggcattatcactccaccaacttcattgtaggtcttccaaatcttcaacagcttgaagatcttccaaacctccatcaacttgtgtacctttgtgaaacctactcagcatgcttgtggtcgaattcctgcttttgccacggacttgtctacttcctaattttgattagtacacagtgagcagaatgtccaatttcccttccatacacaagacttcaagtagtaatgaattcacttcgtaaagctttctgtagaaacaactaaaagatatgtgagagtgatagtaagcattggaccaatttgtacttccgacacacatctctgcaatatcaagtcatggcaaagtctagatttttcgacacactcgtgagtcatgacaaaccatactatcacacattgttcttaccaacaaatatacattactacatgtgtaaccacgaccaagcattgaaaccatacatcaatcagtaacttgcactactaaattttggaactgaaaataagacatgagcagataaatgggatctcaaatacaccctacaaacaaaagagggtgcagaattacatggct

SEQ ID NO: 68670 - DNA, 111 bp, Triticum aestivum
  unsure (1)..(111): unsure at all n locations
  Clone ID: PAT_TA_68670
ctctcgctctcacgcagtgagatnatgtgagagcacttattcatatatatgnntatgtatgtgtatgacctcancgtactgaacgnanatcgctcgagctatatgcaccga

SEQ ID NO: 68671 - DNA, 663 bp, Triticum aestivum
  unsure (1)..(663): unsure at all n locations
  Clone ID: PAT_TA_68671
acacacaagncagagtttttgtgggacgtgagcatgggaggctaaaaaaaagtgcacacacaaaatagctcaggcaactccaatattcagtcacagggccgacactaataactgaaacatgctaatttctcttgatgccagaaggaatattgcctacggaaatcggataatagaccgcagttcacagcctaaaggtcaattccaagttacagttgaccacggcatgataattcctacaggttcacatcacatttgacggtgcatgatatatatgcaaggtcatctcccttgtggaggagcacatcacaggccccatgcacaccatacagaatggaagaacatacattacataatccatttattcatctctgacgatgaaacctaactcttgatacctgctcaatcaatatatctcatccacatgtctatccggataaatcatatcatgtattgtgcaaaagtttagcttcatcgtttccaccaccaatgtctgtgcctgcagtatagacaccttcaagtggataaaagcaacaccactcatgggattcaaaaagtttcttgaactgcaatgattcaaactgaaccatgaagactccggcagacatccatagaagcaccacattattgccctcggcaaaccctactatcgatgggtaccctatc

SEQ ID NO: 68672 - DNA, 173 bp, Triticum aestivum
  unsure (1)..(173): unsure at all n locations
  Clone ID: PAT_TA_68672
accaacaccacctcatatccctncaggataattacaacccattacgacngacataaagnagagcgctgaaatacagacatgacgaatgctaagngtngatctttnagntnggcggtggcatgtggctagatgttnctctactcaaaggcccactggtnctncctgcggatntc

SEQ ID NO: 68673 - DNA, 672 bp, Triticum aestivum
  Clone ID: PAT_TA_68673
tgcctcatctatgtttgcaacagaattgcatgattacacacgctacattgcatggaacaaaacacaatatgctccacatgattacatacggactgcacgacgaccccggacctgcaaataaaatgcaacgtgaaaaccgatcacttgcacatttttcttcctgcaaaaataagtaatctgaatgtcaggagcaaagaacagtggaccacatcgctctttgattttttacttaaggatgaaaagatcttcaccctgccctggaaccatgcaaagggcagcagagggtgtggctagttttttcgtcggaaaatgagctcgccattgcgccgttaacctccatggatgcctgttggggaagggagtagagggatccgcgacggagatgcatgggacgaccctgccattgtccatgctggagaagcttccgcctgcaccatcggcctcgcctcttctgaatcgaggcatggatggggctgcccatcggggggatggaaggagacgacgacctcatgtcaccggactataagcacgctcgccggtggactggacatccaaccgcaccgcattgacgccccaagcaagctgcagttaaatctgaaaaagcaagaaaacaattgaaggggagcagtggatggctgaacatggatattcgccgtgctcctcccggtctgc

SEQ ID NO: 68674 - DNA, 166 bp, Triticum aestivum
  Clone ID: PAT_TA_68674
gtgggcgtacaacataaatgcattggatgcacaacatggtaatatgtaatatgttgagtgaagggaatagtagcaaattaaacacggtatcaaatgctaagtcgaggcactcgcacgcaatacatgcatgcagcctgaccggcatcgacttattgtacatagagcc

SEQ ID NO: 68675 - DNA, 682 bp, Triticum aestivum
  Clone ID: PAT_TA_68675
aaattaaacccgctgtctatgcctgatcttcatcgatctaggctggccgttggcggatcacactatcggactatcctattacaagccaaacagtagcaacaaacagtttaagaagttccacagaagtagtgcagctcaactgatcactaatcacatcaacgcaatcattcaaggctgggcagtctcatcctctgcctgagcttatcttcagaagcaccacactaggcacaagaattatcgccggacagagcacttctctgctgctgaaatcgatgtcgtttacttttgcgttcgccatcgagctgttggtctgccttcctgcaatccgatgtttcggcgtcatggcactatataaaagagagatagacaaggtaaatggaagggagagtgtggattaggaaattctgaaactgcagcagggaataatagatggaggggtagtgcaagtgcagcattcgcgcgtggcgtggtagagcacctgatcttggttcctctgctcaggactctccggctcttctccgacgcggttgtcaaagtcgtagttgaactggaatgaaaaggacgggacagactataacacttgaaataaaagatactccctccgtccaataatatgctatgggacggagggagcagctagggagcaaagctagtagtacctctggttctgtctgtcgggagg

SEQ ID NO: 68676 - DNA, 190 bp, Triticum aestivum
  unsure (1)..(190): unsure at all n locations
  Clone ID: PAT_TA_68676
atccacccacctggtacttgcgttcatagatgctgtacacaggcngagcactacacagaactggtgggtggagaattgntagatgctncaggtagnacgtactactagttgattcagattgctgcagcagattcaggtgtcggtggcggtgtggggacttncactgtaaccgggagnccgttgtgcagcc

SEQ ID NO: 68677 - DNA, 414 bp, Triticum aestivum
  Clone ID: PAT_TA_68677
cttttttacggtaattggagatcttcagaaggattacattgattctctcctcagcttctgttgccacaataggtatcataaagagtgaaaatgcttcatcattattgtttcggcagaatggaaagacgctaaggagacatatttttatccaaatatttcgaggcccatagatctcaagggggaactgaacttaaaagaatatgttgcactaatctatcaccacgaacgttatagtggaacctataatttaaaagttagaaattcatcaaaaattttgtttagtcacaaggacctctgcttgacactaatccacagtatcgttgaaattcccatcctaatcttctagactgattgcacatcatcttaatcaactataaggagggctcacttccgaccaacctacttaatgttaat

SEQ ID NO: 68678 - DNA, 572 bp, Triticum aestivum
  Clone ID: PAT_TA_68678
cggctttatatttaaatcctcaaaatgaaacaaaaatgacaacaccaccaagtaatcatttttcacaacacacatgttgaaatatattgtcagcctctctttatcagtttggacttttggataaattggttggagcatgaattcaatcagagatatccgatttaccagtgcctccacgacttattgatgtggccttgcttttggggacttgatctgcactggatagcggtggatgcacccagcccatggtccattgctattgggggctggtacgatgcactcccacaccgcactgttgcatttgaagccagagccaaacccgatcatccatacgcgatcaccatcatgcatacggcccttggcctcgatatatgctagctcataccaaactgagctgctagatacgtttccgaagcgatgcagcgtcattcgtgacggctcaacatgcttgttcgacaagccgaggctgcgttgaacctcgtcgatgaccgccgacccaccagcgtgtatgcagaaatgctcaaaggccgtgagaaagttggggacatacaatttgaaacgcctgctggaca

SEQ ID NO: 68679 - DNA, 203 bp, Triticum aestivum
  unsure (1)..(203): unsure at all n locations
  Clone ID: PAT_TA_68679
ggacggaccgggggaagacacgacacacgantntgttatttagatcgacnacacgacacgggacacacngggcgatgacgacgacggcgaccggcgggcgggcgnatctagagctggccnnngtcggngatgacgacctgcttggagcaggtgccgntgcgggagccnaccttntcgatgttcttgacgacttncatgccctc

SEQ ID NO: 68680 - DNA, 439 bp, Triticum aestivum
  unsure (1)..(439): unsure at all n locations
  Clone ID: PAT_TA_68680
gngacgactncaatntttggagcgngccgaaggcgcnccgccgtnatcgcccntccntngtnggngccgggcaaacattgttgtagtanacagtcgggaagtcgttgtgctaaggccccatgggaccagngcaccanaacagcaaccgccgccgntgaanagaagcntagaccgganggatccaacctgcagtcacacagacntanacnagcgaanaccggatccagtcggatccaccgaanacaaacnccgaccggatcccatganatccgccgganacaaacctccacacgcnttccgacnatgcttgaaacatnaccaggacgggggntaggcggnaaggaccttattccattttnaanaagccgccaccgcctnatttttttgagcatggcacaaaccctaacaaaactcanaaaaacatntaaaancggagccc

SEQ ID NO: 68681 - DNA, 185 bp, Triticum aestivum
  unsure (1)..(185): unsure at all n locations
  Clone ID: PAT_TA_68681
aaaaagaaagggaaacaaggaaaaaaaaggatcatcgatggcgatcggacgggcgccccggcagcagtagtagtgatgatcccatgcatcgtcggcgcgcctttacttttgttttgtttggngatgatgatgatgatgatgataagaaggtaagatantgacgatggaatggggtggatatatga

SEQ ID NO: 68682 - DNA, 664 bp, Triticum aestivum
  unsure (1)..(664): unsure at all n locations
  Clone ID: PAT_TA_68682
ggtatataacggaaatnccacagtacagtacaggagggtttatacagtgatatacgaacacggggtatctgtatctatggtgtccagtagtcctacaagcactcaaaaaacccgatgcagctctagaaatactcgaactggccggagcccgtcttggctgccgcaacagcgccagccgataagctgctcggaacgttgccaaggccacgctctgccgccttcttctccttgcctaggtactgcctgaagtcgacggggtccggtaccgacggcgggtgcgcgctcctgacgagcgcccagttcacgccctcgaagaacgggtgctgcttgatctcggtggcgcccctcttggttgcgatcctcttctgggggtccttggtgagcagtccccggatgaggtcccgcgcgacgttgctcaccggcgggctctccgggaaccgcagcggctgctccaccacgttgctcagggtggcgcggttgccgttgcccttgaagggcgtcatgccgtgcagcagctcgtagaggaagatgccgaaggtccaccagtccaccgcgctgccgtggccctcccctcggatgatctccggcgccaggtactcgtgggtgcccacgaacgacatggaccgcgcgtccgtcggctccgcgttgaactccatggtctgca

SEQ ID NO: 68683 - DNA, 173 bp, Triticum aestivum
  unsure (1)..(173): unsure at all n locations
  Clone ID: PAT_TA_68683
tgtgcatatncatngccaccgatngcnttcacatacgagcacgctttgtcgngcnatgttgttacatgaacatggncatacacatattattaggagcangtaacaaagacaaatggngaaggnaaacccaaagcaatgtcangagttgacaaaactgcaanggccctttatat

SEQ ID NO: 68684 - DNA, 685 bp, Triticum aestivum
  Clone ID: PAT_TA_68684
gtttaatgcctccgctcccttttctggaaccataatagtgaccttagttacaccacatgacaatctgcacacaattgttgcttatatttcacaaaagggttcctgtatgaagaatgccaagaggaggacaaaaatgaaaacccactcatcactttctttttaacatatttcaattcgactggtcaaaataaggtggctctttctaatgcagcaagtctttggcctcaactcgtaaattgggtgggtcagctgagagaagtggaatgagaaatgctcaccattcaagttggcagtgggctattcgagctatttctctggtcataaatttcttcaccctctcatccaccatactgtggggccatcttcgccacgatccccgtatatggaaaatgtgatgctcggcgagagcccaattgtatgtacatcacctccgtcaactgtacgtcagcatgtgtgattgcagaatgtccttgaactgcgtctcttcaaatgaaactagtcaggaagactcaaccgcctaaagaattcaaaaagatggagatttgatgtccagtagaagaaagctatcacaggaccatctctgatgaactttccatctagtatcaaaagctcgccgtcaacccatcgaggatttttgaagccagcatctgcaatcctcctttgccccttatacctagcaaccact

SEQ ID NO: 68685 - DNA, 576 bp, Triticum aestivum
  unsure (1)..(576): unsure at all n locations
  Clone ID: PAT_TA_68685
acacgatagaaagacagctatgagtttttcaagccttgcattcctgaatgctcacgggatggtacatccatctgacatcccaaagttcctcgcctcgccgcctctggaaactcaatggttggctggtacatccatcagcggcccaaaagctcctcccaactcttgaaaccgaatcactttctccaactatcccttggtcctttggatagtaatttcaatgccaaatgtactcaaaaaattcagaactttgcaaactctgccatcaacctcttcacatttcactttgataatcttcaggtgtcctgaaatagccgctggtttctccatcaaaccaggattttcttccacttccactgaacatgtaggttcttcttgcttactgaattgaagtgtcagattctcaagaaccggcgaatgttcaagcatacaaactagtgcacggaaatcaggttccacactccactcgttcagcaacaatgtctttaacttactaaatgtagggcaccatctcaaatcccttctgaaaataaacattcccggatgagctatcaactncaagtttttagcacgagacag

SEQ ID NO: 68686 - DNA, 531 bp, Triticum aestivum
  unsure (1)..(531): unsure at all n locations
  Clone ID: PAT_TA_68686
cacttggaaaaccgcgaaaaggagcatgcatcgcgatgtgcggctgttctgggtggagacgagagtttctaaagagcggaaggtttcatttattcaaaacatccagaggagcagctgcccttcgaatgtggatttacgccaggcatgagtaggccaacgccttctcctctgacagctcctgggcggtcgcatccatcttcttcctcgagaactcatcgatcggaatcgaaccctaattctccgtcacccgtcaccaccatggtaggcccctatcctaccatcgaaagttgatagggcagaaatttgaatgatgcgtcgccggcacgaaggccgtgcgatccgtcgagttatcatgaatcatcggatcagcgagcagagcccgcgtcagccttttatctaataaatgcgcccctcccagaagtcggggtttgttgcacgtattagctctagaattactacggttatccgagtagcacgtaccatcaaacaaactataactgatttaatgagccattcgnagtttcacagttc

SEQ ID NO: 68687 - DNA, 655 bp, Triticum aestivum
  Clone ID: PAT_TA_68687
tccccactctcttctatcaacagaagtcagtatgacaggttagatactacctagtcaactcccattgtcttatgagcaaagtcatatatcatatatataccaagggggaggcacggcaaggccgccactagtagcctcccctagttaaaagcaccagcccagttccgcaaaggacagggcgtcgttatattcacgacgcccatgcaaagaacgtgcatatggcccgcctcgtgacggtccagttgccgcatccatagaaatgtcttccctgcatcggacctggtttgcgtacagtgttcggcctgctcggcgctccgcagaagcagacctgtccagcggccttgccggcatatgggtgagcatggacatgagatcccaacatctcctttgccttatgctgctgcaacagggtgaggtctggagaacggtcaggggatggggatggctggcacgttattgcctgcggggcaggttgctgccacacaagcgagttggtgatggagaacttgaatccctggtgcatcaacagcgcaaggaggcgagcagtattgcgagcgtcgtcaagcccacagtgggcacgaccctcccatgtcagaccagccaactgaactgcatccttcaagttgcaccgaacacccccatagacttcctggaa

SEQ ID NO: 68688 - DNA, 596 bp, Triticum aestivum
  Clone ID: PAT_TA_68688
gggcactgttgttcgcattagacagtagtcccctctatgcaatgtacagacgaatcccgacagtggaatagtgcccacttttattactgcatgtacaaagatccaacagcggggaactcaagagcgagcgagcgaagtactgtctgtctactcatcagacaaatcacgcaagcactttttcatactcttctccagcgtatttccagttcaccaccttccagatgttggtcaggtagtccggcctcacgttcttgtactgcaggtagtacgcatgctcccagacatcaattcccaacaaaggatgcaggtttgaccctttggtcacaagagggtcctgattaggagtagtttcaactgaaagccttttggcctctttatccaaagctagccacacccatccagatccttgtaaagcagcaccctctgcattcatcttctttataagtttctcaatagaaccaaaatcctcatcaatggcccagccaagtttgccatgaggtgcctcaccaccaccctcgctaatgggcttgaggttcttccagaagattgaatggttaacatgaccgccgccgttgaacttgatggcgctctggagc

SEQ ID NO: 68689 - DNA, 650 bp, Triticum aestivum
  unsure (1)..(650): unsure at all n locations
  Clone ID: PAT_TA_68689
gacacagcacaaggnaaagaacaaggaagggtcatgatccgaagccttgatngcaaaactgttatcattattaactactagtactagtagtaatctaatcaaattaatcatccacaacagtgacagcaatgaacccttccagtacagtacagtacagtcaatggcggctcaacaggcgagtcaaaccgaacctaaaaacaatgcactgcattgatagtaagatgtttcagtctcaaccatattatcatacttgctgaacatccatgcgttagagcacggccataagcttcatttaacttacccgtgctgggagcagaatacccccaccatttcgacagaattagcgcaatggacaagctttacatgagctatgtttccaaaaacaatggtatgctcgcagagatacagatggcttgacctggcatgttgaaacagccacaaatgttcgtccaggcgtttctactcatattgtgagttacacaatcacccaggttgtttatgacacagacccgatgttaatcaggacggtggtgtagaccttggcagcctcttggcaatttcctcgaatagttggtttatattatcagctgtcttcgccgatgtctcaaggaaaaacatattgctcatgtctgcgtgctcctgtgcttcct

SEQ ID NO: 68690 - DNA, 618 bp, Triticum aestivum
  unsure (1)..(618): unsure at all n locations
  Clone ID: PAT_TA_68690
tttcgcgcgagnganatgctcgtgctactttagaactttagaacattcaccggagtcattataatcccatccttcccagaaacaaaatgcagaggcacatccatcatgtcaacaacgagcccctgccatacgttggttttacagccatggtacaaagcgagtttctccaatgcaggcgacggtttgcaggtgggggagtacaccacgggctacagctacagcggctcacttcctgccacggcctttgcctttcttggatttcttcttgcccttgtgcttctgcgccgccctctgcgaggtcgaggcggcggccactgcttcctccttcaacggttccacctcgttgcttcctgctgtgtcaggctcactgtctgaacatccggtccgttcgaccactccgtcagtctgcggctggacattcctcatgtcatcttctctcatggatgcccttgcggaggacacaaagctgatgaccgtctgcagtttgttctcaccatctccccatatcgagtatagatcctccagagtcagacaagctgtcttctccatcccggcaatgcattcatcaaattcactgcggatgcgcctgatatcttccaacagttgtgcatcaagctt

SEQ ID NO: 68691 - DNA, 652 bp, Triticum aestivum
  unsure (1)..(652): unsure at all n locations
  Clone ID: PAT_TA_68691
agtagtaaaatgtnaaattggggaagtgcttttcttcccttacatctggccgtacctaagacattagtatgtatcctaggtgtgaaatattttggtttcagtacaaagggcgatgtcattgggttttctgcttctgcttcaggaactctgtcatccgagcaactgggttatgagctattctttaaatcctgatgtcctccaaacccagtaatccgatttgagttttaggtcatctactgatgcttactttctattcgatgcactcagtgggttagctgctgcttggattggtcttgttccatagaagtcattggcacagcttttgactgaggttgagctgatgactgaggttgctgaaatttgctcttgagtaccgccgagaagcattcctccagtctgagccagatctcatcatcacttgaaactcctgatagctaatgcgaccatcctcatccgtgtcaacgtcacgtataatgtctttgatcacttgctcatctgggcctagttcgtcatcacctaaagcctccatcaattcctccatttcaatatatccattgccatctttgtcaaagtatttgaaagcttcaggtaggtactcctcattactcatttttttatgtgaagtaagactgtcacaaactcgtcagtgtcc

SEQ ID NO: 68692 - DNA, 705 bp, Triticum aestivum
  unsure (1)..(705): unsure at all n locations
  Clone ID: PAT_TA_68692
aataaactgattgttatggaaaggaagagcaattacagtagaatttagccacatggaacgactaacacatgcccagaacaacaaccagtgctagctaggcaaaacaggccaagagtaacattgttctttggaaattcagtggcatgattgaagcagattccaatgtgcacagacaaattgttcagccaaaagaagagacggttcttggaggaagcactggcgtggcttgaggtaaagctactgcccatctgcatgactctgagaacagaggaacatagggtagaaaccgttttggttttgtaatgcctttctcaagattaaggatacaatcaactttctgatgttgcatgtcatacgctaccaaggtatcacctccagatgacatcaagaaaacggtgtcacaatctggatgaatctcagcaaccctgtacttctccccaatcatgcccataagctcattgatgttggcagaacgcttcagaaccaattctttactgtcacgatccttgaggcaccaaagtgttatcccagaacctaggatttcattactatcattgactgaaaccgttgaagctacaacatagtgtaagcacccctgcgacactccaatcgtggaagatcttcggccgtactgcacagggatagtcttccacacttccccctccgcgtncaccaccatcagcacgtacttgttgaagcccatca

SEQ ID NO: 68693 - DNA, 147 bp, Triticum aestivum
  unsure (1)..(147): unsure at all n locations
  Clone ID: PAT_TA_68693
gtgcgaccaacacagcaagctnaatacgacnacaancncgctagcaacaccacccaaacaacacgacagacggctngctncctncgaccgggagggaatcggaagcaacaacaacctgagctagtgacnggaactgaaaagaaannc

SEQ ID NO: 68694 - DNA, 105 bp, Triticum aestivum
  unsure (1)..(105): unsure at all n locations
  Clone ID: PAT_TA_68694
ggtacataacgattgactgtttatttntttcctagcgataattaatgccctgancatgcatattggggccaataatttgntanataatcgacnagaaattcagag

SEQ ID NO: 68695 - DNA, 153 bp, Triticum aestivum
  unsure (1)..(153): unsure at all n locations
  Clone ID: PAT_TA_68695
agctatattnagcatctaagcaggtctnggcccaaaccaacgctngangtcaggtagcatcatntatggnttatncttggacatattagacaaagaataacngtaagatgaacccttctnatcggatgctcnagagacatatgcangggganc

SEQ ID NO: 68696 - DNA, 292 bp, Triticum aestivum
  unsure (1)..(292): unsure at all n locations
  Clone ID: PAT_TA_68696
aatcgattttttacacaggttactccgtagtaaatatacactatgtatgtgtgtagatgatacacatttgcattgcaatgcattgcatgtgagggagggagggagggagggaggaaggaaggaagggtaatatataatacagtagagcagatatctagatagatagaaaaggtaggtaaaaaaaggtggatgatggtggtccggctccggtggtggtggcgttgcaggagatgaagaactggccctggcgggggccgntgaggcagggggcgcggccgcagccgacgtanng

SEQ ID NO: 68697 - DNA, 731 bp, Triticum aestivum
  unsure (1)..(731): unsure at all n locations
  Clone ID: PAT_TA_68697
tnaaggctaggagcaagtcgcggcccaacaaataattttctagagtacaaaagttctacacggccactgtggtatgaatgtatggtacagctctagttacacgcttcgtatcagctggtatgtatgtatgatacagctctagtacgtagcatccacttcaagacacaaacgacgcgtcgatcgcgtgcagttcagtagctgcttctctcatgttgattcgctcgttaggatcctggctcgcgcaagaaagtgccactttcagcaaggacaacaggcaccggtggacttcgttctcttcttccagattatcctgggagcagtcttggcattcttcccggagagaagcgtcaaggatatgaagtatctgatccggaaagttcctcctgacaaagttcacgatgtcaagcccctcgcagaacatagggtcggtcggccttcttcctgtcagcatctccagcagtactatcccaaaactgtacacgtctccggaggtggataggtagctgcctcctgcatactctggagcgatatatccaatcgtgcccttcagagtcattgtacccattgaactcaaacccccagctgctgctgacttggatttgatgtagaaccttgcgatgccgaagtcccccaaacgagctgtcatatcataatctaggaggatgttgctgggcttcaagtcacagtgaacaatagggctctcacagtcatggtgtatatattgcaatgca

SEQ ID NO: 68698 - DNA, 746 bp, Triticum aestivum
  Clone ID: PAT_TA_68698
taagttttgcacctttttggcctagagtcggagtgttaattaaccgttaactaatgagaattaggatacattctacgtatcaaatgatatcacctctcgaaaagtttatgattaggttagtcagacttcgtaagctcatcaactgatagcaaagcagaatcgtgcagcagttttttaaatgccgcttgtgatcaattaagatgaaaaccacttttaaataccatgcggcgttttattagatgtcagcattgtgaaatagatttctcatttgagcgtacaaccgtcgccccaacataatccgtatccatcatctgaactagatgacaggctaagaagtcctccagcatatgagaagatggcagtgacttttatcaatccaattccaggtatttattcggatttccatctctttgtatggggcagctgatatgttgaggaatgaaaagagaatggtgagcctctaagctttatttttgggcttcttacgtacaagagcgtcgttgagagtacttacgcatgttttagaggccatagatgggacctgagtttcttttgtgccagtaaatttctggccccactcagcctcagtttcaggtcgagcagcatagcgaacttcatttatccatcgcttggaacttgatacagcgcgctcgatgttggaaaagtcaagattcaacagatgatcaaccagacgcttatagtctgagtcgtcaacaaccacctgcccatagatttttgtctcgcta

SEQ ID NO: 68699 - DNA, 676 bp, Triticum aestivum
  unsure (1)..(676): unsure at all n locations
  Clone ID: PAT_TA_68699
gacctggtgaggtgatntctgactgttacgaggtacacacatttacatggaggatttcggaaacataaagctagcagagtgaactaaaagcagcatggatcatatgtaaagcaagaatgagttgaatcagaaattaaataggaggagaggaaggaactaagacataaccgccagcatctccgcagctcctctgtcttcagcttgaatagtcactgatttttgttgttgctccgagagtagcgagctcatctggtataatgttattagtggaacaagtggttgtggctttcggaaccgcgtcgcctccactgattctcaccattgttattcctacacatgcaaaagcattcctcagcgcagacttcgcagctgctgcgtcgcgtccattgagcctctctctgaagtggtcaaactgcattggactaacttctgtgaagccaggtggcaggtgcttgatgccagcgggcaggcacgcactgctgccttgttgccatccctttatactgaaccgcagctcgagtcgctggagcctgggcacggctcctgcttcaaaggccagcagcagcttaggacaagagaacttcaggtgcttgagtgtttggaacgctgtgccgctgccggtgatgatgaccctttcttctgggcatttttcgatctgcaactcgaggtggataag

SEQ ID NO: 68700 - DNA, 103 bp, Triticum aestivum
  unsure (1)..(103): unsure at all n locations
  Clone ID: PAT_TA_68700
caacatggtgtttggcagttgnattcacaagacagtttcaggtcagaaaattggagtactgatccacaagggaggngggtggggngtttacacagnggaacgg

SEQ ID NO: 68701 - DNA, 669 bp, Triticum aestivum
  unsure (1)..(669): unsure at all n locations
  Clone ID: PAT_TA_68701
ttacaaactgcgaacggaaatnacaaactaagattccacacgcgggcgcttcgccaccctgctgctgacttcttcttcctcgtcgcttccctttctcaatgagtccatgacagcagaggcatcttctgaaacttgttcgtccgcagtgccatcgcctgtcgtctggacggatggatcgtgctcgccgaacccctcctgaacatctccttcctccgccttcatgtccacttcctgagcgagcaaacaagtctcccaacgatctgcttgaacaacttgcccctcgtctggcacgtctacaccgtgcggagccaaatcagttgtactccagcagctttccgntgatgccaccaaaggagaggcctttgcctgatcctcaagaccgaaggctgaaccactcaattgagacctcctcgtcgtgccactgctttcaggctcagcagcgcttggtgccatctccagagtccttcgacgcccctgctctacgagatgaacactttgtgaaagtggttaccaggcangcagctgcctcaccctcggcctttatactggtttctgcgtcgtatgctatccagggctcacaacttatgcatttactagcttgntcaaaatttgaactccatggtgcgcgcgctccacacgcatggaantaaactgagccaccacacgcat

SEQ ID NO: 68702 - DNA, 665 bp, Triticum aestivum
  Clone ID: PAT_TA_68702
caaaatcttagataacttatagtattgaagtacatccaagaactgttcttttctcaaaatgtcaacatggttttggagttgtattcacaagacagtttcaggtcagaaaattggagtactgatccacaagggaggtgggtggggtgtttacacagtggaacggtacagactgaagctaataaagatgcaaaattattgtgggtttattttttccttttgaggcctctccttataatcccgtttctttgaagctctttgacaaccatatggctgtctctcttggagacgccttcccaggcccaaaaggctttagcaagatccccagctcctgaaatctctcttgttggagcaactgggcactgaactcaagcaagccctctagagcctcagctcgctgccggtaggacgttgtgtcgaatctcttcagcctcaaatcggatgaacttccgacttgattattgtcgatactgagcaggttcagatcacgagtgttggtgtagctttcgctgtccccccggagcacttggaaagtgcatttgtccttggtgattgatttgtcagtgatagatggtggcaagagattcatgatgggatacaatggatcttcagacgatgccagtgggaattcagcgattctgtcgattcgagggtgtgttaactgaaac

SEQ ID NO: 68703 - DNA, 600 bp, Triticum aestivum
  unsure (1)..(600): unsure at all n locations
  Clone ID: PAT_TA_68703
gaatctgatacaacagtnctaatctaatctgactaattngtctagctngagngatcncttggaaaccgactggntagcaggcttcgatcagaagacaatagtctaagccttnacgcacgttccatgcattgccaagtcacgatacaactaatcctacacagtacagaaattccaacatcgaagaccctaagcgcctnanaagcctacggngccactagaccagntattggccgccgacnacgccgggatcgtntggtaccccgcgagccccgtggccggatgcacgttagcgttgntnaggtactggcgtaccgggtcgacgctgcaccaccagcaccgacacccccatgganaagtccgacnacacgagcatgtcgccgatgggccccagntccggggactccatccagtcctccagcgccgacgtnatcggcnacccggcctcgntggggcgccggcccacnatgtacatntcgngcgtgctgctgtccatgctccggatggccgccaccgtntcctcgntgttggccaccgtnttgtccgcgtacgtnatggcgccgttgccgnggttgcnatcgcggaactcgcccaggtactcct

SEQ ID NO: 68704 - DNA, 114 bp, Triticum aestivum
  unsure (1)..(114): unsure at all n locations
  Clone ID: PAT_TA_68704
gtcaccaaggggcttatcagacagataatcctgcggattgnatactttgncagnactttntgcaccttttgncaaatccccaaattcattnattgaccatccatgttnaccagg

SEQ ID NO: 68705 - DNA, 331 bp, Triticum aestivum
  unsure (1)..(331): unsure at all n locations
  Clone ID: PAT_TA_68705
cttatncaatagtatnctaccggctgcgcaactcgaatttgatacgccttccatacttcacaagctgcggctagttcaggactccatttgcaagctgctcggataatttcattaccttcgcgagcaagatcgcgcccttcgttacgagcttgtacacaggcttctaaagccactcgattagctgctgcaccaggtgcattngngnaaggatgtcctaaagttcctccaccaaattgtaatacagaatcgnccccaaagatttcggtcagagctggcatatgccaaacatgaataccacctgaagntaccggnntaacacctggnatggata

SEQ ID NO: 68706 - DNA, 115 bp, Triticum aestivum
  unsure (1)..(115): unsure at all n locations
  Clone ID: PAT_TA_68706
tggtacaggtcatggtacaacagacggaaataacagagggctgnatcacagctcgccaaatctgtaaaactaggagnaatcgnacagggagatgctcttgtcatgtcgaagcgct

SEQ ID NO: 68707 - DNA, 650 bp, Triticum aestivum
  unsure (1)..(650): unsure at all n locations
  Clone ID: PAT_TA_68707
ataccttgcactttttatnaatctgcctgttcaaattatcaaccgctaacatcaacatctttcaaacagggcgatgatccgttttggagcaagaagcctccacaagagaaaccggagaagccagagagaccaacccggcccaaaaccagagttgtgaagaggcccgctaataggaataaaaccacttcatcttctgatccggcagctgacgaggatgtgggtaacccggaccttgaggtagagcttgattcacttggtttatttttcacacgccttattgataatgatcattgccaggatgacaccgaagtcagtcatgctgatgctgtagaggtaattgctctctcctccgattcaatccccttgccttcactaaaaatccgttgggcaaaccggaaagttaaattagcaaacggtattcaattagcacaagcccaaccgcatagatgccttgatgtgggtaaagtagaggttgaagcttacaagagcccggcttaagcttacatggtttgtctctagagtattcaaagacatagttgcgtagttggttgtttcgtacatctcggaatgcaaacatgccgtagacctctaaggtggcatcgtgaggagacgataaattcaaactaaacacttggatggcccgtcgacaa

SEQ ID NO: 68708 - DNA, 582 bp, Triticum aestivum
  unsure (1)..(582): unsure at all n locations
  Clone ID: PAT_TA_68708
gcaacttgatntgatcggcacatctagatgacacgacaccgtttacctcctaagttaattgggcgccgcgtggtgtgatgattcgggtggatcaacatcgtaggcaaggcgagacagagccgtgacgacggtgccgatgggcggtctcgtggcatgatctttgtggatgcacaccgaagcaacttcgagggcctcctgcaagtccaaggacggatatcgcccctgcagcgccgggtctgccatccggcggaactggctcctgtccttcagcattgttcgggcccatgtgacaaggtgccgatcctcgacgtcctggggggaatcggtggccctccgcccggtgatcatctccagcagcacgacgccgaagccgtacacactcgaccccggaaacagcttcccggtcatcacggtctcgggggccatagtaccccatgtcccgccggtgatagcagccggtgcagacagctggtcatgctccgccagtccatattgtgacagctttgggtggtagccttctccgagcaagatgttcgaacttttgacgcatcggtagaggacacctttgtcgtgcatatactc

SEQ ID NO: 68709 - DNA, 131 bp, Triticum aestivum
  unsure (1)..(131): unsure at all n locations
  Clone ID: PAT_TA_68709
aaatggagaagggaaacccaagagcantgtcngagttgacaaaactgnactggcnctttatatatggcctgtcgtgagngagctgnttaggnctngccggactcctcgcannccggtggnttgnaggcgat

SEQ ID NO: 68710 - DNA, 501 bp, Triticum aestivum
  unsure (1)..(501): unsure at all n locations
  Clone ID: PAT_TA_68710
taggggaaaagtgctcccagttcttttaatgcattcgtgtttagctcatatcntttctttttncgaaatcccttagagcaactacaaaatttgtttgtacattacatgattattacacaagtatgcaatccgaaatctcccaatcaaataacaaaatagaacagctatgatctcctgtctgacttgtaatcacttgtcctcctttcttcagcttcttttctcttctgttgcgcaaaagcagcatatccaccagcaacagcattttcagaagtcaaaagtgtggcagatccactggctgctgaccgactgtcaagtccactagcagctgcagggntcttagtatcaccatcaaccttatccnattttgactttntgnttggcctagcctctttntgtacagtatntgccgatgccggaaccgatacaccagctacagntgntgctgatatggcggctgaaatcttcgntattgatggattgattggaggttgtactccaaaa

SEQ ID NO: 68711 - DNA, 696 bp, Triticum aestivum
  Clone ID: PAT_TA_68711
aaggtttgatgcggtaaacaaagagatggcaagcaagctcaacattttagttgcaaggatctaatttggaaatcagataagaggccttctaaataaaattttattaacctgctggaagataaataagtgccccctgtctgaataagtatagtatatcacaacagaaccatttaacaatttaagatccggaagaaccaaaacgttgacagctgcacgactttgccaaggtgaagcattcaacttatcttcttgttggtaagtagacaatagagcataaaccagatatgtagaagacgaacacccagccatgtcaaagtaaaagttagatatggcgactctacatttggtgtctcctgcaatgaaataccaaaaaatcaccaaaatttaaggttgtcatactggaaggacgtttatcattagcaataaagagaacataatgaataatccagaattggtacaccaatagaatggcctagcagctgagctcctatttcccacaaccctggaaaaaaatacagttgcttggtgaaaattttggaaaattattcggcaagatcttatatgtactgaccaaaaaaacatgagtgcgcataatgaaagaagtttcaagttcatttgatcatgaaactccaaagggacttttggatactcataatattattctgttttccaaaacaacatgaatagtacataaca

SEQ ID NO: 68712 - DNA, 105 bp, Triticum aestivum
  unsure (1)..(105): unsure at all n locations
  Clone ID: PAT_TA_68712
acttggtggcgaggatggttgagcacttgcgcagcatcgacctcagcgacgcgcatgtntctgcatcnangggcggctnaacagcgacgcatagcgcaaacagcc

SEQ ID NO: 68713 - DNA, 579 bp, Triticum aestivum
  Clone ID: PAT_TA_68713
ccgacccttttctcttctctgtatttctcttctaaaagcaaatatgcatacaagtgcttaagtagactcacgctcacgtagccgggccacacactcgcccactaactgcatgcacgcacccacgcacaccactaactaatgacttgatcttctcctagaatcactctaggaaccacacgacccggccactcatgcagcagcagctaacaacctcggacatgcatacacagcagcctctcgccaccgttcggcatctcgccatgcgccatatctcacggcgcctcgcatctcacctcctgcatgttctccaaggcttcacctgctacaactacctatatgcatggacaagcaaactaatatgcagatacatctgaatcaagattaaaaaagctaacaatcacccccctaatcttgattcccaattcttcatgttcaaaggagagctggctcgtcgtcgacgtactgtcccagcagcgccttctcctcctcgttctccttcttctcgggacactcccaagcgaagtgaccaagtttgcggcaattgtaacactgtacctcacttttgtctctacgccctcc

SEQ ID NO: 68714 - DNA, 377 bp, Triticum aestivum
  unsure (1)..(377): unsure at all n locations
  Clone ID: PAT_TA_68714
ctgcgaattaagtgactgatcncaacatctgcggattttattaagcatttgttatgaataagatttcgctctagagttattttcttattattacacgcgtgtgatgcgtgcgtcaccactaacacagtagccctacgtagcttacagtcgattgagcttgatcgccatgcttaggtctggacgatacatgtagataggaccagcgggcctatgatatgagatcagccgacgttgggcggcggcacgccaccgccgccgtcgtacgccatgacgggcgtgccgctctcgtcgctggtgggtatgttgtaggagcagctggcggacgcctcgagctggtcctgtgccgccggcaccatggccggcaggtactggccgtc

SEQ ID NO: 68715 - DNA, 692 bp, Triticum aestivum
  unsure (1)..(692): unsure at all n locations
  Clone ID: PAT_TA_68715
ctgatattctnatataccccaagatggaaatatatctgatattactcaaagagtaggtaatggtagatactacaataatcaccctgtaaaatatctaaaaatggccctatctacatgccattagtgcatttgttatacaatgtgacatgaaatacctaagcaaggtttggtatgatagaaatcaaaagcaggtcatagtatgtacactgtttttgatactgcacaatagtaaactacatggttgactattggatatataactttgtccacacaccttcatccgctcgattttggatcgcatttggcggcatggccaatgatatataactttgtccacactccttcatttgatttggttgcatgttgtgacacacggccggatctatggtgacacaagaagcctctgaagcaaagaaggcggctcagcggtgacttgaaaagcgagagaggtcacacgctggcctacatctcctcaaactctgcatggtgcccatcaataaggtaagagtccatgaaaccacacataattattttcgcctacgcagtgacaacataaatgaccatgggatcttattctctagaaaaggatcaacaattagaatgctagatcttggcaacaacaacataatacatacttccatatcagagacataaatttcttaattctgaaacaatgcgcttctaaaatcttc

SEQ ID NO: 68716 - DNA, 601 bp, Triticum aestivum
  unsure (1)..(601): unsure at all n locations
  Clone ID: PAT_TA_68716
gcagcttcggcgtagngnancaaacaccgatcagtggaacggcggnatgagtttgtgtttacttgaaatacacttcggcgagcttcttcagggtctgagtcacgctcgtgaacgggtcgaacgcgaccgacgacttgagcttcaggtccgggaactggttcgtcagggcctggtccatcccgggcatggacatcatctccgcaagctggtccgaggacacctcgcagtcctgcggcgtgtccttgatcttgctcgggtcgtagccgaagccggcggcgtatgacttgtacttctcgatgaactccggtccagggtttggtgttcttgagtatatctgaataaagctggtgtcctttgctccagacacgacggcgtaattgtcgtagtcagtcgcgaggacatcatagggtagcttgggtatgaaggggagtgtcgggaagcgcagaaagcacttgctgctgatcatctcctccctctcaagatcagtctcggcaccagccatgtcttcttgagacaggcattgcaccttcccccggatgccggtgatgtatccgtcaggtgaaccatggacacagaatgtctccaccttgattgcgcccgc

SEQ ID NO: 68717 - DNA, 643 bp, Triticum aestivum
  unsure (1)..(643): unsure at all n locations
  Clone ID: PAT_TA_68717
atcacatcatcgatcacttccgtcctaacatgttcagtcttccccgtagcaattataactaccaggnaatgcttgctagcttgcactagtcatgcagcagccgcgttgctggtcagctcagagtaaaacgcctacaagctcaccacacaacggccacggctgcagcgctggcgagctcatggttgcagcaccgggttgccgtaacaacgctactgcgaccatccccatgaagtagcgttgatgcttcggcggcccggcgatgctccatcgcaacaccaaagacgcttcgacagcctggcggtgctccatcgcaacaccggcaacgctccgggatgctccattgcaacaccgatgatgctccgacggcccgaggatgctacataccaacataggcgatgctatgggatgctccaatgtagcaccgatgatgctccagcgtcctgaggatgctacatagcaacactggcgatgctccgggatgctccaatgcagaacggatgatgctcccgcggtccgaggatgctacatagcaacaccggcgatgctccgggatgctccaatgcanaaccgatgatgctccggcggcccgaggatgctacatagcaacaccggcgatgctctgggatgctccatancaaccccg

SEQ ID NO: 68718 - DNA, 594 bp, Triticum aestivum
  unsure (1)..(594): unsure at all n locations
  Clone ID: PAT_TA_68718
accagtggncatggnaaaacttaatgccacaaattattcaggtttattggaaaataaacacactgcctggnaacaggaaaggaaagcacgaagagacacactacttgtgtcatagatcataacttacattgaataaatagaaggataaggagcactaaatgagaggcctgtaagaaatgtgagaaaattcagccaaaaactagttgaacagcagaggaagaaaccccatccatgatttgcttcagcgtgtagtccttctcctcgtccgtccatgattgttgctgggtaaccatctcccagtcccagagtcccttgccccttgcatgaccgttcttgaacatggcaacatggcgcaacgctgtgcatgctcccacgacgagattgactaggcaaatctgccttttagttccctggaaaccagcaaccacaaactccctcaagttatgcagcccaagcttgctgggctgccaggaaatttcttcaccgggcttctccttgcaggaggcaatgttgatgtgaaggctctccagggaaggtgtcatctcaagaaaaagacaaggccatgtggcatcccaggaagatggaacatccgcg

SEQ ID NO: 68719 - DNA, 682 bp, Triticum aestivum
  unsure (1)..(682): unsure at all n locations
  Clone ID: PAT_TA_68719
actgtttccacacatccatggggnactgcggatggtncatcaaaccagnttcggntgtacttaatacgaacaagtacacatgcactaacagcagcaggtccaacgtcagggcaattactgtaccaccacggcaggcggagcaccnggtggagggnggacttccttctggatgttgtagtcggcaagggtgcggtcatcctccagctgcttgccagcaaagatcaggcgctgctgntcaggggggatgccttccttgtcctggatcttggccttgacgttgncaatggngttagagntctcaacctccagagtgatgntcttgcccggtaagggtcttcacaaanatntncataccaccacggaanactcaggacaaggtganggntgtnactccttntggatnttgtantcagcaagggcnccagccntttctccagctgcttgccagcaaagatgaggcgctgctggtacnggggaatgccttccctttgncctggatcttggccttgaggttgtcgatggntgtcggaggattccacctcaagtgttatggtcttggcagtgagggtcttcacgaagatctgcatgccctcctctaggcggagaaaaaggtgaanggtggactccttctggatnttnnagtcagcaagggtcctgncatccttcgagctgcttggcngca

SEQ ID NO: 68720 - DNA, 637 bp, Triticum aestivum
  unsure (1)..(637): unsure at all n locations
  Clone ID: PAT_TA_68720
gtttcttnctgcccttgnnaatttacacgtnacggcacattcgtactctcaaacttttcccggtaaaattcacacagcacatgctgctgcatcgcgcgcacgcagctgatcatcagcaaccgacggcggcggacgggcaataaacggccagctcacaggctgggcaccctctcggcggcgccggagnatgacgtaggcctggatgaagaagcccagcatggagaacatggccagccgcccgttcttgatctccttcaccttgagcagcgccgcctggtcggggtcggtggcgaggccgagcgggtcgaatgggccaccggggtggagcttgtcgtcaaattccagcccgttggtgatcctgtagtactcggcgcctccgacgaggacgacctcggcgacgacggcgaggatgaggttgatggggatgctgttgccgaagtagttgagggtgttcccgtcaaggagcagggcgccggtcttgaaccaaactgcctcgggaccgcagtttgcgccgaacttgttgagcgcctcggggatgatgaatccggcggcgccgagcatggcccacctggcatggatgagctcaaaggcctggtacttggcgaagtcctctggcttcttgcccaggccaaaagga

SEQ ID NO: 68721 - DNA, 183 bp, Triticum aestivum
  unsure (1)..(183): unsure at all n locations
  Clone ID: PAT_TA_68721
ttgtaacctgtactgtgtcccacagcctctctgaccagttctgcaatttccttctgcagcaaggaactgaacacaccaactctagggaagtggacgtaacggtctgtgcaaatttggctggagcggatgacgtgataaatcctctagcgtcaatggaatccttncatttaggttacttccgta

SEQ ID NO: 68722 - DNA, 593 bp, Triticum aestivum
  unsure (1)..(593): unsure at all n locations
  Clone ID: PAT_TA_68722
ccaaactggngccgagtgaattcctctcctgncgagcagcttgctgcactatgtatcagtctacctccatgtcatggtaatcaagtcatcaactcgtctcatgactcaggattaggatccaccccagctgaaagatttcccagaccgtagattcagtgagaagctcaacccaaacatctccttgatggcctgtccccgctccagatgctggaccattttcgaaacgagctcagcgctctccctcacatgctccatgtcagtctgtgtccagatgaggcgcgatagctgcagcctccgttgcttagagctccggtcgatcccccacttgctgtagaggctctccttttcagcgccgctaagcttcctcaccatctgcctgtacaacatgtccctctcattccgaagactctttaaacttgatgcaacagtagcattcggctcaccatcagcaatggaagaatgcttgatgaangacagtcgcctgtgttctacctccatgtagatgtgatctgtgtggtctccattgaagaggaggaagaagtaagtcctgtgcactatggagatatgacattcatgccacagctcgatgatct

SEQ ID NO: 68723 - DNA, 653 bp, Triticum aestivum
  unsure (1)..(653): unsure at all n locations
  Clone ID: PAT_TA_68723
taagtcttgctcgancgggtatttaacgtccttgcaaggnacgacaggtataacgctcacctgtaggagtgggttttattcacctcaaccttctaatgaatgttgagggaagggcgttcccgcgcctttccaccagtaacctcagcaacagtacctgctgaagtgctcttagcatcctcaatcctgaacatcttgacctccattatggaatggttcgcaagtcgttcagcatcagaggggtccctaacaagtccatcagtgtagtgggctgctttggactcaaccccatagaagaagtcaaaggctgcaaacctctcagagaagaggaagcccttcttatcccagtttgcagggggtgaatcttccagcaacatggaattccacacgtcaggcgcgtaaaaagcgcagaaacgacgtaaagtagttacattccggatggcagtcagaagatcagttagtgaaatctccttggcagtcgaggcaagctcctcaaagttttgaacgttgctggagctggaatcggcggcacgccttgcaatctgcaaagcgaccaccggcatttcagcatcagtaacgccaatagcagtaaaggcctcggctacttcagaaagttgcccttcagaggcaacactgtcagtcatgggcttgtagtt

SEQ ID NO: 68724 - DNA, 107 bp, Triticum aestivum
  unsure (1)..(107): unsure at all n locations
  Clone ID: PAT_TA_68724
catacacaatgggcaagtgactgcataatgtcagcatcggngttctncttattacagatatacacataaatgcacgtgattacttactactngtccctcaggccacg

SEQ ID NO: 68725 - DNA, 599 bp, Triticum aestivum
  unsure (1)..(599): unsure at all n locations
  Clone ID: PAT_TA_68725
taccgcgcagncaaattttttgtacagtacgatcgtatcctatcccaccaagtgcccgccccaatcgttggcgccatcatttgatttccacgcaaataatatatcgcgcagccactccatcaagcttctggtgctactgcggcagtggcgccggcctctacgtccttgctgctgccggagcggctgtcgtcgtccttgccactctcctgcagctccatgataggcttcatcttgcggtccgtgatggcgatggcgatgtcgttggggaaaaggtcgtggtacaccaaggcgtgcaccatggtggtggcgaagaggcccgtcacggtgagcgtggccagcagagacagccccacgcacagcgccttggtgaaggcgttgtccaccacggtggcgtaccggatggacgcgatggccgctccggtcatcgggaacgtgtaggcccaccacgacagcgagaacatgaaccctctgaagaagttgatccggacggcgagcgacgcgtagaggaacatggcgatgaagtaggcgagcttggcccccacgccgaactcgtccacgatcttggcccacgccatggacgccacgctcggcgccgccac

SEQ ID NO: 68726 - DNA, 720 bp, Triticum aestivum
  Clone ID: PAT_TA_68726
tattctgcttgcacatagtacaattttttctcatagttttctcgcggatacacaagttttgcatgatacatgagtggtgagttacatagtttctcatagtatgattatttgcatatacaaatttgaatacttttctctatatagaatttacatatatagaatctactaccactttgagagcccgtggatcggtgtatgcgtcttgatccttgtacaagaagtccaacatccttgtcgaattcaccactgcctctaggagcggcgttgttggccgtgcggtggctggcttgaggagctcctcaatgatgtccatccatgactcctctatgagctccccgagctttctatatgcatcttcctttgcagtgtacttgttctcctccatgcacgcttccaccgttgacatcacagacctctcgtcagagcactgttcttgttctcgctcgtgtgaagccacatcgttgatgacacggccgatgacacaagaagctcgcatgattttaggataggtcatgccccactcgatggcatctctgctcgctcctatgataacaaaggcaaggcatgcaacatgcatgcagcaacagctaggcaccgagaatcgcaggtgctcctccacagtaacaggtgtgtcggtttcctcacgccattttgcttcattgtagtagcatttcgtagcatcgattagtagcttttttacatagtctgcatgcttgtttc

SEQ ID NO: 68727 - DNA, 632 bp, Triticum aestivum
  Clone ID: PAT_TA_68727
tgtgggttctactttgcaatccacgattcagacagttgtaaacatttgtgatcacgatagtgtggtaagtgtacatattaattatgtatcaggaaaagaatctagcattagttcccacttcattcagaaacacataaaagggctaacagacagttatatgtccacccaccactcctagctgtgacttcctgaaaggaatgggaataaaaaagacattacagcctcatgtcccttccttcttcggctgttatattcggcatgttcttacctgaaactttttaggactgaatttcagcttgtatctagacaagttgtgggaaagtcccaagctcctcggaccaaggtcctgtgtgcccaaccaagatataagctcactaagctgatttatgagccctctcattagctccatcacatcactattgtgaacgcagccaattttctgtagatgggctggtgaaggtgaagtcgctggcaagatggtgaggtcgccggcaaggagacccagctcttcccgaagacaccggctcccatgtgctgctgggatggggggcgccaaatccacagaacgccaccctcgctggatgtggccaccccatgctaccaacaccatggtctacatacccaattgatta

SEQ ID NO: 68728 - DNA, 254 bp, Triticum aestivum
  Clone ID: PAT_TA_68728
tacaacatagaccaaaacaaatatatatataatataaaaaggattcaaacaagttatatcagttttgattcttcgtatggtttttcaataaacatatacacacatgtatacatatgaatacataacacagtatgcaaagatatatatacatatgcacatatgttaagaatggcttattacaggaaacaaccaacaaaacatttgtaaccaccaagtttaaatagggatcccatcaggttcccaaatggctccca

SEQ ID NO: 68729 - DNA, 618 bp, Triticum aestivum
  Clone ID: PAT_TA_68729
taattctgttcttacagcgaacgaagcatcggcaaacattcagcaactcccatcaagcactagcactacttctacttggtgataaccagggcgaacagctatttagatacaggcaatggaatctaagaggaggtgaacttggtgactgccttggtgccctcggagacggcgtgcttggcgagctccccagggaggacgaggcggacggaggtctggatctcccgggaggtgatggtgggcttcttgttgtagcgggcgagcttggcggcctcgccggcgagcttctcgaagatgtcgttgatgaaggagttcatgatggacatggccttggaggagatgccgatgtcggggtgcacctgcttcagcaccttgaagatgtagatcttgtaggtctccacgctcttcttgcccttcttccggcccctcttctcgccgccgccctccttggaggcggtcttcttgcccgccggcagccgcttctcggccttgggcttcttcccggcaggggtcttctcggccttctccgccgcgggctcctcctccgcgggcttcttcgccgccggcttcttctccgccttgggggccatcgctgctccgggaagatgggtggggattggg

SEQ ID NO: 68730 - DNA, 704 bp, Triticum aestivum
  Clone ID: PAT_TA_68730
gctttgattaaaaatggagtgattcggctccgaaacagtgaaggacaatgtacaagttgtcaccaacttagttggttacatggaacaatcatagagaccctcaggaccatgctgaactgacagctgacagcatatctgaaacgacttagcacacccaacattactgatcagcacctcagaattggtttggtttcatctctacttttcacttttcaggacttgcactggccaggaactccaagacgcacttcttcagctcctggaactctgcttcagacagggacgcttcaaccaaaaacccgcatagtgttgccgcagatgcttcgtcgtagtccttcctcctcttcagaaccagatggccgctgagctcccacaccgctgggttgattctcatgtcgaggaattcctggctcgccttcccggaagcctgcttctcagcgtagcactgtagtagaaggaataatctcttgccagattcagagataaggacattgaaagggtctgttattctcttgcaagaagatgcatgcatctgagacgacctgtgacagatcctccaggctcgctcccccttcaaatgcaaagccgcttactgggtaccgcaccagctgagaaatgctgacaccgttccctacgactgtgagctttttctgttggcgccttttcgactgggatactgcactttcagatagtatgcttggaat

SEQ ID NO: 68731 - DNA, 609 bp, Triticum aestivum
  Clone ID: PAT_TA_68731
ctacacatatatatatatagcccgcgaaggggtgcgtccgaagggacaaccgcctcgattaggaaaagcagggattaataggactaattaaatcctaacatatacatcaccacacaggttctgagaacagctactacaaccctctcttattcaactattcaagttgggcataactttactaccaggacatagatgtggcgggcattctatatcactcatgccatcagacgacacgcatcagaagatccaaagatagtaatctctgccttgataatgcagcacgattctacaagatagcctctctctggattcatgaatgtctcaagtggaatgaagtcagaccacccccagtgggatttaccagcaaacaccacgagacctgggcatttcctgatgaagtgttttccatgtttttggtccaatatggataaagttaattcaaccaacttcccatacttatgagggagcttctctgagccatcaaggtgcaagtacaaggagaggcaattatttgctgtactggttacctcgcggatagacgccaaagtaccagttttgtccatcaagttcaaaatcttgaacaaacgaatttcatcatgctcatttcaa

SEQ ID NO: 68732 - DNA, 659 bp, Triticum aestivum
  Clone ID: PAT_TA_68732
atgctatgactatttatatggttctcatgcattgtgcagcaacattctctatatgtgtaacaactacaaccacttcgcagactctggtatctcctttccttacttgcagttcttccacttctcttgcacaacatgagaatgcttctgtccaaaccaaaaacagacaaaaaaaacagagataccatctacaatcctacatttaccaatacatcagtccattgcatttcgatttcatatgatacaaatacatcgagtgagagaaaacacatatagataggcagtcagggacagtgatggaggcttggtgcaaaccctccagtgtgtcagatgaagcacgggcaatgaaggtgctgcatgttgctgaagcgcggtccaggaggaggcagtggccgcagcggaaggctgtcgcaaggagggtcgaggaagagctagtggtggtgcgcactgatgcttctactccgacatcggccatctgcaacgtactttatttttattgaatcaagaacagtattctgaatgtactttattttactctcacaatgtatgaaacttttagacaattgatcaaatacattgtcaaggaggacataaaaatagtatgaattaacttgcttaataaaatggcaaggattacatcttactgggtatgcttttctttt

SEQ ID NO: 68733 - DNA, 124 bp, Triticum aestivum
  unsure (1)..(124): unsure at all n locations
  Clone ID: PAT_TA_68733
atcagcgcccacctnctctgctcccgcgttcttgtggctnttggtgccagatggttccgagctggccccagccactgnggngtcctgcttgctccctccaggtgctgctgntggctggaggtcg

SEQ ID NO: 68734 - DNA, 641 bp, Triticum aestivum
  unsure (1)..(641): unsure at all n locations
  Clone ID: PAT_TA_68734
aaacggcaaacaatngctaattacagcatgcagcacccctatatcaggaaaaggcacacatttggcatcgcattttccgcggtaacacggtaaatagagcagtgttacagcagagcaagtatcatcacgcgaacagaaaacgctacagagttggggagaggcaaaaatcaacagttaggggcggaggtacctcactaggtgctgttagtcaaaatctacaagggcctcctcaagcaggtcctccagaaccaccgtgcagaccatggcgcagacctcaaacgtctccagccgagtcgtgtcggcggtggcggtggcggtctccaccacctccctcttgaggatcatctccagaagaaggttcctctcgatgacttcaccgggtggatacttgtcgagtatcgaccagttccttatgacccgccaaatttcatcggccgcggagttacaggaggaatcatcatcgtgatctttgcgttgcgaacgacatgtccgaccccatgggtaagcggacaattccgctgtccaagtgagcttcgtgagcgcctcgttgatggcatcaaagagaagcctctctttcgaccgcctttccctcgacttgatctccactgcttggtgatccgacaacttctcaagcaacttca

SEQ ID NO: 68735 - DNA, 137 bp, Triticum aestivum
  unsure (1)..(137): unsure at all n locations
  Clone ID: PAT_TA_68735
anatgaacatgtgtcaaaagttggaatatgcangtaagagcctgggacatattatgagngggaactgccatcngcattgactcttgcttcttatggtggaacattcctgngatgctggncagcatgaagctcttacg

SEQ ID NO: 68736 - DNA, 572 bp, Triticum aestivum
  unsure (1)..(572): unsure at all n locations
  Clone ID: PAT_TA_68736
ancttgtgtcggcatataatttagtaaatagttccaatacaaatatgaaaattgagaagcataaatagccaggttccccaaccaatcaagacgctctagcaactcatcatcaatgccctcaacatgaacaacacaaagaacacctacactgctgtcaaggctttacgatgcattcatgaacaagcagaagccaccctcaacatgaactacaggacattcacagtttcatacctgcctgaaaataaaatatttctttccttcaagaaatttaatcaaattctccttcttagttgccttcatgaacaagcagaagccaccctcaaacacgtcctgcaaactgaaacgtgggtggagacagaggcgatatgaagcagacaactcctatccttattattgatgttgtcggaggcctacgggatcataaacgactctaagaccttgttcggtcgatggctcgatgctccccgatgcagtcttccacaacccaccttttggtgccaccgatccagcgatgcctgatcccggccgcgaagccgagccgtangagccattgtactccacattgtataaca

SEQ ID NO: 68737 - DNA, 284 bp, Triticum aestivum
  unsure (1)..(284): unsure at all n locations
  Clone ID: PAT_TA_68737
tcggtagtacataccagcaagcgtcccaataacaatatggcacaatgaccaagtgagctgagaacagcatcagntaaaacatcaaacataaaattactttgccttcctggctcatcctgacatgcctgcctaacacggcattcagcatgtgacatcctccatctccaattatcataccaaaccatggcatcttntagcatgtacaggatcacgcatataaagatcagctgcattcctatgttatggtccatacaaaaaactactccctccgtcccataantaaa

SEQ ID NO: 68738 - DNA, 348 bp, Triticum aestivum
  unsure (1)..(348): unsure at all n locations
  Clone ID: PAT_TA_68738
actacaccacttgaatctgcttgtgcagagattcttttcttgngtgcttgaacatctccagggaatttttcgacggnaccntgatcacatntccaaagactagngcaanctgtttgcaacatggtntcatcgtgactcaccatcaaaactccaccctggaactgccgaagggccgtacttaaagcatccatggnttcaatatctaggtggtttgacggttcgtcgagaactaagatgtgcggattttggagggataagcaagcaaatgcaacgcnagatttctgtcctccanataagagttccatctttnggagcccagtcatacctgtaatgccaaatgcacctaag

SEQ ID NO: 68739 - DNA, 615 bp, Triticum aestivum
  Clone ID: PAT_TA_68739
catgatgaaaaagaatacaaacatctagtatacatccgaacaaaccaggatgtatgtatcatgtgacaccgtgtcacgtcatcgacatcatactcgatgatgatctcctggtaataaaattcaccagtgattcagaaataatcaatcctaggttgctatctacacaacaacaacttacacaccataattaattaatcctaaatgcatctgtatgcatcttgggtggagaggcctgggataaaagagcttccattttctaaagaaatgtaaaaaatgcacgctactccatccattctcctttggttaacttgcgaaaaaaacgaagccaaccaaatgaaggggatgggatgaaatgaatatctatatacagtagttaatcgatgcggtgatgagccaatgatgatcaactcaaattatgggtgtatattttgtatgcatggagttatggctagcaagctgcggatttggtggcgaagaagctgcgtttggtggcagggcggtcggcggcgtgggcaggcggtgcaccggtgcaggaagggcaaacggaggccgccgtggcggcggacggaatgaagaaagcggcggctgggtggtggtgttggtggtggtggaggg

SEQ ID NO: 68740 - DNA, 540 bp, Triticum aestivum
  Clone ID: PAT_TA_68740
tagattgtgcaattcagtgatacattggatacattttaagaaaggtggccgcagccttaacatgttgggaattatcacattacaaaagcaaagcaattcagacaactcacgtcaaccatcataactcagaactgagaagtaacgaaacagattattgaatcacgtaaactactgaataaaaatattaccaattagacatcctaatccttgacgatgtatctgtgtgtagtgattttacaaggtgataaacgtacaaaaatggtcaacttttaaattggcacaattatttatctaagtaagattgcaacacaaatcaaagaatgactgttattcgaacaatctgccttattttgttttcactgccgaccaccagttatttgctctttcaatataaggatgctcttcctttgctcctctggtagcatagcaatttgctctggagttaactgtaatacttgcatgatcaaagcagcctttttcttgatcaggattatttgacaaatcagggatatttccaccaagaggaggaggagggccagg

SEQ ID NO: 68741 - DNA, 602 bp, Triticum aestivum
  unsure (1)..(602): unsure at all n locations
  Clone ID: PAT_TA_68741
tgtgatggtcgaatcttacatcagnactatagatctnctcagtcctaaccgaaacagtatttcagaaactaagctagtagctaagtacaaagagcaaactgacgggtgattcccattgatggggccatgcaactagcattgtagttgtgacagtgcccagcaatggagctcaagaacgccttctcgacctcctcggaggcctctttcctgaccaggcacaagacatactcccatcaccgtggcgtcgcagggcagcatgatcctgcctccgtcgccgccactcgtgaagccaaactcctcctcggacatcctcaggagctcagcgaacaccgtcgtcccgaggtatgccagagggacctcgaaccgtgctccatcggtggtgtacatcacgcagtggccctcatcagcagccacagatgctgtactgcagcattcatcatcggctgaggcatgccgacggcgggcaccggctccagctgccaacatccgttggcacttcttgacgagctgagcaagcttctttggatggatcatagctggctaaatttcactttggctctggaagtctgaatgtgtgttgtagattgtttttttttttacta

SEQ ID NO: 68742 - DNA, 298 bp, Triticum aestivum
  unsure (1)..(298): unsure at all n locations
  Clone ID: PAT_TA_68742
ctacctaacaacatnanggcgataccaaacagctgtgcagcagcagcaacgcgcgaacctaaagcagccaccanccaaaccctaccgccggacctncgctccctcgacgacccttcctctgaaaaaataccggnagggttcgatnggaacggagccgggatttgatccggcaagctcgccgncggatccatccggacaccaaccatccacagataaaatncttccgtccttcagncagggagagttattaccaccaccacctattcttnttgttnnttccgacnagatgaggcgagac

SEQ ID NO: 68743 - DNA, 497 bp, Triticum aestivum
  unsure (1)..(497): unsure at all n locations
  Clone ID: PAT_TA_68743
tactacgtacaaggtactccaaataaaattgctcatactgctaaaaccctcactaactgttcaggtggatccgatgatccaactcattgtgaatgtgaatnctcaagcccaattattacaatcctattattgaccgatgatggtcaaatgtgcaaatgatgacagccaacaaatctgaaagttactagaacccgacccattttaatcacccgcttccagcagttttcaatccactaacagaccattccatccgtgcagcancttgttaacaaagataagaattgtttttggcactttcctactcattaacttagggtatatttggtttggagcccanggttgcaaaaaaactagtaacgctgactgtatttgatagccatgttgtctggggcctcagcagtctgcggtggctgagtgctaaatgctggtccaccttgacgagaagatccaagctgatcatgctcatttcctatgtggccatagtgtgggagactntg

SEQ ID NO: 68744 - DNA, 105 bp, Triticum aestivum
  unsure (1)..(105): unsure at all n locations
  Clone ID: PAT_TA_68744
gttgaccactttcttcagacttgatgtggagcgtcttcaacgttgggaaagcatctgaggacagtcggaatcatcttgacatcattgcggcctncacaacgcact

SEQ ID NO: 68745 - DNA, 123 bp, Triticum aestivum
  unsure (1)..(123): unsure at all n locations
  Clone ID: PAT_TA_68745
ttaacttcagatatatntttaagccacacatatatcttcaaccgangcannnaaaccacatacatatacatgatgtatcttagnaagaacccattcatcttcaactacatacatcaactgtat

SEQ ID NO: 68746 - DNA, 690 bp, Triticum aestivum
  Clone ID: PAT_TA_68746
gctgaaaaattgaaaggtttgaactatgaaaaggcatgtacttagcatgaaaaaaaacattagaactaatacagtactactacgataattgaaccaactaatgcatagatcttccatggaacctgcacgattttttttggatatcactgtgaccacgaactaaatgattgatccacgtccatgtcttcttctcctcagtaggggaagccgtgattcgcccgagctactgctgggacatgtccatcctggcggggaactccggcaccgtcggcagcatggccatcagcatcagctctatctccatcccggcggagaaccagtgccgccatgtgcatcccggcggcggcagtatcaccatctgcatcttcgtgccggcagcgaacacctgtgctggatgcatcgccatctgcatctggtgaatgcttgcatgtgctgctgctaccgaactcaaggatgtagaatttttgagcatatgcacccggcccttgttatcctggctactccaatgttgcgttgagatctgtgctacacaactaactaactacatgaaaatttctctttttttgtttctgtcatataaaacatgtattaaactttaaaatttgtggcagaacaaaactttttacctagaatgtgggatgaaactttctgatttttttgctacaacataaatactaaaaaaatgatttt

SEQ ID NO: 68747 - DNA, 591 bp, Triticum aestivum
  Clone ID: PAT_TA_68747
gttgtagacttagacgtgagataactaaatttcatctagatgtgacttagcaaatccgtttgcaaaagggtcgtcagcagaaaaaccggatcctattttgaagctccgaatggaacctacttcaggatcagaaggtacagtgaccagcactgtagaggtttcactggcccgtttcactgaccccagactcgacagtttggactgcgcctcttccgtcgtcgaagagaagccaacggcgaacagaatcaccaccttcttcagcaccaatgcggtctcaaagaagtatttgaggaaggcgatctcagctcgcccccctcggaaatcatggaaaaccagcagcttgatgcgcgaccgaatgcactctatcacaccacactcatgccagaactttaggttcagcttgccagtggaccgatcggttttcgcagacttgatgtggagcgtctcaacattcggaaagcacctgaggacattgggaaccatcttggcatggttgcggactccgaaacgcacctccaaagccagtatccccacacttggtaccatggtgctcgggctcacccttgccccagccttgatgatggtgttgcc

SEQ ID NO: 68748 - DNA, 526 bp, Triticum aestivum
  unsure (1)..(526): unsure at all n locations
  Clone ID: PAT_TA_68748
aaacttgctgatnggcaataatttggagaaattgtgggcattgaaattgccaaagctgggcaaaaaaactcccagggaagacgacaacaaaggtaatcaaggcaaaacataccattaaatctgccaacatccttggttgttctagaactagtgtatttccctttatgtacctaccccttgatctactgcttgcaaaatttgcccctgtactgaattgttgttgcagaacctgacatgaatcttgtccccctgttcttgcctcccccctacacctgcagaactgaaaatattgttggcatgaaggaaaactactgcctcttgaaaacacatcatgtttattggcttgcacgttgcttctcgccattctgttgatctgggtagtcatccatcataaaaactaccactcgagggttactgaaaaagatgccctcccccgtagtttttcacttttggtttttgccttggggcgttgaatcagcaggatatcgcgtctccggggcatccgtcgcttcgcgcagagcttcgc

SEQ ID NO: 68749 - DNA, 630 bp, Triticum aestivum
  unsure (1)..(630): unsure at all n locations
  Clone ID: PAT_TA_68749
cttacttattgtaaanaatgacacatacaacaaaacatgaagaagtgaccggtcatatttccaccatttggtttgatcactgatatgcagtgtaccttgtcagcaccaacatgagtggagtcttctttcgaatggtcagagccccttcctcctccatgcttagatcctcaatattcattccaggtggaagctcccagttgaagcagtacaatatgttggccaggatgaattccacgttggccacacccatgtccattcctgggcagatgcgccgtcccgagccaaacggcaatagctcgaaatgtgccccattgaagtctatatccgtgtcctcaaaacgttcagggtaaaactcctccggatccttccagacattgggatccctggcaatagcccatgcatttacaataacccttgtcttggctgggatgtcgtatcctgcaatctgaatcttccgtaaggtctcccttggaaccagcaaagccgccgggatacgtagccgnagggtctncttgacaaccattcttaagtaggttagcttggacatgtcttcgctttgcactctctctttcctccctaccgcagttctgatttcttcttgtacccttcttgagcacccttgggtgccga

SEQ ID NO: 68750 - DNA, 146 bp, Triticum aestivum
  unsure (1)..(146): unsure at all n locations
  Clone ID: PAT_TA_68750
acaacatacttaaaacagattgtggtcagaaaataaagctcggatgaagttgaatgtgccggtgctgctgctggcgctnaccccgcctcggttttcacttcttttttnccgccaaacgccttcnntccaccatatntaatancgcc

SEQ ID NO: 68751 - DNA, 615 bp, Triticum aestivum
  Clone ID: PAT_TA_68751
gacttgagaaatggaattccgaaaattcagaccgctctttacactctctgtgcatgcaacaaatgtatcagaaaacagaacttcttcatctacactgttaggccaggtgaagaaggtttcaacaagtccctacagaaagaaggttttaacaagtcttgttaaaaccatctacctgccgaaactattttcttgatctggtcaccggagagagttccatgctgcaggagggcgttggcgaggacatggagctccctgctgtgcgccgtgagaatcgtttttgcgttactgtaagccttgtccaataatgccttcacctcctcatcgaccagggccgccattgacccgctcatggtcgccgcgcgcccaccatcgtcgtaggaaagaaggccgacccgtttgctcatgccatacttggtgaccatgtccatcgccaactgagtcgcctggctgagatcagagaaggggccgctggtgaccccggtctctccaactaagagctcctcggccacccgcccacccatgaggacatccagtctcgccagcatctgcttcctcgactgttcgagctcgccatcttctcccggcaggttgtgtcaccatgccaagtgagtttcc

SEQ ID NO: 68752 - DNA, 262 bp, Triticum aestivum
  unsure (1)..(262): unsure at all n locations
  Clone ID: PAT_TA_68752
acaaaacagccgacatgcaacatgacaactgaatcaacaaacaacacaaacatatcgatctccaaatgtcgtngcgcgtgacgcctccttgctgtaatgccactccatgggcaagtgagcgagccgccgctgcatgtgtcgcggcagggcaggtcagttcttgggcttgtcctcctccccgagcggcgggcacggnttcttcttgtgcatcatcttcttcatnttggggtgcttgnggaagaacggcttcgggtcgtcctcg

SEQ ID NO: 68753 - DNA, 575 bp, Triticum aestivum
  unsure (1)..(575): unsure at all n locations
  Clone ID: PAT_TA_68753
gcggcacacccacaatgttaattttgtttagtataagcgcacccatgaaaactgttgaaatcagtaaggaagaaaggaaagaaatatccacagaggaggaaggggaagggagtctgtccagcaccacgtcgtcctttcgccggcgctgccgcataaggaagaggaataacagccacacccccagcacggcatctggccggagcacatcaagaggaccgacaggagacgaaacatctgcagcccgcctgcctgacatggagactagcaccagcaggccactcgggaggccgctgcccaagtcagctaccaaccccgcgcacaccagtgcagcatgccacagcccctagcacagtcgtgccggcgccccatgctctccaatggatcctcgttaagggatttagattgtactcattccaattaccagacactaatgcgcccggtattgttatttattgtcactacctccccgtgtcaggattgggtaatttgcgcgcctgctgccttncttggatgtggtagcccgnttctcaggctccctctncggaatcgaaccctaattctncgtcacccgtcac

SEQ ID NO: 68754 - DNA, 372 bp, Triticum aestivum
  Clone ID: PAT_TA_68754
agcaactactcatttacatctttcttcctcttcttctttctcctcctctttttcaatatatgtaaaatgtacaacccaaaaagcctccgagcaccaccatgaatggcatcatccgtgctcgggggcctcccagcttttctttacggtacaagacttaccccacaggccacaaatgacggccccaacattcacaattttaaaaatttacatgcctatatatccatatgaatcatgtcttcttcttctgctgttgtattgataatcatgaggactctgttcagttgctcttgatgagcagcaggccgatgccggtgacgatgagcgtcgccgggaagccgaactggaggtggctgaagaaggagagggtatacc

SEQ ID NO: 68755 - DNA, 476 bp, Triticum aestivum
  unsure (1)..(476): unsure at all n locations
  Clone ID: PAT_TA_68755
ggccgccggnacgcagntccagcggcccaannagtccacctaaaaccctcctaaaccaaccacggagnatctcatcggacggaccaggggaagacacgacacacgactctcttatttagatcgacgacacgacacgggacacacggggcgatgacgacgacggcgaccggcgggcgggcggatctagagctggccgcagtcggcgatgacgacctgcttggagcaggtgccgctgcgggagcccaccttctcgatgttcttgacgacgtccatgccctcgacgacctcgccgaagaccacgtgcttgccgtcgagccaattgcaggggacggtgcagatgaagaactgggagccgttggtgttgggcccggcgttggccatggagaggatcccgggcttggtgtgcttgtggacgaacttctcgtcggcgaacttctcgccgtagatggactcgccttccggtgccgttgcccctg

SEQ ID NO: 68756 - DNA, 488 bp, Triticum aestivum
  unsure (1)..(488): unsure at all n locations
  Clone ID: PAT_TA_68756
gcataattgttgntaaggtacattgttactgggnaaagnaaaactaaggccgctccatgngcattccacctttttgttgttctcaacaccacagnaccattaaccatagtccagttgtttcctcataaacaatggagacataccaaatatgttagnatctattcatttcctttcttttttgagtgagaatctattcatttcctagaggggaacacaactacatgaaagggtgcaaacagtcacacccaaagcttagagcatgaccgttggaggggcaaaactangagctataagattttcattcttctcctcaaccacagctttcaccagatgtcagcaaggagaggctaatgtgcaaaagatcctgtaatacaatgaatcggattagaaccacaaattttaattgtttttctaaataagaactggtactgagtggcagatagcagaggtagcatacctatacacctaatagttacaatattccgcca

SEQ ID NO: 68757 - DNA, 545 bp, Triticum aestivum
  unsure (1)..(545): unsure at all n locations
  Clone ID: PAT_TA_68757
agtgtcaagcactactcaaatctgaacattacaaagcataacacatctcagcttacagnaaaattcagagnaaagataatgagggaaacagcagtagtaggggttcagaaaagtacaacaacaaggttaggagaagaggggaattagggagaaggtgcagcagcagttttgaggagaagaaagcagcagaggcgtggcaaagaagaggaacagcagcagcgtgaggggcttagagaatagcagcagcagagattgaggagaggagcagctggttcgagttgagaagtggaggagcagcagcaaggcgagggaagaaggagcagcagcaaggcgagggaagaaggagcagcagcaaggcgtaggagaagaagaagagcagcatgggcgcgaggtgcgagaagcactgtggtgctggtggcggcggtgtggatggagtggtggcaagaggcgatggtggtgctggtgaatggatggcgcagcggcgctgatgtggatggtatctgatcgtcttcgagcccccaactttcgttcttgattaatgaaaa

SEQ ID NO: 68758 - DNA, 475 bp, Triticum aestivum
  unsure (1)..(475): unsure at all n locations
  Clone ID: PAT_TA_68758
tactaagtaaaaccaagtataacagtaagnaagnaagnacgccaatgagtaattggaatgtatcaagtcctgaaaaatcatcttaggtgttttacagttagtcagcggacacatgaccaccgacacagcactacccattttataatcaattgtttcgtctaagcaccatcagctgctcattacggacagtccaagagcattaaagcaacncattgaagcaaagcggcaacaagctaagtcttcggctgatctccagcagcagaggtggcaaggtggcgtcggtgagggtcaagtcaagcctgacgaacgtgtccttcaggttgtacggcgtgtgtcgttcctgtgtgccggcacgccaaagagttcccgcccatctcgctgctggtcgtacatagggtggtgggaggacatcgctgcgagccacccgtggtggtcggtggtgaccctggttgcttgagacaccaaagtgcctgtc

SEQ ID NO: 68759 - DNA, 512 bp, Triticum aestivum
  Clone ID: PAT_TA_68759
atagcggagttcatctcattcaaacggtaagatagcagcagacacaggaagataaccaaggccgccggacgcagatccagcggcccaaagagtccacctaaaaccctcctaaaccaaccacggagatctcatcggacggaccaggggaagacacgacacacgactctcttatttagatcgacgacacgacacgggacacacggggcgatgacgacgacggcgaccggcgggcgggcggatctagagctggccgcagtcggcgatgacgacctgcttggagcaggtgccgctgcgggagcccaccttctcgatgttcttgacgacgtccatgccctcgacgacctcgccgaagaccacgtgcttgccgtcgagccaattgcaggggacggtgcagatgaagaactgggagccgttggtgttgggcccggcgttggccatggagaggatcccgggcttggtgtgcttgtggacgaacttctcgtcggcgaacttctcgccgtagatggactcgc

SEQ ID NO: 68760 - DNA, 358 bp, Triticum aestivum
  unsure (1)..(358): unsure at all n locations
  Clone ID: PAT_TA_68760
ttgcctatgtgaagggggggctgtctatatgacacaagagcaactagtntagatcaaaaaacacattcacagaggaaaggaggaagaagaaagtcactactgtggcaacacanattaaatcaaaacatgcaacattaatatgcaatttcaaaatagtactacatcttgagtactgcctgactggcagttggccctaaaacatgctttttgaaaaggaatacccctcttgttcttaaaacaagaacggtgtggtttaaataattaagaaaaggtccaggtaagcaaaataaattctcgcagttgacgcaaaagagactgagggtttaccttcgcgcttgcccaaaattgagcaaaatca

SEQ ID NO: 68761 - DNA, 735 bp, Triticum aestivum
  Clone ID: PAT_TA_68761
cacaaatatttagtatctttcttaccgagaacaagcacacggtgtggccgctcatgtgtcacaaaaagagaacactctcttccttgaagggcagtaagccagataaacaggtcactgcaaatccttattcgggaaaaagtggaggggggaaacatccatcagcagggccgggcctcctgcttctaaatacatatcctggctaacagacagtaaaaagcacaacaggttgaccacgaaaaggttaaaattgcaggttgcttgtaaagaggaagtttcttatcaagcgttctccttggcaatcttctcagccttggcaatgacctcctctattcctccaaccatgtagaatgcctgctctgaaaggtcatcgtatttcccatccagaacaccctggaaactttgaacaccctccttaagctcaacatactttccaggtgcgcctgtgaaaacttcagcaacatggaaaggttggctaaggaaccgctgaattttcctagcgcgagcgactgttaacttgtcgtcctcactgagctcatccattcccaaaatggcaataatatcttgaagattcttgtaattctgaagaaccttctgaacaccacgagcagtgttgtagtgagcctcgccaagaacatgaggagacaacattcttggatgtggaatccaaaggatcgacagcaggataaataccgagctcggaaatctgtcgtgagagcaccggtggtagcatcaaga

SEQ ID NO: 68762 - DNA, 560 bp, Triticum aestivum
  unsure (1)..(560): unsure at all n locations
  Clone ID: PAT_TA_68762
taaaacttttgccctnccttcnttaaatggctagatctactaaaagattttttaacattcattcctttcgttattttttnactggtttctcttgctgcggcatcatatattttcctacttgggttgagctgatcataaactttcctggtagcctgaccagactattgaatgcttgaaacggaaaaattaaagtcgttgcggcccatttgataattgcagtagttaactgatgggtatgtatccgctgacttgtagtagcttttgcagcaatagcagcaatagaaatggtatcttgcagtcgagattcaagttcttgaagccttgactcagtttgtatcgtttgtatggaagcccgtttttcgtatcgacggacggcacgattaagggtatcaatctcggagtgtagactttttctaatctcactactgattaaatttaattgtttctcaataacggtaaattcagaactcgttttgtgaagagtgaggtttcgtgcttcaacttcctcaagtcttcgggaaatttccttgattgtcttcaatgtaacatcttttctgtaa

SEQ ID NO: 68763 - DNA, 628 bp, Triticum aestivum
  Clone ID: PAT_TA_68763
atgaaataccttaacgtgacaattacaggcatggagtagacacaacaggcaatgtttctctgggtagcgcaaagcaatgctagtatcgatcgcagccatggagcatttcatctcggtgaaaaaccgcactactgactgaggggcacgcactcgagcttgatctcaagctccccgtgctcgacgttctgaagcctcaatgcaatctcctgctccaccttaccatcgacgatcgagataatgctgtccttggctagaatgctgttctcgcttgccaagaatgtgcatatctgtgtcgattctgtgatgatggagctctggtactctcttgctgcagagatcaatggctggatatcaacttcagcctctcccattcggtcgtcagaggtgaatgtgtccttgtcgaacacttgcactttaagaggcggcaccggttcagggattgatagcatcaatctttcattccatatagggttcagtgtgttctttatcacctttgttttcatggattggtgtcctagcataatcatgacatatggatcacttgacatcacatcacgaacagctaaatctgtgccccttatgatgtcgaccttaattaatccaacgaactctaccatgcccacatcca

SEQ ID NO: 68764 - DNA, 624 bp, Triticum aestivum
  unsure (1)..(624): unsure at all n locations
  Clone ID: PAT_TA_68764
gtgaatcgtgtatgtgcatttatatatacatnaccctcactacagtcaatgtagcaggatactgttctagaaacgtccatcgatcacatctgagcgcagacatggggaggggaagctgagatcaagctaccaccgcacgccggccggtccaacacaacacccgcgagcgagagcgaccaaagtttgaaactcgcgccgcatcgcacagtctgaaccgcgctccctccctacgaccctacccaaaccaagatcgaacgggcatcacctgcatgcgctcgggtcgatcatccgtcacacggcctcgaactccctcccatgaggtcagccggcaacgctgtagcgcgccgtggtgacgtcggtcacgaccgactccgagtcttccgccaccttcttgcttccctgaaacctcccgccaccgaagatgttgtgccgcggctgctggtgcgccgcgccatccacgccatcggcggtaggattgtatatgtcgccgaagttggaggagccgatgctggtgcgcttgacgctgtatccagctccgaggtcaaagctcggcttgcccatgtcgaagctgaggctggcttgggtgttgaagctcttcttggacgacgacagcatgccgaagga

SEQ ID NO: 68765 - DNA, 188 bp, Triticum aestivum
  unsure (1)..(188): unsure at all n locations
  Clone ID: PAT_TA_68765
gcatgcacacgcggtacgattcgcggctgcatgaaacgaatacaangaaggaagcntgcatcaggaaaaccgctcgccgagcgagtcaaggcctagatgcctgcggnttaattacatccccntttccttgccgattttctatggcaagattgtnatcaaaacctttgntcaataaagctcattgatnc

SEQ ID NO: 68766 - DNA, 765 bp, Triticum aestivum
  unsure (1)..(765): unsure at all n locations
  Clone ID: PAT_TA_68766
tccttggtgtntgtctggcctgaactcgcagcacaaatcgagcaaattttcgataagagacaagcagatgtacatgggcgtgcatgtgataaatttgcatccccaatttctctgtagagatcagtagtatcaaagaaatttacaccaacaataagtagtaacagcgccgaccagtccagcccttcccttccccacgttgtagttctccttcgtccccgatgctcttcctccttggcgccggactccttccttcccatcctagtccactacgtgtgcatgcttcgaccaggctaccacctgcaactctgatgctctttggtaagattttcatcatcctgcaaatgaacagaggatacattcagtttgatgcatatacctaacaatagatgaaggaatcccaagtgcaaaataagagggggaaataatttcaaaaggccaacaaggcacacctcacaatttatagaacacggaagagcaaagcactacccgaggaagataatgttccctcatataagtacttcatgtaaggttgcaaaaggtgggtcagaaagcttctgggaattatcgaaactttattatttaatttaagtaactttaacttgatttaatttgatcaagcagtataaaaatgtcgtgttgagtatgaagtgtacatttgaatccctcatttcaaaagtaattttatataatgaatcatatcatggaagttttgcacctttagtgacctatctgaatccaaccatatattaaaatgttacccatatc

SEQ ID NO: 68767 - DNA, 148 bp, Triticum aestivum
  unsure (1)..(148): unsure at all n locations
  Clone ID: PAT_TA_68767
tctatttgcactaatggaatgaangaatggatggagggataaatgattaatcaatgnacgcatcactcanaatccagtaaccctttccagaggccagcatatntagctgcccgattatccttcagtagggccggcatatttgnntagc

SEQ ID NO: 68768 - DNA, 217 bp, Triticum aestivum
  unsure (1)..(217): unsure at all n locations
  Clone ID: PAT_TA_68768
caccattgntacaggatgacactgnacagaacacacacagntngctacaganctcatnagacagggaacaggaaagaaacacangaactaatgcacgaggagcctaggncgaggngaacttggtgacggccttggtgccctnggagacggcgtgcttggcgagctcgccagggaggacgaggcggacttnctaacgtcnncgnnaaccgccacatnc

SEQ ID NO: 68769 - DNA, 493 bp, Triticum aestivum
  unsure (1)..(493): unsure at all n locations
  Clone ID: PAT_TA_68769
tatttttttaaaacccaagacagcacaattcttacaaaggttgnaacatcgtactgatgccgccatcagttgatgaagcggcgatcaatcctagctgcctaggaggaggtgaacttggtgacggccttggtgccctcggagacggcgtgcttggcgagctccccggggaggacgaggcggacggaggtctggatctcccgggacgtgatggtgggcttcttgttgtagcgggcgagcttggccgactccccggcgagcttctcgaagatgtcgttgatgaaggagttcatgatggacatggccttggaggagatgcccacgtccgggtgcacctgcttcagcaccttgaagatgtagatcttgtacgtctccacgctcttnttcgccttgctgcccttcttcctgccccgctgcttcgcctcgccgccggcctccttggacgccggngcccgcttctccgccttgggcttnttccccgccgtcgtnttctccg

SEQ ID NO: 68770 - DNA, 667 bp, Triticum aestivum
  unsure (1)..(667): unsure at all n locations
  Clone ID: PAT_TA_68770
tttttttttnttncctttttctctttgcacgcatgcacgtacgaactgattggtacgctagctcttctagcgtatggcttaggtgccgctcactcctcaagtaccggcgacgatggccggtagaggtcgtagggcgcccagaggtagtcgacggtgcacggccgccgggcatcgagacggtgccagggctttcccttgccgntccagtgcagcaggctgatgggtcccgggtgcaggccccggcaccgccctttgacattgtcgccgcctagcccgtgctggttccaccggtggtccacggcctggatatccccggcgagcaccagaaggaacggcggcagagagccgaggtggtagattctcttctgcttctgcacggccatccacccttccacccgcctcgtgtacccgccggtgcgccactggtccacgtccatcaccatcacgccggtgttgaagtagcacgggcgccgcccgtggaatgttccgctgagcgcccggtccatccaaaatgtgtccgtgaagtagttggtgaagttggcgtggcagtactccggtgcgcccaccacgtggcccgcgaggtccacagagaagagtgtgcggatgtcgtcggcgacgatcacgtcggagtcgaggtagataacccggcgcacatcanggggaagcg

SEQ ID NO: 68771 - DNA, 126 bp, Triticum aestivum
  unsure (1)..(126): unsure at all n locations
  Clone ID: PAT_TA_68771
atatatttgctgcatgnagnctgcttggcaaactttattcaaggtgagaagaaatgcanacttttattnttcttacaacgaatagantagatctgctgctactactactccactgtgccctttctg

SEQ ID NO: 68772 - DNA, 487 bp, Triticum aestivum
  unsure (1)..(487): unsure at all n locations
  Clone ID: PAT_TA_68772
aacacaaaacatagtaaaattcttgatgccggcctcaaggaaccaacatcgctgctttctcccctggcccagctccttgctgtggagcatggccgagactcagatgcggagctcccagagagcttgttgtcgccgacatacacaaccgccgtcccaccggtcgcctcaagaagcaccgctgtgccggagacacacaccatgtgcaagagcaaagcaccctagccctctccctcagcttggcaaagggcaacaaagttgagagaaagtggtgcagcagacgttccatcgagcacctggggcgtgctctgtttggtgcaggacacccgaaccggcgctgcgctcgtcccggaccggcggctgcagggtgcggacccgttgtactcgaagatttgctactgcacatcttgcgggctcgacatggccatggccatgggaggaagagatggtncacctanggttccagcaccatnnangaggttggacacng

SEQ ID NO: 68773 - DNA, 189 bp, Triticum aestivum
  unsure (1)..(189): unsure at all n locations
  Clone ID: PAT_TA_68773
ttacattagcagattcgtattcatnctgcaagcagtcatacttgtacacacaaagaagtcgactaggagactgtaaatcaatacgaataagagcttggcatagttatagttactgctgaaaatgtgatgttggccagtttattcgcccttggaaatgagattcagcgcaccgtgttgtttcatcaccca

SEQ ID NO: 68774 - DNA, 186 bp, Triticum aestivum
  unsure (1)..(186): unsure at all n locations
  Clone ID: PAT_TA_68774
cacacacagaaccatatagaatgaaaantatgctctggtcgtccagcagagtggnggacaaaagntaagttcacaaaagaccttcatacataggccnttgtttcaactngtantttaggccttgccagactcctcgcngcccggtggcctgaaggcgatgaagctgacgcactgcacctggcgcag

SEQ ID NO: 68775 - DNA, 308 bp, Triticum aestivum
  unsure (1)..(308): unsure at all n locations
  Clone ID: PAT_TA_68775
taacaaaggagcgagataactagggtaaagcataaggctgagggccgcttccgtcgaaagcatcactcgtgccaccttgctgtctttcctctttcccaggggcctccacagctgattttttttttttgaaccattcaaagatgtagtcagcagggnggngccagacgattntaatagtanaacattatgtagttngttggcatgtagnggcaaanggtttcgccacgctccccgcccaacagctnaaagtactgcccgtcccaatcanatgtgttcatgtggnacatggntgtcgccgtcacgcncgg

SEQ ID NO: 68776 - DNA, 649 bp, Triticum aestivum
  Clone ID: PAT_TA_68776
gttcttaaggaacattgagagaagaataaaaacaggtgcaaattaaagcattcaccttccctcttcaagaattgacaccgaagactcaccagatacaacacaaatattcatattcgatgaagggtacgacattatgtatgaatcgaacccttcattctgcatcattgctatcctgttgtaactcatgtaggcggacatgtcaggaattgactggtcgcggtccaggtattgcatgacctttcgcatgctaggtcttgcattggacacagaaagcaatcctctgtacactcttccaaatcctctgggttgaaattccccataagatgtggatcgaccacgtcaagaattgagccgttgcggtgatgttcaagcacccaatcgaccaacactaactctgtgatatccttggtactgttgattggcctacgcccacatgcgacctcaaggagaaacacaccaaatgcgaacacatcggttaagggtgttgccttcccggtgcgtataagttccggtgcaaggtaccccatggtgcccaccacatgtgttgttttagaaaccgtgccatggtcgtataaccttgctagaccaaaatcaccgagccgtccattcatctgactgtccaagagcacattgctagcctttatatccc

SEQ ID NO: 68777 - DNA, 660 bp, Triticum aestivum
  Clone ID: PAT_TA_68777
accggccgggtgagaaacttttggacagaatgttttagagttgcaacaagtaaatctatatatcttgataataataatagattgcattgcagcgcgcactaattaagagccagcatacgtacgatccattgctctagacaacacggctccattctatgatttcaccgtcatcattgccttcccgcgttgctggtttcatcatttcaatcttagtagaaggccctgctgaatcatcattgccttcccgcgttgctggtttcatcatttcaatcttagtagaaggccctgctgaatcatcattgccttcccgcgttgctggtttcatcatttcaatcttagtagaaggccctgctgaatcaacagtgctcgttgattctgctgtgccattgctcttctccaatgccttcttcatcttagccttctgagcccaagacagaacaccctgctggacatgcttattaaagatctccttcttgtagaagcttcccatctgtgttacaactgcatacagaggcagagtgcagtagctgcagagaagctgaataatgaccccaataacaagcctcggcacaataaaacctacatgccccatgatgcacgagttgaatccataagtggtcagtatccagaagaaaaatgcaatctcgaaggcgttctgga

SEQ ID NO: 68778 - DNA, 519 bp, Triticum aestivum
  unsure (1)..(519): unsure at all n locations
  Clone ID: PAT_TA_68778
cagaaaatnaaaaaaaaacatctagtttggcaaagaacaccaaaacaggaactnccaacttactntgccgagtgaaaactttgctgcgcaatacatagtagccaatttcctcagcccacttttggttgaagtaaaaatctgaagttagttggcacctgccctttgcaagcggttgcatagtcttcggcaaggtgtggcgcagcttccttgtgagggcatatgtacttgtccacgaaatccttctcggtcctcgtgaccacattatagaagctccagtcgcgatcggccaatccagtttccttgagaaactttaacacatagtgtcgaggcctgagccggccctccaggctataatagagtatcaccggccgatgagcaatgtaggccggttccaacccgagttcagatagcaagaactcagacctgcgcctaagcaggtctttggacttcctcagcaacactggagccttggacagagcaatggccacctcggtatcagaccacctgatcgtcttcttc

SEQ ID NO: 68779 - DNA, 723 bp, Triticum aestivum
  unsure (1)..(723): unsure at all n locations
  Clone ID: PAT_TA_68779
accggtcaggaaatacaaacccacaaacccctcggccaaacgatacaaggggacactctaggaggcttacaactcaacggagcgcacaagcacaaaaagaatacaggaaaacaaagcgaagcacgcgttagcttctagttaaacgatggaggcagctgaatcgtatccatctcgccaaggccgatttgcagagacagaaagtcgcctatgccaatttacagaaagacaaaggttgggctagggagcgagaagatagtagcacgagcaagatggtcctcgcgtgcatcttggccatatcctcggtagctggaaccacctgcagtagccccctactaatacccaaggacaccacgtacaccaaagtgagagaaatctcacctctattccaagggagcttagagcttgaagaaattgatccggtgccaattagacatgtattcagtgcaagatcaaatagtccaactcaaatttgaatatggaacacaacaactttatggtatgatcgactaagtcaccttcacccagatagaggcatgcttaagcattatttcttgataggcacatccatgaatgtttgctttgaactgacaataccgttctacatcattataattagagcctttctgacctaccttgaacttcaaatacattccaagtatcctcctgtatagcaatcacatgcctttcttgntaaaccacatgactcaccaataataccgcaaa

SEQ ID NO: 68780 - DNA, 487 bp, Triticum aestivum
  unsure (1)..(487): unsure at all n locations
  Clone ID: PAT_TA_68780
tcctcccagctccctggacaatnaccacgaattgtcgaagagcaaaggttatccctgcatgagtngtcgataacccagccctccggtaattgagtaccacatcagaactctacgttgccctggtaagtggccgacttgatggtaggcggcttcttgggcgatatgctgtcgacgacgagagccgcgtgcacgttcaccttgatctgatgcaggtcgtaggtatccagctgcagctgcaccggcacggtgacgtacacgtcgagcggcacgttgccggccttctcgctctcctcgagcgcctcctgcaggccggacccgaacccgtggcgcccctccatggagatctccagcatggtgacgttgttgtggccctggaagaaggtggggagcttgccggagcacagcggcgtgccgcggtaggagacgacggtgtgggagccgtccgcgtacttgatgccgatcttgtcgttggggttctcggcgcgga

SEQ ID NO: 68781 - DNA, 643 bp, Triticum aestivum
  unsure (1)..(643): unsure at all n locations
  Clone ID: PAT_TA_68781
tgatttncatgcttactgaaaacagagttattttgacacaggtttggaaatagaggctcccataaagagaaataaaggagaaaagttcaggaatatattaaagcgggataggcttggcgaacaacttctcgatcatcccttcactgtccttgttgtatgtgtaaccgtctcccccgtcatggaacaagactgacatgcttgtagtaaggttgatgacacggtttacaattggaagcagcgtagtacaaacaaagcgttcacggttgatagttttccatgcatcttcaaccagaccatcgagcacggtgatagccacctcacttgtaacatggtgctcattaatgtagcattccagagagcttggcacatccattttgttctttccacgcttaaatgcagccaagtcatccatgaaacgtgtcaccttgccgcaggccatcacaacatcagtacaaccaattgcccactcaaatgcttcattgtttgcttcaacatccataccaacaagtaaaccgacacttagcattgtactaccagaggtgatgactgacacattgacttgttcttgaaatcttggcatgtaattgcgatgaaaccattcagcttcttggagataatagctacttaatgtttggaacccttt

SEQ ID NO: 68782 - DNA, 723 bp, Triticum aestivum
  Clone ID: PAT_TA_68782
aggcatattacatatatattatcctccagcaacttgtagatcttccaacctccagcaacttgtacatcttccaaaccgcatcagcttgtgtatctttgacaaatccctccagagttgcatgtggtcgcattgttgcttttgccagacttatccacttccagctgcatacatagaagcagattattaaggtgtaaaaataaattcggagcagatacagaagatagaaaataaacttcttgttactcaaataagttgcagttgaaacacagtgtatccaatctacactctaatgagctctgcagcctccacgatgggccatcagggttggtttacatccaatgtgagcacacagaggtggtgctgcatagcatggagaaagagggaggggagttgggaggggaggcctgcaagaagccatgccgagaaggccccaagtgaaaatatcagcaaggcagactcacattgtccatcctcatctttgtcagcactatctagtttcaaatggaggattatctagtttgaaatggagcattatctagcgtatctactactcctaagttactactaagcttgtgcctaagtgtggaaatcaaaatctagaagtgattggatacagctcatataaaaataggcccaaacttctgaaccaccaatcaacattactaatgaagtgcaaatataaacatagtaatcatacaaatgtaacttttaaagtgaacttct

SEQ ID NO: 68783 - DNA, 356 bp, Triticum aestivum
  Clone ID: PAT_TA_68783
ttggcttactctgtatatgtaacgacccgaatctaataaaattaatgtctctgtgctcactgtgctagtccctggatcgactcgctagcacacacaatacatataaatatcaaataacaagtgcatcatttactacaacgtatgatccagaatttataaagtattacaaactgaatagcacatggctaacttattcaataataacagcggaaaggtggcataataaacgatgaggccatcaatgcccactagagaacatgttgagtgaagactcgcgaccctactgtatctcactgatcatctgaaaatccggaaaacatggcagggtgcgtcgccggacttgaagaagaacagtg

SEQ ID NO: 68784 - DNA, 231 bp, Triticum aestivum
  Clone ID: PAT_TA_68784
gttcttacaccacgggccacaaagcgttggcaatacccagcacaggtgctactactgctaccactacttgcggatagatagataagcagagtcaacagtacagatgcagatgcagaaaccaactgcacgccgtcagtctaggaggaggtgaacttggtgacggccttggtgccctcggagacggcgtgcttggcgagctccccggggaggacgaggcggacggaggtctgc

SEQ ID NO: 68785 - DNA, 627 bp, Triticum aestivum
  unsure (1)..(627): unsure at all n locations
  Clone ID: PAT_TA_68785
caaagaaaatctgcattcnaaatttngtttatatacacgaactgaacaaactagaccgtccggtttgacttgcgccatgtctatttgtgcactaggatntctatttctgctaactaaatcgcttcacttacaaaattgtacagggcaacagcctaacagaaaactgagtaactgctccaatggctgcctttgggaagcatgccatgaactcttcatcttctctgccttgtgatgaacttcagtttgctgcattgcctcttatcttatagcacactggaataatatttcatggcagtcggaaggcgatcaaccctgcctaactggagtagttcaggctcctgcagcagcaaatcttgtagactcccagccctagcatcgctgacatccagggagagaagtctgtggtgaattgagttatcggagccaacataggtgacaacgaggcttccagcatctggatgtggccagcttcgtgtggtagggaatctaagaacgaatgttcccggtttcttgagcagttccctggagcttcttagcgcattctcggcttcctctgttgtaatcaatccctctatccacgcaggtgcagtgcaaccccataggctgttgattttatctttcgacaga

SEQ ID NO: 68786 - DNA, 653 bp, Triticum aestivum
  Clone ID: PAT_TA_68786
tgaggaaggatactaagagtcctgaattggagtgaaataggatgggataagcgataataaagtggctggagtagaaacagatactagctagctagaggcaggcgtgcatatccatatcgtccacatcttgtggtcagcgcgtgaagccgagtcctgatcctcgaagcttgtcctcaacaatggcatcgatgtggcgggccatctccggcgtcatatggttggcccagtcccctacgacccctttcctgaagaaggatttatgcgggacctccacgaactgcccagccactccggtgttgttcacctccagatctttcatcgtgtctatgctgcacagcttgcagatatccatgggtaaacccgctgcctcctccgccgccgtgaagggcacaccaaggaacaaggcgagctctcggacactgctgaccgggtcgagcagcatctcctcataccttaggaagaggaccctgtccggacttgctttgctggagcgcgagtagccgagaatgtggtcccaaatggggccgtgggggtttttaccctcgcatgcaaactcgaagaggtcggagaaggggaaggcgtcgcctcctgcggccatgatgaagtgccacatggaaaccagcatatccttgggctctctgcatccatcaggc

SEQ ID NO: 68787 - DNA, 575 bp, Triticum aestivum
  Clone ID: PAT_TA_68787
ggttgtaattttataatcttaaataatgcaaacatgctgttttctttcaccgaaactgtttactactacgaacacaaatgaccatcaaacgaaaatttcatgccccacacgaactaaaccaaaccaaacaaaatttgcgtacattcacgataaggccgatgctatcaactcttgaacctgacactacggctgacgtttgcattgatgccagacagttcacctccgtagggacccgagggcttcttcgcgctgcgcacttgaccttgcctccttttactctgtttatcactcttaatcctgtatttcttccgtggattcttgagattcttgtttctggagcgtgtcagccctcggttcttctcgatctgccgcgaaatcttcctcttgccatctccttcgctttcttcctccagctcagtagcaggggtgctctgttctttgcccaggcgcttttcggtcctctgcctcttgatatctttgtagaattcatcttcagaccctgaagattcatgatcatcgccatcttcctcgccggattggctgagcttctcttcagtatgatcaccatcttctgg

SEQ ID NO: 68788 - DNA, 146 bp, Triticum aestivum
  unsure (1)..(146): unsure at all n locations
  Clone ID: PAT_TA_68788
aaaaaanaanaaatngaataatttagtgcggaaacaangttctgctatttttttgagccacaatatcgacagnaaatcatattctcggctgtagttgaaaatttcaccagactataatgtaagtgcatntnagngctaaagctaca

SEQ ID NO: 68789 - DNA, 733 bp, Triticum aestivum
  Clone ID: PAT_TA_68789
ctgcactggcatacacaatgattattgctcccgtacaccctattagtatactccctccgttctaaaatatgtgtcctggtttagttctaatttcatttcaaaataagttttgtgctttcggttcaaacttgaactaaaatacaacacttattttgaaaccgagtgagtatttgaactgaaaccttgacatttattttgaaacgaagggagtataatgcgcactgcacaacgctggggttacgttcgtggttgagcgcgctagctagcattcgatgatctccggcgcacgggaatgctcaccggccgggtatcgatgtatgcactcagcccatgctttgtccgggtcgtccgccggccgaatgcactcccagacagcgctaacgcactcaaacccggacccaaacccaatcatccaaacacgatcagccttggacatccggcccttggcctcgacgtacgccagctcgtaccacactgagctgcttgatgtgttcccaaacctgtaaagggtcatgcgcgctggctccacgtgttcgtccgatagctcgaggatgcgctgtacaccatcgatcgccgtagggccccctgtgtggatgcagaagtgatcgaaagccttgcggaaatccgggacgtacggactgaagacccgcttggtgtcgatgggcagcttgctccatacgaaagacgctgctgcatgtaatgcaaagagcagctgctcggcgagtggcaggat

SEQ ID NO: 68790 - DNA, 545 bp, Triticum aestivum
  unsure (1)..(545): unsure at all n locations
  Clone ID: PAT_TA_68790
agttgccgaaatnttattttntccatctacccctggaactcctttcccttctgggcaagccggctctttcgcgacgattaactcagatgccgaggcaatatttacatattattctcaacaacggaaaaataatattaatacatgtacaacagtctataactgggtgtctgggttcacaacatgtcactacagtgttgcctacaaaacttgtggctctgatatcttacaacttcttgttacacttgaggaagaaagaatcaataggtatatgttttccctctttggaggacttgagtttcttcttgggcgtgggtgtggtagtagtagagcatggccgttcggccaacctttccttcgagaggcgggctgtgttgtctaccgcctcttcctgttgcaacatttcagccaagtggaaatccgaatgctcttgcctttcctcctcaaaacatggaggtagctcaaatccgcagagggagcaaatatagccatctacccagaaatgctgaccaggtttactcgacgaagcacaagctctggagctggtc

SEQ ID NO: 68791 - DNA, 716 bp, Triticum aestivum
  unsure (1)..(716): unsure at all n locations
  Clone ID: PAT_TA_68791
ttattctagttttgatacaactgtattttgtacagggnatacaacaagaacctgtcaatttctacaggctcctagctagttttggaattggcagggttgtggaataacggttcctgattcttgccattttgcattctgacaagtgctttccgtgtcacccttgccgccttccattttcaggttgatattctccaagacaatgtcggagcatgagatgctatggctgcagctcagcttgatggcatccttggagacggttgtccctctaatgttcttgaagacgacattgctgacctccaccgcagatccctgacctctattgcatggcttggcggagtcgcagtagttctggtcaatgattatggggttttgcacgttgtccatgaccatgttctggaacgtgatgtccttggcgtacccgctccctccctgccatgtcttgatccgggcaccattggtggtgccgtatagttgcaccgagtcgattgtgatgccagagacctcggctctggagttgtcatctcctaagctcccgatgctaattccatgccccggaccacaaacaactttactgacaaaaagattgtgggttccattctcgatggagacgcagtcgtccccggtcttgatgacgcaatctttgacttgcacatctttgctgcgggtgatgtggatgccattcggtgttgggggctggtgccgggcgccgtgatgga

SEQ ID NO: 68792 - DNA, 420 bp, Triticum aestivum
  Clone ID: PAT_TA_68792
ttgcacagtgggcaaaaactgtacatacatgcattgtcaagttctctctccctcgtgtggatcatatatcatccaagcacaaatcagaagatcaagagaactacacaaatctactccaccaagaccagtcttacggcatgaatgagcactaagaggtatgaaatatacctctgttcatgcatcgacaggtagatttgcctccatgtcagactgtgatgtggccatgtcaactcgccattgaatgaatcaattgagagcagctgccacatcctccagtccaaactgacggccacccaatcgtgattccttacaccttgctgcaaagtagaacatcagccacaccaccatgaagtacacctctgcgaatgagtggaggaacccgccaagaactttgccaccaaatgtaaccataatgagccg

SEQ ID NO: 68793 - DNA, 651 bp, Triticum aestivum
  unsure (1)..(651): unsure at all n locations
  Clone ID: PAT_TA_68793
ggcgatgtattaggtcgggcaaactgaagcacaacccagngtatacagtaacagttattattattacacataatataatacaagctgctacggagccctcaacaacacgcaataaactttcagggcctgctaatcaggtcacttgcacagctgctgttgctgtaaagtaccagtttcaacaacatgcatcacaactttaggtttgttgcaggtgttcttcctgtgaccaccaactccccagtttgaacattttgcttccttcctttcttttcgaggaagatcacccctctgtggacaggtgatgctcttgtgcccaccagcacgaatgtgttcgcttgcaccgcatgcaccaccagcacgaatgtgttcgcttgcaccgcatgcaccaccagcaccagcgtactgccattttggactttttgctttttgcacccaggtcatcgtatggcggcttgctcacctggtggttggtcggcccgccttacgctatctctccagagcctttagaaccatgaaattaccaattacactaccttcggtgtcaatacaaacatccgttgtgagttgcatgccatgtaatcgcttctttgctttccctcttgcctggctaaattctgtcttctaagcccattccatctggatagctgccat

SEQ ID NO: 68794 - DNA, 603 bp, Triticum aestivum
  unsure (1)..(603): unsure at all n locations
  Clone ID: PAT_TA_68794
ggtaatggttgganngtaaataggctaacggagtattccacaaatgtgggataaattgattgcaatcgcctattttgcctaaaaagtttagttcagcgggttaacaaaaggtgcattgtgagtattgtagactttgggcccagtttttggcaagcagcatgtgatgctggatgctgaatctctaaaattctagtggtttgagcactttttatgatctgaaataatgggtcaactatttaacaatgtgttttggcaagaaaaaatagtaagcatgaactatgacaactatttcattgggtattagtatatataaatggtgctcgacaggtggaggggagccagtaagtaacatgtcatatgaaacaattttgtaataaagaaatttcaggataatttcagaatttttcattgaagtcgcagcagtttaatgtgtagctggctttggaagcgaatatgaaacaacccagtagagacattatgttcagggagcttttgtcttgatgaattatttaattgtatagatatggtatttggttctgatgttaaaactgacacctgctgatcagcaaagccccataatttcctcaacgtttgtgctcagaa

SEQ ID NO: 68795 - DNA, 677 bp, Triticum aestivum
  Clone ID: PAT_TA_68795
gctcccctcgaccgtggcgacgacggcgtccctcctgtcggtcgtgccgccgctgcctcagaccgtcacacggccgcagccgcctatgctttttctcgcacctcccctaatccagttcccgtccaaagccgccgccgcaaacaagggatcccaccggacctcgccgccgccgcaatcaagggatcccgccggattgccgccaggagccgcaggaactgcatgccatcaggcgcggcgtgccgagcccgccgaagcctcctctgccccaccgccccctgcagcgcatccctccgtcgagcatccggtcatgccgagcaacgccgcggaccagtccgtaggcaggatctatctggccgacctcatttgagctgcggcttaagtattcctactgcacgggtttgcacatatgatacataggtattgtgaaatttcgcagttgttttcagttttctgcaatgttgatttgaaaagctttcgatgttctgtttatgtatgccagacttaagaaagaatttcatagtcacatttgacatattcagatcaagtttatccctccgattatgttacattcaactcttcctctctccagtgaataatttttgacatatcttaacaagacttttttgtcatcttttagctggtgtgatgagattttggcacctgtacattccttgtac

SEQ ID NO: 68796 - DNA, 716 bp, Triticum aestivum
  unsure (1)..(716): unsure at all n locations
  Clone ID: PAT_TA_68796
cngaaggaatcaccctccaccttgtcctccgccttcgtggtggcatgcaaatctttgtaagaccctcaccggcaagaccatcaccctggaggttgagtcctcggacaccattgacaatgtgaaggccaagatccaggacaaggagggcatccccccggaccagcagcgcctgatctttgccggcaagcagctcgaggatggtcgcacccttgcggattacaacatccagaaggagtccacccttcacttggtgctcaggctccgtggtggcatgcagatatttgtgaagaccctcaccggcaagaccatcacccttgaggtcgagtcctctgacaccatcgacaacgtcaaggcaaagatccaggacaaggagggcatncccccggaccagcagcgtctcatctttgctggcaagcagctcgaggatggccgnacccttgcggactacaacatccagaaggagtccaccctccacctggttctcaggctccgtggtggtatgcagatatttgtcaagaccctcactggcnaaaccatcaccctcgaggttgagtcctcagacaccatttgataatgngaaggccaagantccangacaaggagggnatttccccccggaccacnagcgtcttanattttgtncggcaagcagcttnaggatggcccnannnttngcnggnctacaacattcnacaangaggtccaccccttcnctt

SEQ ID NO: 68797 - DNA, 641 bp, Triticum aestivum
  unsure (1)..(641): unsure at all n locations
  Clone ID: PAT_TA_68797
tcggcacgagggaaggaccgcgaccgcccgatcccgcgacagnatacagcgccattccgttccggtgccggcgaggcgacgacagagcaacagagctgtcattcctcttccggatggcgtcgacggccgaggtggtcctctccatcaaggactccttcctcgccctccccaccaagaccggcgacagggctctcgaagaggttgagaaaaacatctcctcgttgcggcaagtgctctctggtgatggagaagcaggagcaaatcaagagcaagtcctgcaaatagcacttgaaatttgcaaggagggcgtgctttccctctttgttcagaatctaccttccttgggttggggagtaagaaaagatttggttatttgctggtgcattttgcttgggcagaaagttgatgagaattattgctgtgtgaagtatattgaagatcacgtggagcttttagatttcctagttgtttgctacaagaagtcagaccttgcactgaactgtgggattatggtgagagaatgcataaaacatccaacccttgcaaaatatatcttggaatccaatagctttgagctgtttttcgagtatgttgagctgccgaacttcgacattgcttctgatgctctaaacaccttcaaa

SEQ ID NO: 68798 - DNA, 560 bp, Triticum aestivum
  Clone ID: PAT_TA_68798
gcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagccgcggtaattccagctccaatagcgtatatttaagt

SEQ ID NO: 68799 - DNA, 229 bp, Triticum aestivum
  Clone ID: PAT_TA_68799
gggctgccgacatgaaagccttcataagttgtagaacgtgtagagcgtcaggtactgctgttgttattcgatagagaaataaacacagctgctgctgctgctgtatgtgtgtgtctttcatttcatttcttctttcccttttgttcacagatgttttttcttcttcttattgtcgttgagaaatttgggctgcatattttataaaaaaagcctttcaataaaaaaaaaa

SEQ ID NO: 68800 - DNA, 611 bp, Triticum aestivum
  Clone ID: PAT_TA_68800
gatttaagatgcgagggcctgttgcctctccttactcggggccagctcagcaatttaaaagtcaaaggaagccccaatttctttggtgggtgggatcccaatcccatgcgggggatgacagaatccaaactgcagaatctcgaaacagatgacatcgagggcttactcgatgcgcccgtcctctgtagcctcctctcttcctccctcacatcgttggactttattgggaaccatgagacgacgcgcttcacaaaggagcaggaggaggcctttcaacgcctcacctcgctccaggaactctggttttggggttgcgacaagctcgagcacctccctgcaggcctaaacaagctgaccaacctcaagagattatggatctggtggtgtccagccctccggtcgctgcccaatggcggcctcccgagttcactgcgagaattagatgtcaacaggtgcgacaacgaggagctaacaaagcagtgcaggcggttgatgggaaccattccgaaaatcatactatagaccaatccaagctggtctctctgctgggagttgtgcattcttctacccttgtggaattctctccatacatggacagtggcgcatgaggg

SEQ ID NO: 68801 - DNA, 331 bp, Triticum aestivum
  Clone ID: PAT_TA_68801
gctcgaggcccctttatgttactattcggttgcgaggcaacctattggtaagagagtctgagtgactcaatgcacgattttggtcacggcatgagtagtatgttgatatttgcattgaacttgcttaaatgtcatgatattgtttctcattatggttttgtttgctatgagcttgcaagtacattccatgtactaacctggcatgttatgccagatttcaggaaagtctaactggatcggagtgctgccgtgtctagactgtgtccacattggtgttcctatgctatggagtcccgctacgttgttgttccgctgacgtgtagatgtcatg

SEQ ID NO: 68802 - DNA, 354 bp, Triticum aestivum
  unsure (1)..(354): unsure at all n locations
  Clone ID: PAT_TA_68802
tgcaggnaattcggcacgaggaagagtgacggtccgggacaggatctccgtcaggccgtcagcttttgaccgccttttggggccaggggcgccagctagcgataattcaaatcaggcggcgaatggagaccgcggtttggtggcggcttcgagaacggatcccccaatgattggcgttgatgggaaggataaggaggagaaagttctggtatccactccgcacctgccagctagcgagattgtggtggggccgggcgcgggtttgatggtggagacggagacgtgtgtggtggcgcagaattttgaggaaaggggggtcccactgcaaggggacagggagcagagtaactcgcc

SEQ ID NO: 68803 - DNA, 584 bp, Triticum aestivum
  Clone ID: PAT_TA_68803
ggccttcctccccctcccgcgattcccaccgtcgccacccccacccaccaccgccgacctcgtctccgccacacaccctctcccctcgccttcatcccccagatccaccagtctgcttctcggccatggcgtcacggccggttttctcgccagcacgcgcgtgcgtgcttcgatgcgcgccgctccgtcgagctggccggaccgtggagcgcgcgtggaccgtgtatccgctaccaaatctcccctccgctcccgaatcaaacctcccaaatctctcccccgctcccgaatcaaatccccatcacctccgccaccaccccacctactcccaccgccgtcgcgagccacgagcgcgagcggggcgatggccaatcctctgcttctcctcgaagtccccactccattcgtcgtgcataccctaggacgacggcggccgacagatctagggagacgacgaaccctagccgcaacggcttgttggtgtggctgcggcgcatctgatactcgccccgagctccctcctcctccgttgctgtggccgccttgggacgatattcgccgcctgtgaccgctgtgttgggaac

SEQ ID NO: 68804 - DNA, 595 bp, Triticum aestivum
  unsure (1)..(595): unsure at all n locations
  Clone ID: PAT_TA_68804
gaggcnctcgccggnncactcccctgcgcctctccggccttctccggccgacaagcagtacgaatagccgcggagaccggacacgcggcgtggctggaagttcttgcggttcatatagcatcccacacacgcgcagttccagccccgtccgtgctctgctgaatccaaggtcgcgggcgtgtacctcttcttccctgaggcacaagggtcgtccaccttcggatgcacaaaatgagtcgtcatcctccaagggatcgtcatcatcgactgaacaaaatagattttcatcatcgggtggacaaaatggatcttcatcctccaataaagaaatacatgggttggctgagtaaagttgttaaaagttcggtaaataaagttataagaggacagtatgacgggaactttagtgaaggctattcaacccagcacgctacgtcacatgatacacatgccagtgacaatgaagacatagatcgtgctattgcattatccttatcagaggaaggacaaaggaagggaaaggccattgatactgatgatcatttagaagaagatgaagagcttgcacgggctctgcaagaaagtctgaaagata

SEQ ID NO: 68805 - DNA, 360 bp, Triticum aestivum
  Clone ID: PAT_TA_68805
ggaaagctggttgacatcatgctgagtgaaaaggagggcagcaccaacatcatggtggtcgccgttgttggtgtcggcggaatcggcaagaccactcttgcccacaaggtcttcaatgacgaagccttgaacaacgtgtttgagaagacgatatggttgagcatcaacaaggacttcgacgaggttgagttgcttaggacaatcatcacgcaagcagggggagtacatggtggtaataaggcgttggctgtgcttcagccaatccttgtcactaccttgaaagggaagaagctattcctggtgctggatgatgtgtggaaccatggggtgtgggatgatgtgcttaaaacacccttggct

SEQ ID NO: 68806 - DNA, 620 bp, Triticum aestivum
  unsure (1)..(620): unsure at all n locations
  Clone ID: PAT_TA_68806
tgcaggnaattcggcacgaggtcagttcctcaagctggtccagagcttcggcatgtacgccatcgtgcgcatcggcccattcatccagggagaatggaatcacggtgcattgccctattggctcagggagattccacacataatattccgcgccaacaacgagccttacaagagagaaatggagaagtttgtgagattcatagtgcaaatgttgaaggatgagaatatgttcgcatctcaaggagggcacgttattctagcccagatcgagaatgagtatggaaatattaaaaaggatcatataactgaaggtgacaagtaccttgaatgggctggtgaaatggccattagcaccaacattggagtcccatggataatgtgcaagcaatctacggctcctggtgtagtgattcctacctgcaacggaaggcactgtggggacacatggataatgaaagacgaaaataaaccccgcctttggactgagaactggactgcacagttcagagcattcggtaatgatttagctcagcgttcagcagaggacattgcatattccgtgttacgtttttttgccaagggtgggacattggtaaattactacatgtattatggtggaa

SEQ ID NO: 68807 - DNA, 446 bp, Triticum aestivum
  unsure (1)..(446): unsure at all n locations
  Clone ID: PAT_TA_68807
ggttcctggnanatccggnggcgtacgagacgctgtcggacccggcggccagggcgcgctacgactgctcgctcggggtgttccgcggtgggggcgccggcggcgtgatgcgggtgcggaggtgggagacggaccagtgctggtgaagtggtgatccaccaagccatggtatgggcaatagcatcgctcccaggaagtcaggaacgtggatgagctgcaacggcctgtgttggtgtcctcggcgtagttagtgctaagttagtggagaggttgtgatgtgggtccagccgtcggtccccctatgcagccggccccactttttggtctttttggggccactcttggtcctggtgatgtagcttttgtgaatatatattcaagcttgctactgttcagctgcttttctctcaatatattttagcttcaggtgttcgagaaaaaaaaaa

SEQ ID NO: 68808 - DNA, 451 bp, Triticum aestivum
  Clone ID: PAT_TA_68808
tcggcacgaggggcaaggggctcggcaagggcggcgccaagcgccaccggaaggtcctccgcgacaacatccagggcatcaccaagccggcgatccggaggctggcgcgtcggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccagggacgcaccctctacggattcggaggctaggccgccaccaccaccagattaggagctagcccatgtgtagggttcgtggtcctcgttgtaatcgcagtatctcgctgttgttcgctgtgttctgtaggatcgaatggaatggaattgaaattaaactagttcgtcgttgaaaaaaaaaa

SEQ ID NO: 68809 - DNA, 645 bp, Triticum aestivum
  unsure (1)..(645): unsure at all n locations
  Clone ID: PAT_TA_68809
ggtaaccacaaacagnaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagggttccgttactaacatgtttacttccattgtaggtaacgtatttggtttcaaagccctacgtgctctacgtttggaggatctacgaattccccctacttattcaaaaactttccaaggcccgcctcatggtatccaagttgaaagagataagttgaacaagtatggtcgtcctttattgggatgtactattaaaccaaaattgggattatccgcaaaaaattatggtagagcgtgttatgagtgtctacgtggtggacttgattttaccaaagatgatgaaaacgtaaactcacaaccatttatgcgctggaga

SEQ ID NO: 68810 - DNA, 195 bp, Triticum aestivum
  Clone ID: PAT_TA_68810
ttttctgagggagaatcacctacacttatgttgaaaccaaggggattccactccaacctttgatccttcatttttggccccctcaagttgctttctccaatgcttctccaactaccatatcaaatctgtgatagagtgattcagtgttgagaaggctatcttttgaagcacaagggcaacgagttcatcatcaac

SEQ ID NO: 68811 - DNA, 264 bp, Triticum aestivum
  unsure (1)..(264): unsure at all n locations
  Clone ID: PAT_TA_68811
tgcaagcagttgtcaccatgctggatgtggggaagaagatcaagaagacaccaatagnggtcggaaactgtaccggnttcgcggttaaccggatgttctttccgtacactcaggcagcactcttacttgttgatcatggaatggatgttgacaagatcgatcaggcttgtattgaattcgggatgccaatnggtccattcanaatgacagatctggttggttttgacgttgctctagccacaggcatgcagtaccttgaaaact

SEQ ID NO: 68812 - DNA, 692 bp, Triticum aestivum
  unsure (1)..(692): unsure at all n locations
  Clone ID: PAT_TA_68812
gggcactgtatgtcacttcagnaccccatcggtggaaatgccactttgaggaataagactgaggtcatatatgccggtggccctgatgttcatggtgtgccagcaacccccacagaactggtttggctgcctgataggaatacacctgatcttgtctactaccagtcggtgtatgaagcaaagatggggtggaaggttcaagtggttgatggaggcctcagtgacatgtacaataacagtgtcctgttggatgatcagcaggttactctgttttggactctgtccactgactctatatctatagcagctcgaggtgagaagaaaagcgggtaccttgctgtcgcgtttgggagtgggatgctgaacagttatgcctatgttggctgggtaggcaatgatggagttgggagggtcaagacttactggattgatggaaagagtgcagcaggtattcattcaacatctgaaaatttaacctatgtcaggtgtaaatcagaagatggcgttattacatttgagtttacacgtcctcttaagccttcctgtactggaaaggtggagtgcaagaatattattgatccaaccacacctcttaaggttgtttgggccatgggtgcaagctggtcaggagatgacctgacggacagtaatatgcattcggtcacaagcagtcgccccatacgtgttctttt

SEQ ID NO: 68813 - DNA, 594 bp, Triticum aestivum
  Clone ID: PAT_TA_68813
gcccatcatcgcggttggtacggtggttcagcggcgcaatgcgcgacctgaggaggagccacggccgggtacagaaactcctgggggacatcatcgttgagcgcaagaatatgaaagagaatgcctccgccagcgccggcactaaagacaacgaggacctgctagacgtgctcctgaggctgcagaacgaagacaccctcagtttccctctgacgtctgagatcataggcacggtcatctttgacatatttgcagctgcaaccgatactactgctgccacgctagaatgggccatggcggaactcatccgcaacccaaaggtgatggcaagggcgaaactcgaagtcagacagagtctcgcacagggacaacccacagtaacgagcacggaccttggcaatcttcaataccttcgaatggtgatcaaggaaacactaaggctacacccacctgtgccgctgatacgcagggcaacccaagataagtgccaggtcatgggttaccacattcccaaaggcatccatgtcatgataaacgtgttcgcagtgggaagggacccgagccactggggggaggacgcggcggagttcaggc

SEQ ID NO: 68814 - DNA, 702 bp, Triticum aestivum
  Clone ID: PAT_TA_68814
ggccccacggcctagccaacttccgctgcccgcagtgcggggtcgacctcgccgtggacctctccaagctccagaacttcctcaccgccgccagcaacggcgcgcccccagcgtcagtccctgtgcccccgacgttcctcccggtgttgccgccaggcacgccgcagctgccacagctggttgctgtcacgacaacagtccctattgggctgcccaccacagagccacccgaggagatcaatgaggttgcaattgatgttgagcgcgatgaagatgaaggtggtaccgtcggcgaaactttcactgactataggcctcccaaactatctcttggtctgcctcatccggatccggtagtagagacttcttcgctgtcagctgtacagcctcctgaaccgacttatgagttgaacatcatggatgagttggatcaaactaagacattatcttgcttacaaatcgagacaatagtatatgcttgtcagcggcaccttcatcatctccctactggtgatagagcaggtttttttgttggtgatggtgctggtgttggtaagggccggacaattgctggattaatctgggaaaattggcaacagggaaggcataaggcagtgtgggtatcggttggttctgacttgaagtatgatgctcgaagagatttagatgatgttggtgcaaaatgcgtgcaagtgcatcctt

SEQ ID NO: 68815 - DNA, 638 bp, Triticum aestivum
  Clone ID: PAT_TA_68815
gcaaaaggttgttgatattcttgtaaaagttgttgagtctgagggttcaacattggcatcaattgcaatggaatctcttggccatattgggctccgttgtgcattgccttccattagtaggaactcctctgcagctggagttttaactgttctgcatgagagattaacaaagccgctttccgaaaatgataccaaagctatacaaaagatcttggtatcacttggacatatttcatggaatgagttgtccttttcacatctgaaaatagcgttagacttgattttcagtctcgcgcgttctaaggttgaagatgtgctttttgcatctggcgaggctctctctttcatatggggtgaagttcctgtgactgcagatgtgatactagaaacaaactttgtttccctttcccaagccacaaactttcttactggtgatgcacccctgcttgactcaaggaacttcggtaaaagaagcagctgtgaagaagcacgtacaacggctcaagaagaaattataaacaagttgtttgatacactaatttatagcagcagaaaagaggaacgctgtgcgggtacagtctgtttggtctcactcacaatgtactgtggtcggcatccgaagatccttgaacttcttc

SEQ ID NO: 68816 - DNA, 538 bp, Triticum aestivum
  Clone ID: PAT_TA_68816
gccgtcggtgtccccgcagccgtacctcgtaccccactctctcgcgcccgtgaaggcgccggcggctgcatcctggacctcccgtccaccgctgcagcggcagcggcgcggtacccggcgctcgtaccccgcggaggcgccggttgtttcaccggcaccgtcttcgatgtggtctccaggggcgggattcgtggtggcgaggggacgctctggctctccggggacgccatggccagctccgggctgcggcatgggtgtctcgtctctgtatcactcatttcttcaagtagtaacagtttagatgaattcccacttgatagcttatttgaggagtgcaccagattctttgatcttgatgtggacaatgatctcatctctaacgaagctggggggaactttgtgactgccaaagttttcccttcatgtgaggttcaaaagaatggcatcaagctctcttgggaccttgcctgcatcttacagtggttcttcattgtgcttggatcaagccactgcaaaatcagtattggcagatgataaa

SEQ ID NO: 68817 - DNA, 601 bp, Triticum aestivum
  Clone ID: PAT_TA_68817
aggagagaccctcatgcaaagtaagagctggtcttctccttggttgtgtgcgtgggtgtagaacttctcaccatgtgtgtgtgtgtgtgtgtgtgtgttcttgagagaaacaaccagagaggaagagagagttgtgagagacaatgagaggtagaagaagaagtggcgctgcaaggaggcggcgccaacaattggtatcagagccttgtcgatccgcggcagcgatggcggcagtgacgactacaccgcggacttcatgtgacatggaggacgtcggcgtgaggtggaggccgttggcggcgcgatgccgctggtggccggttgcggtgcgatgctgcaagatgatgatggtgtggtggtcggtgtcgcgaggacgtcatccacaacaagatggtccatggtgaccggcgctgcgacggcgtcggctttggcacgatggactccatgcgagatgaaggccgacagtgcaagaaggaagatggtggccatgcggtgccgttatgtgaagatggcggtgcgaagctgccacaagaagagtcggtgtgatgccgacgatggtggtgtgatgccatcatcatcatggaaagttggtgtgaagcca

SEQ ID NO: 68818 - DNA, 591 bp, Triticum aestivum
  Clone ID: PAT_TA_68818
gaggaattcggcacgaggagcgcctcccgccgccggcggaggtgccgccgccgactgccgcgtctcctacacccagggcctctacgtcttccacgtcatgcgcgccgacggcctcaccgcgctctgcatgaccgacgacgacgccaccgccgcgtcaggacgacggattcccttcgcgtttcttgaagacatccatggaaagtttgtcaagacgtatggtcgtgcagctctcacggctcttgcttacgcgatgaacgacgagttctcgagggttttgagcaagcaaatggactactattcaaacgaccccaacgccgattgcataacccgcatgaagggtgaaatggatcaggtgaggagtattatgattgataacatcgacaaggtgctcgagagaggcgatcgtctggagatgttagtcgacaagaccacaactatgcaaggaaacacgatgcggttcaagcggcaagctcgccgtttcaggaacactgtgtggtggagaaatgtgaagctcacagccgcggtgatcctcatcctactggcgatcatatacattgtgctggcctacatgtgccacggcttcaccctgcc

SEQ ID NO: 68819 - DNA, 514 bp, Triticum aestivum
  Clone ID: PAT_TA_68819
ggctaactggtgctacgcaaccgtcgcgccccgtgcccgctcctccaccatcgtcgccagcctcggcacccccgcgccctccaactcctcctccttccgccccaagctcatcaggaacacccccgtccaggccgcgcccgtcgcacccgcattgatggacgccgccgtggagcgcctcaagaccgggttcgagaagttcaagaccgaggtctacgacaagaagcccgatttcttcgagcccctcaaggccggccaggcgcccaagtacatggtgttcgcgtgcgctgactcccgtgtgtgcccctcggtcaccctgggcctggagcccggcgaggccttcaccatccgcaacatcgccaacatggtcccgtcctactgcaagaacgtgtccctccagaacctcttgacctacccgttcgtcaaggagggtgtgtccaacggaaccctcaagctcgttggcggccactacgacttcgtctccggcaagttcgagacatgggagcagtaaatcttc

SEQ ID NO: 68820 - DNA, 549 bp, Triticum aestivum
  Clone ID: PAT_TA_68820
aggaattcggcacgaggccgccccgtgcgagagcgacctaacccgcgtccccccgacccctctggcctcctcctcctcctctccatcaccctctcgctcgccgtcgccaccgccctgtcctcccccgccactcatctccccctactccggcgcgccctctcactagccgccacatccctcagcccatggatttcggcgcaaccactctcggccgccacctctcctctcatctcctcgtttcctccaaatttcacgatctggagttggagaggcaaatacgtccgccgacgccacggagatggacgaggctgcaactggtgctggagagccatgggtggctgagaggaggaagggaggtaccctctcctgcatctcgcgcaaagccatcctgctggtggctcgagcgatgcaggcagcgacgagcgccagtgagtgtaggagcctggcagcgggagcattggtgccggtagtgcaggagcctggcagcgggagcgttggcgcgaggaccaccgtgtcgcaggtcaagacttgggagtgcatctggaatcc

SEQ ID NO: 68821 - DNA, 108 bp, Triticum aestivum
  Clone ID: PAT_TA_68821
tgctggaaatatttataatattgtactttgactacgttgcaacttgttgcaagactgttgtattgccattcagttgctaaaattattatactttgactaaaaaaaaaa

SEQ ID NO: 68822 - DNA, 177 bp, Triticum aestivum
  unsure (1)..(177): unsure at all n locations
  Clone ID: PAT_TA_68822
tttggttttttttgacagaacagatcagagagaggggaggggagatggcggactggggcccggtgatcgccgcgacagtgctgttcgtgctgctgacgccggggttgctgtgcacgctgccggggcgcgggcgggtggcggagttcgggagcatgcacaccagcggcctctccatnc

SEQ ID NO: 68823 - DNA, 564 bp, Triticum aestivum
  Clone ID: PAT_TA_68823
gcgacgccctcctctgctaccgacgcatcgcaggggccggggccgccgtcccgcccgccgctccttctctgctgcaccacagacgctagcgcggatcgccgtcgccgcccgccgctcctcctctaattctagacggacgcgagctcggatcgccgtcgcctcctccggccgctcatcctctgccgccccatggtctcgacgccggaggctctcctattggtcggatgctgcccccacggatgcgagctctcgccgctcctccttttctgccccacgggctcgccgccgaccgctctcccttcgtcggttgctgctctatacgcccatagccgtaattgcggaacgcgccgccgattctctgcgctggaagatcaggggaaggctctcctctgcatcggatctggcatcctgagccttccaatgatcggatccggtgagatttgccacctcctgctatcgtccatgtgtagctcgtcgacttcacccaggatggccaccaagacgagtcgacgacctctgcctcatagctgtcttccccgagagctgacgctgtctccatgccgc

SEQ ID NO: 68824 - DNA, 908 bp, Triticum aestivum
  unsure (1)..(908): unsure at all n locations
  Clone ID: PAT_TA_68824
gggaaccacaaatccccacccaatctcgtctccgatcgactccacgctcgtcgaatactcctcccccaccgcctcaagatgcagatctttgtgaagaccctcactggcaagaccatcaccctagaggttgagagctccgacaccatagacaacgtcaaggccaagatccaggacaaggagggcattcccccggaccagcagcgtctcatcttcgctggcaagcagctggaggatggccgtacccttgctgactacaacatccagaaggagtccaccctccaccttgtcctgcgtctgcgtggtggcatgcagatcttcgtgaagaccctcaccggcaagaccatcactcttgaggtggagagctccgacaccatcgacaacgtcaaggccaagatccaggacaaggagggcattcctccggaccagcagcgtctnatcttcgctggcaagcagcttgaggatggccgtaccctcgctgactacaacatccagaaggagtccacccttcacctggtgctncgcctgcgtggtggtatgcagattttngtgaagaccctcaccggcaagaccatcacccttgaggttgagagctctgacaccatcgacaacgtcaaggccaagatccaggacaaggangggcanttcccccggaccagcagcgcctgatctttgctggcaagcagcttggangatnggccggaccctnggccgactacaacattcagaangagtncaccccttcaccttggtcctgggcctgcgnggnggcatgcaaattctncgngaanaccctcaccngggaagaccatcactctgggagggtganagctccgaaaccatngaanaacgtnaaggccaagatccaggacaggngggggntttnccccggaccaacagngnctgatctt

SEQ ID NO: 68825 - DNA, 675 bp, Triticum aestivum
  Clone ID: PAT_TA_68825
aggaattcggcacgaggctctatccgccccgtctcccacccctgctcatccctatcctgaagctctcatccagcgaatcctccccatctctctcacctgctgttctactcgccggcgtcgatctactccgacctatcgccggcgattctgcttgccgctcctggagcggcccaccattccgcaaaaaaatgtcggatgaaggcagttgtgcggcggacacgggtgatgagaaacttctaactgatagcgaggattcagctcagagtggtgtccgcccattgccgcaagcaccaacttcctgtatgtctatcaagcatgttgtcgaggtcattcagactttcaacgagtacaagcgatttcttgttaagagcattgggtttggtggaatgcttgatctccaaatgctgcagaaattaaattttaaattcagcgcctggacaatgagcaaagtaagcaccacctgcgggccatcgtcctggctgagaacaaaatgctgccactagtcaactatacatcgacctcccacacgatgctgccacaactgttttcggccggaggagtaatgatcttcccggtcgcaagtatgtatctcgtcttggattccagacagacccctggtgcaggggagttgtccctggtgcaggggagttgtcccgtacccatcacaagctggtg

SEQ ID NO: 68826 - DNA, 381 bp, Triticum aestivum
  unsure (1)..(381): unsure at all n locations
  Clone ID: PAT_TA_68826
cttctcccttcttcttcttcttcttcttcttcttcttcttctccggagcaacaaggaggagacncagaggagggaggacgacacgatcttgccactagctgcatttntcctcctntcgcattggtcgtcttntagttccaccggccacnancctgcgcaggactgaaaagggcgatgggggcaggggaggaggatgcggcggcggcatggnanaaggnggaggccaaggagganaggatcatggngtccgngcgggngcggccgctcaacggcagggagtccggcgacagctccgactgggagngcatcagccccaccaccgtcatgttccgnagtaccgtccctgaccgngccatgttccccaccgcctacacctacnac

SEQ ID NO: 68827 - DNA, 415 bp, Triticum aestivum
  unsure (1)..(415): unsure at all n locations
  Clone ID: PAT_TA_68827
gcgagncgcgtccccaatctgctcgacgccgccgcggcgctcttgccagtggagctccgcctcgccgtctgggaaaacacgccattcaagtacgtcaaagtggtcgtgccccgcctcccgcgcgccgnctcggtggagctgcaagggctggatctcgccttcgccgacgagccaggcagccggcaggggttcccggcgctggagaggctctccctcacgagctgccgcgccgtcctcacgaacctgctcccccgctgtccgcggctgcgcgtgttcaggctcagggatgatcttcttgtctgtcaacacaagaacatcatcatcagatcctcgtcgctgcaggagctggatgtggagagcaaggtccccttcctgcaccgcatcgacatcgaggcacctgcgctcaagcgactgg

SEQ ID NO: 68828 - DNA, 214 bp, Triticum aestivum
  unsure (1)..(214): unsure at all n locations
  Clone ID: PAT_TA_68828
ccgtgcggtggtggcggcnngggggcctttccctgtacnctctcgcggcaagaccggcgttggcagcttcccatgtgacggttgacggcgccgccggcgcgcatgggatcttcggccggtgcatgcggcgtccacatccatccagatcgaggccaagcaaaactatttgtgatccaggtgtgtgccatcaagtaatctaggaagttaagatcca

SEQ ID NO: 68829 - DNA, 194 bp, Triticum aestivum
  Clone ID: PAT_TA_68829
cccgtccatggcgatttcgagaccttctcccactcgagacttgatttctctccccttccccttcgctccccggtgtcgcggtttaaatgggtaggctacggaaagtgtctcatcaggatgttccattagtatcatctttagagagtgcagattcactggatgaagcttttgtgcctaatgattttgcagaagat

SEQ ID NO: 68830 - DNA, 172 bp, Triticum aestivum
  unsure (1)..(172): unsure at all n locations
  Clone ID: PAT_TA_68830
ggctactacacgctcgacaccttcagataccgagcgcacagggacgaggcctatggcgaggcgagcactcgccgttcgcttgccctgtccagattcagcccttccagttccagacgtaccttcttctccgtgtgcnangctccgagcagggacctggtgcttgatgccggga

SEQ ID NO: 68831 - DNA, 318 bp, Triticum aestivum
  unsure (1)..(318): unsure at all n locations
  Clone ID: PAT_TA_68831
ggcttttgagaatcattagcagaagtattgaaccctgagttttcatttatttcgtcctggttattgtgagaatgcggaggttcaatccctttggggggaaagtacagactggagtggaaggccgcaccattgatgtaaggaatgtgaagatcacagtacgcaatgccattgcacaaggaggtttctcttgtgtgtatctcgcatgtgacgcgttgcactcgtcaaagcagtatgcattgaagcatatcatttgcaatgactcggaatcgcttgatcttgtcatgaaggagatccaggngatgaatctcctcaaagggc

SEQ ID NO: 68832 - DNA, 240 bp, Triticum aestivum
  unsure (1)..(240): unsure at all n locations
  Clone ID: PAT_TA_68832
ccggccggcntctggcgcgctccgccgtgatgcgcgtctccccggggctctcctctttcgccgcggacacggcgcgcgcgggggagtcgttgcggccgctgttggaatttgccaaggacaaggtagggggcgagggggccgccgcagcgacagaggtgcggctgatggcaaccgctggcctgcggctgctcnaggagagcgtccgggaggcgatattggtgtcctgcaggaacgccctca

SEQ ID NO: 68833 - DNA, 219 bp, Triticum aestivum
  unsure (1)..(219): unsure at all n locations
  Clone ID: PAT_TA_68833
actgtctcggccaccctcaacagaacagtttcaagcggcattagcggtgcgagttactacaccggcaccttcaacacggtgaaccgctcgcctgacggcagctacgtcgctgtctccagccgcnncaacttcttcttgacatgggagccngggcagctatattgncanncgcacaacagggctgtggcgcggcggatacagaacatgggttggagagca

SEQ ID NO: 68834 - DNA, 595 bp, Triticum aestivum
  Clone ID: PAT_TA_68834
gcatggccaccaacggcggcggcggcagatgtgccggtagcgacctcaatttcgttgaatccgttgcccactctacccttcgtcgctctcccactgcccttcctcgctctcccaccgcccccgtgctagggttcctggcaacggtggatatttcaccggcaacggagaggagctcgacgagcaaggtggcagcaagttcaagcccacctccgatgacattttttcacggccggcagcatcattggcccaggtctggaaggcaaatcctacacagagccaccacttcacctctggcctaggcggcgtggaatgagtcttcttcttcctcttaactctctgaattggctaggaatgcttagctctgtataatttttcgtgtagtctatactttgctcttagccaactgaatttaggaattatggttaactgaatttaggaattagagttaactgaattgttcatgtttatttgttcgtgtatgtattagctatcttgaggtgtactcaatatacattttagtgttatctgaaattatttggaactgaattatagtttaattgaaagtagtgttaactggaaatattttcaactagtt

SEQ ID NO: 68835 - DNA, 680 bp, Triticum aestivum
  unsure (1)..(680): unsure at all n locations
  Clone ID: PAT_TA_68835
ggaggcctcctagnaaaatggtacaatgagaaaatggaggcaccacatgagcaattatgtctacagatgtgtttcaaggatcaacatcaattcagagaggctttgttgaacttacacatcactcaaggcagaaacttcaaatatcataggaactcagatcaaagaataattgtagaatgcaaccaaaaacattgcaacttctttatggtggcagcagttataaaaggtgaaactacttttgtaattaagaagatgagaattaagcacacttgccctattagtacagagacaacaagggtaagtgccaagtggcttgcacagaagtatgagtcactgttcagatctgatctaacaactggcattcagactttgattgatgcctgcatggagaagtatggtgtggatgtgcccaagtcaatggcatatagggcaaagaacctagctattgatgatgtgctaggagaccacaagaagcaataccctaggttgaaagactatgctcagacagtgatggatacaaaccctgggcgtagagtagtagtcactactgtaactccaacacccactgaaaaaatcccccatccaggtccaagattccatgctatgttctattgcatcaatggagcaagggaggggtttctcaaggggtgcagaccattcatttggtgttgatgggtgct

SEQ ID NO: 68836 - DNA, 620 bp, Triticum aestivum
  Clone ID: PAT_TA_68836
gctcaaggagaagaagaagaagggcgtcgtcgccgaccccgacgacgaggacgaggacgactccgacgacgagtcggatgaggacgaggccgtcgccgccgcctcgcgccgcgtcgaccgccgcgtgctccaggtcatccgccgcatccgtagcggcgacagcgccatcttcgacaaggacgccaaggtgtactcctcctcgtcggaggacgaggacgacgccgagggggagcccaaggaggggaagaaggccaagaaggagcgcccactgtacctcaaggacgtcaacgcccagcacctgctcgaggagggccccgagttcgcggcgcaggctggccgtggcagcaagtatgaccggattgcgtacaacgagctccagagggaggggctgaaggagttccttgaggcggagaagaaggcattgggggatggcgatgacgaggaggacgatctgttcaaggcgaagcaggctgaaggagatggtggcgacagcgaagaggacgaagacgagaagcagaccgaggagctgttggttgaggtttttggggatgatgacaagctggatgaaaatgagaagtttttgaagaattacatcctcaataggccgtaccttgaaccag

SEQ ID NO: 68837 - DNA, 654 bp, Triticum aestivum
  unsure (1)..(654): unsure at all n locations
  Clone ID: PAT_TA_68837
ccccgggnctgcaggnaattcggcacagggtctcggctcctcatcctcctcctctgcttcatcatcgtcatcttctccggcgaggcggccccgacgaccctggtcaccagcctcccaggctttgacggcgccctgccgttccgtcttgagaccgggtacgtgactgtggacgatgagcacggctcagagctcttctactacttcatcgagtcggagggtgacccacggcgtgaccctgtcctcctctggctcaccggcggcgaccgctgcagcgtgctcagcgcactgctcttcgagatgggcccgctgaggttcgtgatcgagccctacgacagcgccgccgggaccgtgccgcggctgcactaccacccctactcctggaccaaggccgccagcgtcctcttcgtcgactcgcccgtcggcgccggcttctccttctcccgggaccccagagggtacgacgtcggagaggtctcttcttcgctgcagctcaaaatgttcctcaccaagtggttcactcagcatcccgatttcctctcaaatcatttctatgtcgggggagactcgtacgccggaaagtacgcaccaatcgtcacgcagaagatctcagaagatattgaagcgggagtgaagccgacaattaatctcaagggc

SEQ ID NO: 68838 - DNA, 540 bp, Triticum aestivum
  unsure (1)..(540): unsure at all n locations
  Clone ID: PAT_TA_68838
gcgcgcctccaatacaccgagcctccagcaccaccacgcccgacnggcacgcagccgcgcgtgtgtggacactcgcgcgacccttgcccctgctgcttcccttatccttctcccacagactgctactgctccatccctatcgactggaccaaggacccgaagcccttctacatcccctacctcgctgctcctgcccttcttctcttcccttacctctgctgctgcccttgcttcttcactgaatctcttcgctgctgctcctctaccacgtcccaactactgctgctactccttctcccccatgaaactgctacaactccactctccagcgcctcctttgctgattctctgctctgaacctcaagatgctgctgctacttcttcttctctgaacccaaactctactgtttgctgctcctctttctttgctgctgcttcttcttctcatgccccctgctgcttctctcctcacgcccctgctgctgctccattcccaatctttctgctgttctctctctctctctctctctctctctctct

SEQ ID NO: 68839 - DNA, 103 bp, Triticum aestivum
  Clone ID: PAT_TA_68839
ttgtgttttaaaggtgggaataaggaggtgcttatttttctaagggaaagttccacgggtcttgaagtagctgaagtataaacattagttgctttaaggccca

SEQ ID NO: 68840 - DNA, 184 bp, Triticum aestivum
  unsure (1)..(184): unsure at all n locations
  Clone ID: PAT_TA_68840
ctgctagcccgcacgagctgctccatggggccgacgacgaccactactgacgcccttgtgttccaggttccaacagccccgaggtaccgacgagcgtgcggaatcaagctgccacaaaaccaacatcgacgatcctgcatcgcaactccggcggtgtcgatgcccgctgcatcgcagctccgnc

SEQ ID NO: 68841 - DNA, 390 bp, Triticum aestivum
  Clone ID: PAT_TA_68841
gtcccctccctccccgtagctttgccactccctccctgtagctttgctcaaaggctatctccaattctccatcacgcacgtccagcgacagatatacccaatggggggctcgacgaacgtgaaggaatggtggcctgccgtattcatggtgttggtccagattttcacgacagggttggtgttgctcacgaaagtggtggtggacagtgggtcacttgcttggaccttgctcacataccgcttcttccttggcgccatcttgaccgtccccttggcgatgttctttgagaaagggaggttgaaggagcttaaattgaaggcattcatatggattttcaccagtgcacttgtgggattcacaattcctggtctctactacattggcctcgg

SEQ ID NO: 68842 - DNA, 660 bp, Triticum aestivum
  Clone ID: PAT_TA_68842
cccctcccgcccctctggtcctcggccgccgctcgccatcctcgacaccacctcgcaaccgcgtgctcctccaccggtcgctatagccgtgtacgccgccccgacgtgctcatctgcagccctcccggacgcggaccaggggctaaactgcgcagtcgcaactatcagaccagccatggctaaaggcccaagcagtcaccatctcaactcatcggccagcccacctttggcaactgctgctctttgctgcttgccgcccctgccagcggctacacagccaactagagaaggttgaaaagggaggaatgaccacatctgatcctcataattcagaggggcttaagtggaagtcgatctggtgagctccgtgttcgataaacattcaacagtttctatggcgtcttgcacatgagtcatgacagcctacgagtggagttggatcaaatatgccctgtgtgtaaccgttttgatgaggatggtggagacttgttcttcaaatgcaaaccggtgcggaagatttggcaagagttgggcattgaggaggtccggcaacagtgctaggatctgtctgatccaaagattgctgtgcaacggattttaggccatccagaagagctcgaatcaaaatgtatcgctctactatgcaactggcggaagagc

SEQ ID NO: 68843 - DNA, 268 bp, Triticum aestivum
  unsure (1)..(268): unsure at all n locations
  Clone ID: PAT_TA_68843
aggaattcggnacgaggcttcgacgtcctcctctacctcgccttcngcacctggacccctcctccgagcgcacgcggacgcgccacgtgcggaacggccnctccagactgtggttcctgggccngttcgtgctggagctcgccttctgcgagttcttcctgcagaggtaccccagggaatcccctgggccgatgcgggagcgggtgttcgcgctcatcgggaagaaggngctgcccaaatggatcaaggcggcgagcctgcataattt

SEQ ID NO: 68844 - DNA, 321 bp, Triticum aestivum
  unsure (1)..(321): unsure at all n locations
  Clone ID: PAT_TA_68844
ggaggccggtctcgccccccgccggaccgcgcgtaggcactaggtaggaagagccgtcgccatggcgctccatcgggcgcccatgtattccgccacggaactctagggatttgggggtcgattcggggaccaaatcgggggatcactggagcctcaggggcgatgcagatcgatgatgcgttggtgcctcaggtctaagctgcatgattgggctgcaggtgctgttcctgatcgctccatcatgctacatacatacattgtgcaattcgttgccggatcggtgatacccaacggnttcgatttcggctctactctggccaa

SEQ ID NO: 68845 - DNA, 428 bp, Triticum aestivum
  Clone ID: PAT_TA_68845
agaggttacttgttgggttctcgctgtcggagttcggcggcggacggagacggagtcgtagtcggagcgagaggtctagctggtggctgcggaggcgaggcccggaggaagcggctgattgagtaagcgcgtctagcacaggaaccaagaggaggaagaggaacccaatccaatcatggactcggagcactggatctcgcgcctcgccgccgccaagcgcttctatgccgcgcagctcggccacatcgacgatatgtcggggatggggatggaggaagtggacatggacatggaggacgacctcggctccctctgcgtccacctcgaggaggaccacccctacgagccacaccccgcgccttgccccatctgctctgaaaagattacaagagatatgctaaatcatatcaccatgcatcatggttact

SEQ ID NO: 68846 - DNA, 596 bp, Triticum aestivum
  unsure (1)..(596): unsure at all n locations
  Clone ID: PAT_TA_68846
aagtgcnctaatgcttttttggaattccattggttttctggaaattttggtgaaagcaagatttaagacagagaggttcatgtgctaggccatcgacacacctctcttcaaggtaaggtcagttctaaggtgagctcatcctattttctttcttcaatctcaggcgaagattcatctctctaacctactacctctctatagaatttagaaatccgaaagttagaagatgtaggcagaattagtcatgcattcaaaagttagggatttcatgctacatgcaaaatgttttctattgggcagcaacacataacatgtggcgctttagggctgcttcctactagttatcgacataaaatttataattttgtgatgcctagccttttactgttggaaggaggatattcaatgtggttctttgcccccattttttatctatatgcattgcgtaaaagttctttgtgttttgttgatggaatattgatactcagctgtgtgccaatttataactaatcataaaagggagaagaataaactcaagcacattggataaatgcaacttgcagaaatttaatgttctcttctcctttgtaggtccc

SEQ ID NO: 68847 - DNA, 147 bp, Triticum aestivum
  unsure (1)..(147): unsure at all n locations
  Clone ID: PAT_TA_68847
atactttgctcgaagcaacaaaagttcctctcagtagttggacattcatatattcacaaaattcattgntatttttgttgaacagaatatttttccgcattacgccgactatggcacttcttcgatgcaataccttattttaaattg

SEQ ID NO: 68848 - DNA, 627 bp, Triticum aestivum
  Clone ID: PAT_TA_68848
gtgttgctctccctcccctctccccccctctctctcttgcgcgcttgcttgctccccttctccgtgtgagcgaggccgagacggagcaccagcggaggagggctgtgctgaagaaggctgcgccagcgagagcttggtgactggttggccttttcctacctactggacctgcagtactttgaacatgctttttgcatatcactgcattaaggatgaataaaatgttaagcaccgactgtttagggacgcaggagtttcatacattccacaagaccactgaaatactggaagactcgcaacctcaagagattgcattccacgaaacagcgctggggtcaacgctagtagatcatcaaaatgtccactctactgccgcagtatcagcggtagacattggaatggctgaagtcagcttgttgcatggtgaatctgacacatcagctaccggtttactgccagtgtcattcttgtcatgcagtcctagatctatgtgatgttcagttgaaagaagtgatgaactacaatgctacagcaatggatgaaagcactgagttccttcagctgattcttagtggcaatgatgaaggctacaatactacaagcgaactgcaagtttgggatgttctg

SEQ ID NO: 68849 - DNA, 670 bp, Triticum aestivum
  Clone ID: PAT_TA_68849
gcagacgcgggcagctgaggcagggcttgcctggttctgcttcttctccccactgccaacgtagtgttcagaccaaggctctcaccgggttggccggcgcgtccatggcgtttggccgcgtgtatataagccggcagaggcgcggcaggcaaaggagtcgccgcctgctgctctccggccgccgggcgtgaggaagatcgcgttgccgctgcttcggatccttccttccgtgtatagttttgacgatcctgtcaatcgaagatcagtaagtcagtctaaaacctgtcgatcaaagacgagagagatgtcagtccaagccgagggcgcggcaggcgcggagaggatagcgccccgcgactcgctctacggggacgcggagaaggtctccgacgacaagcaccacggcttcgcggcgggctggtggcagacgctgcagctggcgttccagagcatcggcgtggtgtacggcgacgtggggacgtcgccgctgtacgtgtactcgagcaccttcccgggcggcatccggcacccggacgacctcctcggcgtcctatccctcatcctctacaccctcgtcctcctgcccatgctcaagtacgtcttcatcgtcctctacgccaacgacaacggcgacggaggaacgttcgccctctactcgctgatctcccgg

SEQ ID NO: 68850 - DNA, 512 bp, Triticum aestivum
  unsure (1)..(512): unsure at all n locations
  Clone ID: PAT_TA_68850
gagaactngtctacccgggcatctggactcacctcctgatcgcgccgttccgcgcgcgcgcattcctggagatgaaggtcacggcgtttcttcccggcgtctgcggcctcgctctcctcctcctcctccccttgcatgccgctggcgtggagtctcgaggacctctgggcggctaccactggtacaccatgttcatgttcggcgattcgttcgcggacaccggcaacctccccagaacgagctgcaggagctccttgtcgcgtcaatggcactacccctacggcacctttaatggaagtcgaagtggcaacccgctcggccgcttctccaattacttggttcagcccgatatcatcgcgaggatgttagggcgcctcgtaggccctccggcgtacaagcgcatggtgaagcactactgtgacccgtccggcatgagcttcgccgtcggcggctcaggcgtgttcgaggtcccggagaacctgacgaccctctccaagcaaatcgacaacttc

SEQ ID NO: 68851 - DNA, 614 bp, Triticum aestivum
  Clone ID: PAT_TA_68851
tggagcttctgctggagcatctggaggtagcaagatggatggaagctctcaactgagtagttctggctcacggtatcttctgaagacagagatggattccacccctcttccaaatgaaagacgagagcgccatggtgggctagacaaagaacgggttttggtgaaaggaaacaaggcacatatttccgaggatatgcaaccaggaaccttaagtcctgtgaccaagggtaaagcaaccagagcaccaagaaccagttcgcttgtcggtatccactcatcatctactttgctacgctcagctggaggaattgatgaatgggaagaagcaccttgcacaaataaagcctcaccattgggaagcaccacaaatcgcaagcgtcccatggctgcaactgcctcttcacctcctgttgcttgggtgggtcaacgtccacagaaaatgtcacggacaagaagagcaaatgttgtatcaccggtgtcaaattttgatgaacccgtatctgaaggatcaccagttgatgttgctgttaggccagcattagaaacgcccggccttttacttccgaggggtgcagctagcaataattcacaagctgcatctagaatggataatg

SEQ ID NO: 68852 - DNA, 260 bp, Triticum aestivum
  unsure (1)..(260): unsure at all n locations
  Clone ID: PAT_TA_68852
gtcaactttattcaggtgtttatggatgatacatcactatattgccccacttgagtactactccgtacctgatattagcattgcagggtgcagtatccggctttgcaccaagtgttgttatcccgttactgataattaccggnggagtgacattcacagagtctgcaatgggtaggtatattggctgaccaattgntattcgnctcanccaaaatgtttctcgtgtatgttngatgtcagatatataaatggnccggcat

SEQ ID NO: 68853 - DNA, 231 bp, Triticum aestivum
  unsure (1)..(231): unsure at all n locations
  Clone ID: PAT_TA_68853
catccgctccaacantnngaaacaccggtaccttggaggagctggggatggggnggggnagctccttcccacggcgcgtggcgcgagcagccaagcggttcatgccgttcagccggggcacagctcccggcgacgatctgaccgactccgcggtgcggaggttcgagaggatagccgacggcgccgacggcttcttcgagctcgtcaggtgcngnngccgncccaagaccc

SEQ ID NO: 68854 - DNA, 255 bp, Triticum aestivum
  Clone ID: PAT_TA_68854
ggaggtccaaggaagcagcagatggaaaccggctctgtgcgtgattcttgtggagctgttcaacacagggactatacttctaggcaaggtcgcacttgatggtggcatgtttgtcttctccttgctatgttatcgaagtattctggccgctattttcatcatgccgtttgctctattcttcgaaagtgggaagtggagggaattggatatgaagactcttgggtggctcttcatcaatgcttttatcggatattc

SEQ ID NO: 68855 - DNA, 118 bp, Triticum aestivum
  unsure (1)..(118): unsure at all n locations
  Clone ID: PAT_TA_68855
taaagattgccgctttcttctcaatattaatctgcggggcgctcgagtgcggcctgcctgtgatgggacngcgtgtgccttgnctgaactctnatncctactccttctttctnatcaa

SEQ ID NO: 68856 - DNA, 918 bp, Triticum aestivum
  unsure (1)..(918): unsure at all n locations
  Clone ID: PAT_TA_68856
cggacgaggagcgcctgatctttgctggcagntgctggaggacggccgcaccctggccgactacaacatcagaaagagtccacccttcacctggtgctccgcctccgtggtggtatgcagatttttgtgaagaccctcaccggcaagaccatcactctggaggttgagagctccgacaccattgacaatgttaaggccaagatccaggacaaggagggcattcccccggaccagcancgcctgatctttgctggcaagcagctggaggacggccgcaccctggccgactacaacatncagaaggagtccacccttcacctggtgctccgcctccgtggtggtatgcagattttcgtgaagaccctcaccggcaagaccatcacccttgaggttgagagctccgacaccatcgacaacgtcaaggccaagatccaggacaaggagggcattcccccagaccagcancgcctgatctttgctggcaagcagnctggaggacggccgcaccctagccgactacaacatncagaaggagtccacccttcacctggtgctccgactncgtggtggtatgcagattttcgngaanaccctcaccggnaagaccatcacccttgaggttgagagctccgncacccattcntcaacgtcaaggccaanatccaagacaaggtagggcattnccccagaccagcagcgnctgatcttngctggcaagcancttggaggacggncggacccttgcagactacatcattnaanaggagtccacccttnacctggngcttcgtctncgtggnggtntgnaanatcttcnngaanaccctcaccgggaagaacatcancctttgangttgagagntcnnnnncctttnannangnanagggccannatccnggacanggaggggnttcccc

SEQ ID NO: 68857 - DNA, 586 bp, Triticum aestivum
  Clone ID: PAT_TA_68857
taaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagggttccgttactaacatgtttacttccattgtaggtaacgtatttggtttcaaagccctacgtgctctacgtttggaggatctacgaattccccctacttattcaaaaactttccaaggcccgcctcatggtatccaagttgaaagagataagttgaacaagtatggtcgtcctttattgggatgtactattaaaccaaaattgggattatccgcaaaaaattatggtagagcgtgttatgagtgtctacgtggtggacttgattttaccaaagatgatgaaaacgtaaactcacaaccatttatgcgctggaga

SEQ ID NO: 68858 - DNA, 653 bp, Triticum aestivum
  Clone ID: PAT_TA_68858
ccccgggctgaggaattcggacgagggtccccggccgcgccgtgtggagagcttcgactggccgacggacaccctgctcccgtcgcagacgctgtcaaggacaagaagctcgtcgccggctactacgccctctactacgacaacgacaacgtgctgcggctcctgtacgacggcccggagatcgccagcatctactggccgaacccggaccataacgtgttcgacaacggccggacaaactacaacagctcacggatcggcgtcctcgacgacaccggtgtgttcctctccagcgacaacctgcgagtcgaggcctccgacctgggcgctgccggcgtcaagagacggctaactatcgagcaagacggaaacgtgaggatctacagcctgaacgcggccggaggatggacggtcacgtgggcggcggtaaagcagccgtgctccgtgcacgggctgtgcggcaagaacgccctctgcgagtaccaaccgtccccccgatgctcgtgcgcgccggggtacgagatggtcgaccgccgcgactggagaaagggctgcaagcccgacgttcagcctccccaccggcaccaccaacttgtagtgaagctccggcgtcggagcggttcacgttcgtgcaggtggcagcaaccgacttc

SEQ ID NO: 68859 - DNA, 686 bp, Triticum aestivum
  Clone ID: PAT_TA_68859
ggaattcggacgaggcgccgctgccctcgtgcgatcccgatccccttgactaacgcagcgtgcgatcccctcccctcgagtaaacgccgccgatgacctcccggatcttgtgcgatctatctcgctgccgcctacgtccggggtggcactgtccggggtcgaggccaacatcggcgtcatcaagtgcggacgtcgaggcccccgactcgtgggccgccgccgccatcacctcaccccgggtcagggcgtggctgtgaccgccgtgcgggcaacgaggagcgccgcaagggcgtaccgtggaaggcctggatcaaggaggagcacagatcgagcaagataaagtgtgacgtgtgggagattggccggggaggataccgccgtaggtgacgccatgaaccgaggctgatgttggagagccgcggctctgcttgggagccggccggtgagaggcagctctccgaggtggtgttgcccgtggcggggatggacaatccagtggccggcctgcacccctggacgctcctggggcgggccatgatagtgagtgtgatgggtgctggagcagcatgatgccaacaaccacgagctttgggtgcttagtgtgttggcgaggcatagaagggatgagagcgagatagacatgtgtgtgcatggattgagagagagagagagggaggtagagagaa

SEQ ID NO: 68860 - DNA, 600 bp, Triticum aestivum
  Clone ID: PAT_TA_68860
tgggcaagccctcttcaccgctgaatgttctcacatgttccattttcactgcatctcctccagtgtaaaacatggaaattatgtatgcccagtttgccgagcaaagtggaaagagataccctttaatcgctcgctatcttctatagttcctcgtggaagaagtgggttgaatgtgaaccaagctcgattaccccaacaagatgcttacatggctctcctccgtcaagttccaacccgacagcgagaagcacccgccttgcatacttctgagccagtagagttcaatgatgatgaacctttgcagctgatggaggctgctgacaattgtgatgttaggtctagtaaaactgtggaaatgaagacatattcagagttctcggccattccacagtcatcatctcaagatgatttcgctgttctgatccatctgaaggccccctgtgctaacccagagcagatcacaagcagaccggttaatgcaaccctcagttgggtatccgacatctcgtgctcctgttgatcttgttaccttgcttgatgttagcgggagtatggcaggaacgaagttggcgctgttgaagcgagcaatgggttttgtta

SEQ ID NO: 68861 - DNA, 225 bp, Triticum aestivum
  unsure (1)..(225): unsure at all n locations
  Clone ID: PAT_TA_68861
ggctcgcagtctacgacgagctcataggacccanggagcggcgccatggtgatctcggtccccagccaccggcgctccatgcgcgacgcaatgctcggcgggggccgccagctccacaagccccttcgctgcgccttctacgacgggattcccggcgaaggcctcgccgccgcgctcgccgaggccactgggagcgtttccctctcccgcacccccgccaccgac

SEQ ID NO: 68862 - DNA, 105 bp, Triticum aestivum
  unsure (1)..(105): unsure at all n locations
  Clone ID: PAT_TA_68862
tcaccagtacacttggtatctccataatcccaatttccatgttgggttgnatcatcacgtagaagntaaatcattgcaagtagcattccntngtncagaaatgta

SEQ ID NO: 68863 - DNA, 631 bp, Triticum aestivum
  Clone ID: PAT_TA_68863
gccgcagcactagaagatttgccaccgacgagatccagcgcctggcaaggtcctcgggtcggctatcgctcccaccactccgtcggccagatctgcgcccttgactccctcttctctcgcgtcgcgcggtgcctctgctccaccatgcggcggttacctcatggatgacggggccatggatctgtccttgaaggagagaaggaatatgacggagagagaacagagaaggaaggagaggcgggagaaggagagaggaaagaggagagggaggtgcagcggcagatgggagatggtcatcggccgacattagtcattcagccattcgcatctctcctcttctcctgctctcgaccaccaatgcaccccctcctctttcccttctcttctcaccatctcctcttctatggagctagctgagtgatccacggtgaggaagatggggaagacagagccaacaccgccgatgcccacgggccacttcagtcaggtgccttccatacttcctccttcaggattttcaatccaaggttagttttgctttgaatctatatatgcttctacatgatatttagtttctgtactatgcgcttgaaaaaatgacaaggccgtgcagcagagcataaaatgaagc

SEQ ID NO: 68864 - DNA, 572 bp, Triticum aestivum
  unsure (1)..(572): unsure at all n locations
  Clone ID: PAT_TA_68864
tctcgcacagggnagccgacaagccatgcggcctagccttcgccgctgaccagttcgatgccgaccaccccaaggagcgcgcctctcgcagctccctcttcaactggtggtacttctcgatggccatcggcatctccgtcgccgtcgctgtcgtcagctacatccaggagaatgtcggctgggggatcggcttcggcatgctctgtgccattatgttatgcgccttcgccgtcttcctctccggcacccccacctaccgcctctatgcgcccaccccgggcgccgagagccctttcgcccgccttggtcgcagcctcgtggggctcggaaggagctcgagcttcttccatacaaaaggataccaagatgaagacgtcgcggccaagtcggaggaggcgcgtggcgtgctgcggctgctgccgatctgggcggcatgcctagcgtatggcgtggcgtacgcgcagatcatgactctcttcaacaagcaaggacgcaccctggaccgacgtgtcttcggcggcctggagctgcccccggcggcgcttcagacgctggggccagcgagcatcctg

SEQ ID NO: 68865 - DNA, 564 bp, Triticum aestivum
  unsure (1)..(564): unsure at all n locations
  Clone ID: PAT_TA_68865
gggtgagctcccttgcatcggtggcccttacgtcatgtggccgtcatatctcagggagtccacactagccatggccccgccggagaccgcaccgttagcctccatattcccttcccggtgttgacccctcatcttcctctgtgcggcagaggtgatggcacagtgggagagatgggacaacaggccccgagctcgctccctgccgcatttcctgaccaccaccggccacctctgtcgcttgctttgccagcaatctccggtgcacctatccctcgatcccctccgccagtttcaccatgctacaagtgttctttgctcccacgtgcactgtcgctgctaaccctagcagcctgcttgagctagccagcgcaggcgcgctattcaccgttggtgccactctcctggatggcgaacaggatgtctaaggtgccaatgagcgaggagtgtgtggaggtgttctagaagctgcatggcgtgtgtgcacaggtttgtggcatacaagatggatgacaacacgcanaaggtggtggtggacaaggtgggcagcctggacgctactttcaa

SEQ ID NO: 68866 - DNA, 109 bp, Triticum aestivum
  unsure (1)..(109): unsure at all n locations
  Clone ID: PAT_TA_68866
ccggaaatggcggcgcggcacctcagatncggcctcccgctcctccaagcccgcctcgnggctaacgaatccgnggncgtcgctcaggtgtcgagggggcttgcaacgg

SEQ ID NO: 68867 - DNA, 613 bp, Triticum aestivum
  Clone ID: PAT_TA_68867
attcggcacgaggcttttccccaaagccttggcttaccttctttatccgcttttgctgggaatggagtggaagcttgactaattaagtaagggcatacgccgcaaatggttgacgcgatgcagctgtcagccattcagaaccaagattgtgcaggctcgtagatcccttcgactccacacagggagtgacagttccaattcacagtgatcatgggtggcgtctgttcaaggaagcgaagccaattggtggaggatgacgacgattctctccagacaccgacgaggttctcgaagaccagcagcttgaaatggctgctgctcacgctgccccgcagcagctccgatatctcccgtaagggaccagggaagggccctggccggtgcccgacactcatggagctctgtgtcgccaaagtctgcaaggatatcagcaagtattctacttttgctatgctgccgagtgatctcagccagcaggttttcgatgaactggtggactcgaactgcctcacggaggaatcgcttgaaacctttcgggattgtgcgctgcatgtaaggacatttgtttgggggagtatcctggagttaaggatgcctggatggaagtagtggc

SEQ ID NO: 68868 - DNA, 349 bp, Triticum aestivum
  Clone ID: PAT_TA_68868
tccggcgccgcgctgtcttttcgtctagcctcgcgtctccgatccagcgcaatccggtgggcggtctccccattctgacggggctctgatccagtggtgtgattcggcggctgctggatcggtcggcgccacagggagctgcggattcagctccgggtagccagatttgactgcgtagaacgagacctgggaggcgcgcccatcgccagaggtgctcgccggggacggcacatgcgcgtgacgctcacgcccaaggacgaggattggctggtcgtgctgatgacgagggagcgcccgcggtcggcggtggtcgcgcctgggggggacgtcttcaccgccggtggcggcg

SEQ ID NO: 68869 - DNA, 521 bp, Triticum aestivum
  unsure (1)..(521): unsure at all n locations
  Clone ID: PAT_TA_68869
agcctcgtcgccgccccgccttccctctcctctacccgccgntcgccacctntgctnccttccagctgngnggttgtgcctgcctctttgagcttcggcctctccccagctggcgatgagcactcatctccgatgagccgccgtggcgtgccatcctccccctgcttgagtcagatccggccaccccggcctcgcatccggccaccaccacccaccnggatccctcctcgtcataggacaccatcagcaggtggtggtcgaaaacatgccgagaccgccgtctctgcatccacgtgtggaggtcgccgtcgctaggacaccaccaacccgaggaggaagaggtgcagcacccaagctccgaccagtgcttcgtcctctgnctcgnggcttcgacgagttgcctnccccagngattngcctgctctgcatgcgactngcctnttntncgatccggaacctngngcaactaananacnngcccgcatgaaaaanncnnnnntngnnnnnngcanngnnaanna

SEQ ID NO: 68870 - DNA, 674 bp, Triticum aestivum
  Clone ID: PAT_TA_68870
tcggcacgaggcgacggttggcgtgtgacggcggggtgcggggtgatggtgactgcctcgttctcctgggtttggaccgacggtgcgcggggccgggcgggccgctggaggtgccagccgcgcgcataacggggaaaggttcggatctatggttcgtgctcgggcgggctaggtcagggcccggggcggatcagagcaagtgcttcaggtaggagaggtttggcttggcccgggatgtgcttgcaggtatggtgctcgatggtggtggtcgtgttagcgttgcgtcggtgcggggatcggcgccggtgaccacggacacgacgtcgagtgagctcgcctggccaagggttggggctggctcgccagcggccgtcggcagtctcgtgagtcgtgtccctcccagttcaccgggattggctagtgacacaggtgttagtgcctcctacgatggaggcgccgacccagactcggggactgatgtcgggctaggagtagatggtgtgtcgtcactcttcctatcgtggttgagtgcgttgtgatgtgagcggcgcacgctgtcttgcgaaagggatgccgaggcggttcacatggttgctcttcggcgggcaattgcggtggtggtggctctcctcccgggttgtgtgggcaacgggaggtgttgcgactggtagctc

SEQ ID NO: 68871 - DNA, 652 bp, Triticum aestivum
  Clone ID: PAT_TA_68871
caccaacggcggcgctgcttctcgaggaccccgcggccgagccccatccactcgctccctgtgcctttgcctcgacgtgcgcctccacaagccgtcgctcccgccaccgccttccctaccatgtgctccccgggcgacgccctcgaatcctctgcgggcgcccaccctcgtgccggccccaaaccctgccagtatcctaactagatgtcctctctagaacgggcggttagcgaggatgctggtgatgcacggggcctgctcgagaatttccaggttgagctagttgcggttgtcccaccggcagaccatcttgtcattgtagtgctgctctttgtgatagggcatgagcaggacgtcggcacgaacctcgtccagacagcggcggatggtcttcaggaatcctgtggctgcagcatagtgcgcccttacccatgatggtgattaccactgtgacgatcttcctctatattcgggacgatggtaggaggtggattcacataccccctgggcgcctctccaccgctgcaccccatttcccttcctaaggttgtgttttatttcacattgatcaatttgtggggagcaggcccatatgtagcaaggagcaagctgcacaagaaattaattggaaccaagatactcatctttaatt

SEQ ID NO: 68872 - DNA, 224 bp, Triticum aestivum
  unsure (1)..(224): unsure at all n locations
  Clone ID: PAT_TA_68872
ccctgccctcctatgctatatatgctccccgccatggtacaccctactcccacccatccatccatcgatccatcagcctccattgctagccagccacccccattactctccacctagcccaacaacaaccaccgccgccgctgccatggcttccaacaacaccaccaacgcgggctncgaggtgagcaacnncatcaccgacctnaacgaccacctggccaccg

SEQ ID NO: 68873 - DNA, 480 bp, Triticum aestivum
  unsure (1)..(480): unsure at all n locations
  Clone ID: PAT_TA_68873
ccaccaaaancttcctcccgcgccgcaccggcgacctcgtcatcacctacgacgtcgtccaggcatacccgaccagctacctggcgctcgtcacgctcgagaacaacgccaagctcggccgcctcgacaactggcggctgtcgtgggagtggcgccgcggcgagttcatttactcgatgaagggcgcgcacccattggaggtggacgtcaatgagtgcatctatggcgcaccaggccagtactatcagagcctggatttctcccaggtgcttaactgcgagaagaagccggtcatccttgacctgccgctctcccggtacaatgacacccagatggggaagatcgagcattgctgcaggaatggcaccatcctgccaagtccatggacgcggctcagtcaaaatcggcgttccaaatgcaggtgttcaagatgccaccggataccaaccggacaaagctcttnccaccggccaatttcaa

SEQ ID NO: 68874 - DNA, 658 bp, Triticum aestivum
  unsure (1)..(658): unsure at all n locations
  Clone ID: PAT_TA_68874
gcagctggctggnatgcggcgggatgagccggtagaagaaagcaggtaagcagcggcggcctacatgtctatggttggtacatgccgccatctaaaacacttacaatgaacatcaatgtttctgagctttgcttgttgagcctgtcgttgccatgtaagccagccacgaagtgttcagaaaatatctgaagttatattctacagtagaatctaatcaccttattgtggttgttttctgtgtcagtcattatttggataacatcctattggagaatatcggtgatgttaagacattgcaagcattatttgaactcgaagcacttcttcttacaagtatgctcattttataatcgtttccttggttgtggtggattatttagtgaatataattccttttttaggtcattgcatgaaaaataagaatacttatatcactgaattactggtgattttctatcggaagctagttcagttaggcgcttctaacgtcttaagctctatttctcttcagttgcccttaattaccagatgttgggtattttcttccatgaaactgctcttcagtttgatataatctgcaggagcaatccaggagcatggcgtgtcacctatgtcctaatcaagtgtgtaatctcctattgattttgcctactgaatt

SEQ ID NO: 68875 - DNA, 534 bp, Triticum aestivum
  Clone ID: PAT_TA_68875
aggggaaaccctagttgcgccgccgcccgcaccctagatccatatccttgagcttcgccgccaccggagggacgccgacgaagtccgtgcgtggccaaggagggcggtggcggggcgttcttcgtctggcgaggctagtccttcagtcggcggggcgcgtgcttgacggatctggcctccggcgccgtcctctccccggctactaccgttgctcaacggatctggtttgggggccgcggcggaggcatcccgcggttgcgtgcgtggcgcgctggccgtgcgtagtcgtgcgtgggcgccctcttcttcggcgcatccacacgggccagccatggccatgcgcggtgcgtctaccgtggctaggttcttcgtcgttggtgatgcaggtggccccgttctggatccacacggggttgctgccgttttgctcggggtggtgtggttcttctcgtctttgatgtggcagcctgcacacggtggaattccccctcgccgctgcggtcccggttggcttcaaacctgcgttttccaggg

SEQ ID NO: 68876 - DNA, 596 bp, Triticum aestivum
  Clone ID: PAT_TA_68876
gaggaattcggcacgaggcgagagcaggcatcctctttcggaagtggcgatgcatctgttccacaggagatagctccgatggattgaacaaaccacctgatgaatcaaaatctactgagccaattaatatttcgaacagcaattactggagagatgtcagagcgaaccttgtgcgtcgggaacaggtgagggtggcacgtttgtagtgacaatctgtagagctcttagcagcttttctttaggtcttaatcaactattattcgacattcacttacgtaatctggacattcatgatcaccctatgacattacccattatctgccaagaaaataaagaacagtgagttgatcttagctagtttcactggctgtataatgtataatgaatctaatttttgtcaatagtcaatactaataccaacatctgttatggctgctgctaatgctatagtgctatgctagtatgttccaaagaagatataaatgcacagtgtcttcaattaggcgttgcattagaacatcacttattctagaaatctatgctttccattattacttgatactccaaatgtaaggttccaagaaaatatttgtgca

SEQ ID NO: 68877 - DNA, 568 bp, Triticum aestivum
  Clone ID: PAT_TA_68877
gcacgaggtccgacctgcttcctctcctcacctcgcacccctcgcgctgccaccctcccaacctctcatcttccagcgcctcctccccgtcagctcgatctctccactcccagccggtcatccttctcttgcatcgcccggaggggtgcagccgccgccgctcgcatttgttactccccctgcccccaccttgcgagctcgcacatctgctccgcccagaggcgtcgccattgaccgccggaggaccgtgccgcagccaaactcgaggacaaccactgctatggcccgtggagttgcaagtggaaggttgaaccggcgatggcagctgtagcgtgacagacgacatcagcaacaagcaattactcatctttgcatcagcaacagatggatgatggaattgtttcaatctggatattttgcttggaaaaaattatcacgtacagtaccagaagggtgagagtgaatttcaaacggcttatgacaaaggaatgcccaaatcaaagttctgggagcctgcatatgaagattgcttaaatatgattgctctaccgcatgtactcccccgttg

SEQ ID NO: 68878 - DNA, 214 bp, Triticum aestivum
  unsure (1)..(214): unsure at all n locations
  Clone ID: PAT_TA_68878
cgaggnatgccgcgcgtactctcagtaatccaggcatcatcttgatgtggattaaggacgtccaacggagtaggaagagtcacgtagcattcagccgcagccgcagccggaggcatcaagatgaccgggtcaggccgagaggcgccattgctccgcgtcaggaaggtgtaccatgaacgatgccccggatgcagacaggagaggaagacgcagg

SEQ ID NO: 68879 - DNA, 197 bp, Triticum aestivum
  unsure (1)..(197): unsure at all n locations
  Clone ID: PAT_TA_68879
gcacgaggtaagcttggcgtgccccgggnattcctcattgtttcgctacgcgctcatggcgttcgtgattcagagccaggagaaaattgacaggaaaatggggatgcttgaaatgcttggttggtcacaggatgatgtgttgactgctgtgaggaagatgccgtgtatcctcactatgtccgaggaaaggatgcaga

SEQ ID NO: 68880 - DNA, 624 bp, Triticum aestivum
  unsure (1)..(624): unsure at all n locations
  Clone ID: PAT_TA_68880
ctcccccaagnaagacgccgccgatgcccgtctacaaggacctgcacttcaaccacgacctctccgccaccaagaagttgcaggctggtgtggacctggtggcgcggctggttggggtgaccctgggtcccaaggggaggaatgtggtgctcgccaacaagtatggccctcccaagatcgtcaacgatggggagacggtcctcaaggaggtcgagttggaggacccgctggaaaatctaggagttaaattggtcagacaggccggcgccaggacgaacgatattgccggcgatgggtgtaccacttctataatccttgctcaaggcctcattgctgaaggaatgaaggttcttgctgctggaatgaatccggttcaaattgcgcgtggcattgggaggactgctgatgctttggtttctgaactcaagttgatgtcacgtgagattgaagatcatgaaatagcacacgtggcttgcagttagcgccggaaacgactacgctgtcggaaacatgatttctgatgcttttaaaagagtagggagggaaggcatggttaggattgaaaacgggagaagcactgtaaacagtttggaggttgtcgaaggaatgcagtttgaacgtggt

SEQ ID NO: 68881 - DNA, 671 bp, Triticum aestivum
  Clone ID: PAT_TA_68881
gcttaattaagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagggttccgttactaacatgtttacttccattgtaggtaacgtatttggtttcaaagccctacgtgctctacgtttggaggatctacgaattccccctacttattcaaaaactttccaaggcccgcctcatggtatccaagttgaaagagataagttgaacaagtatggtcgtcctttattgggatgtactattaaaccaaaattgggattatccgcaaaaaattatggtagagcgtgttatgagtgtctacgtggtggacttgattttaccaaagatgatgaaaacgtaaactcacaaccatttatgcgctgg

SEQ ID NO: 68882 - DNA, 618 bp, Triticum aestivum
  unsure (1)..(618): unsure at all n locations
  Clone ID: PAT_TA_68882
gcncgtcgcccgcgagaagcccctgccaccggagatctcccgacctctcccctcgccgcccgcccggagatctcccggcctctccctccgccatcatgggtaagacacgtggtatgggagccgggcgcaagctcaagacccaccgcaggaaccagaggtgggctgacaaggcatacaagaagagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagccgcggtaattccagctccaatagcgtatatttaagttgttgcagttaaaaagctcgtagttggaccttgggccgggtcggccggtccgcctcacggcgagcaccgacctactcgacccttcggccggcatcgcgctcctagccttaattggccgggtcgtgtttccggcatcgttactttgaagaaattagagtgctcgtgtccagctggtgaagaacgggaagaagatcgctgcctttgtgcccaatgatggt

SEQ ID NO: 68883 - DNA, 556 bp, Triticum aestivum
  Clone ID: PAT_TA_68883
gcaggcaattcggcacgaggcaccgctaaacctcttcgtcctctcgatctgcaatcgcctcccctctcctcctcctcctcctcctcctcctcctcccccttctcctgactgggatctcgatcggatgagatggccgacgccagcgccggcaacaatgcgggcagcacgagcaatgccgaggtccagatacagatccctgtagggccacccaaagccgagccgggggcaccatccaagaactccggcgccaagaactggcggtggtggatgatggtgtcggtggacgtcttcttcgtcgtcgccggccagacgtccacgacgctgctggggaggtactactaccaccagggcggcagcagcaagtggatatcaacgttcgtgcagaccgctggcttccccatactgttcctcgccctcttgtgtttccccaagtcgtccggcggcggcggcgccaacggcgacggcccggtcgccaaggtcgcggtgatctacgtcgtcctggggctcgtcatagccgccgacgacatgatgtacgccggcggcctcaagtacctcc

SEQ ID NO: 68884 - DNA, 612 bp, Triticum aestivum
  Clone ID: PAT_TA_68884
tggcccccaccgtgatggcctcgtcggcccctccgtcgctcctttccaggggctcaagtccaccgccggcctccccgtcagccgccgctccaacggcgctagcctcggcagcgtcagcaacggtggaaggatcaggtgcatgcaggtaaacaacatcgtctctgtctttctactcattttctagctgacggacggaagtcaataacatcaattgtgtagaactagaattctagcctgttaatgtatcaaaaatgtcaatcttatttgcaggtgtggcccatcgagggcattaagaagttcgagaccctgtcctacctgccaccgctcagcacagaggccctcctcaagcaggtcgactacctgatccgctccaagtgggtgccttgcctcgagttcagcaaggttgggtttatcttccgtgagcacaacgcatcccctgggtactacgatggccggtactggacaatgtggaagctgcctatgttcgggtgcaccgacgccacgcaggtgatcaacgaggtggaggaggtcaagaaggagtaccctgacgcgtatgtccgcatcatcggattcgacaacatgcgccaggtgcagtgcgtcagcttcatcgcc

SEQ ID NO: 68885 - DNA, 628 bp, Triticum aestivum
  Clone ID: PAT_TA_68885
atattttcccccagtatgcgtgtcttctcaattggaatgatgtaattaaatatatggaggtgtgatgtactatttctgctgctggtgcagcatgctattctgtactaaatggaaatagtatttgtatgcagtaacgattttgtactgccaagcctgtgaaaaatcatgctaatgcaacttatatttacagaaccccattgtctataattgctggattaatgtggattggcatgaaaaatggacaatcttttatattatatggtgatgtgcaaccttattgaatctttttttgaagccatttttgctatgcaggtgcaattgcatacacaaactgaaacacaggcagaaggactggtgtgcactgagactgagactgagactgataaccatgactggtcactggtgtgcacgcacccagctcatggcgaaagatactagaaaaaaggtgaagaaggagcggccgcccactcgacggtgtggtgcagggcggcgagggagcccggcagggaggcgttgatgcggtgcagggcggcgactatacgatgcagggatcgaggtcgccatgcagggaggcgacggtgctgctgagcttcgtctggggcggtttgttaatcgttctctgcaacta

SEQ ID NO: 68886 - DNA, 594 bp, Triticum aestivum
  Clone ID: PAT_TA_68886
gggttggtggtgttgatgggaggtttcttgcccaaggtggttctgttcctcattcgagtgctgatgaggcgcggcggcaacgccaggcacggcaagatatccgtcgtgggaagcgccctctagattcatcgtccgttggaaggaacgtttgccctgtacttgaagagctggttgatccttgtcttcttgctgttaggggtgcatctgatgtcgaagttttgtatcgtccgtattttgttgctggttggttgtctggttcctcgcgtggactgactccttctgttcttcctacacctgttgttagtcgtgctgatgctgtttggaatcgtcggaagcgaaggattcttcgagattattacactggtaaaaaaagagttcctgctatggaaccgccatttgctaaggaaaatatattacttcttaaagccgtttcacgtgttcgctcttattatggtggtcctgagtatgtttgcccggtgtgccatgcttcattttggtttttggagggctgtaagacttatgctgccggtggtggtcgccttccagtgtatagtggctgttgcaagggaggcaaggtgtcgttgccttcatttc

SEQ ID NO: 68887 - DNA, 627 bp, Triticum aestivum
  Clone ID: PAT_TA_68887
ttgagcttttcttagaggctgcacttggtttatattgtgggaaagtaaacaaacctgacaggctcaaggctcttttacttctagcacgttccattgaggctgatccaagcacagtcattctgtgggtgttttatcttcatatttactatcaaaaggatgaaggtcttgggaaagatgacatgttttcccatgcggtgcaacacaatgtttactcctacgaattatggcttatgtatattaatagtaggttgcgctttgatgaccgattggatgcttataacgatgctctgagtatgctctgccaaatgccagctgatactgacaatgaattgaaagataggagtgccttcatcctagatattttcttacagatgatttacttcctgtgcatgtctggaaatgtagataaggctatttctaggatatatgggattctacctgctgcaaccgctgactgctctggcgagaagttactttcggatgccatatcttgcttgactgtgtctgacagatgcatattttggatttcatgcctgtacatctcaatttataggaagcttccagaggaaatttgcgatcagctagaatttccaaaagatatacctcgcatgttagtatggcatccta

SEQ ID NO: 68888 - DNA, 135 bp, Triticum aestivum
  Clone ID: PAT_TA_68888
cgcgaccgcgactgaagcctctgctccgctccgctccgctcgccgctggaagatggagcctgaccagagtggcaccgggcagacttctccccgtgggaacgactgggaggtcgtgcagctcaccgcgtcgaacta

SEQ ID NO: 68889 - DNA, 531 bp, Triticum aestivum
  Clone ID: PAT_TA_68889
cgaggaaggtggggaggaggaactcatgctcatcggcgcctcgttcttcctagtcggcgccatcctcaactgcgccgccgtcaacatctacatgctcgtcattggccgcatcttcctcggcttcgccgttggcttcaccaaccagtccgcacctgtgtacttggcggagatcgcgccggcgcggtggcgcggggcgttcacgagcatcttccacttcttcctcaatgtggggatgttcgtggccgacctggtcaactaccgtgccaacacaatcccagggtggggctggcgcctctccctcggcgttggcatcatcccggccgtcgtcatcctcgtaggagccgtcttcatcccggactcacccaacagcctcgtgttgcgcgggaaagtcgacgaggcccgccactcactgcgtcggatccgcgggccggccgctgacgttgacgtcgagctcaaggacatcatgcgcgccgcggaggagggcggccgacacaaatccggtgcgtttcgacgcatcctgctgcgcgagta

SEQ ID NO: 68890 - DNA, 558 bp, Triticum aestivum
  unsure (1)..(558): unsure at all n locations
  Clone ID: PAT_TA_68890
tagagagggtatatctattatcccgattgtcgggcttggtggtctaggaaagtcaacattggctgaatnagtctttgtggacaagagggtcaatgacttcgaggtccgagcctgggttcatgtgtctaaggagtttgatctacgcaaaattgggagtgccatcctcaaaagcataaatagcagcatcaaccttgacaattgtagtttgcagtttttgcaggaaaatctcaaaaaggaacttgctggtagaaggtacttgattgttttggatgatctttgggaagaggatggggataagctggaaaggctgaagcagatgttacaacatggccgcaagggtagcagggttattgtaactacgcgcaaccaaagtgtagtgaataaattgagcactggtgttcttgcacaccaaagaaaattttgtcccgtgcccaactctgatcaaatcaacttgtttgttttgtcaactgatgaatgctgggaagtaatgaagcaaacagcatttgggcctgatgatgataaaagtgacttggaagaaattggaagggaaattgcaga

SEQ ID NO: 68891 - DNA, 463 bp, Triticum aestivum
  Clone ID: PAT_TA_68891
gaggaattcggacgaggggagctcctccgaagaaggtggaggcgatcctggtaccgcaggcatgcagggctattcggacacaatcaacagcgccagccgggtcgtctggctaggtagcctcgtcttcttcaacctaagaagcgccggcaagaaggcattgtatggatccctgtgggtccttgcagctgccaagttggtgcagaggttcgtcaccgtagagctgggaaagcgttctttcgcctatggcaagaatccccagcttatcgcctcttacatgacccagatgctgaagctacaaggtgaggcagctgggtcggatgttttgaaggggtgcaactatgccgtgattggcgaagaggagctgaaaaagaaggccggcccgaagggttacaagctcgacgagctggagaaggcaatatcagaagcggactccagcgtcgtcacggttggcaaaatctgggcc

SEQ ID NO: 68892 - DNA, 612 bp, Triticum aestivum
  Clone ID: PAT_TA_68892
caaggattgacagactgagagctctttcttgattctatgggtggtggtgcatggccgttcttagttggtggagcgatttgtctggttaattccgttaacgaacgagacctcagcctgctaactagctatgcggagccatccctccgcagctagcttcttagagggactatcgccgtttaggcgacggaagtttgaggcaataacaggtctgtgatcgtgacagagattgaccccatctgtgcccttcaggccctgatggagggcatccagatcctcaccttggaggatgttgtctctgaggctgatatctttgtgaccaccaccggaaacaaggacatcatcatggttgaccacatgaggaagatgaagaacaacgccattgtctgcaacattggtcacttcgacaatgagatcgatatgaacggccttgagacctaccctggtgtcaagcgcatcaccatcaagccccagactgaccgctgggtcttccccgagaccaagactggcatcattgttcttgctgagggtcgtctgatgaaccttggatgtgccactggccaccccagcttcgtcatgtcctgctcattcaccaaccaggttattgctcagctt

SEQ ID NO: 68893 - DNA, 864 bp, Triticum aestivum
  unsure (1)..(864): unsure at all n locations
  Clone ID: PAT_TA_68893
atctcgtctccgatcgactcgagagctcgtcgaatcctcctcccccatcgtctcaagatgcagatcttcgtgaagaccctcactggcaagaccatcactctggaggttgagagctctgacaccattgacaatgttaaggctaagatccaggacaaggagggcattcccccggaccangcagcgcctgatctttgctggcaagcagctggaggacggccgcaccctggccgactacaacatccagaaagagtccacccttcacctggtgctccgcctccgtggtggtatgcagatttttgtgaagaccctcaccggcaagaccatcactctggaggttgagagctctgacaccatngacaatgttaaggctaagatccaggacaaggagggcattcccccggaccagcagcgcctgatctttgctggcaagcagctggaggacggccgcaccctggccgactacaacatccagaangagtccacccttcacctggtgctccgnctccgtggtggtatgcagattttcgtgaagaccctcaccggcaagaccatcactctggaggttgagagctccgacaccatcgacaatgntaaggccagaatcccangacaaggaagggcattnccccggaccagcancgcctgatcttttgctggcaagcagcttggaggacggccgcacccttggccgactacaacattcagaaggagtncacccttcacctggngcttcgcctccggggnggtatgcanattttcgggaaaaccctaccngggaagaacatcacccttgaggttgagagntccgacaccatcgacaacgnnaggcannaatcccnggaaanggaggggatttccccggac

SEQ ID NO: 68894 - DNA, 154 bp, Triticum aestivum
  Clone ID: PAT_TA_68894
ggcgcagccttggcactttaatcgggatgggctcatcttcgccgagttcgacggcaacggtgacccggtagaggttgaccttggcgtcatgaccatatgggtccaggtacgcgatcttccgtacgtgcttaagacggagagtatagggtggcct

SEQ ID NO: 68895 - DNA, 637 bp, Triticum aestivum
  Clone ID: PAT_TA_68895
attcggcacgaggtgagatttctcaaagaagagatggttcatggtatggctcgtggggaatttgttttacttatgccacatggtttgcagtggaaggattagtttctgttggtaggacattcaagaatagcgctgcgatcagaaaggcttgtgaatttctcttgtcaaaagagcttccttcgggtggctggggagagagctatctgtcaagtcatgacgaggtttacacaaatctaaaaggcaaccgacctcatggtacacacactgcctgggccatgctaacactaattgatgcagggcaggccgaacgagatccaatgcctctacatcgagcagctaaggttttgctcaatttacaattagatgatggagaatttccacagcaggagatcattggagtttttctccaaactgccatggccagttactcccagcacaggaatgtcttccctatctgggctctcacagaataccgtcgtcgagtattgcttgcaggcaagaaataggcgcttgatttaaagttacctcttactcctagcagcttgtactctctctctctatctttcgtttgatttatactatattctagctattgtagtttctaagaataataaaatgtgtaatcgtaagcaatcag

SEQ ID NO: 68896 - DNA, 594 bp, Triticum aestivum
  Clone ID: PAT_TA_68896
agggagggacttatgtacccaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagggttccgttactaacatgtttacttccattgtaggtaacgtatttggtttcaaagccctacgtgctctacgtttggaggatctacgaattccccctacttattcaaaaactttccaaggcccgcctcatggtatccaagttgaaagagataagttgaacaagtatggtcgtcctttattgggatgtactattaaaccaaaattgggattatccgcaaaaaattatggtagagcgtgttatgagtgtctacgtgg

SEQ ID NO: 68897 - DNA, 516 bp, Triticum aestivum
  Clone ID: PAT_TA_68897
ccatcccctcccctcctcgccggaaccctaggcagcagggagggcggatagccgcggcgcgggcgcacgggcggcggcggagatgaatccccagcggaagcgcatccccaagatcgagcccttcaagcaccgggtcgaggtcgaccccaagttcttcgacaagtcgtggaagaagctcgatgacgccatccgcgagatttacaaccacaacgccagcggcctctccttcgaggagctctacaggaccgcatataacatggttcttcacaagcatggtgggaggctctacgataaattggcagagaacttgaaaggacaccttagagaaatgggcaaattagtagaggctgcccaaggtggtttgttcttggaggagctacagagaaggtgggctgatcatatcaaggcattacagatgatcagagatattctgatgtatatggatagaacatttattccatctagcaaaaagacacctgtctttgaacatggtctagaactgtggagagatattgt

SEQ ID NO: 68898 - DNA, 649 bp, Triticum aestivum
  Clone ID: PAT_TA_68898
gggagattggaagcaaccccaccaccaccaccagggggacgagactggcgatctaatgaagccggactcagaatacccgccggggctgctgcgaggaggagcacctgccacgaaccggcggcagttccagaaggccattccggcgcccgttatgtcattcaggcagcccaccgccgacacgccgatgccccatcatcaggcgcagctccggttccacggccgccacggcggatccaggccgccgttcaattcgcctgggagcaaccctagtgccgccgatggcgtcgcgtccagaaatcagcagcgttccaccgccatcggtgccgccgtgtccaggtccgcggttggcgtctacgcaccaacccggagcatacggaatccaaagtcaacactaatgactatgttctacgacggcgccgtcaacgtgttcgacgtcccggtggacaaggcccaggagattatggttttagcaggcagggcttctgtttcaagcccacccagtgcagtccagaagcctgattttcctgccccggccaatacatcaggatttccggtgcccggggcgaggaagattataattcagaaaccaggagagaccatggcacctcatgtatcagtcatttcaagtccgatccccgtcgtgtcacaa

SEQ ID NO: 68899 - DNA, 470 bp, Triticum aestivum
  Clone ID: PAT_TA_68899
ccggagagaaaagaagagaagcgaagatgtcggggcgcggcaagggaggcaagggtctgggcaagggcggcgccaagcgccaccggaaggtcctccgggacaacatccagggcatcaccaagccggcgatccgtcgtctggcgcgtcgtggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcactcaagcgccagggacgcaccctctacggattcggaggctaggccaccaccaccagattagagtgtctggggttcgtggtcgttgatgtaattgcagcatctcgctgttgtttgctatcttctgtagaatggaatggaatggaaattgaactagtttatccttgaaaaaaaaaa

SEQ ID NO: 68900 - DNA, 131 bp, Triticum aestivum
  unsure (1)..(131): unsure at all n locations
  Clone ID: PAT_TA_68900
agggagcgcaaanacctgcttggctacttactcctaccttttctctctggaaagagattgattctcaaacaacctggacgatcgccacancggagtctgctactttttctagggacaacaatgagaatnca

SEQ ID NO: 68901 - DNA, 200 bp, Triticum aestivum
  Clone ID: PAT_TA_68901
cccctgtttcggcattccgccacgctagatcgggccctctttcccctttctcctcgtcctcccatttcccgttcccacgcaggagaggggcgacgagacgacgcgagctaggattccggcgagcccccccgccccgatctgacggccgcggcggcggcgatgacgacgcacgagcggaagaccgtcgatctggaggaagg

SEQ ID NO: 68902 - DNA, 904 bp, Triticum aestivum
  unsure (1)..(904): unsure at all n locations
  Clone ID: PAT_TA_68902
ttcggacgaggnggaacggaaccacaaatcccacccaatctcgtctccgatcgactcgagagctcgtcgaatcctcctcccccatcgtctcaagatgcagatcttcgtgaagaccctcactggcaagaccatcactctggaggttgagagctctgacaccattgacaatgttaaggctaagatccaggacaaggagggcattcccccggaccagcagcgcctgatctttgctggcaagcagctggaggacggccgcaccctggccgactacaacatccagaaagagtccacccttcacctggtgctccgcctccgtggtggtatgcagatttttgtgaagaccctcaccggcaagaccatcactctggaggttgagagctctgacaccattgacaatgttaaggctaagatccaggacaaggagggcattcccccggaccagcagcgcctgatctttgctggcaagcagctggaggacggccgcaccctggccgactacaacatccagaaagagtccacccttcacctggtgctccgcctccgtggtggtatgcagattttngtgaagaccctcaccggcaagaccatcactctggaggttgagagctccgacaccatngacnaatggttnaggccaagatccaggacaaggagggcattcccccngaccagcagcgcctgatctttgctggcaagcagctggaggacggccgcacccttggccgactacaacattcagaangagtncacccttcacctggtgctncgnctncgtggnggtatgcagatnttcgggaagaccctcancggcaagacatnacccttgaggtgagagctccgaacatnnnnaaaangnnaagggcaanatccaggacaagganggcatttcccccgaccancancg

SEQ ID NO: 68903 - DNA, 296 bp, Triticum aestivum
  unsure (1)..(296): unsure at all n locations
  Clone ID: PAT_TA_68903
ttccactgcgattgagtgagtagagactttgcttctngcattggtgaggagaaaatggtggcctanaccaatggcaacatgccaggctcccactagcgcgccggagttgtcgtcgtcgtngggtaggagcgcgacngaggtgaggtcgctgaaggtccatagcgagtcngagaggcggcgccgggagaggatcaatacccacctggccacgctgaggagaatgatccctgatgctaaccagatggacaangccaccttgttagcatgtgtggtgaaccaagtgaaggaactcaaga

SEQ ID NO: 68904 - DNA, 620 bp, Triticum aestivum
  unsure (1)..(620): unsure at all n locations
  Clone ID: PAT_TA_68904
aggaattcggncgagggatgcccttatccgccctctgatcgagattgcttggctctcggcaccgccaaatccctccccatggcattgcagattggcggcggcggaggcggcggggggttcgacaattggagctggagtatatgttcttgtgggaacagttgccagggagcatgctggtccagcattggcagtttcattcctgatagctggaatagctgctgcactttcagcattctgttatgccgagcttgctagccgttgcccctctgctggaagcgcctatcattattcatatatctgcattggcgaaggtgttgcctggttgattggctggtcgttagtgctggaatatactcttggcggatccgctgttgcccgtggaatatcccccaatttagccttgttttttggaggaccagatagcttgccatggattttagcacggcatcaacttccatggtttgacgttattgttgatccctgtgctgccgctcttgttcttgctgtcactgctttattatgcctagggataaaagagagctcatatgtacaagcaattgtgacgattatgaatgcttgtgtgatgctatttgtgatcatagctggttgttatattggct

SEQ ID NO: 68905 - DNA, 882 bp, Triticum aestivum
  unsure (1)..(882): unsure at all n locations
  Clone ID: PAT_TA_68905
gctccgatcgaagcgaagccaggctctctcgtcctcctccgcaagatgcagatcttcgtgaagacccttaccggcaagaccatcacccttgaggtcgagtcctctgacaccatcgacaacgtcaaggcaaagatccaggacaaggagggcatccccccggaccagcagcgtctcatctttgctggcaagcagctcgaggatggccgcacccttgcggactacaacatccagaaggagtccaccctccacctggtgctcaggctccgtggtggcatgcagatcttcgtcaagaccctcacgggcaagaccatcacactggaggttgagtcctcggacaccatcgataacgtgaaggccaagatccaggacaaggagggcatccctccggaccagcagcgcctgatctttgctggcaagcagcttgaggatggccgtaccctggctgactacaacatccagaaggagtccacccttcacctggtgctgaggctccgtggtggcatgcagatatttgtgaagaccctcaccggcaagaccatcaccctggaggtggagtcatctgacaccatcgacaacgtcaaggcgnaagatccaggacaagggagggcattcccccggaccagcagcgtcttatctttgctggcaaacagctcgaggatggccgcacccttgcggactacaacatccagaaagagtccacccttcacttggtgctcaggctncgtgggtggtatgcagatttttgtcaagaccctgaccggcaagaccatcaccctggaggtcgagtcgtctgacaccattgacaatgngaggggcccaaaatccaggacanggagggcatttcccccggaccagcagngtnttatntttgctggcaagcag

SEQ ID NO: 68906 - DNA, 547 bp, Triticum aestivum
  Clone ID: PAT_TA_68906
cgcccggagcagagaaggcagggagggatcgatcgcggaggatggtggcccggggaagcggcgcggaggaggcgccgccgccgacgcagcagcgcctcgtcttcgcctactacatcaccggccacggcttcggccacgccacccgcgccctcgaggtggtgaggcacctgatcggcgcggggcacgaggtgcacgtggtcaccgccgcgccggagttcgtcttcaccaccgagatcgactcccccagcctccacatccgcagggtcctgctcgactgcggcgccgtgcaggccgacgcgctcaccgtcgaccgactcgcatccctcgagaagtaccatcagacggccgtggtgccccgcgaggcgatactcaggactgaagtggagtggctccactcaatcaaggccgacttagtggtttcggatgttgtcccggtggcgtgcagggcggctgcagatgctggcattcgctccgtgtgtgtcacgaatttcagttgggacttcatttatgcagagtacgttgtagcagctggaaatcatcatcgctc

SEQ ID NO: 68907 - DNA, 663 bp, Triticum aestivum
  unsure (1)..(663): unsure at all n locations
  Clone ID: PAT_TA_68907
gcttggggatgtntattttctttatncagaagaatgcgcatgtaccatacagaaatagcaagcttacacaagtcttgcaaacttctctgggtgggcatgcaaagacactaatgtttgtgcaggtcaatccggacgtttcgtcttatacagagaccttaagtactcttaaatttgcggaacgagtgtctggggtggaactaggtgttgcaaggaccaataaggagggaaaagaagtcaaagatgttagagaattgatggatcagctttcgatgctaaaagatactatctcaaagaaggacgacgaaatcgaacagctgcagctactgaatactagcacctccaaattgaagtccaacagacaagctgatcacatattgaagcattcatcatcttctccgggcataacatcactaggaaaggtctcaagtgttggtagtggagcagcttctgatcttgacaacttctctgacactagtgacaggcaatctgaagctgggtccatgctctccattgaacctgaggtttctggtcttggtgatgttgaatctgatggaaggttaagtgatgcatctgatgggggtaattccaccggtgcggaaactgacagttcagtaagcagtgtggtagaccaagggcaagagaaagcgtctagcgctgcgaaag

SEQ ID NO: 68908 - DNA, 638 bp, Triticum aestivum
  Clone ID: PAT_TA_68908
aggaattcggcacgaggatctctctacttctctctctcccgttcccttttttcgccgccgccttcgtcggccggttccggcgaacgctggcggtctccgccgtcgtggtggctaccaatctcttcctctcctcgcgctctatatgatccaccgcatcgattcatcgatcccatcctcatgtggttgcccgcatcggatttacccgtctagggtttcggtgcggtcgacctcctcatcgccggcgatgctccggcgccttggtccggtcgtctttgtcttctgccgtgctctctcgtgctgctctgcttcctaacggcgctcccgtgcctcagatgcacgccagggcggcacggtgagcaggtgggaggagaaggcggcggcgatttcgatctattattctgcgttgacacgggaggcggtagagcggtctggacgagattcctggtgccggtttcctcaccatgctgaggccacctgcatcgagcaatggttgatgccaaggctttaaggacctgttcgggttctctccgctccacaactacggctcccggagcggagggaggggcagcacaaatcagggagtggctcaaactgaggtcctcgtctcctctacagctcggagcggagttttgagattg

SEQ ID NO: 68909 - DNA, 635 bp, Triticum aestivum
  Clone ID: PAT_TA_68909
attcggcacgaggcagagcagcaacactctagccggttgcagcccactgaatccaaacttgcacgaggaagatgagcatgagggaaatgtggtttcagaactgagcgtgttgggcggtggtgcggcagaagctcgaataatggtttgctaattaatttacatcatgtggagtcgcaagactcctattgctttgggtgacacatgggtacgccaactcctatttctttgggtataggatacgcactggcaaggaagcttcccaagactggcggtaatgtgttaaaaaacgccttctattaagttacagagatagtatcacataacctacttggtttagacactttcagaaagaatgaaatggacaatatgcaagtaacaataacaatttagtcttttttgacacacaatatatctctacagctgaatgcttgaaaagggaatttggagagcaacatttgaggttcaaaatagtacagtgcaacacatttggttccatagtccctgttcaatgacgcctctagtccatggtcgggcgatgcgttaaggatccctgagccttatgtggatctcacgccgccaatggagccccacatcccctaggacccgactcccaccacaagggctcgattcctctc

SEQ ID NO: 68910 - DNA, 701 bp, Triticum aestivum
  unsure (1)..(701): unsure at all n locations
  Clone ID: PAT_TA_68910
ggtaatccaatccgcacagaaatccccatctcaaaaccctagccctcatccccgatcccggcgagcgagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaagagcggcaagccgctgcactacaagggcagcgccttccaccgcgtgatccccgacttcatgtgccagggcggcgacttcaccaggggcaacggcaccggaggcgagtccatctacggcgagaagttcgccgacgagaagttcgtccacaagcacaccaagcccgggatcctctccatggccaacgccgggcccaacaccaacggctcccagttcttcatctgcaccgtcccctgcaattggctcgacggcaagcacgtggtcttcggcgaggtcgtcgagggcatggacgtcgtcaagaacatcgagaaggtgggctcccgcagcggcacctgctccaagcaggtcgtcatcgccgactgcggccagctctagatccgcccgcccgccggtcgccgtcgtcgtcatcgccccgtgtgtcccgtgtcgngtcgtcgatctaaataagagagtcgtgtgtcgtgtcttcccctggtccgtccgatgagatc

SEQ ID NO: 68911 - DNA, 545 bp, Triticum aestivum
  Clone ID: PAT_TA_68911
agggagaaaatgaatgcagcagcaagacggagaccttgacctcaccccccactgattgagtctgcctcgcctctcttgttccttctccgcgttggtctttctctccccatctcaaccagcggctccgctccgtcgatccacgctgctgcagctgctgcttccccaccatcgctggctgctgctgctgcacctacgtcggctgctcttcttccatctcctccccgttgaaagcctgctgctgcttcgttgcttcacctgcctgctaaataagttggatccaagaggagcaccggcgccgccacggctgcatgtagcatgtttctacttctggagtaacggccgcaatggaagctgtttcagtcactcttccagctcaggtgcagcacaagcataactagagagccaagatagatagatccttgtccggatatctcaactagatggctggaataatggtgagcgcttctaccggggtgatgaactctctcctgggtaagctggccaccctgatgggagaggagtttgccaagctaaagaacctgagg

SEQ ID NO: 68912 - DNA, 593 bp, Triticum aestivum
  Clone ID: PAT_TA_68912
attcggcacgaggggcgcgtgcgcgggcatactcgatcgcctcacagtataattggcagtacggtcgacaatgggtgccacggcgagccgatcggcgccgatgacgtgcgacgacttgccggtcttgtggtactccaagctggtgcggtcacgtcgcgtgctgaatgtgggcaaagtcttcttcgacggcctcgtctgcaacgtcgaaattttgcccatgtgtttcgacaaggacggcctagccaacgtcttgatcgtctcggtgggcgtcatgttggatcgtcacctcagatcgttcgccggcacccacgtctccctcgaaatcttggacgcgaccggccagcacaccgtcttccacaaagatagtgaccaagaagaggacagtttctactggctgaccatgtacgtgcgcaggtgcgagctggaggcgtcgtcgtgcgtgtctgccagcgacagattaaccatccggtgcactctggagaagaagcagcaggtaacaaagcggccgcacctgctcggaatcttgttcaaacccaacgcggttcaggagccgccgcaggtcgccatggacgggtcccacacgctcaccgtcg

SEQ ID NO: 68913 - DNA, 689 bp, Triticum aestivum
  unsure (1)..(689): unsure at all n locations
  Clone ID: PAT_TA_68913
ggnctgcaggnaattcggcacgaggcgccgtcgagtatgcttcggagcccagccgccgctctgctccgctgcctggcccctcgcatcaccggctgcagtggggaagccggctcatccacgcgtcggaccctccctccttacatatcctcctcctccttcctcgcgcgcttctcgtccacgccgacgtcctcgccgccaccgtcctccgtcggtgcccgctccggcccaacccaccagcacttnagctactccttctgtctcgccgtcgagatgcttcggagcccagccgccgctctgctccgctgcctggcccctcgcatcaccggctgcagtggggaagccggctcatccacgcgtcggaccctccctccttacatatcctcctcctccttcctcgcgcgcttctcgtccacgccgacgtcctcgccgccaccgtcctccgtcggtgcccgctccggcccaacccaccagcacttnagctactccttctgtctcgccgtcgagatgcttcggagcccagccgccgctctggtccgctgcctggcccctcgcataccggctgcaggggggaagccggctcatccacgcgtnggaccctccctccttacatatnctcctcctncttcctcgngcgcttnntcgnncacgccgnnngtnctcgccgccaccgtnctacggtngggtgcccg

SEQ ID NO: 68914 - DNA, 400 bp, Triticum aestivum
  unsure (1)..(400): unsure at all n locations
  Clone ID: PAT_TA_68914
ggagagagagagagagagagagagagagagagagagagagagagagagagagagagagagagagagagagagagagagagagaganattttncnccacaccccncgcgcgcgcncnctntctctctcgcgcgcgcgngagacacacncncnctnttctntncncncncccccccnctntctctcnctctctctcncgcncccccccnncncgcgcgcgagagngtgtntctctntntatangggngggccccccccccccnccnctntnngggggggggcgctntatgtgngcnctctntnnggtntctctctnngagagnannngnnctctctctctctctnnnagngtnttntctctctcacncncnccctctctctctctctctctcnnngnngngc

SEQ ID NO: 68915 - DNA, 643 bp, Triticum aestivum
  unsure (1)..(643): unsure at all n locations
  Clone ID: PAT_TA_68915
gcgcctttngctcctctcctccctccgcaacttcacttttcgtgtttccagaagcttcaacaacttcctgcaggactgcgcaaccttaccagcctcaaggaattaatgatctacgactgtccagctatctcgtcattgcccaaggatggcctccccaaatcactgcaaaagttatgggtcagcaactgcggcaaccaggagctaatacagcagtgcaggggtttgaaggacatcatgcatgacattcttataaacacaattgccacatgcatgacatgagggccatgtggctgccgctgtatcatatcaatttggtgttctcgtgcttctgatgtcttgcacctacttggccgtcagtaccgtttgtgtttatattcgtccaaaactcatgaagacttgatggtgtatctgcaaagttcaattttgatattcaaaaggtcatcatggcataattatgaaaagcacccggtttcctgtgttctgccaccaataaggtttgcatttttgtatccagtctacattcaaccaataccagggcatgtgcaattttgaaatttcagaaccccattaagtcatcaagatgcataattacaacagactggtagacctgcaggatggatggtgaccaaagcttcttggacac

SEQ ID NO: 68916 - DNA, 635 bp, Triticum aestivum
  Clone ID: PAT_TA_68916
gctgccgctgcccgctcctccccaccaaatctcccctttcccacctcccggcggcaacctcccgcaaacccggcgtcagaccgaggacagctacgcacatcactctccttcgccgtgcctctgccctcatctcaagcacgacctgcttccgcgatctgtggcgggcccgcctagtttcctctccacctctctgtttgggcactctttcattgtaggtctaggagatgcctataaagagtcaaggatgtgcacacacggaggaaggaggaggagtaagcacaagtaagaagacttctttagaatccaactctgaccgagaagattctccacctccgagtgatgacctccctcgcatattacgcaagcgcctacttccccgcggttatcctttgccatccaagtttgctgggggcatacgcttggtgaatacatttgagctctgctttggaaagttggatggctacaacgaagagcacactagcattaaattacttgctttgagtgtctgtcggtccattgtttcactcgcttctttcaagggtaaaaatacaatattaggcacaatcatagagcacacgccacccagcatgagaattctaacatccgctagcttgattagatcgtctgaagaagat

SEQ ID NO: 68917 - DNA, 635 bp, Triticum aestivum
  Clone ID: PAT_TA_68917
attcggcacgaggattcccgttactctcgaggtcatcgcggcaatggcgggctcctggcgagccgcagcgctggcggtggcgatggtttgtttggtcgccagcagctgcgtgctcgggttcccggaggaggatttggtggggcggctgcccgggcagcccgtcgtggggttcaggcagttcgccgggtacgtggacgtggacgtcaaggccgggaggagcctcttctactacttcgcggaggcacaggaccacgccgtcggcaggccgctcacgctctggctcaacggaggtcctggctgttcttcggttggaggcggtgcgtttacggagctcggtccgttttatcccagaggagatggcagaggccttcgattaaacaagaagtcgtggaataaagtgtccaatcttctatttgttgaatcgcccgccggagttggatggtcctactccaacacttcgtcagactacaatacgggagatgcgcggaccggtaaaccgatgcgatcttgtgacatcgcaggatgccgttcccggagtacagatcaagcagcttacttctttcgggagagagctatgcagggcattatataccgcaactcactgatgtccttctcacacacaatgagaaatctaa

SEQ ID NO: 68918 - DNA, 633 bp, Triticum aestivum
  unsure (1)..(633): unsure at all n locations
  Clone ID: PAT_TA_68918
ttcggcacgaggcttgcatggnaaggaagccgancctatagtccaccgtgacctgaaacctgcaaacatcctgttggacaagaactacgtgggtaaaatcggcgatgctggtttcgcgaaggtcatatctgatctggtccctgactggcaaaccgaatacacagataccattgttgctggcaccatgtactacatggatcctgagtaccagcaaaccgggactgttcggccgaaatcggatctgttcggtctgggagtcatcattcttcagatgctaactggcaagcacccaaacggcctcatcgtaagcgtagaaaacgctatcaaaagcaggtcacttccatatatcctcgacagaactcaaaccgactggccagtcgccgaggcggaaatgttggcaaagctcggtttgcgatgcactgctctaaaatgcagggataggcctgatcttgagtcggaggtgctgccggagctggaggaaatactgcacagggtttcctccattgtcaacatgagaaacccaaactcacgagcaccaggccacttcatctgccccataacacaggggttgatggatgatccgtatgtcgctgctgatggacacacctatgagcatcatgccatcaaagattg

SEQ ID NO: 68919 - DNA, 574 bp, Triticum aestivum
  unsure (1)..(574): unsure at all n locations
  Clone ID: PAT_TA_68919
ggcaccacagcgcctgcccggnaccccggcgccatcggaggggccagcggcggcgggtagatgatcggcggcatgaacccgccgcctcctccccctccgccacctcctccttctcctagaccgcctcctcctcctcctcctacgcctccgcctgctcctcctcctcctcgtcccgctcctcttcgccgcggccaacggctacccatccacctgcggcaacgccacctgcgggaacctgaccatcgcctacccgttctggctcaactcgtcctcggcctccagctgcggctaccgcggcctcggccttgcctgcgagggcaacaccaccctgacccttcccgcccagtcccaccaccggtacagagtcgcggacatcgactacgacatgcgctcggtcttcctcgtcgacgacgccgaggcccccttcaacacgaccggctgccagcacctccacttcaacttcaccaccgacggcgggctgcagctcacgcagtcggactccaacatcaccttcttctacaactgcaagaagaacgcctcatggcccttcgccgaggaattgatcggctgtccg

SEQ ID NO: 68920 - DNA, 638 bp, Triticum aestivum
  Clone ID: PAT_TA_68920
gaaggaatagaaagaagaagaagcaagccttggcttttgacttggtgaagatgtattccaaggaattagtcccttttttggtcccagagaaaatagttgcttgttgaatctccactcccctcttttttgtttgctctaaaatttccaatctttctcttttcccctgtttgttcgtgggcgtgggcgtggggagaagagagaagagggaggagggcgccatggcgaagaaggagggaccttgcggccattgcggagtcacaagtactcctctctggcgaaatgggccaccagacaagccagttctctgcaatgcatgtgggtcgagatggaggataaggggtacgttggtgaattacacgccggcgcatcgccgggaagatactggcgctagtgaagctagacctgacaagctgaagctcaagggacagaaacagcccaagaaaagaccaaaccgcagcatagtgaaggacgaaccatggtctgatcagaacttctggaagatgggaaatgcggacacaagcaatcgatctggttctggatcagcggtatcatattcagagagttgtgccccgtatggttctattgatgcgagtgaaatagccggttcagcgcagtcacatgctttggagtcactggta

SEQ ID NO: 68921 - DNA, 557 bp, Triticum aestivum
  Clone ID: PAT_TA_68921
gaagagggagaaaaaggcttgctaatcagcgggattatgtcctcgttggggaatttctcccgcaggctctgcgattcctgcttcgacggggaaacgcaaacaaaaatcaagttatggctcagatggttgctccgttatgccttccctgcactcatcgtctcagcaggtagtctgctcctcatattacacttcatcatcaccccgcaggttaaggcctacgttgaggacgcccgtctcgacagcttcgccttcgccggcacgcgggcgtccttctccgcgtacaacttctccacctcggtcgccctcacagtgcgtaacctcaacggggccatggccatcacgtacaccaggcccctcgtggccaccttcctcttccacgaccggcgtctgtacaacgtcaccgtggccgacaaagggcacaggcacaggccgctcaagagggaggcgcacctcctccacaccggcggcgagggcccgtatgtgctcgacgccgcagcagtcgaggagttcaacaagcagaatgccacgggggtgttcgaggtggaggtgcgcctctc

SEQ ID NO: 68922 - DNA, 507 bp, Triticum aestivum
  unsure (1)..(507): unsure at all n locations
  Clone ID: PAT_TA_68922
gcaaggggagagcagagcactttctcctctccttcctcttcttcttcctccagctcccacctcccacctccccttcacacacacacacacacacacacacacacaactgcggcaagaacgtcccctccggcttccagtgccccaactgagcccggccggaccttgcatgctgcatccgccatacctcatgcatgcatgcatgcatgattggctatttgaagtaccaccacgtacttaattgngcgctttgattacgtaattatctgctggtttttatgtgtggctggatttcgattgcggagaaactacgtactacttctccaggttctacgtacaagcacgcactgttacctgcgtgcgtaaggatttcgntgtgtgtgtgcatgatgtcttgtcgtaatcgtcacatgtttgtgatgagttagttattgccagagtgctcatgatgtaccgctatctccggctaaataaaagatttgctattttccattattattaaaaaaaaaa

SEQ ID NO: 68923 - DNA, 217 bp, Triticum aestivum
  Clone ID: PAT_TA_68923
gaatccgttggcccccgcgtcctctctctctccgccgttcccaacgccatgtttcccctttcgattggttgtttattcctcctcttcgctgccatcattcgcccttttttcccttcccgtatgcggatccgtctccttgtgcccatcgccattcgccaccacgccggcccctgatcggtggacatgtggagagggggaggggatggtggggatggtg

SEQ ID NO: 68924 - DNA, 584 bp, Triticum aestivum
  Clone ID: PAT_TA_68924
gcctcctccacctcaggatcctcccagatccccatcgtcaaacccacacacctcgccgatctccgctgctcttcgcttcccaaccggtgccaaccaccgagaccatagccagacctcccctgctcctttccttctccttccctgcctctactccctcctctcacatctctctctttctctctgtacagctgcaagagggagcacgccaggcgccatggccgccgaaggaactccgccgcctcaccgaatccacgcctccatctctcccctgcatcaaggtcgccatccctgccggacctgcaggacgccaagtccaacgccatgggcacctcctctgcccgatcccgcctctgtctcgacttcgccgtgctcctcctctgccccgagcctctgccgtgaccagcacccgagtagtagggccgccagcgcgcccgttgcctcctccttgcgcgcctgccaccctcgccttctctcttcttcccatttttcgttcggcttctttgattgactatctctctctctctctccctgtccttgcctcgaacaggagcaccagccggcgccaccatcatcggagatgggct

SEQ ID NO: 68925 - DNA, 617 bp, Triticum aestivum
  unsure (1)..(617): unsure at all n locations
  Clone ID: PAT_TA_68925
gaggattcgagatctgcccagnaaatatgaaaatgcgcaccgtgctgatgttcgttgtattactagttctgtagatccagcgcgcatctcggtagatgggatgcgaatctcctgtaatcaggtctagatctagttcccttgctaagagaaggatgcatgttgttatttgcttgtgccgatctaatttcaacttccagttctgtttgcttgttatcctgtggaatattgttttctcaatctgaagctcggtggttttagattagatttgtccaatagaatatcagaaaagtcgaagaatcaaaggccagtattgatggctccttttgaggatgtagtaggatatttagatgcatacattcctctaaagtgattccttacctaggttgtacaagttgggctagctctctaactatactgtatcatatgaaaactgctcacaccacttgcgaatctgggaaagaggatgatttgtagcaattgtatattcactttcgttggttcattttcttcagattctggaattagtttgcttgttgatcccatatgcactgcttttcgtagcatggtacatatatgggcaagtggtaacagtgacaatttgtacttgcaggcactga

SEQ ID NO: 68926 - DNA, 623 bp, Triticum aestivum
  unsure (1)..(623): unsure at all n locations
  Clone ID: PAT_TA_68926
gggaagctgtctgcacagngnaatctaacaccttggctgaaacttctaccgtgtcgtgacaaagctgggatagcttctttgctgtacaggccttcagtttataaaggatattaccattcacagaagctaaaattgaaatcatcacaatctcttggtattattcttgatcaaacactcacagttgtgctgcaaccaaatacagttagtggtaaacagctacattctactggtggacaacttcagcccagctggtccatggaacatctgttcagtaagaagttatcagggaaatgtcttgtttctaaatccagcagagtttttgtagagattgagaaaggcatagttgacaatgttcacaaagctgggtcagatgtttcatggaataatgatttatttgtattgtcaactgccccagacaggtccctcaaagaattagataacttggaagtccaatcctcttcactatatgagtatgatgttaacaactacaacaatgataagcctttgaatgtgggcataacttggaagcttcccttgatatggtcttgcacccgtgcgccgtatcatgcaagtagatttcttatgggtagcggaaatgaaagaggctcaattgctatgtcatt

SEQ ID NO: 68927 - DNA, 575 bp, Triticum aestivum
  Clone ID: PAT_TA_68927
gaatgatagcagctttcctctccgactcctacattactcgctttagaacaatgctcctctttggtccatttatgtttctgggttacggattgctcgcactgcaagcctaccttccttcactccgtccaccagcttgcaacattgaagcagagctaaacagctgtgaagtggtccatggatggaatgctaccttattgtacacagccttgtatatgactgcatttggtgatggttttatccgtgtttgcttgccatccctcggagcagaccaatttgaccatgaagatccctctgagtcccgccaacagtccagcttctttaactggtatacctttggaatctcctttggaggttttgtagggctgattctcatagtggggatcgagaactacaaagggtgggatatcggacttggggtgtgtgccatcctaattctgctaggattgctcatagtcgctgccggtttccccttctactgcaaccaagtaccacaaggaagtcctctaactcgaatactgcaggttcttgtggttgcattcaggaacaggaaacttgaacttcctgaaaaacttgag

SEQ ID NO: 68928 - DNA, 483 bp, Triticum aestivum
  Clone ID: PAT_TA_68928
attcaatagtgagaagagatgttcaagagaacgatgaagaagctgttagggttaaagaacagagcatcttggagctggggaccctcctagcaaagacaggacaagcagcagagttgggaggtctgctgaagtttgtcaggccttttctgatctcaatcagcaaagccaaggcagctcgtctggtccgctctctgcttgaccttttcctggacatggaggcagcaacaggccaggaggtggaattgtgtctggagtgcattgagtgggctaaagcagagaagcggacttttcttcgacaagcactggaggctcggctgatctcgctctactttgataccaaaagataccaggaggccttggctcttggcacccaattgcttcaggagcttaaaaagatggacgacaaagctctcctggtggaggttcagctgcttgaaagcaagacgtatcacgccctcagtaacctgcccaaggcccgtgcag

SEQ ID NO: 68929 - DNA, 182 bp, Triticum aestivum
  unsure (1)..(182): unsure at all n locations
  Clone ID: PAT_TA_68929
ggccccaatccggcgactagcaccgtcaaatttaggcatccgatcgcagcgagattcaaactctnatctacaatggcgtccgtgtccgagctggcctgtatttactccgctctcatcctccacgatgacgaagtgactgtgaccgctgacaagctgaacgctctgatcaaggnagctggagt

SEQ ID NO: 68930 - DNA, 631 bp, Triticum aestivum
  unsure (1)..(631): unsure at all n locations
  Clone ID: PAT_TA_68930
gctcccagtaccctcgccgccacacgcagagnaggagcagagccccgcgcgccgtcctctgccgatggcgtgcccgcgagttcctgaccctgccacagccacctctcctcgccatgtaccccgccaccgccggagctgctccgctcgccccgcgctggagccgtcgttccctcgtcttcatcttcggcggatttcgcgccactgcaagcccctgccccgcctctgcttcattcgagcggggtggaggacgcgtctctgctcgcccgcgtcatcctcctgcgcctgcgccgacgacctccacctccagccgttgccggcgagcaagcctcgctggaggacgtcgtcctcgcccggatcctcgtcgccagccccaagccttgccgctgcctgcgtccgtccaccacttgcagctgctggggcaggacctcctcgtcgtggctctgcctccactagcagcctcctgctgcctgtcatctccatggccttgagcagcccaagccgccgggcgttctggcccttgcacatcgctgttgacccgaggagaccaccgccagtccaaggactatccctgaagattttggatgcgccaagttccacgacgccgcataagtttcttcttgaacgtgtacgg

SEQ ID NO: 68931 - DNA, 543 bp, Triticum aestivum
  unsure (1)..(543): unsure at all n locations
  Clone ID: PAT_TA_68931
gctaagggaccttcagnaagaggaagttgttgcaaacgggcttggctgtgccaaggacactgctgacacttctttggagcttgagggagagagcgaagttgcctctgttgtggttgaagtggagggcgtagtagtaaaggatggtgagggggatttgcatgatggtcatacggttgttgtcccctcatctgacgaggaagcaaaacctcccgcaaaggagggtacaaatgaggccattcctgctgaagttgtgaaggagggaataagtgaacaaattgtgcaagataatgaatccgttaaggttgatgtctcttctgtcacacatcagtcagtaaattcagaagctccagttgttgaacctaagggggatcacatactccaggtagaagatgctgcaggtgatggaaacactgcagtttctgatgtgaaggttgtcatgttggaaatgaacgcagcagatagcgtgcaaacaccggatctcaagtcggcatctgaagacaggagtgtaccattgcatgcgaattcgtccgaccaagttgagga

SEQ ID NO: 68932 - DNA, 221 bp, Triticum aestivum
  Clone ID: PAT_TA_68932
ggctggctgggagcaacggcgggctgcggggctggcgtgcagtggcggctcggttgcttgccagatctggcggccggctagcacgctcgggggctggttggacctatggcggaagcgagggaggaggtctggtggtgctgctcgtttgccggtggcggaaggattctggggcggctcgggtgaaatcaccaaggtttctcttccgtgagctcttctctgta

SEQ ID NO: 68933 - DNA, 499 bp, Triticum aestivum
  unsure (1)..(499): unsure at all n locations
  Clone ID: PAT_TA_68933
attcggcacgaggggccgctggnaggaacgcaggatcagcgctctgctcctccgcgctggatcccgatcaaactataggtttacactcttaatgtggacccgaaaagcatcatgtaccggaggcgcccggagtctgacgtcaccgcggctcagatgatgtccctgcagtccagccgagtcctgcttctgcatgtgccagtcctcctcctcctccgggactcctgcggggctgcactcctgattctcgctagtcggcgctgttgcatcatgcagtctttgaagcgtggctcggagccatctccaagcgcgctcacttgcctttacgtgcacgtgcaccccgcaatgagcgcacgccctgaccccgaaaaagaggcgcagcagacacagttttgctgccattatgcagtgtggggtaaattacttctaaagagtaatagaatactttacttactgtatcaaattaacaattaaactactttactcagtaacaaaaaaaaaa

SEQ ID NO: 68934 - DNA, 131 bp, Triticum aestivum
  Clone ID: PAT_TA_68934
cacgagggttaacagtgctgtgtacaacttacagcagcacatcatcgtcaacaactggtgtagatacaaataaattgttgacgatgatgtgctgctgtaagttgttaacagtgctgtgtacaaaaaaaaaa

SEQ ID NO: 68935 - DNA, 505 bp, Triticum aestivum
  Clone ID: PAT_TA_68935
gcgcatcgtacgagatagtgtgtgtgcctagataatcacgtgcatatacatggccgtgtggctggcgcgccgggccgtcaggaggctcgctagcgagctgcgcagccatggaccatggccgtggcccttgagctcgtcgacggtgccggttctcggggtgccatcaggggaccaaagcagggggttctgctccgtccggcgcttcgcaggagatagcgctgccgtcgaggagccggagaatggacttgccgcaggcgatctgcaggtcagtaaggagttggctctgaaaatgtacagtaacatggtcaccctccagattatggacacaatcttctatgaagctcagaggcagggaagaatttccttctatctaacttccaatggtgaagaagcaatcaacatagcctctgctgctgcgcttagtgctcaagacattgtactacctcagtacagggagcccggtgttcttctatggcgtggcttcacactgcaagaatttgcaaac

SEQ ID NO: 68936 - DNA, 571 bp, Triticum aestivum
  Clone ID: PAT_TA_68936
gcaccatcttctctcctctgtcctgctctgccatctctgcgcatcgcagctcctcgtcgggcagttaccacaccaaatatagccacgcagcgccgccatttccgcggctatgctgtcgcagttcaatagttctctttgggtgcaggaaggcgacgtccatgaacaccagggcctcggtcacgaccaggcggcgctgatggggcaggaggccggcaacgaccacaaccagcacctcctgcctatgccctcgggcggaggcggggggttccgcgccccaccgatgcttgatgacgacagctggtacttccaccctctgactcctacaactcctacaatgcccgcgctgccatctcgcgtgaaggaggaactggcaagctctgctgctcaggaaccatgtgttgaggttaagcttcgggaaggtcgggttgtcaacatccgcatgatgtgctctcgcaggccaggtgttgtgcattcttccttgaaggccctcgaaggccttggtcttgacgtgcagcaagctgttatcagctatttcaatgactttacattggatgtcttcaaggctgagtgc

SEQ ID NO: 68937 - DNA, 690 bp, Triticum aestivum
  Clone ID: PAT_TA_68937
ttcggcacgagggagaactagtctcgagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagggttccgttactaacatgtttacttccattgtaggtaacgtatttggtttcaaagccctacgtgctctacgtttggaggatctacgaattccccctacttattcaaaaactttccaaggcccgcctcatggtatccaagttgaaagagataagttgaacaagtatggtcgtcctttattgggatgtactattaaaccaaaattgggattatccgcaaaaaattatggtagagcgtgttatgagtgtctacgtggtggacttgattttaccaaagatgatgaaaacgtaaactcacaaccatttatgcgctggagag

SEQ ID NO: 68938 - DNA, 623 bp, Triticum aestivum
  Clone ID: PAT_TA_68938
gctgaaccttaacattaggagggttgtgttctatagcttgtccaagtacaacggggacaagatggtacctgttgctgcttcacaggtaaagcagatagctgggcgtgctggtcggaggggaagtgtttatccagatggactcacaaccactttcttgttggatgatttggattatttaattcagtgcctgcaacagccgtttgaggaggcacaaaaaatcggtctttttccttgcttcgaacaagtggaaatgtttgccagtcagttccccaacctcactttcactgacttgttggataagttccgtgacaattgccgcatcgacaagacatacttcatgtgccagcaggatagtatcaagaaggttgctaatatgctcgagagggtccagggtctctccctcaaggatcgctacaatttttgtttcgcgccagttaatataagggatccgaaagccatgtaccatcttctgagatttgctactcattatagccagagccgtcgtgttagcattgcgatgggaatgccgaagggttcggcaaggaatgacactgaactgctggatctcgagacgaagcaccaagtcctgtcgatgtatttgtggctgtcacaccattttgagg

SEQ ID NO: 68939 - DNA, 517 bp, Triticum aestivum
  unsure (1)..(517): unsure at all n locations
  Clone ID: PAT_TA_68939
gctcagtatctctcatccaagnagtccccccggcggcgcccctcctccgcccccggaccgtcatcccgcaggtttgagatcggtgcattgcttggttgacccctacttgtggaaatgcttgattcacttattagccatgacccaaaggtgttgactgagaagaagcctgatgagataattgcgagtggtgttgttgaaagtctgcagaattttctgcgcaagtgcatcatagctgtcctctcatatggcccaatgcctaagcacatcgcgtttatcatggacgggaaccgcagatacgccaagtccagaagtatcaagcaaggcaccggtcacagcgtgggcttcgctgctctaatggcaagtcttatctactgttacgagatgggtgtcaagtacatcacggtgtatgcattcagcatcgacaatttcaaacgcgaccctagtgaagtcaagaccttgatggaattaatggaggaaaagatcaacgagctgttggaaaacaagaacgtcatcaaca

SEQ ID NO: 68940 - DNA, 118 bp, Triticum aestivum
  Clone ID: PAT_TA_68940
ttcggcacgagggagtcgttgtaatagctaatagcctgttgaagctgctgaatacgtgcacgtattaaccaagaagctaagaaagcttgaggaatttgtctgtttattaaaaaaaaaa

SEQ ID NO: 68941 - DNA, 464 bp, Triticum aestivum
  unsure (1)..(464): unsure at all n locations
  Clone ID: PAT_TA_68941
agccgcagnattggctggtctgatcctcaagaatgcactcgacgcaaaggagcagcacaggaagaacgaacttttccagagatggctcgcactggatgctggtgtcaaggcacaagttaaagcattgttgctgcaaactctctcatctcctgttgcaagtgccagatctacatcttctcaagtcatcgcaaagattgctggcattgagatccctcagaagcaatggcccgagcttataggatcattgctatcaaacatacatcaggtacagccaaacgtcaagcaggcaacgcttgagacacttggctatttatgcgaggaagtttctcctgaagctgtcgaccaagaccaagtcaacaagatacttacagctgttgttcagggtatgaatgcttctgaagggaactctgaagtgaggcttgcagccacacgagcattgtataatgcattgggctttgctcang

SEQ ID NO: 68942 - DNA, 459 bp, Triticum aestivum
  unsure (1)..(459): unsure at all n locations
  Clone ID: PAT_TA_68942
gcttcatggcaccaaggnacgcatacctcctggactgggacacacggtaccggatcgccttcggggctgctgaaggcctacgctaccttcacagcgattgcaagccaaaggtgattcaccgtgacattaaatccaataacatactgctcgatgagatgatggaggctcatgtgggagactttggtttggcaaaaatcatcgacatttccaacagcaggaccatgtccgctgtagccggttcatacggttacattgccccagagtatgctttcaccatgaaggtgactgaaaagtgtgatatttatagtttcggggtggttttgttggaactagtgactgggcaatgtgcaattcagcctcttgagaaaggaggagatcttgtcaatttggtgaggcggacaatgaacagcatgacaccaaattctcaagtttttgacagcagactcgatctcaactcaa

SEQ ID NO: 68943 - DNA, 142 bp, Triticum aestivum
  unsure (1)..(142): unsure at all n locations
  Clone ID: PAT_TA_68943
tctacaagggcttcgagggcctcggnaccatacgtcgacgtgggcggcggcgtgggcgccaccgtgggcgccatcgtcnccgcgtacccggccatcaagggcatcaacttggacctcccccacgtcatctccgaggcgccgt

SEQ ID NO: 68944 - DNA, 103 bp, Triticum aestivum
  unsure (1)..(103): unsure at all n locations
  Clone ID: PAT_TA_68944
ggnggacgccatcctaatgaagtggatcctccacgactggagcgacgatcactgcncgacgctgntcaagaactgctacaacgcgctggcggcgcactggcaa

SEQ ID NO: 68945 - DNA, 529 bp, Triticum aestivum
  unsure (1)..(529): unsure at all n locations
  Clone ID: PAT_TA_68945
gacaagnattgaggtgggtctagctcaagnaagagcaaatgcctgtgtgcttattttcatattttgcatttcattttctattgaaaaattcactaagcaattatacttgctttgagaataatttgcatattcttatgtctacaagcaatttagcatcagctttccttgcaatcggagaaaaacatgattatttaaataattccaagacagaaaaggagtaaagcctagcaaatcaacacaataactaaattaaaaaatatgtattgcaagaatcaccacatttatgagactaagtaaatctttgaccattgatgcaattgttctatgtatgattcgcgatgattatttggcaaacagtttctctccccaaagaaaataaaaatcaaaaggaagttcatcatctgtttgttcttgctctgagaaaaggcttgaaaggaactaattcactttggaatttgtctccccttgagcttaatttgtgtcatgactgcctgcaattcagcaccatctttcatttgcgttcttccat

SEQ ID NO: 68946 - DNA, 617 bp, Triticum aestivum
  Clone ID: PAT_TA_68946
ttcggcacgagggttgtactgacatggagcttgtgaagcaaatgttcaccgtcaggacagatgtgttccagaaggactacttgaaccctagcctggactcagtttttgggaacggggtcatatttgcaaacggacaagactggaagcgacgccgcaaattcgtccacccggccttcaaccaggagacgatcaagtccatgtcagcaatagcgtgggactgcacgcggcagacgatggaacggtggtgcgtccagctgcgagggcagcagcaagccgagatagacatgaggtacgactccgacgagatagccatgggtgtcattgcacaagtgatgttgggcaaggaccacgaggaggcccgggaggtgttcatcgccggaagggagcagctgaagattgccgcgtatgcgtccgcggatcctcccttacctggattcaggtacctgccgacacgtcgcaaccgtcggatgtggcagctcgacaagcttgtgacaagcaagatctcacccatcatgaaggcgcgacttgccagcagcgtatacgaggacgacctgctcgggcagatgctgcagcagcaggcatgtcgcagtggcagcggcgccgagactctgagcacc

SEQ ID NO: 68947 - DNA, 628 bp, Triticum aestivum
  Clone ID: PAT_TA_68947
gctcctcttcctgctcctacctctactctatgtcctccgcctacgtcggaacaccagaaagcaacctcacgccgacggcctcaaggcctaccccatcatcggcacgctcccgcacttcgtcaagaaccaggactgcctcgtcgagtggtcggccggcgtcgtcgctcgttgccccacgcacaccatggtcttcgacttcaagggtctcggcctcatggccggtgccatcaccgcgaatccggccaatgtggaatacatcgtgaagaccaacttccagaactaccccaagggtgagttcgtggtgtctgccatggcggacttccttggccatggcatcttcaactccgacggcgaccagtggctctcgcagcgcaaggccgccagctacgagttcagcaagcgctcgttgagaaacttcgtggtcagcaccgtccggttcgaggtcgtcgagcggctgcttcctctgctctcccgggcggagctagaaggcctgacgctggacatgcaggacgttctcgagcgcttcgcgttcgacaacatctgctgcgtcgccttcgacgaggacccggcgtgcctcaccgacgacggcctggggttgaatgggcgtgccgagttcatgcatgccttg

SEQ ID NO: 68948 - DNA, 502 bp, Triticum aestivum
  Clone ID: PAT_TA_68948
gtttctctcgctcgactgctcttccccagccctcctcgatcacgcgagcctgttccgtgctactccttcccgcaccaccgtatgctcgaccccaactcgcctctgtccatgacaacactcagcagcggcccaaatcgagcggaggatcccctcaggtccgacgaggtcatggatacttctggctcgggtggagaatatcctactccatctccttcggatctgccttcaaatattgagaaacttcgtgaagttggtccgtctgtggtaactattgaatttctcctccccctactgccaacaaaccagttgtatatgggacggatacagttcttatggttgagaataatgacagtctagtagtgactataattccaaagctgctgtcagatggtaaattgtttatagacgaattaacaatatctgtctggttccacaatgagaaagaaaaaattcctgctatagtagttgttgacgataatattgaacttgcgatccttctggt

SEQ ID NO: 68949 - DNA, 564 bp, Triticum aestivum
  Clone ID: PAT_TA_68949
gggttccacggccgccgcccgccgcttgttgccccgccgacgccgcccccagctccgtctccgtcctgccttgctgcatcctccgccgctctgaagtgtactgcatcctccgcctcgccggaccgccgtcgccgtattcctcctcctcaacctcgtctttttcagccgaaggtcgctgagatcattcacccggtgtgaaaaatgagtttgtgggacagagctgcttcattggcgccgaagataagttcgacatcaacgccagcaccaacattgctatctatcgacgttgaaaaccaagttcaagatcaacctcggcatggatcgatgtcgtcgccagtactacctctgcccacggctgcaccgcctctgctccccatcattcagttggacggagagagcggttacctccgctggaaggagtcagtgctgctccgcctccacactattggtgtggccgacgtcctgaccgaggagcgccctcccgacgagaagacggctgccggcaagcagtgggcgcacatggatgcattgtgccgtggccacatcctcgccacgctctccgac

SEQ ID NO: 68950 - DNA, 646 bp, Triticum aestivum
  unsure (1)..(646): unsure at all n locations
  Clone ID: PAT_TA_68950
ttcggcacgagggaacagtctgacatggnatgcagtcaagacgatggcgattctagctgaaatgaaagctaacgatcctgacttcaattacacggtgcaagtggatggggaaagcagggtaaagacactaatgtgggtaacaagcagaggttttgaccagtataggtgttttggagatgcaatcacatttgatacaacttaccgtactaatctttatgacatgccgtttgggttgtttgttggtgtaaactaccacttccaaagcataatttttggtggtgccatgatgagggatgagaaggaggacaggttcaagtggatttttaaagagttcatccgtatggtgggcgggaaacacccacagacaatcctaactgatcaagcacgtgcgatggagctggctatcgaggctgaactaccaaacacagtacaccattggtgcaagtggcatgttctgaagaaagcaaaggagtcgatgggtgtgctgtggagcaagaacagtgacttcaagatggagttccacaagctagtccatcacatgatcacagaggaagaatttgaagctggttggcagcagatgctggaaaggtactccctgaagaagcatccattcttgacgcagatatatgaggtgcaccataagtgg

SEQ ID NO: 68951 - DNA, 575 bp, Triticum aestivum
  Clone ID: PAT_TA_68951
agcgaaatggccgcgtcggcgctgcaccagacgaccagcttcctcggcaccgccccgcggcgcgatgacctcgtccgcagcgtcggcgacttcggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacggatgggacaccgccggattgtcggctgacccagagaccttcgccaagaaccgggagctggaggtgatccactcgcggtgggcgatgctcggcgccctgggctgcgtgttcccggagatcctgtccaagaacggcatcaagttcggcgaggccgtgtggttcaaggccggcgcccagatcttctccgagggcggcctcgactacctgggcaaccccaacctggtgcacgcgcagagcatcctggccatctgggcggttcaggtggtgctcatgggcttcattgagggttaccgtgttggtggcggccccctcggcgagggcctcgacatcatctacccgggcgg

SEQ ID NO: 68952 - DNA, 615 bp, Triticum aestivum
  unsure (1)..(615): unsure at all n locations
  Clone ID: PAT_TA_68952
gcgcacgtccccacgatccaatnaccccgaccccgtcgccccaatggccgtctctcccgagaggcaagagaaatcgatccaatcaccccgaccccgtcgccgcccaacgtccatggccgtctctcccgagtggccaagagaaatcgacccgcttccgcggttctgccctacagtcttcgcgtcgtcccgcgcccaagggcgctctcctctacccaatcctcctccctgtcgattgtctgtcgccccatccatgggcctttcgccgtgcccgtgatgcgccgcgtccgggaccggcacagagcctgcacagggtggtatgagcgcagccaatgcctcctctccacccgtcgccggtgaggactcttaaggatggctactgatgacggcgaggagacccatcagaagtggtgcatgcgtgcggcatgccattagagaagaaaggctcatgtatgaagaacgttggcaccagcctatgtgccaccatccgcatagaagacgaggtagtgttaccagatgcgtacacagttcatgtgaagtaacccctcattgcttcgatgctgattcagtggattaccagttcaccaccaccgccattgaagatgcaggttctcttct

SEQ ID NO: 68953 - DNA, 153 bp, Triticum aestivum
  Clone ID: PAT_TA_68953
ttcggcacgaggtgagtgcactttgtacactgtcactggcgtagctagctagctaggcagagatggcgaagaaagtgcaggtgatcgctacgctcctgaccctgaaccttctcttcttcaccttcgccaacgccactggccgtcggttttaca

SEQ ID NO: 68954 - DNA, 665 bp, Triticum aestivum
  unsure (1)..(665): unsure at all n locations
  Clone ID: PAT_TA_68954
ggttattgtgagaattcttaattcaagnagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagggttccgttactaacatgtttacttccattgtaggtaacgtatttggtttcaaagccctacgtgctctacgtttggaggatctacgaattccccctacttattcaaaaactttccaaggcccgcctcatggtatccaagttgaaagagataagttgaacaagtatggtcgtcctttattgggatgtactattaaaccaaaattgggattatccgcaaaaaattatggtagagcgtgttatgagtgtctacgtggtggacttgattttaccaaagatgatgaaaacgtaa

SEQ ID NO: 68955 - DNA, 707 bp, Triticum aestivum
  Clone ID: PAT_TA_68955
ctatgataattttgtagatacatacctaacgtctgtaatgaacttctcttatcctattgcataaaggtgcaaccatacacagtacgacaagtgctgaaagtgtaggtacctgaacatccattgccatgaattaacctatcagcttaatttatgcatcacttcgatgacatagctttggacaacatgtgtggaatagctctaagtttaaggtcatggcttttggttactgccagcccgaatttctcagacatgtcaagtgatgcaaggttatgtccatcaggaagcatccagtcaaagtgatatagaaagtttgttaataccatctcagtgaccgatgagctgaaatgaattcccgggcattgtcttctcccactcccaaagggaatgaactcaaagtatgcccccttgtagttcacattgttgttatcaaacctctctggtctaaactcttcaggtttgttccagtgtctaggatctcgagaaattgcaaagatattaatgtacacatcggtgcctttagggatatcataacccataattgtacaatcctctctggacatgcggtggactagaggaccaggcggatgcaacctaaggacctccttgatgatcattcgcatatagtggagttcagcaaggtcgctattagtaataacagctcggtcttcgcctaacacctcgcgtatttctcgttgtgttttagccat

SEQ ID NO: 68956 - DNA, 205 bp, Triticum aestivum
  unsure (1)..(205): unsure at all n locations
  Clone ID: PAT_TA_68956
caatcttaaacctatttggnttaggaggngcgatnctnaaaattctgggagaatnggncaaaanaactgcgcctgaatcccaatctattgntaccagaacattaatatgccntgaatccactgtctagaaaacatatgtngcctcatgccatcgaactgtcttgcatganacagttcatacagntttttcatgtatagatctggt

SEQ ID NO: 68957 - DNA, 167 bp, Triticum aestivum
  unsure (1)..(167): unsure at all n locations
  Clone ID: PAT_TA_68957
aacttcttccgatncatacataacatgcatacgagctcaagcaactgcgttggactagtgctagttacagcggcagtatgccatgttcgagattcgagaagaaggattacatatagctaacaagtgaccagggcactactagggtatggatcaattggtttcttggg

SEQ ID NO: 68958 - DNA, 269 bp, Triticum aestivum
  unsure (1)..(269): unsure at all n locations
  Clone ID: PAT_TA_68958
cccttagtcncaaagcatcttttagctctagcatcatctagcttttgggattcttcaatctctgattttatttctcatcttcgagtaaacaacatgtcgattatttgaggaatacagtctaactgtcaaaaagaagatacaaaagtagaacctctattctaaactgtcaatttagaggacactagcaatggtttatggctacaaagatttaaggaggcatccagatgcagagaccgggggcctatcctcctttcaaaaaaaaaaaaanc

SEQ ID NO: 68959 - DNA, 212 bp, Triticum aestivum
  Clone ID: PAT_TA_68959
gctttttttataaaatatgcagcccaaatttctcaacgacaataagaagaagaaaaaacatctgtgaacaaaagggaaagaagaaatgaaatgaaagacacacacatacagcagcagcagcagctgtgtttatttctctatcgaataacaacagcagtacctgacgctctacacgttctacaacttatgaatggctttcatgtcggcagccc

SEQ ID NO: 68960 - DNA, 575 bp, Triticum aestivum
  unsure (1)..(575): unsure at all n locations
  Clone ID: PAT_TA_68960
tttgtgacctgaagagaaaatctgatngtacaggctaacccttattctgtacaggctaaccattaaagcagcccatgctaaaaatttacccttccaaaaatcagtactacaattctgncagaccctcatgaatgttgaaagaaatgccgataaatgagtggagcaaaatatgctctccaactagacaaatgttgaactgtatttttcttcaatctcttgcggtactaaatagcagacattccagcgagttcccgcagcttctcgcacgcgacgaaagtgatagctgtttgagggcctaaccttgcgaaggtggcaaacccacctttataaagtgactttacaccctctgtcaggacaacctggtaagcacagtggaaaccattcctgtatactctggcacctttggactcccgttgcagcattagccttgttttgatcatgtcaataggtgcantcacaagtgtaccagctgttccagcgatgcagctcgacatgagatgtaattgaaaaccttcttcaagtggtgtccacatcagcaagacctgtttggcctcatcataagttgccatttgtga

SEQ ID NO: 68961 - DNA, 646 bp, Triticum aestivum
  Clone ID: PAT_TA_68961
tcgctaaatgaagtagtagaaggctgggacaacattataggctagatacaaaagcttgggctttgaaaagaaggcaagacaattttcaagatgggcaccaactacatccaagaaggattgtaggcttactggctagcaccacacgttggtggtcttggcagcccaagttctaattaaatgtgtatacagcatctcccagacccttctcttcacacttcaagcatcctcggtggggcaagtcaaaagggttgtccattgacaaatcatgggtacacctgatgtgtgtgaaatactcgcgactgccacatctcatttcaattcgagcatctcgtgaagctctactgttgactcgcagcatgctgagctgattagcaaaccatttgtgttggcggtggtaaggcaatgtgattttcatttcctttagcccttttgcattcagaacaaagaacttggcaaagttaatagatgaaccacagaggccgtcataattcttcaacaccacctttttgagatggagctcaaggcattcaattgggtccagtggatcataactccggacattattgataacctcccttaactggaaagtgacatgcaaccactccaagcgaagaaagcacttgagcaagttaaccactgcatccag

SEQ ID NO: 68962 - DNA, 706 bp, Triticum aestivum
  unsure (1)..(706): unsure at all n locations
  Clone ID: PAT_TA_68962
ctcctttggttaagacatngcaagttgatctactgatttcacaaagccatatgaagtgctccctgctctaacttctctcgaatgaaatgtctatctatctcaatgtgcttcgttctatcatgatggactgggttattcactagattaattgtagcctgattgccacaatacagttgaagaggagcactatcatacaacccaagttcactcaacaagattctcagccacattgtctcacacaagcctgacgccattgacctaaactctgcttctgcagtcgatcgtgcaaccacactctgcctcttactcctccaactcacaagattacctccaacaaacatgcagtaacctgatgttgatcttctatcgtctaagcagccagcccaatcagcatcggtatagccctcaattctcagatgtccatgatttgagaatagaattcctttcccaggacagcttttaaggtaccgcagaattcttgagcaccgtagacaacctcgattcccaggaagtagtggagaaaccccagatctttcacttcaaatgatctagataacattttcttcaatttagatattccttcatcatcattacctgtttcttgagtaatgaccaggcatcctcctcatctaacttgtccacatggtgatagggaagcacggctttcatccttcgagctaccgtttcatctctggtagtgacgagg

SEQ ID NO: 68963 - DNA, 221 bp, Triticum aestivum
  unsure (1)..(221): unsure at all n locations
  Clone ID: PAT_TA_68963
tgcaagctgctcggataatttcattaccttcgcgagcaagatngcgcccttcgntacgagcttgnacanaggcttctaaagccantcgattagctgctgcaccaggtgcatttncccaaggatgtcctaaagtncctccaccaaattgtnatacagaatcgtncccaaagatttnggtcagagctgncatatgccaaacatgaatacnacctgaagctacc

SEQ ID NO: 68964 - DNA, 582 bp, Triticum aestivum
  unsure (1)..(582): unsure at all n locations
  Clone ID: PAT_TA_68964
acgacngtncttcaaatgacacatnaacagggcgcatatcacacggcgctaacagtagcaaaacttaataggcactaaactactagagatctcaaaaagcagacatagacggattcaggtaaacgcctcatttcttcttgatggcagccttggtcaccttggcgccagttgggtccttcttctccacacccttgatgacaccaacagccacagtttgcctcatgtcacggacagcaaaacgaccaagaggagggtaagtggcaaaggtctccacaaccatgggcttggtgggaatcgaaccctaattctccgtcacccgtcaccaccatggtaggcccctatcctaccatcgaaagttgatagggcagaaatttgaatgatgcgtcgccggcacgaaggccgtgcgatccgtcgagttatcatgaatcatcggatcagcgagcagagcccgcgtcagccttttatctaataaatgcgcccctcccagaagtcggggtttgttgcacgtattagctctagaattactacggttatccgagtagcacgtaccatcaacaaactataactgatttaatgagccat

SEQ ID NO: 68965 - DNA, 481 bp, Triticum aestivum
  Clone ID: PAT_TA_68965
acatagaacatacaatgtgcatatagcacaaatttctttgcacagtcaatatatgtttgtacttttatcatttcccagagtatatatactactatcacttgacgcgcgcgatctcttggatgaacctctcgaggttcccgtgcgatgaaccacccaccgtgactgccttctctgccttctccttccactctgccgccttccgtctcatcgccctgtcacccatcagctccctcaccgccgcctgcacctcttcccgcccggcctggcgcgccatctcaatgccgacaccccactcgtcacatgcgtacctgcagttggtcacttgctcagcgaagaatggccaacataccattggcacgccagcgcgtaggctctccagtgtcgagttccacccgcaatgggtcaagaaacccccagttgcgcggtgctccagaaccgcctcctggtcgcaccaccccacaatgagccccctccccgccac

SEQ ID NO: 68966 - DNA, 621 bp, Triticum aestivum
  unsure (1)..(621): unsure at all n locations
  Clone ID: PAT_TA_68966
ggttagctgctgaagnggtactattcttttatacaactcacctagagataaaacatttcccccccatacaacacagaggcgacacccctggttcagctatcagacgtaacggaacagatctatgtaaggatcacactatgacacaccgagtttagtttgaaacgccaactataaccccaggaccaaccagcaaaacaagtttaaaagctgcaacccgcacagctagcaaaacacagcaccacaatctgcaaccaattaactaccagtcagatcatcgccaaacagggacgcatttaacatcaacgagactagcacgggcaggctcagtaaggtcgatgtcgcccatccgttcttgatctgctgccgcctccgctgggaccatagccgcggtcagaacccaggttgccgcagaacatgccaaaaggccgcattgagccatacgatggtgcaggaagttccatgccaggcatggggtcagcgaaacgaccactggaatcacccctaggaggtgcagcaatgtctactgtaaccttacatccaagaatttcatggcttttgtcagctaccttatctgccacaccctcatcagaaaaggtgacaaaaccaaaagctcgatggcca

SEQ ID NO: 68967 - DNA, 759 bp, Triticum aestivum
  Clone ID: PAT_TA_68967
gttccgatgcgaatcctccggctatataataacaaaacgaaaaaacatcagaaggaagtaacagcagcagcaaagagagttctctacaactcggccaacagactaataacagctcgtcatggtcctcgtcgtcgacgccgccgtcggcgccctcgccgcccggagctccgccggacctctggtacacggccgacacgatggggttgcacacggcctccacctccttgagcttctcctcgtagtcctccttctcggccgtctggttctcgtccagccactccaaagcctccttgagggcctcctccaccttctccttctcctcgctctccagcttgtccgccagcttgtccttgtcgccgacggtgttcttcatgttgtagacataggtctcaagctggttccgggcgtcgatgcgctccttcaccttcttgtcctcctcggcaaactcctccgcctccttgaccatccggtcgatctcctcctggctcaggataccgttggcatcaacctcgaaggtgacttcgatctgaggagtgccccttggagctgggggaatgccagaaaggtcgaacttgccgagaagacggcagtccttggtcatgctgcgctccccctcaaagacctggatagagacggtggtctgctggtcctggtaggtggtgaaaacctgcgacttcttggtggggatgacagtgttcctggggatcagcttggtcatgactcctccaacagtctcgataccgagggtgaggggcgcca

SEQ ID NO: 68968 - DNA, 335 bp, Triticum aestivum
  unsure (1)..(335): unsure at all n locations
  Clone ID: PAT_TA_68968
aaaaaaacaatttcacggggacaaaaatacccctccaaaattaggttaggggggagcactcgagcagggctcaatgggctgaccagacccgaatgaaagccccttttntactagtggagatctntgtttacagatganaagccagcggtgcccgcgtgagggcctgccgatctgcctgataaagaaggtggtcctagggttcttntcgcgttaanacggngtcatgcttgatgcctgtcctcattgatctggcaggtggtggtggctgctgctntgcgtcgtcnacnactcgaacccgctgcctttgttgcccgggtcgttgttgttgcagcaca

SEQ ID NO: 68969 - DNA, 164 bp, Triticum aestivum
  unsure (1)..(164): unsure at all n locations
  Clone ID: PAT_TA_68969
gcttacttnagttcctgacgagatcgagtacagtccaacatctacaaggcattaggcattaggtaacacaaagttcacatggattagcagcaaaatagaggtctcctgctgatctctctctctctctctctctctctctctctctctctctctctctctctncc

SEQ ID NO: 68970 - DNA, 635 bp, Triticum aestivum
  unsure (1)..(635): unsure at all n locations
  Clone ID: PAT_TA_68970
acactggataatgtatacnctcatacgagtaatagataatacataaatgtgtgggtacatggccntgaaattcaatcgaacatgcataccaattattgtagacccatctctattgttggatggaccctagacccaggtccacctaaaattcactgacttaaatcacctgactttgtggagcacaacaagctagctcacttgtcaaccagccaaaggtaatagtacgatgaattaagacagagaatcttggtccaccaataaacttgttcgatgagcttgcttcttggatgccatttgtaggacactagtggagctgcggatggcaagttgctgcctgcacacacaagttggacctgcaatgcacaatgaggccaaacacctcgttcatgtccagagtctccgagcttgccccacccggaatcgaccagtcaaagcggtacaagagatttgctagcaccagctcaatcgtcgttgtggcgaacagggctccggggcactgcctacgaccaaatccgaatgggacgaactccatttgtgtccccgagctgtagtccacatgtatagcgtcgttcctctcgaacctctcgggcctgaactccgccgcgtcctccccccagtggctcgggtcccttncc

SEQ ID NO: 68971 - DNA, 248 bp, Triticum aestivum
  unsure (1)..(248): unsure at all n locations
  Clone ID: PAT_TA_68971
gncgcagaatncagcggcccaaaggagtccacctaaaaccctcctaaaccaaccacggaaggatcncatcggacggaccaggggcaagacacgacacacgactctcttatttagatcgacgacacgacacgggacacacggggcgatgacgacnacggcgaccggngggcgggcggatctagagctggccgcagtcggcgatgacgacctgcttggagcatgtgccgctgcggtagcccaccttntcg

SEQ ID NO: 68972 - DNA, 147 bp, Triticum aestivum
  unsure (1)..(147): unsure at all n locations
  Clone ID: PAT_TA_68972
agctantngattgatgngcatttatncatntgcngaaaaancatccncttggagagaanatgagagccnatgtnanttatcagganaacggaaccaaagcattngattcatctcagntcgcaatttacgcagcacangccatagntt

SEQ ID NO: 68973 - DNA, 644 bp, Triticum aestivum
  Clone ID: PAT_TA_68973
tttctctgtagaaaaactatgagctaaataatttttttaaactagctaaataaaactatttcgaccagttccgcaatcacaaaaagctgaactgacagtgcatctctgaaatttagcaacaatctatgttcatgccaaccgtattagccaattgaacttatgaggtagtaattaagaacaccgatgagtcataaaatcacaaaatgaaagcctgaaatcatgagcagaggagagcctgattccgagaagttccaaaataccaaaacgaaagactaaacacatcaggtgagaagtggctcattgcttttattcttgtcaccttccaacatgtttcccccatgacatatcgagccgcccaaataccacgctcacctgtgctcgtgaccagaacaaccgcttccaccaacgaaaacaccagcgcgagggcactcataccaacaagacctcatgttcaaactgtctcaacacgaaccagaacgtccacacacaaattctgtacacatttcattctctccacattcaacctcctcttcccatatcttatttgcagatcctttctcccaggaatagaggttgtagaaaacatacgtctctcctagcgagtcaaaacttgtcccaagcatcggtacaatagcattttcaga

SEQ ID NO: 68974 - DNA, 189 bp, Triticum aestivum
  unsure (1)..(189): unsure at all n locations
  Clone ID: PAT_TA_68974
ttgtttagtaatncagtatacctctgtttcaagnagtctaccactacaaaattagtactactagatcaggtagacatccaggcaaaaggatgaaactcatgacatgcactactagctttcaccagcaaccaaaaataaataaataaatccagctgcaggaaacgctggataagatcatagtacaactat

SEQ ID NO: 68975 - DNA, 671 bp, Triticum aestivum
  Clone ID: PAT_TA_68975
ttttcttaacttaagtaggcagtacaagataagaccatgcatccctggaatctctccacgatgcacaagactcggcctccacgcactaacctactagctacatgcacgccatcctttctcaacgcccacgcaacctggccatgcaactcatgcatgcagccactaactaactaactagtgcatgcacaaatcctggccactaacacacacagctaactaccttgccggatcacccagctcctcctcatcgtgcagccggtcacgctccagcttcatcatgtcttgccgcttctcacggcggtctggcatctcgccttctccacacatctttgttaaagcttcgccggactcgctactccccttaatcttgattcttcaatccttgacacggatcacccgcgatcacttgacgacgccatcgcggcgctgcacaccctgccgtggaccgacgccatcgcagcgcaggcgtccatcaccatgtcctcttgccgcacgcggcggccacctcttgacgtggacgacgttgtctcaacgccgatcaccacgccgtcttcgccaagcggcatcgcaccgcaacttttgttggcttcacaccaactttccatgatgatgatggcatcacaccaccatcgtcggcatcacaccgactcttcttgtggcagcttcgcacc

SEQ ID NO: 68976 - DNA, 168 bp, Triticum aestivum
  unsure (1)..(168): unsure at all n locations
  Clone ID: PAT_TA_68976
accaatttacttggggnggtgcttggtactaatacancagcatgatgatgatacaatagacaaccgagtacaatttttttgatactggtggtagcactgnctgctaagaactatcgtatttncacacgcccggcacacaantgtnttgttncctgtntntattngcct

SEQ ID NO: 68977 - DNA, 122 bp, Triticum aestivum
  unsure (1)..(122): unsure at all n locations
  Clone ID: PAT_TA_68977
caacaaaactnccagcnccaggtganangataggcacccaggaactgaaacaaanggngnatagngtancantctnactatatcaaagagaataactcagtcnacctactcgatcttggggc

SEQ ID NO: 68978 - DNA, 545 bp, Triticum aestivum
  unsure (1)..(545): unsure at all n locations
  Clone ID: PAT_TA_68978
ttattggttatncctccaaacaagggtgacggtgaaacaaaagccgaaaatcggaattctacaagaacggcgctaacaggatgtacaagattcacagttcagatacatgaaagctctgcctgatcgctccaaacaagtcaacaaactcaaacagtacaagaagaagaggaggaaaaatgccgtggacaaaactcaaaaaaacaaaaaccaaaagttgccgatgaggaaaagaaaacttggcaacaatctgtgcacagatcctatctggtgaaactccgccgtctcccggataccgtatctcccagcttctgcaatatcaaattatgtacaaggcaacacaacacaatggagtggccggcaatgtgttgatcacagctgctccgtcatccatcgctgccaccctccaatgcctagtacatctcctgccgtctcaagactttctcttcgtcatcggttctcctcacatcctcctcaacgtgcctcagtagttctccattcaatcttgttgccgacgtangagacaacggtgcgtaaaggcctattnt

SEQ ID NO: 68979 - DNA, 629 bp, Triticum aestivum
  unsure (1)..(629): unsure at all n locations
  Clone ID: PAT_TA_68979
cacatctctttctttctctcaccacaacagcaaaagcagaaaaaaaattaagcggactgaagttgttttgactgcctagataacaaaatattggaggatatcgcaccaacttattgtagtaccaaatacatgctgcctagataaaatagattggggcatttactgacagagaatatacaacaaaaaatggttgaagaaaacagaacaaggatagaacagtacacagactgtacttagtagaaacacacacacacacacacacggagagagagagagagtacacttgaactgttgtttttttaagttgacgcccaagttgtcattgtcgctgcagctcaagctcaagctccacgccttnctggtctggttgttcgttgacttccggacaacataaaggatttagcagatacatttaagacttanatgctctgaatttcttcatttgcaagaaaaatgatattgcaaggtagatcattttcttgtacaatcaaatctccaaaagcaccaaaacaaantttgaagcaaccggtcttcgtagcagccaatttgttaaaaagcttgctgaaccctncactacctcgcatnggcacattcacacgcactcgctgcacactcacagagcattgact

SEQ ID NO: 68980 - DNA, 622 bp, Triticum aestivum
  unsure (1)..(622): unsure at all n locations
  Clone ID: PAT_TA_68980
cggtgaacagatgatatgcatattatgtaaattacatggttcaatngatatgaaatccgaaaagccaaaagcaagaacttacaacccaaaagcactctacgagatggggacgaataaactacgacacgtgggacttgattgttttgtcagctgtatacgaaatgcaggccccacccctagtcatcgaaggcggagtcggatcccgctaaaaccttccacagtgccttgtgggaaagttctgagaagttgccccgtagcttcaagcattcatgcaaggcatcgttcttggttttcaaaatgtttggcttggtaagtgttaacttaattaagcttctccccatcaaactgtcgagcaatgtgtatggcgcatgcacctgactcagcggaggaaaatatggcatctgtcgtaggtccatgcttcatccgccagttttccttgaccgatggccatccgccatagaattcatggaggcatgcgaataatgcactgtggagcttccaagcagttgcttgattgcgatccttatgcgtaagagccgatgcatttttgtgatacagaggatcaaggacattgattaaggactgcagtgatgaacatttgggacgatgttagatcatactt

SEQ ID NO: 68981 - DNA, 669 bp, Triticum aestivum
  Clone ID: PAT_TA_68981
tacttatataagaataaaccccgggattacaagttcttgctagaagaaaacaaaccaaacaaacctcagttggcgaacaacctttcccagtgttagcagacttcgattaatatgactaccttcttttaacctcataccagctgaagcagtctgagatgctcgctcacttccagctaagtcaacaaagttcacacaagataccagggtgctcgatttgcctcttcctaaatactgtttaacagaactttcgattgtcagcctgagtatttgatgggacctagagctcgcttcgttcaaagccgtttctccaatctctctttgagcttcacacattccaagaagatccctaagatggtccttgtccctcagtgtttcctcagtgagcttttcaacagtagtccctttctctgggtcatcaagcagtctaagaggtgtggtatcatggctcagaagatctcttacagcttcattatatatctcaattgctgagaatttcagcatgaattctctttcagggtgcttctctatgtagtcatagatgtccatcacactgtactcagtaatgccagtcattgtgtaagtctttccgctgcttgtctgcccatacgcaaatatgccttgagttgattccactgacaactgatagagcaacttcttttgctccttctt

SEQ ID NO: 68982 - DNA, 349 bp, Triticum aestivum
  Clone ID: PAT_TA_68982
aatattgatacgaagctacttcaattgaacaaaagaaacagtcatgatatacttccttctctctcgtggtacaaatgtcactagaagaatctatcgtagtctttgcaatgcacagcctgctccccaaaatgattgaaaaatcttcctagcagtgtcatcctaagaaccaactaatggaactagggagtgatgcgcagctacagggaagcaaacagaagcaacagttttcaacactaactacttcatgcttgtttcgtttcacttgaaggcgctgggtaaaacgggcctctcaaaatctgatgaattaagtactgctcgtgctgccattccgaccgcgtgaacccttgcc

SEQ ID NO: 68983 - DNA, 571 bp, Triticum aestivum
  unsure (1)..(571): unsure at all n locations
  Clone ID: PAT_TA_68983
ccttgcatgggcatggaaaaagaatcacatggnagcatcgagnaagatacaatatgagcacacacccggcctctgcataattaggatgcacacagccaacctaacacacacacacacgcataaacacgccaacaactagcaaggtcacaagaccaaaagctatgcataggcatggaaaaaagaaaatgaaaaagtaaaaagctccaaagagatcagatcagcaatcgacaaactacaactgagaccatgtccgcaccaaccattgacatcacatggaggccgatgatcttcaacagcaacgccttcaggaaggaagcgacactcaagcgccgccgtcaccggattcaaccacaaaggccagaatcaaagttttcaccctgaataatagtctgaacatatccgagcaatgcctccaacaaggtaacgacatagaaaacatcgccattgccaggtatgaccactcgggtctatcctaggctttcgccccggagctcgagactaggtgcttacagcaccaccatcaaagccacgcatgtgttgtcgccaccactattncgcaataccagcagct

SEQ ID NO: 68984 - DNA, 447 bp, Triticum aestivum
  unsure (1)..(447): unsure at all n locations
  Clone ID: PAT_TA_68984
gtaagattatatatactnctnccctgtctaattgacatctgactgtttttnattcaaaaacagtcaaattttctgtccaatcaacagattacacctgtactagcaggaaaatcaccagaaagcaaaaaacgaacctctaaacgggtcaggtaaacatcttgcccgttcgaccattggtaacatcgccattagattgaacaccaagagtgcgatttaactgagcaaaagtgggtctttgaaaaccattatcatcggccttgggttcgcatttcttaataagaccagctgagggctccaaagtaaaaccaacaacaagaattgcacaccgcgtcgttgaaggggatataccctatagaatgagaaggactttttatagaagataaatccgccactggaattgcagcttcaacatttgcctcatttgccacgccctcatcacacacttta

SEQ ID NO: 68985 - DNA, 101 bp, Triticum aestivum
  unsure (1)..(101): unsure at all n locations
  Clone ID: PAT_TA_68985
ttgacgcaagggcagatggcagctagatatagctaggtcgaaccaagtctcattacctcattatcgaaggagatgaataatgcagtagaaatagntaacca

SEQ ID NO: 68986 - DNA, 203 bp, Triticum aestivum
  unsure (1)..(203): unsure at all n locations
  Clone ID: PAT_TA_68986
tttcaataaggaggtaattgacgntgtcctctgaattntggacgcancancattactgaatgctngaaataggttngcacttgaccacaacagttactaatagcgagtcacagcacagactaaagngcttcattttgggctggtgaagaactngttgattcctggcatgatctcnggggtcttgtactgcacataagctctga

SEQ ID NO: 68987 - DNA, 711 bp, Triticum aestivum
  unsure (1)..(711): unsure at all n locations
  Clone ID: PAT_TA_68987
ccttttcttttcttttcttttaaatattaggagacatacacttaacgcgtgctactgngttgggtgctggtcatggtcagtgagtgaaagatggctagctctcaacccagctccctcacaacccagctccctcgctccctcactctcactcaactctcttccaatcgatccatccaccggtgcagctcgcccaaagcaccggcgatggagacggcaatggaggccggcgatgaccctgcgttcgtcgcggagggcaccgtcaccagcatcaggctcgccgtcgcctcaaaccaggagatcgtacgtaattgccaagcatttcttctcctctttcactccaaccaatcatggcctcttcgtcgtctcctccccctccttcttcatagcagaacagcaggtgattaactaaccacattgatggtcgcatgcattgcaggtgaaggcgcagccgatgaaggaggagttcccggtgacgcacccgagccagctggccgggaacccggcgctgggcctgccgctgcagctcggccactgcgactcctgcggcgccaccgacctngccaagtgtgaaggtgactcactggctcctctctgttttatacctacagtaggcaagatcactctgtttgaaacacaaatagtttgatatgataacagctgatctgactactcacttgagtattatacattgncagagtattcttgctaaaa

SEQ ID NO: 68988 - DNA, 356 bp, Triticum aestivum
  Clone ID: PAT_TA_68988
acaaattacaaatggagttaatactttcataagaaaacatcatcagccaagcccatgcagcaataaattgtaaaatagcatagatgtcgtaatggacatgtctaggagataaagttgcgtcaccctttcagtcatcacatcatactagcatgtctcaccaaacaaccatctcacatattgttcaagacttcatttccatcatgtccatcaacaatgccagtacctgcaggatagaaacatgcaaatggataatggtgacagaaggactttggatcagaaagtttcttgaactccattgactggaggtagaccatgaagacaccagaagctgtcagcacaaggattggagaactagt

SEQ ID NO: 68989 - DNA, 192 bp, Triticum aestivum
  unsure (1)..(192): unsure at all n locations
  Clone ID: PAT_TA_68989
acaacactaacactatgggtatnanaaatnnggcgaaacctgggngagatgtnctgncagaaccggaaaccaagggcngctangngccnccactcttcacncggccaggctaggcgcnagaagaaataaacagatacaatctcaggatgctgggatancaggggatctattagaagggcnggttgngcttcc

SEQ ID NO: 68990 - DNA, 690 bp, Triticum aestivum
  Clone ID: PAT_TA_68990
catgaacaaagcctatatggcattgattcttaaagtacaccagcaaagtacaataagagcaccaacaaagtacactgagagcaccagcaagatcacattgtaccataggatgcaagaacacacatgaagtatctagttttgaacattacatggcacatgtgccatttagtggttaccacttgcatagaagtaggctctccatcctctgtttctaccaccagaaggtggagtagcagtagatgtagagggagcagtagatgtggagggaccagattgccttggggcagagaatgtacctctccctctcccagcacctctccttctcaacctctagcttctcactataatggggtgttatgtcccatctagctttctttccactctccctattcctatgccacctcaccatctgcttatcctttattccatcacacattgtcctaattggtttcttcctaacatctaggacatacttgttgaacacctcagataaattgttaactacaaggtcagtcttgcagtttgtgtcaaatgcatgccttgcccatgttttcttgggtatttgacaaagccactcccaagcttgctcacactcatctctaaggtcattcattgcaatgttaaatttgtgttcactatatgcataggcagcattatccatacactttttcagatcttcccccctaaacc

SEQ ID NO: 68991 - DNA, 177 bp, Triticum aestivum
  unsure (1)..(177): unsure at all n locations
  Clone ID: PAT_TA_68991
cntgtatgagggaccttcgcaagcattatcttctccttttatatttgatttctagcacataataaacatcgtcatccatatttcaaagtcctggttgttaattttgcatcatgtgtgtggcaatctgggttcggcaaaaagctctgaatcctttcctcataatcttcgtgttttaat

SEQ ID NO: 68992 - DNA, 702 bp, Triticum aestivum
  Clone ID: PAT_TA_68992
attttacattacatagtttaccacgtggtatacccaaagtaaaacacatatatagaacatactcacagaccattgcacattcaccctatccaacatcatgatatacaacacacaaacacatcagagtggctcattggaaatccaacgcctaagcattgcgaggcatctctctggttggtacgacggtgcagtgtgtccaccaccctttacggtggcgaacgtcatgttatttgtatatgctattgtgaatccagcggattgtccatcaagatgccaagccctccattcatccataatggagaaattgagtgatcttacccaagactgtgtacccaaaaaaggtacaacagcatcatggtctccactatataccaaggcacgataaccttttgacgtaatattacgatggtactttatactgctctcaatgtcatgggtgaaaggtaggtctttttcatggcacctcacccattcgcccatgctcccctccttgattccaagtttttcccgtatgatgttgttgttagcccaaacatatatcaggtaggtaatatagctatggcaatccactggaaaccgaggtggtggatgtttcagtgctccagtttcttgttggaggatcctgccttgtgtagtctcatcgtttggtgtgggagatagataattgcactttttatccaaaatatgggagtcataaatttc

SEQ ID NO: 68993 - DNA, 327 bp, Triticum aestivum
  unsure (1)..(327): unsure at all n locations
  Clone ID: PAT_TA_68993
acacacatagttatatatncacaggnacaccacacacatatgaagattactatttcactaaacaaagtatgacagaacaagtacttctcaaagtgaaaaggtatcacctagtcaggacatactaatctagcatttatgttacaaattcgaaactgaaccaaacagcaggatactacacttatcaaaactgaacattacatagtactcgttatgacacttctgaagattacagaaatttgagagagagagagagagagagagagagagagagagagagagagagagagagagagagagagagagagagagnacancagagagantgng

SEQ ID NO: 68994 - DNA, 321 bp, Triticum aestivum
  Clone ID: PAT_TA_68994
cacatgtgtgtaaattttcaaagcaaaataggttgaaatgagtgttgtgcagaagaaaatatggggctttttaacaaggcggatgctaggccttggtaatcgtccgatcatgcacatcgcggccgtccgcttggtctcgcactacttgtcaacatcttccctctcacgcaacagaggcaccatgcatgcagcgcccacggttgagctccaagcacaactaccagctcgacgacaaaggttaggacaccaccggagctgcgatgcaacgactgtcggagctgcgatgcagcgggcgtcgacaccgccggagctgcgatgcag

SEQ ID NO: 68995 - DNA, 541 bp, Triticum aestivum
  Clone ID: PAT_TA_68995
ataaacagctggaaatgtttacttaaccatgcaaagtatgtcggcaacggcctgtctctagctccatgattgtgtatatgctcctgcgccttcctggttaacaagaataaagaaaatgctccaaacacaaactcaaatctagagtgcacacacctctggacaaaatgcagcacaatttatccaacatgatgatacctaatcacaatctcgtaacttgccaatactccattggtgcaacacatgcatgtcaaatggcattctgatcatgtgcgcacctatagcatgttaaggcgtttaagaatctcaagcaaaggttggtactttcagacaaccatgccaaaagttgttccataggtaaattatcaaccagtttgcttcaggactggcaatgtattgggtgttataatcaagatacactgcattagctgatggtctctgtgattacacaatctgtttggttcaaggaaggtttgttttcccattacaacacagctctgacgcaggatagctcaggacgcctgaaaagagaagaaaagaagac

SEQ ID NO: 68996 - DNA, 548 bp, Triticum aestivum
  unsure (1)..(548): unsure at all n locations
  Clone ID: PAT_TA_68996
ttatgaagnaatttgataaaaactcaattcatacagcccttcctcagttcaggtctccaaatcacttcatcaccggacaaaactaactttgattgctcacacaaagtaaagtaaccacagaatgaaccgaattacagatcaagcagcaatttgataacgctgattcgcatgaactgtcaagcaagctttattccaccatgagttggatccagatgagacagctatgcaccacctgtgtccgcgttcccgagggcacccctctctttcaagaggattcgcggcatgtcaagccctggtaaggttcttcgctttgcatcgaattaaaccacatgctccaccgcttgtgcgggcccccgtcaattcctttgagtttcattcttgcgaacgtactccccaggcgggatacttaacgcgttagctacagcactgcacgggtcgagtcgcacagcacctagtatccatcgtttacggctaggactctggggtctctaatcccatttgctcccctagctttcgtctctcagtgtcagtgtcggcccagcagagtg

SEQ ID NO: 68997 - DNA, 140 bp, Triticum aestivum
  unsure (1)..(140): unsure at all n locations
  Clone ID: PAT_TA_68997
acctacagnaggaggagttntaagcactagggcagnaaaaaacaggggaaccatgccatgccatcacatggggaggggcacatcacancanagagaagcaaggtnatcaggaaggaaggagctttacatnntgatgacag

SEQ ID NO: 68998 - DNA, 535 bp, Triticum aestivum
  unsure (1)..(535): unsure at all n locations
  Clone ID: PAT_TA_68998
ctttaaggttccccntgaaaaaattgttgttncagctaaccttttacgcaggaataaaataatacgcacatacatacaaattactttctcttccatcacgaagcatgtactgtagtaagcgactactacctgcataaggtgaatcgacaaaacacatggtgcacataaatctcataaccggtcagttgacaaaagcaatcaccagataacctactgctcgccaagcagatttggagcatggaatttctgccctcatggacgcgctatggagaagagtaaattcataaaatactccgacaatggatagactaaggtctcagcagtgcacgtatccgcccagtaaaatggcagcaacatgcctactccctgaaatcttggaagaacaacaaacctccaaatcgtaggaagatcctgtgctcgactactcctgcaaggacatccagcaagctgaacctcttacttctaaacaaatgaataaatcaacatgtatccactgaataaaaatatcctcatgaaacataattggtgggggggg

SEQ ID NO: 68999 - DNA, 208 bp, Triticum aestivum
  unsure (1)..(208): unsure at all n locations
  Clone ID: PAT_TA_68999
tctaaaaaaaaaaaaaaancacaagtcacaactaatccttttatttattccaggagggttctgaaatcaagccgcagcaatgcgcttccttgcctcttcaatgatggtgagcttgatgcccttgcccttgggaagagagacccacgacttcntatccttgccaatgctgaagacgttggccaggcgggtggcgaactgatggccgang

SEQ ID NO: 69000 - DNA, 697 bp, Triticum aestivum
  unsure (1)..(697): unsure at all n locations
  Clone ID: PAT_TA_69000
aggttgccttgggaattctttcgatttctagaatncacatggttggaaacgagcaaaatagtgtagggtacacataagttcagtggtagatggtttggtctgttttgcaatacaaaacacttgtacagtattgttagagtgggaaacggacatatagtgtaggatgtacccacaaaattataccttcattcttccgtttgtccctagaggcatttgatcgaaagagttctgtcttgatccattcttcgaagaattaattgttcatagtcactgattcaagatgatactggcagtaagaatagtccagctcctgacctctgaagaattcaccccaaaaaaattctacatgaatgctgacttggagcgaacgtagctcctctggatcccatctccactccacctggaatgctattttttcgaaaacaccaacattaggtgggtgccaattcatttttcttttagattagagtcctgaatatgctcagccagaaaatgatacaatgcaatttatatgacactctttagagattatggttttccatattcgcggttatctagcatattctgacagctcacaaaaccaattgagtccattggtgaattgaaatcgtctgttgacacagcccaatcagccaatctttgcacattattagcgtgctgccataattcaaagagctctgttggtaggtgattcaaa

SEQ ID NO: 69001 - DNA, 363 bp, Triticum aestivum
  unsure (1)..(363): unsure at all n locations
  Clone ID: PAT_TA_69001
catacacgtgcatgcatttatcatgcatgccctntttacatgcaagcctatttatatattgtaatcaactgcatatatatttacttcgcagagtcagatntaantgtggagtatatgatggaatagacccggccaaaaataatatctgactggggattgtaatcaactgcatatanatttactatttnntatatgcactacaatgtatatatgtgcatatgaaactaatatncaactatgttgngactcgttttttagttcgaaaatactcctagcctaggtatatggccaaaaattatactatctgactgnggatngtnntcagctgcatatatatcctactatnngctctctacantatat

SEQ ID NO: 69002 - DNA, 350 bp, Triticum aestivum
  unsure (1)..(350): unsure at all n locations
  Clone ID: PAT_TA_69002
agttcctcaatacatgggtatcctctatcgaaccacacagttatagctcgctcagagcgactgtaccttgtcagacaatctgtcacgctatttagagatctgtattttctagggaataaacactctatcgatcatgagagacttaatctcggctactaaatgaccatnaactgaacgatctaaactagaactggaaagacaggaaatagcaaacgatgaaccagattgaaccatgatccggtagctccgtgtgctgatgagcaagcgccatacaaatcatcaacgcatgaatctcagtcttcagtgtgtcactgcagttgaataaatagcgatacgctgagaagatgaca

SEQ ID NO: 69003 - DNA, 199 bp, Triticum aestivum
  unsure (1)..(199): unsure at all n locations
  Clone ID: PAT_TA_69003
tagagatcntctcaactaaggncatagattgaanggcgggatncaagctgataaaaccaaagccttccaagctccaacacatacattagtacacancatanaccgaagttttggacgtcggtgntggtcaaatttaacttcctgacggcatatcctgcttacataaatacaatacttgatacggacatgtcatactaca

SEQ ID NO: 69004 - DNA, 110 bp, Triticum aestivum
  unsure (1)..(110): unsure at all n locations
  Clone ID: PAT_TA_69004
ctgcttgggttntcccaggccttntcncacaccttggcctcgtngagnttnttggcgccgccttccttgacctcgatggtgaagtantgcatgcacccggncaccacntg

SEQ ID NO: 69005 - DNA, 124 bp, Triticum aestivum
  Clone ID: PAT_TA_69005
gtagtacattacacggacaaaaaccccgtatcatgatgatgattaagcgttttcgcgcggtaaaaatggacgtccctcgaaaccatcacatttccagtccaacacacctctagtgagagctaag

SEQ ID NO: 69006 - DNA, 326 bp, Triticum aestivum
  unsure (1)..(326): unsure at all n locations
  Clone ID: PAT_TA_69006
atgcagngnncncntnnttaaaaaaaaaaaaaaaaaanatgtggatacanataaatggtcgtgggtgctctcgacatcatcgnctaatacaagatctttttccagatttttcccaatttgagaatctgacaatctgttgccaatgagctcccgtagctcgaactcactangaaacctctgctcanataattttganaagaccagntgtccattgcagtaaacttcaaaggcgccataactttgtanaaganactgancaaaattgccaaacatncacactgatnccatggntccaaacctattagcactcantgaatagtaccacg

SEQ ID NO: 69007 - DNA, 728 bp, Triticum aestivum
  Clone ID: PAT_TA_69007
tgattgctaatgaaatgcgtgaagatggcaaggaattcccggcacctagttacagaacgatccacaacgaaccccaccaagcaaccatcataatgtttttttctagaaagcagccatttctagaaggcagccataaagttggtgaatcacttgagccctgagacattttcggtgccatggagctagaccagtgagctattacgctttcttcaaaggatggctgcttccaagcccacctcctggttgtcatcgctcgatcacttccttttccactaagtgattgcttagggaccttagcgtacgatctgggctgtttccctctcgactttggatcttagcacccaatcagtctgtctgtactaaggatgacggcctgtattcggagtttgcctggggttggtaaagcgaaatgggggccaccctagcccattgagtgctctacctcgggccatcgacatcatacgctctactgaaatagatttcgcggaaaaccagctatatccgatcttggttggcctttcacccctagccacaagtcatccccgtattttgccacatacgtgggttcggtcctccaaggcctgttagagctctcttcaacctgctcatggctagatcgatcggtttcgggtcaaataggaagaacgtaaatcttccacctctggaaagcgcctacacctaatggcttaagccgctgttcccatttcctcgctgacccatcatgcgaa

SEQ ID NO: 69008 - DNA, 600 bp, Triticum aestivum
  unsure (1)..(600): unsure at all n locations
  Clone ID: PAT_TA_69008
agtatatataaccnatgaaactcagttatcaacaaaactgagctaactaatttaaatgggcaaaaatggatttgattgtggtaaccagttagatcacaaggtaatagtgtctcccgtgcttgaggccggtgcaggcacgttggacctggcgaaggactggatccatcggtgcgatttatgcggccatatccatatgcaagggagaacagcgagatggtcaacgaagaagcattagtgcaacaaaagtcctcctgaacctttgattctgaaggccttatctgtggctataaagggacgattgtagggcacttatacaaagacaatgtcctcctcaaagtgcacagccgacacggaatctgctgccttcagtctgtcctaattttaccatgcaccccatgtctcacccaacaacaaggtggaaattgcaacccaaaaaaagagatgcccttccctctctcagtgacaagcatgcatgccttcaagaggcgccgacctcaatctccttccttccttggatgtgttatcataagcgatctgctgtcaaatgttttgcgctcttatgtcncgtntctagagagtcatttntacaaaaagngacat

SEQ ID NO: 69009 - DNA, 592 bp, Triticum aestivum
  unsure (1)..(592): unsure at all n locations
  Clone ID: PAT_TA_69009
acattagccaaatactgtgatgaaantngtgcacccataaagcaacttagtgactagcctaccctagaccacacccacttccccttgaagccattataccaatccccagcccccctcccctacttacttcccagcccttattccttgacaccacaggagtataccccccacaatgtatttaccaccatgagccaccacccccacaacatatatacctccaaacccgtctcacccccaccttctccggtataccgccaccacgactcaaaccagaaaaacaaaagatggatactaaactactacatttcgacctactaagcgttatttcttcaccatcatccgtgtgcttgcttcacgggatcatgtgtgctgctaccttctaccttggctgaggtttctgcatgaatgaccttgtcggtacgatgatctgtggccttgggatctgaggcgaagggcagtggttctgcgagcgctgcagcatctgaaccatggatggtgtttgatacgagtaaacaagtgaactgctgtccgtggagtcaccgcgtgtcgtggctctctgccaagaatgcgagctgagccccgacagcagata

SEQ ID NO: 69010 - DNA, 122 bp, Triticum aestivum
  unsure (1)..(122): unsure at all n locations
  Clone ID: PAT_TA_69010
caaaaaaaaaaaaanaactacgcaatcacaaggataacatcaaccttaacaaatccttactccatgttggtaacaaaaacatcaaggaggcaacaaacactgccaacaaaggtacttgagaa

SEQ ID NO: 69011 - DNA, 100 bp, Triticum aestivum
  unsure (1)..(100): unsure at all n locations
  Clone ID: PAT_TA_69011
ttgaaatgccctttcagnactagcatccactatatccagctcaaccccattagcgagcatgtgtttcacggcctgaacaaattgcatgaaccccacccct

SEQ ID NO: 69012 - DNA, 666 bp, Triticum aestivum
  Clone ID: PAT_TA_69012
acgtgtatctttttagtaatcttctgtctagacaaacacacacgccaagaacttagatccttacatataaaaaaatgcattttcacatagcccctttgtaaggtcaaaactaacatggcaaaagtgggtatggcctgggcgcaagccattatcagaatctccttccttgccttgcttagcatcttttccttccaccattgtatacgttgccaaattctatccttcagatacgcaaagacttttgttcttgattgtcccacatacaccaggagccccgggtatctttcattccaagtctcatgagctagtcctagctggtccagcatagctttccgaacatcattcttgatattttttattgtcggcgcagtgacaaaaactacaggaagcagccttagacaccgatgtgctgatcacgaatatatcctccgtttcctcttgcgacgtcagcttcaatgaaataccacatagtagcaaaggggtatacgcaaaacaacctgattgggaaggggaagaaggattggggcaggtcacctaagcaagaaagatcacgagcgacaaaatcctacatgatgcagtgtggtgcagaacaacctcatcgggaaattcatggacgccaaacaatttaggaatgatgcctgaaatcatgtctacccaaatacagtt

SEQ ID NO: 69013 - DNA, 457 bp, Triticum aestivum
  Clone ID: PAT_TA_69013
caacagcaggaaaaaaaacctgcagtcaagaaagtacattgatgaaacaagtgattcgaacgccaacaaccaagcagcagcaagcaccaatcactcaaacagtgagcgagcaggggaagaggagcacgcggcagagtgggggtccttactcccgccaccaagctctcttctgtttcaccctcacccctcttgatctgataagtttcccaaccctaccctgagacccttcccctgtcttgtctcaattttgctccctctcttcgccactcacctcgcctggtcatcacttttcttccgcccagcacccgcctacagcttacgcaatctgcctaggcgagctcccactttcgttagggagaaggggagaagcaacatgttctgctcaccgctcatattaagcgtacccaaacttcacaaagaattccttcatacacacgtatatatatgcatgtatacc

SEQ ID NO: 69014 - DNA, 329 bp, Triticum aestivum
  unsure (1)..(329): unsure at all n locations
  Clone ID: PAT_TA_69014
cacatncatacanactgtggccagcacaagnatagatattccctcggtcccaaaattcttgtcttagatttgccagatacggacaagaattttgggacggaggtagtagttatgtgatctggcgataccacacaagtcggtccaccttagtactagtagcagtatatgcatgcctgggtgtcaggcaatcaaccgagcgagaggcacgctttttccttcacaagcaacgaccaccctacagcaacctccaccttggagtcgccaacttgacactcaatcgttcttgttttggcactgctgaacaggggaagttgatgtgaccttctcna

SEQ ID NO: 69015 - DNA, 590 bp, Triticum aestivum
  Clone ID: PAT_TA_69015
caggtagataacacgattcattaaaaacaaaaaacattcaactggtgaaggaaaagacaacaccagaatactgattattcatgcagattaagagcatggttaatagtatagccaactgctggctataagccattgccatgtcatctatagcccatcttatagccaatatgtacaatagttgattagaagagtgtactacttttttattatatggcccacctttcactctcacaaagtgcctaggagcacgtgctagagctggctcttcaccaagagcctgcttcccttctctctcttcttctctttcctccaactaagcaagaatatactagtttatttcttatagccagctgactcagctttattgtacttgctctaatagtcacccacttaaaccttaaatgtctctttttcctcaaccttggaaccatgcagcaaatgttccttcaacgccacatcagttgccataagccttactaaaacacctcgagtatcctcagctcctgttcttcttgttccgcaagttgcaccaactgctgcgattccctccgagtcgcatcaacatccacaccattgctgttagcaagagc

SEQ ID NO: 69016 - DNA, 579 bp, Triticum aestivum
  unsure (1)..(579): unsure at all n locations
  Clone ID: PAT_TA_69016
gaatncagaagataattatcaggcggaagacaaaacaaccaaatatcttatcgcgtgctgttccgatccgtcggccttcttcctcccggcccgggacgattctcctagggagctggccgtggggcgggggcggacctcgccgtagtggtggctccgagcccctgcacccgaccggacgaggtggcttcccgtgctgctcgcacaggccgcggcgtcccgtagggcggcggcgaggaccagcagctgccacgtcagatgatccaatgggttagccagcggcggccgcgaaggtacgaagagcacagtaaactatccaaacatgagtgaatcatgttgttctgctattatgttttcaaaccaactacagatgaaatgaacagccaacgcaatttatgactttcgcatggccagattatcaagcccgatttaacaacttttgtcactgagagaacagacatgaaattgctactccaagacagttgcagactatgaacttcttcagatagtcagtttggttgctagagcctggccgagtatgttgagggcctggtgctgtgcatcaactgcttgaaagagcct

SEQ ID NO: 69017 - DNA, 225 bp, Triticum aestivum
  unsure (1)..(225): unsure at all n locations
  Clone ID: PAT_TA_69017
atggaaatcggtttgtaattgtaattccggacatcagacatcagcatggtttacgtcaaccatgcagaatagtgaacagcctcaaaaagttttagaaatcacaaagatattgtcaaacaagaacattgaattcctgaaactgctgctcgtttctcatggtgctcccatatcaactccttttttaccactaaagattttntcacttaactgagactagttctcccc

SEQ ID NO: 69018 - DNA, 631 bp, Triticum aestivum
  unsure (1)..(631): unsure at all n locations
  Clone ID: PAT_TA_69018
tgttcagcacacatacaatctacaaaagnagagctacaagttttgtgtgaggcatcaagccatcagcaacagcatcacttgttataggaccttgctagcaacgacgatcacgaccgaatctcgccttcctctaaatcctcgtggaagctttgacggcgttgctgcttccagtcttcgtcaaccttgaggtagagcccaatctgccgcaacaagttgctgggcttcgccgtgttgtactcatcaatgccgagcctcttcagatcctctcggtgtagggtatcgtcgggcattgccgtcttctccatgtggagcagctcctgacgggccttctccctcgcccgggacgtggcctcctttcgctgcctttccagagcacgggcgagctgctcacatgttggaggcgtgatggccggtgctggactgtcgacgatctcgtcagaatcagaatctgagtcactgccgccggagtgctctgaacccgagtcgctgctgccggaatcagtgtctgaatcgctgtcgctggaatcagtatctgaactgctgctgctgctgctggagcttgggctgccgctggctgtttcatcttagacgagcagcagaggtgccggcacgatcggtaatggggagacgc

SEQ ID NO: 69019 - DNA, 635 bp, Triticum aestivum
  unsure (1)..(635): unsure at all n locations
  Clone ID: PAT_TA_69019
ttagggtgtttgtctctaattntattttgaatttgcaagattttgaactaccncttgattagcaacagtaacacggatgacatggcatcattaaaagagttttactgtagcctaattatccgggcgttacaacgggttcccttcgtcggatgttggtagacgacgtcaaaatcagggcaagncgcattaccaaacggacaacggtggcttggncagttcacaaacccacggngtntactcctcatcgactcccgttccttcgtcggcatcatgggtcgggcatcaacgacagtctcccattgctgctgagcacggactccaatgtgacaacgccaaagttgcaagttgtcttgattggacttattgtgaaattttgaagcaggtgagcctcgtcaaagttttgtatattatactgccgttccatcacaatatggcacccatgcatcaacgaaatgtcggccgacgagcctcctagcctccgccgagctagctgcatcatcctaccaaggagccaccgcgcctggcagagaaaggccccccaacgccatggaaggggacactttcagntctctttatttccagttnatagtactggtccatgattccaccagggtcaacggctgataattatgtgt

SEQ ID NO: 69020 - DNA, 195 bp, Triticum aestivum
  unsure (1)..(195): unsure at all n locations
  Clone ID: PAT_TA_69020
aacggtgtgatcaacataaaaatgtgcactcatcaaggcatgccgagggtgagctcccttgcatcggtggcctgcacgtcgtctagctccttgggcccctcagtctcnggggagttagcgtgcaacatcttgctcctcgtgttcgccgcctcgggcgaccaatggnttaagatagactgntgcaatgatagtcgt

SEQ ID NO: 69021 - DNA, 652 bp, Triticum aestivum
  Clone ID: PAT_TA_69021
tgattatgaagaaacacaaaagcagagtaccatgagctgggtgctggacatgaactcaaaacgagtccttttttggatagtcacaggttgtcaaaaaacaagcttataaagaaacgcataacacaaaaggaaatggcaggcaattctttacaaatcctatgtctgagttgtagtttacttgataagctactgaagtaaagtgctaggggtggaatgacggatggcggtataaaggattttgctggaaaggattatgccgagtaggtacgacatttgctgcaactggcccaccttgaattcccggtaaaaatggtagaggaattgcaggcattaaatcaaacggccgatgcccaatggggccaatctgtgtcacattcggaatcacaggtgatagagatcttgcggaaggaccagttggagttggtagcttggtaacacatggccttggctggtttaagtacagctgtttcccttccagctttctttgtttcccctgcacttggccaacttgtccctcgtgttgctgctgctccttcttgtgcttcttgtatttctgcttttgcttctgctgttgggtcttttgctgctgccttgaatttaatgtcgatgtagtagaggcatttgttgtaatacggctctttgcatactcaac

SEQ ID NO: 69022 - DNA, 612 bp, Triticum aestivum
  unsure (1)..(612): unsure at all n locations
  Clone ID: PAT_TA_69022
tgttcctgcccgtggttcggcatggtaacaaaagtaagaaataggatagcagtcgtggtttttcgtcgcttcaaacgaagaacttacagtagagagaaaacctgcgtaaataacaggaaaaaaaaactatggcacgggcctgcggaaccatggtcttggggcccgatcagccgctcactcacgtccatgatgagggcgggataggcggtttgccgtacaggaggtactgggcgccatggagactactcaggccgaacacttatcagattggggagcgctgtcaccctgagcttcttcatctcgttcgctgtcaccctgcacgaatccagcgtcagcgagcgcaagttctgcagcgccttcaggtgacggagaccggtgttggacacccgggagttggagacattcaagcagatcaaagcggtcaagccagaaatcagctccagggttttgtctgtcagcttgccattttgcgaaaggttgangagcgtcagagctttgaggtccttgatattcttcactccagcatcagtgattgacccacccgcatacctcaagggactcgagattcttgaaatantctcaagaagcttgtcccatggtcagtcacccgag

SEQ ID NO: 69023 - DNA, 612 bp, Triticum aestivum
  unsure (1)..(612): unsure at all n locations
  Clone ID: PAT_TA_69023
ctacaacacaacattagtaacttatatctctcagnaaactgaatcaaacattatcctagccatgaaacatgagtacatacttctcagcttcctcaatggaaagcctctcaagctcctccagtatactccccacgcgctggtcaaaatccagctcatcagctgcctcgaaggccaaaggggtctgctccatggccactgactctgacttgtcctgcgcatcagagtccaagtcgatggtctcaggctgcttaattggaggggaagtggactgtacggcctccccctcctcaatctcgccctcttccttctcctcgtccgaggcgtcgacgaggtgctctacctcgtcctcgtcggcaacaggccgcggaacgagaggcttgttctgcacagcctgcgcccaagcaaagctgtggaacgccggcgcataactcctggacatggtgtatcccatccaaaccctagatctctgcgccgacgccgacgcagcggcggtgccactggacgactccttaaagtcggcggcactaatttcttccagcgactctgaggagtccccatcggacgtctccccgccgccaccggcggtgaagacgtcccccccaggcgcgacca

SEQ ID NO: 69024 - DNA, 691 bp, Triticum aestivum
  unsure (1)..(691): unsure at all n locations
  Clone ID: PAT_TA_69024
gcccgcctgttaattccgatngcggggtagatacagtacatatatggtctatcggggacttagtgcagactttggaagaacgatcttccaaataaacgaatatattacattcctttggtgagaatattactagttgtttgacacctaaataaacaggtattttaggaatggaactcctttggtccaatagaatagatagtccccttagaggccgaatgcatcagcagcctgatctccagctctcctttcaaagtaggaacacacgacggtgacgacgagcataattccagttccggaaccaggcacaccgatgaaacctgccatgagagtcagggcaccgacgcaaagcccaacgagaagtgctatcatggcaacatgacgcttccatcggttcctgggaatggagccgggctgtgcaggcgtcacaggaatttgcctcccgagcaacctggccacatatttccttgaatatacacgaataccaaaccatgttgccgagataagagcgcatcccatcagcagcaagacggcatagagtgtaacatggaccggatctcttgctaagtcagcccagcctaattaggattagaaggagtatgtactatgatacatgagaactttttgttggcgcagctctctctcagtctcagtggacgaaggtagaagaagtataagataacagagatgtttt

SEQ ID NO: 69025 - DNA, 615 bp, Triticum aestivum
  unsure (1)..(615): unsure at all n locations
  Clone ID: PAT_TA_69025
gtagtctttccgtgtatgcagcctagaccttcccatatnaagttggattctttccatgtatacaaccgaaaccttccagatggacgacccatatctgcgagccagattttgcctcatttggtgaaggcatccccatccctggaagcgacgaccgggctgggcgacgatctctggaagcgacgaccagatcgagagacggtctcttgaagcgactactggatcggcgacgatctctggaagcgacgaccacctcctggcaagtcagagttttccatggaaggtgtgccagagttttccatggaaggtgaagccacaggtcagcatcattaccctattcatgtgagtacaagatcaatatacagcaataatttgtaatgcatcagactccagaataagactgaagttcttcagtgccaacgccgcttcggcttagcctaaaacatattacagtgacgttctatgaaccataaaaccaaaggtgtgtgttcactttacctctcctgttatactataacttgttgaggaaagaaataaccccccattgagatgcatatctgtagctcatattacttccagtgtccatggaaggatatcaagaattgtggtccagtgacg

SEQ ID NO: 69026 - DNA, 229 bp, Triticum aestivum
  unsure (1)..(229): unsure at all n locations
  Clone ID: PAT_TA_69026
aatccccaggggcgagacgaagctgnagcgcancaccgacaacgccggcgaagctccattgnagcaccaacagcgctccaatgcatcaccggnggagctccattgcagcctaacgacccggcgatgctnccggngaaactccattgaagcaccactgatgcttcattgcagcctcggncgacgcttcattgcagccccgacggtcacatnaaaactccaacacagcanc

SEQ ID NO: 69027 - DNA, 176 bp, Triticum aestivum
  unsure (1)..(176): unsure at all n locations
  Clone ID: PAT_TA_69027
ctccttggcngggggnanctttttgaaaaaggggttntttttgatnaacggnagganctttttnaanagctgagggnccgtctccgggtnttgcnccattttntgnncancggnagggnggtaaatcggngtcgggtgcgtgtncnccggcntcggcggtttgtnctccgncncgg

SEQ ID NO: 69028 - DNA, 489 bp, Triticum aestivum
  Clone ID: PAT_TA_69028
cttctgctgtgatttccctgcattagaatcgtgcagcattgactagatctatatgtgatttcatcaacgagagagctgggcaagctcttcttgctgtacaggcttgttttcaaagaggattcatgctctccctatagaggtatacattcacctccaacgcagatgtagactaggctgttgatgatctgccatccatccctggttgtcatcaagaaaggagcaggataccaggtgaatgcaaatccaaataactagtgctgactcttattggatcataaccacaaataactaaaaataccaaacgccaactaatgagatggaagaacgaatgaaataaaaatccaaactttaggatcaacactgactgggcagcaccgattggcaagaatttgctacaaggaccacagtagagaacacctgacgaaaaaaaccatcaacgttgaaggatatggccagatctgaatctgcaatgatttgcagcccaaccag

SEQ ID NO: 69029 - DNA, 686 bp, Triticum aestivum
  unsure (1)..(686): unsure at all n locations
  Clone ID: PAT_TA_69029
ttggnggacantgtatttaaggaaaattgcccagtaacgattcagggcacatactcgaactcaaactcaacccctatgatagtaaatgttttgagaacgctgccgccaacctacgacaacctctggagttcgatgcctccaccaaaaacgaatgttgggaaaatccaccctctacagaaattattgccttccaacgttaaaaagataaaagttcgccagatccttgaagggcaggactgggaacagacttctcttgttcgtcatcatttcttcccctctaggcaccgcctgagccgtacttcttgccgaagaagaggatctggagctgatcgtagccggagagcacaccagcaccagcaatggcacggaggatgttggcaccagcacccttgaagagagacttggcaccctccttcgccaggatctgctggaaagcatccaaggagctcttgtacttgacagcctctccggaggtcatcatcatccttctgcggacggtgtcaatggggtaagatgcaagaccacggtagacaatgattccaacacaaggagatgttgaatccacggtaaagcccagcaataccatctgacttgagagtcttgcggtagacatcaaccaggccattgaattgcctgtcacctccacccttggatgccttttgcgtcattggccagccttgtcctag

SEQ ID NO: 69030 - DNA, 738 bp, Triticum aestivum
  unsure (1)..(738): unsure at all n locations
  Clone ID: PAT_TA_69030
tataacctatgcattcttgagtgtaatcntgtgatactgaaactcgaacccaattttcatccattcttttcttaaggctgctgacttcctatcaaatgctaactttatactagtactgtcttccacaccacgccaaatgaagtttcgtgtgtgtttgcgcatgtgtcgaaaatacttagcagcgtcagcagtggtgcttgttcctaaacccttataatatttcactgtccagttaccagcctctccttcgtgcctctcattccacagtttatactcgatcattgagtagaaaaaaatactttcactattacgggaaagtctgatgattggagtgataaactgctgtaaaaacccttcaactttgagcaaagaaggccaacattcaaggaataaattgatgattaagcctttgatgtgagaaccgtcaacgtcctgatccatcataatcattatacggccataccgcaagccatcaacaacactgtacttgcgttcaaatttcagacccattatccgcattatagtttgaactttagagctttcccatacttgggctggtgtacgtccattcacattcatgatttttccattcaatggatacacgccatagtaatcccgtccaatagtacccagggcattcatcacaagtaactttgctgaatctccttcggtaagaatcaaggtgcacttcctagcttttgtaccaccagcaaacttcacatcatncaatttcggaat

SEQ ID NO: 69031 - DNA, 191 bp, Triticum aestivum
  unsure (1)..(191): unsure at all n locations
  Clone ID: PAT_TA_69031
agaggcggaactacttagtcttctttccagccaagagatttcaggaaagccatttcttctggactgggttcatnttcagtaggatatgnttcctcttccccagttanaatgggcacanacnacaaaccggnatcaccataatntggagtctgcctttgcagaaccatcatttatatctgctgccataatgg

SEQ ID NO: 69032 - DNA, 261 bp, Triticum aestivum
  unsure (1)..(261): unsure at all n locations
  Clone ID: PAT_TA_69032
cactnttactccntcagccntcccccactaaactaaatctnccanccaaaattngcccagtcnganctcgtcgttgtnggncaaatcgaataanccatcagangacctngntggttttccagangctnttccntttntnggttttcaggttnccaacnggngccttaaaangttattccaacacgacaatccanaancatgctcccagactaagcatgcncagagtctnattttccatttngtcttttcaggtanaaactt

SEQ ID NO: 69033 - DNA, 103 bp, Triticum aestivum
  unsure (1)..(103): unsure at all n locations
  Clone ID: PAT_TA_69033
cacacacacacacatgaaccatacaagtgaagaatatagcntaggtaaaccgaatttatntaggtgcatcgaccagncagtacacatangattgacgttatat

SEQ ID NO: 69034 - DNA, 621 bp, Triticum aestivum
  unsure (1)..(621): unsure at all n locations
  Clone ID: PAT_TA_69034
gncttaaactcgagncgtgacgacaggncggcgtgtcgccgcgccttttgtctgctagtcttcaatctaagagttccaccaacatccatccatccaatttcattcatctattcaaactaggagtaccactttcaacaacatataatgatgagttatatcttaagctaattagggagttttattgtcacgcgctgacctaatttgctgttgccgatcgagttccgtaggtaaccagcagctctgcatgcatatagggaggcgtgctcgatgcacgccaagcaacacatcaggccggcagatccttggccttgtcgggtccatcagggcggtagggggcgatggtcatgggctcgaggagcagcggcagcagctcgtcctggatgcacttgtacatctccctgcagtgcgtgtcgacgatcttggcgaggttggaggtctcctgcatggcctggaggacctcctcctcggcgaggacgggcttggcctcggcggcgagcaccttggagagcttctcggcgttctcctccagctgccactgctggtcctcgaacaggaccttggcgatgggcaggttggccttctccgacgggtaggtgcgcacctcgtcgccgaacatgtagt

SEQ ID NO: 69035 - DNA, 119 bp, Triticum aestivum
  unsure (1)..(119): unsure at all n locations
  Clone ID: PAT_TA_69035
ccctggctngactgcttgctcgctttggtgcgatcgacgtgtgtggattngcaattgcattccatctgaaaatattcttnccgaaggaaacgacctatacggagtacatgaccgggcag

SEQ ID NO: 69036 - DNA, 617 bp, Triticum aestivum
  unsure (1)..(617): unsure at all n locations
  Clone ID: PAT_TA_69036
ttttatnncctnctgattcnacgncacgtcctggttaataggcacagttagagatgcaatgaactgataaaacaggggcgaaatgaggctaatttttgcatctcggttgttaactaggtagagccacggatacaccaagagaggtacccagattagtacatgagcctagaaaccatgtttcaccattgctacaacactcagaggcatgcatatccatcacttggctaatgtgtaggggacatagccatgagctcgaccataagagaagggcagctcgcgatcagatgctggaagccgtcggtggccacgacttccctcagatttggtggagcggcgagaaaatcgaagcaggccttcttcagcccctcacagcggtgctgctcggccagcgtcaggatggttgctgccgtgccgatgtcgatgtactcgcacagcttctgctcgcagatcagctttagccgccccatgccatacctgtccgcagcaacgagcagatgctggcatacgactgcgtcttccttgaacgtctccggcagcaagccggcgtatgtgaaacggagcaacgccttgaacacctccgcgtccatgtcttccacgcgcacgacgccggcattacc

SEQ ID NO: 69037 - DNA, 268 bp, Triticum aestivum
  unsure (1)..(268): unsure at all n locations
  Clone ID: PAT_TA_69037
catttactagatacaacaatgccgacgcacgagtaaccncgngaagatatattcaacaatatatatgcggtanattaaccctattacaatacataaaaancacacgagagaagcagcatcctgcttaagttgttgcgccaatacgggaagcaaagccgaagtttaacnccattaactgctgatttgcctgtntncgattnaagtntccattattggggatagtcaangaatgaaaccttgggcttattgtcatggccctttgcagntt

SEQ ID NO: 69038 - DNA, 633 bp, Triticum aestivum
  unsure (1)..(633): unsure at all n locations
  Clone ID: PAT_TA_69038
aaatacttgctttaaaattcntggcaccgatgttgctaaactgctcccatacaaaacatgaaacccccttgaattggggtacgtatacatgcatatctactaacccttattatgatcacaatactatatagtacttatataataagtactttttttcgagggaaggggttgaaatgcagagagaaaaaaaatgaggagaggtaataagtataggtgtggtcaaaccacatgtcctctcaacggtgatcgatcttctcatctcatcaggtggtatagtgaggtttgtatatgtgtgagtttgtggttgtcgaacgatggacacatgacctcggcctgggcgtggcggggtcacatgaagtcgaactcgtcctccaaggccccacgggcgagctcgaagcacgactcgggaagatcccgggacagcgagcggatcgggaagaccgcggagccgcggtcgtcgtccggcggttgctgctggtgccacgggctgaacttggtcgggtcgaatgggtagggctcggcgtcgtcgcggaacatgtccatgtgcgggagcggctccacattgccgcaggtccaggtgccggtgccggtgccgttgctgttgctggagctgtcgccgccgcctgtgtaggc

SEQ ID NO: 69039 - DNA, 420 bp, Triticum aestivum
  unsure (1)..(420): unsure at all n locations
  Clone ID: PAT_TA_69039
cgctcgaccgtcagcgagcgattgatgtgcggcaggggaggagggggacgaggatggtgcgtgtgcgnaacatcttagatctggctggggagcgggaggngcgcgagttcttgtccttcttnggcgaaatcgagcacgtcgacatcagccctgacgtggtggcgactggnaggacggcctacgccaccttcaaggacgtcgagggccctagagataacgctgctgctctcgtggggagaaagctaggaaccttggcctccaagttcttgcaaggatcanagggtatgcctgatgttgcttagctatttataggaggggacccaaccttcgtgtctcgcggcagtgtcttccttggatttgttcatgcaacaaggaggggacccgaccttcttcatgcctngtgcaacaaggntgatcgag

SEQ ID NO: 69040 - DNA, 595 bp, Triticum aestivum
  Clone ID: PAT_TA_69040
gaaatcttgccccttgccctagatggatcataagttggtttggaagaggagtttggaaaagtcatcaaattaaacctgatactcctgaggtgtaatcatgacaagactaatctgtcattcacaattttcattcttatttgctgtcaagactgttggcttttcttactgttggcttcattcatcaggaccacgcagacctctgctactgctgccgctgctgcctgcccgatcgagtccccgccctgctcctactgttggctactaccgatcacctctgctgctgacatggccatgcttgcttatctttggtctgtttacaattggcatcagaagaaattactgcagtgtaatgatcaattgggaaacctgtaatgcatgagaaaatattgatgttgcttgtcctcctgctgatgctgtccgattgtccaatttacagatgatgatcattgttatacaccatttgtccaattgcaaacatgcctaaagtttctgccagtcaatggaaacaaattcaatacaccatttgagatcaatacttggatatttaaagaacttttaaaaaacttgtgttgtcttgctgtgggggaagatccgc

SEQ ID NO: 69041 - DNA, 184 bp, Triticum aestivum
  unsure (1)..(184): unsure at all n locations
  Clone ID: PAT_TA_69041
aatttacagctatagcntgtnctacatacatggcacaggaatgcagctacagtatgngaagctatgngttgnggaggaggngattccgnacacatngnaagctcgcagttgccatggcnggnctngatccgctgcaccgccgccattccaggccactagacagcggtccaaagacacggngccg

SEQ ID NO: 69042 - DNA, 621 bp, Triticum aestivum
  Clone ID: PAT_TA_69042
catgcgatcttcttgctcggctggtaaagccctttctggcgcttgacaaatacagtatgagcgaaatttacagctatagcatgtactacatacatggacaaaatgcagctacagtatgtgaagctatgagttgagaggaggagattccgtacacattgaaagctcgcagttgccatggcgggcttgatccgttgcaccgccgccattccaggccactagacagcggtccaaagacacggcgccgcggccgccgctgcacgagtcacctttcttaagtccaaacggagagaatgtccggcaacaccaggaactgtccggttcaccttgtacaggtcacgtcccacctttgaagctttgaggcgacaacaatggatcgtcttgatctctcatcacatggtgtagcaatggcgacatgggttcacgtgtgacagacttgtttaagcatggtaccttgtatatatgtctagcgacagctgtaaaatgcagtattcatagtatccatggtgttcactgacgatgtttgatttagtggtgacttcagtacaactggtggcttcttatctggcactagtgtcatgggtgcactaccatcaagcatcctgaccacccttcgcataccag

SEQ ID NO: 69043 - DNA, 492 bp, Triticum aestivum
  unsure (1)..(492): unsure at all n locations
  Clone ID: PAT_TA_69043
tgaaaacagggtaggacatggtnaaaattttcagctggagtaaggagggtggctctggagctgatggaagccatacttgaaggcctaggactgggcaagcattaccagcatgaagaatttgagaacggattgcagctactgcaagtgaactgctacccgaaagagccagaaggcgaatcggcgatagggctggcgccacattccgaccatggatttcttaccatcttgctcgcgagctgcccgggcctggaggtccttgaccgcagtagtgacacttggagagtggtccagcaaccccggcacgcgttgcacgtccacgtaggagactgcatggaggttctgagcaatggcagggtcaagaccgccgtgcaccgtgctgtcctgaaccatggcgaggcgaggatctccatggcgagcatccatagttttgcgatgcacgagaaggtctccgttgccaaggagctggtggatgagcaagatccangccctgaa

SEQ ID NO: 69044 - DNA, 104 bp, Triticum aestivum
  unsure (1)..(104): unsure at all n locations
  Clone ID: PAT_TA_69044
cactaatcaacgatntgactttcgacttcttgatacaccacacttctgaatgtctttgntcatcaatnctttactgacacaactacgcctngncctaggcctta

SEQ ID NO: 69045 - DNA, 141 bp, Triticum aestivum
  unsure (1)..(141): unsure at all n locations
  Clone ID: PAT_TA_69045
aacatactctctccgtccggaattattgnaggagaaatggatgtatcnagacatattttagnnctanatacatccatttttgtccatttctgtgacaagtatttccatatggaaggtacaaaatactttgcatctttggaa

SEQ ID NO: 69046 - DNA, 642 bp, Triticum aestivum
  Clone ID: PAT_TA_69046
agggaatattaatccatcccatctgctaaaactacaccatcacaaaccaacaagttttgcaaaaagaacactgaatgcaaagtgatctatatctcataggtgatcccgaccttgagcagctggtccttggggatggagagcgctttgtggctctcgctgaggttcttcctcaagaaggtgtacacgtagttgaccacgatcctcttcaaccccgacgaccccggcgctgccgccacctccgcctcgcccatcaggtacaccaccccacgctccacctccgcgtcgatgaaccgcttctcctcctctgcaaccaccgcctgctctaaccgccgagcatcgttgtcgtcgttgttgttgttgttatcgccgccattgtcggtgtgcgggcaggagaaggccgcctcatcgtggacgaacaacttgaggccctcgatgaggaacgccgagaactccttggtgccctcgatctgatcagtgtaaccgtaccgcgccacgcagcggaacatgcggtgctcggcggggccgaccctacggaagatgaagcgctcgggcagcgccacccgtgggatggggaggttcttgatggacatgaagacgaagactgcatgcaccgatgggattttgtcaaccaggcatgggaaa

SEQ ID NO: 69047 - DNA, 557 bp, Triticum aestivum
  unsure (1)..(557): unsure at all n locations
  Clone ID: PAT_TA_69047
atttgcatnaagaccacaagtagcgaatgatatgttcatgtaatgacatggaatccaagagaacacccaacctaactacgatatgcgtgcatacacacgcccatgcatgtgtgcctaagattaagatgcgccttagtgttcctttgttaggaacttgagcataggcttttgcagctgcttcatgacggcctcccagccggcctgcgtagggtgcacgctgtcccagtagaagtactggtcggggttcttgcatacggtgtaaagcctctccgagttcttactcagctgcccgcagtacccctcgggatcaaagctctcgcagcacggcgtcagcttgtgctcgaacctcttggccagcctcgagcctttaccgggggctggattgacgatgttggagaaggcggtggcgaggtcgaggatatggacgttcttggacttgcgcaaatttatgctcaggtggccgttgtggaggtccacgcccatgttggcccgcgagtcgcagacggtgtagttggtcggcctggtgagccacggcgtgcagccgacggggtgcagct

SEQ ID NO: 69048 - DNA, 695 bp, Triticum aestivum
  Clone ID: PAT_TA_69048
tcgatggaaagatatgcatgtggattgtattacagatggtagaatgacttaaattggtttacatatagtacaatgacttagaaatacaattatatataggcagcctcacagcttatttaggcatcttcttagtctgattaaatcagcactcctgcccctagtgccatcaaaccacataattcttggacaccacctcccgatcccattgccaattctatcgaacacactcctgctgaagtttgctttggtctccttctcaagggccaatccagaaacataatcagcagcctatgtgcctccatgccaggctttccacctataattgagaagcaccatttcaaacaacattgttacaatttcccctaaagaaatcccaataccttcatcaaagataaaaggagtcatcatatgcacacgtgctagtctgctagatagtacatttgaagtctggtaaagtgaagaaggaaacctgtccttccaattggcccctagatcagacacttgggcggagcactccagcatcacgagcttggcgacgggctaggattggcggcggctcacatcagtttggtgtactcgtccatgtcatagtaggcaccccctgccctggtcgatgggcacggccctaggcatctcccgctggggccacaggcccagtcgagatgatggcttattgcatcgagccatcctcaggc

SEQ ID NO: 69049 - DNA, 491 bp, Triticum aestivum
  unsure (1)..(491): unsure at all n locations
  Clone ID: PAT_TA_69049
ttttggacctatgcatctgacactggtactggatatagtnactcctaaaaaagggcactgactctcaaaaaaaaaaggacactggtnctngatgtctagatggcacagagctttatttcccgcgaaatgtccaacttcccttgcaccactgcacaacagatttgggcggtgaagacaccggcnccactgacaggcgcgtcgagctgtgcggacaccaccattgcctcccgcgctcgaatgatcctcctgcctcgtcgtggtaggaaagcccatctgccgtcgtcggcaacaggccggcgcgtatctgctccggctcgacgtgctcgtgctgctccgagagcttnttaggcaggtaaatcggggagctgtgccagaccagctccaagggcaaaccagatgaattntggagcggggggatgtanaagtgggcgcacgccatcaggacctcagcgggcaaccgcgaccgtggcgcggcgcggggccgcgtcggc

SEQ ID NO: 69050 - DNA, 147 bp, Triticum aestivum
  unsure (1)..(147): unsure at all n locations
  Clone ID: PAT_TA_69050
taaataataaagcatctagacngttnntgaccgcacngnaagtgttggaggccgccgcggcgaacggggtgcacagggtggngtagcaggggctcccggcgagtggggagcaggaggcgcaatgcatnccagcgcnncacgacgaca

SEQ ID NO: 69051 - DNA, 637 bp, Triticum aestivum
  unsure (1)..(637): unsure at all n locations
  Clone ID: PAT_TA_69051
aggtctatatgaacaggtaggtcaaagtcttacaagctggatgctatagcacagcaattgattgaaatnaatgcctaagatgttccaaaaggagaggcagagttcatcgcatcatcataacgcaggaatatcaagtattagataagctaaagatgatagatggatcatatgcatacgcgatagacagcagagacatcattgcgtgtagacgtgatggaccgtgcgcgaaaggcggcgcactgctttgcgcttgaaatggaagacacatatttcaccctcgtggatgttggcgtggtggcgaaaccatgaccagttcgtcgcgatggtagccctcttgccggttccaaggatgaatcgggtgtcataggtcattgtgccgtctacgagcttgagtgagagagtgtcatcatcttcatgattgtacttatggagctcaccctctgtgtattccacctgaaagtacatgccctggcctggtttggcaaacgtcttgttgatggtgcagacataatagtcgatctttggctctttgtgtccaaacattgtgaagagcttatccacatggcgttcgtagagcttcacttcattgccctagaaagcaatgttcctccagctcgccaaagtacttgacaccacc

SEQ ID NO: 69052 - DNA, 681 bp, Triticum aestivum
  unsure (1)..(681): unsure at all n locations
  Clone ID: PAT_TA_69052
gataaactattgaattaattaagncttatcggcatctatgtttattttgtttgtatcatcagaactgacgctagatttgttaatacaagataatagtattacatgccacatgaccaatttgtgtaatgtttggtttcaaaaaggcgaaagtagtggtcatcactcatgaaaggataatagggttggccccctatcctgaagctactgttgtcctcttgtggtacaaagtgtcgtagtcgagagatgaaacaaacaacggtgacactacagtggagggaggttcgtgtgtatgtaccagatgtactgagcaacgatccggtggtctcaatggcatgttgtgcatcatgccatatggcacacatccatggtgcatgtatatgcaggcaaggatcggcaatcctctctgcgcttagtcccctgtatgcaaaaatagaactgcatgaagccaatacctgcacttggagacacggggatgcagcagggacatgcaggcgaagctcatccaatcaccatgcgtcatctttttttcatcacttgagctttttactattctagcaccctgacctgattgtgcttgcagtgctgccaactaaagatagaagagcatgtcaactgccatgagtagggataatgagaggaatcgagcccttgtggtgggagtcgggtcctagggggatgtgg

SEQ ID NO: 69053 - DNA, 429 bp, Triticum aestivum
  unsure (1)..(429): unsure at all n locations
  Clone ID: PAT_TA_69053
cananacncatncanncagcacagnnnnatacactcnnncncncncnnacncacacncananncactcacnctnncgcncactnncanncnnanacatnnacananngncnnacncatnnacatacacagcatacacacacacacacacacacacacacacacacacacacacacacacacacacacacacacacacacacacacacacacacacacacacacacacacacacacacacacacacncncacacacacacacacacacanacacncanacacncactcncacacacacanacatacacacncacacacacncacacacacacanacttacacatcacattacacactnncanacacactnncacanacacncacntacacacacncncntncacacacncacncncncacactctcatac

SEQ ID NO: 69054 - DNA, 367 bp, Triticum aestivum
  unsure (1)..(367): unsure at all n locations
  Clone ID: PAT_TA_69054
aacattaaacatatacaaccacatcacacatctagcagcagcacaagtagtagccgtacccctcaaacaaacaacacaagcacacagtacagtagtagtactaaatcaatgggaagatcaaggaggaagcaggagctcaacagcctgacggagacgagagcgagcggaggaggggtgtgggcaagcttcctcgtgcgccgcgccgcgcgcaacaccttcttctggctcgccgtgccggtcaccgtcaccttgtcccacgcccttgtcccacgctcgntccatgtccacgtaatgcacgccttgaagcctgagcaccaccagcctcgcctaacctgagcccgatctgctgctgcccctctcctcctgc

SEQ ID NO: 69055 - DNA, 129 bp, Triticum aestivum
  unsure (1)..(129): unsure at all n locations
  Clone ID: PAT_TA_69055
cacatgtttctcaggcagttgttactcgacacgacacccnaagtagcatacaagaaaatagcccacanaaataaagcctgctctgaactcaactgtctatatnatcaagtacaacagganttgcagagg

SEQ ID NO: 69056 - DNA, 594 bp, Triticum aestivum
  unsure (1)..(594): unsure at all n locations
  Clone ID: PAT_TA_69056
gtttgatgtaaaaagccacatacatacaacatataatctctggctagtnagttgggagtgagtaacaagtgccaactccttcccaccatcaagccttattacagtacaggagaaaaccaagcaaagcgtacgtgatcatgcatcatcttagagacagaggagaaacagtttgacgagataactcggagatagcacaaagcaaagcgatagctcgatattcctggcgggaataaaatgcactaatccattgccatcagctacaacgcagcataaaggttggtgacacctcagtgttcctccacgcatctcatcttcttgctccaaggaacagaatcggcttccagtcccttcccagctgctgttcgaggctgttaccgaggattatcatacatcgattgtaatgtgagcatggttgggatgcatgctgatagcgctcctgatggctgactccgcgcttctctttttcagattcagtactactccggaatcttacaccgattctttcaagcgctaacaagtgctcgatacctgtaggtgtggcgctctcgtccttcatccatgatagatcgagtctctggagcttaggcattgccc

SEQ ID NO: 69057 - DNA, 112 bp, Triticum aestivum
  unsure (1)..(112): unsure at all n locations
  Clone ID: PAT_TA_69057
atgtaatcntgtcctcaactagcagaaagcagtaaatagttcttacaactacaacatatagctcacattaccctaagccgcgagcaaggatctccttctgcttatcttggta

SEQ ID NO: 69058 - DNA, 218 bp, Triticum aestivum
  unsure (1)..(218): unsure at all n locations
  Clone ID: PAT_TA_69058
gtgccacaggaaagttcgtcacctgacaatcacaactaacaacctgctgaagctgaagcatggatctggcattgcagctctcacatccctccgatcaccatttcctccagcaggttcgcacgatcctgttcttcgaagatttcggcgattcagatgatncnttggaagttttagtcgagattttctcgatcacaaagagtgtgagggtcctcggctta

SEQ ID NO: 69059 - DNA, 365 bp, Triticum aestivum
  unsure (1)..(365): unsure at all n locations
  Clone ID: PAT_TA_69059
caagggnacttttaatagtaatntnaccagctctcacaacctgggtaagtctcagttctgcatctactctaaacaaaaatatcataataaattgaggctaaacctctgtgcctatggtaaacaaaaggagggaaacacaccataattcttaaaggacctatcctaggatgcatttgaccacggtaccatcctaaaagtccttcctgatgcttcttagctgatcgccctgcgtatgagattttgtgccaccttctcaacgctgataagagttccattgataagctgatctatgggttcaatacccatcaaagtgaagagaaaaagatcatgtgatgcatctcagctgattgattgtttcatctcta

SEQ ID NO: 69060 - DNA, 683 bp, Triticum aestivum
  unsure (1)..(683): unsure at all n locations
  Clone ID: PAT_TA_69060
aanatgaattcccttagngacacaccacaaagtgtacacaggattatctatatctatactactattaaaagagcaaacatgaattcccttagagacacaccacaaagtgtacacaggattatcagaggcgttagatcaatccaactaaatagcatctaacagtccatatcacatcaagggtctgccacgcacatgaacatcccagattaaatgttctgccaagcagactgcccggcacactggttcgccctcaattaacgtggataggggggtttctgtcccgtaattttctctctgcctcacaacacgtcgtctctctgctaccccacagacgcgtgcgcagatcgccgccaccgcccgccgctcctcctctgttgtctgctgcctatgggcgtgagcgcggatcgacgctgccgttgtcccttgtccgctcctcttctgctaccccacagacgcaaacacgggactcaatcgccgccatccgctcctctactgccccaatgacgcgagcacagaccgccgtcgccacttgcctctcctacgctgccccatggatgcgagcgacggagcgagagtctccggcgccaccgtcggcttcacctctgctggcccatggaagtgagcgcggggcgccgtggccgcctgctgctctcctctgctgaccaacggatgcgagcgcgggc

SEQ ID NO: 69061 - DNA, 734 bp, Triticum aestivum
  unsure (1)..(734): unsure at all n locations
  Clone ID: PAT_TA_69061
gattattaatagatncagccgacagtttgatnaaattattcaagttgagcctcgccaaacagtacacccgcatacgctatcagagccaaaaatgataataaaactctccgaaaaactaggaaaagaataaaccatgggatgacaagatcactgtctcgaatcccaaccatcagatggagcaaaagagaaccaggaaacgcgtagtagattcgtaacccactcaagtgcttggccctcagagtgggggctggccagtagaagaggaagtcatgatagccagtgtctccgtcacggaagacatggcactcagcgccgccttgagaacatcctgagagcacccaggcttcactatgctcttccaacaagcagctggatgaattctgcctcaacatctcatatgcttttcctctcaagtcaacactagccatatgcacagctggcttcccgatttgtgtggttgcagggccacgtgaccatcccttcacggtcatcatggacgaaataggagcagcaccacatcgccacttgttcagggggctcttaagatttgtcacagtggccatgtaaccgttcaaaccagctgccaagatgtggtaacacacatgtcccagaacataggcataatcacagtcgaacttcgaaggcattgcacccctagcttggtagccaaagaagtgacagattgcattgaacttctttcctttgtaagtgccttcctttcaaacgtttgntca

SEQ ID NO: 69062 - DNA, 214 bp, Triticum aestivum
  unsure (1)..(214): unsure at all n locations
  Clone ID: PAT_TA_69062
ccagggtgactgaacccgtacattggcttaagcgcatatggagatncatancaagggactgacactgctatcaacanaggaaaaacaagngactgacagnnntgagacgcccaacccccaaccacgacgggggctgtcctagatttngncatcccagagctcatngnggntcttgtaaacgctgnctntgttgacgatgaagttgnccataagc

SEQ ID NO: 69063 - DNA, 221 bp, Triticum aestivum
  unsure (1)..(221): unsure at all n locations
  Clone ID: PAT_TA_69063
cggacgcagcatccagcggcccaaagagtgcacctaaaaccctcctaaaccanccgcggagatctnatnggacggaccaggggaagacacgacacacgactctcttatttagatcgacgacacgacacgggacacacggggcgatgacgacgacggcgaccggngggcggncggatctagagctggccgnagtcggcgatgacnacctgcttggagcaggt

SEQ ID NO: 69064 - DNA, 662 bp, Triticum aestivum
  Clone ID: PAT_TA_69064
gcagatatacaggttacaatttctccgccatatatatatgctacaccaaacaaaagaaaacaagcgcagacaaattcagcatatgcatgtctggacgatcatcggtgagcggtatcgtatgatgatgatccaggaaccaaaatgtaaacaaaactaccactgatgcctgttcctgagctgatcgctagcggaaccgggactatggttgctcgggggagaggctgcggttacggtcacagagctgagctgagatggtggggggcagcagagaagaagctctgcttcagggtgccgcgcgttgcgagggacctccagcagcagcgagtcttggtcagaatccttgtccgaggggttcagcatagatgataatttgtctggggctaacatgaacaggttgagtggtgctgctgctgctccggtggcattgccagatttcggcaaaaatgcgcttcttctcaactgacaagaagccatagccctggatctcgaagaagctaatctcatggttcctcctctcacttctgcatctgtgaagctttgctgctggctttcataaggtcttttgagagacctcatgctggacttggtaaggcctccaacttccttgctgcaattgtcctctaaagctgaatctgcgctctccaggatatgctggttcgaac

SEQ ID NO: 69065 - DNA, 360 bp, Triticum aestivum
  unsure (1)..(360): unsure at all n locations
  Clone ID: PAT_TA_69065
tctagtacacgataaatacggttaggctactctngataggttctcattgcagaaccttggcatttttgcggtggtcaacaacaaaatgattgagnaaatngtatgacttgtactcacccgtctcanatttgtgcatatttaaaaagaaattatgaacattaatttgatcanaaantattagttncatgccncaaaaatgtattcacatttgagaaaaatatcgagttgtataaattggtgatcaaattaatggacaaagttttcttacaatacgcgcggcttatattaaaatctgaatggaggggatacttgtacacagtttaaaaaccgtatatatgcggcttatgttattgggaagac

SEQ ID NO: 69066 - DNA, 125 bp, Triticum aestivum
  unsure (1)..(125): unsure at all n locations
  Clone ID: PAT_TA_69066
gaagcctgaagatgaacgcggcagngactggntattnctctngatncttcacgaccacgacacctaactgctgagcgatgaggaggaagcagntagcggcgtcctgtggtcagccgaggaagacg

SEQ ID NO: 69067 - DNA, 202 bp, Triticum aestivum
  unsure (1)..(202): unsure at all n locations
  Clone ID: PAT_TA_69067
cctggtatacacagnattgcaggtatnggaataggaacttcagtacatgccaggaaancccagctcaccggtaaaatagcgcgatatagcctaatctaacttgntnngctagtattttacatattcactantccctagttacgccgatntgtttataactttgcacattaaggnctcaagcagnactgcaggaacaccaacc

SEQ ID NO: 69068 - DNA, 214 bp, Triticum aestivum
  Clone ID: PAT_TA_69068
gttttttcgtgcacatacaagccaacaaaaaagcgccgccgtgtgatcaccaccggcggctagtatacaacggaggcagcagcagcagcagcaagttttcaaatccctttttacaattaggtttcccgaccgatcggatgcagcagcagcagcacacgcccttactttttacgtactacccataggcaaaaacacataggatttctcccctccc

SEQ ID NO: 69069 - DNA, 591 bp, Triticum aestivum
  unsure (1)..(591): unsure at all n locations
  Clone ID: PAT_TA_69069
ataaaaatgttcttgttttcncacacattcatctgtagcctccttggttttttcccccttccttttgttctatatactagtacgtactacagaaaaaggaagaaaaagagccacaaatcaaatcttctcgagtctatttattattagtagctacctcacattcggtgtcactaagaaccctctctctaaatatacatttttacacgtacaatactgcttgtgcaataaaaaatgcatccacctagcgatttgaaatatacacttgaatcaacataaataaattttttcctcgcatgaattatatcttgaactgaattcacgtgttccatcccaacaggcacctcgctccctcgcccatctctaaactattagtgtaggctccaactgaactatgagctcatgtaggccaaacaaaagggcatgagacctgaaaatagaacaatacttggctaggtgaagcattcaaaagaagagacaatttggagtgacttgcagtgttcagaaatatatatcattagattggctataaggttctagttgagcttcatatactatgagaatgcatagatgcgaaaatacaattcttttaga

SEQ ID NO: 69070 - DNA, 622 bp, Triticum aestivum
  Clone ID: PAT_TA_69070
taaaaacaacgggtatgtaatatttcaaggtgaatcctgatcaaccgatgtctcaacgatgcgtggattgtgctggtacacatacttcttggcccagtacaggtagttgcataagccaagcaatcccacaacagccacagcccagtagaacaggtcaagatggctgttgttcaagcttgtaccctcgagccagcctctctggtgcccatgccttgtggccttgttcacaatttccaccagcgttgtggccagcaaggacgcgagccccagagcacaccagaacaacgctgtggcaatagacttcatgccgcgtggtgcctcgctgttgaagaactcaaggagcccggtgaatgatgtcacatcaatgcgttgcaaatgagtgacaccaccaacatagcctgtacgtctacgcaagaatggcacaaggaaccagccttgtgttcgtcatggtgccttgctgcacagtgaatgtgaagaggataacgttcgatatatatccgattatggagctgacgaagagaggaagcacacggaggatgatctttatctcctccacctttctcagactacaaactgaccaggctccactttggccactgttgatgcaagctttgtcgaggaa

SEQ ID NO: 69071 - DNA, 598 bp, Triticum aestivum
  unsure (1)..(598): unsure at all n locations
  Clone ID: PAT_TA_69071
ctgaacagntaaaatatacccagtacgaacaatgcccttaacaaaactcagccaatactaaaaactgcttggtgtctgaaacagtgatttggatatcaattgtggaattacttcttcttgatggcagccttggtcaccttggccccggttgggtccttcttctcaacgcccttgatgacaccaacagccacagtctgcctcatgtcacggacagcaaaacgaccaagaggagggtaagtggcaaaggtctccacaaccatgggcttggtgggaatcatcttcactatgccagcatcaccattcttgaggaacttgggcagggcctccagctccttaccagaccgcctgtcgatcttggtcaccagctcagcaaacttgacagcaatgtgtgaggtgtggcagtccagcactggggcgtagccgttgccaacgttgtcaccaggaagcgcctccaggagagactcatggtgcatctcaacggacttgacctcagttgtcagaccagtgggaccaaaggtaacaaccataccaggcttgatgacaccagtctcaacacggccaacaggcacagttccaatgccaccaatcttgtaaacat

SEQ ID NO: 69072 - DNA, 207 bp, Triticum aestivum
  unsure (1)..(207): unsure at all n locations
  Clone ID: PAT_TA_69072
ggttnctnaggacngggtccggnttnaacttntnatatggcaatttaccgtgcntgctancatggaattnctngtagtnnaaatngtancccataagcttnagaccggacattgtanttncttattccctgtacaaatttangcacatnttggggaccaagctntnctcaatntgaancttgttcancatgtantctgcgattcgta

SEQ ID NO: 69073 - DNA, 184 bp, Triticum aestivum
  unsure (1)..(184): unsure at all n locations
  Clone ID: PAT_TA_69073
cttcaaaatctttctttctattttgaaagaaaaaatttgaacaattgnangatctgatggcatcaataaactancaacctacaaaaaaacttaaaagaaagggcggaaaaaaaganggaacggttttaaaatncnctgcattcaccatttntggccggctaacaaatgatctcaaagccatgca

SEQ ID NO: 69074 - DNA, 308 bp, Triticum aestivum
  unsure (1)..(308): unsure at all n locations
  Clone ID: PAT_TA_69074
aaaaaaanaaaaaaaanaaanaantnaaaaaannnaaagaaacatggacatacacatattcttatnttaggancaancaagaaagatcaatgganaaggaanacccaaagcaatgnnagagttgacaaaaccgcattggcactttatatgtggcccgtggngagtgagctgtttangccttgccggactcctcgcagcccggtggcttgaaggcgatgaagctgacgcactgnacctggngcatgttgtctaatncgatgatgcggacatacgcgtnanggtactccttnttgacctcctccacctgg

SEQ ID NO: 69075 - DNA, 128 bp, Triticum aestivum
  unsure (1)..(128): unsure at all n locations
  Clone ID: PAT_TA_69075
gccgttctgcacgtagtagcagttggactgctccgtgaaggtgnccatcccatggggcnccttgangttgttgntgctgtacaccacctngatgttcttgaagtanctcnccttgccgaacccctact

SEQ ID NO: 69076 - DNA, 293 bp, Triticum aestivum
  unsure (1)..(293): unsure at all n locations
  Clone ID: PAT_TA_69076
acggngatgttgaaaccctgcttccttntaaagagaanganttnaattatncaanatncaaccaccancggnannancangaatgattanactncttnatncccacctntnaagcanaggccttgtcaaacttgangggcttnacaacctnccangtgaagtcagcatnctcacngncaaagtggncatanncggncgtcttgatgaacctgttgncacccttcttnaagtnaaggttgatgctgatcatnccangcctgaantcaaagttntncttnacaatnttgangatc

SEQ ID NO: 69077 - DNA, 205 bp, Triticum aestivum
  unsure (1)..(205): unsure at all n locations
  Clone ID: PAT_TA_69077
ttgaatgagtaattgataattaaactttatttgattctgttaagcngtgaacttaacatgtatgtaaacagtcatctggatggcaattgtaaagtctgaaatgtttatactagttgttttacagagtaagtaggcaagtgagatgtcgatggagtaaacgctgtagactgtaaatatggaggtcgtacattttcctgcttcactg

SEQ ID NO: 69078 - DNA, 676 bp, Triticum aestivum
  unsure (1)..(676): unsure at all n locations
  Clone ID: PAT_TA_69078
cacacttatatntcctgcattgcccacaaggttaaaggttttgttaccgcacatcaacctaaggcatggcacgccacgatccacatatggttccatataagttcataataatacggcatgcatcatattagacagtactctaagcaatagctagcaaaccacaaaccaccaccagcttcaaagttcatgccggcaaagccaactgctagttgtcagaggcagactggccttgaagaagaccatcgcggatctgcgtggcgatgtcgcgcaccgcacgcttgatctggacaatcttctcagcctccgccttctcgtttgcagccaccctcatccttgcagctgcattgatctcattcatcgcctgcttgacatgcgcatccggctcgatgtcgacaatgagggtctgcacgatctcaaagccatatgcggacatagccttctcaagttcatcctccacagcctttgctatatcgttcttctgcacgaaagcatcatccaggttgagctttggaacacttgccctgatcacatcaaagacataggcttgaatctgggatcttgtgttggtcagtttgtagtatgcgtcactttctttgccagccagangtcggtactgaatcgatgcaacaacagtgacaaacacattgtcctttgtcttggtttcacagcgcacatc

SEQ ID NO: 69079 - DNA, 178 bp, Triticum aestivum
  unsure (1)..(178): unsure at all n locations
  Clone ID: PAT_TA_69079
cattcagcatttgggcatgtnagacggnggnggnggnagcttntggctcggnttgctgncgtnctgcacctgccacgccattctnagacccnatgttgngtgcacctncaaatggnaatgcatgaaccatacacctgggttgtntgngangaagcgaatggncacccacccgncggnc

SEQ ID NO: 69080 - DNA, 736 bp, Triticum aestivum
  Clone ID: PAT_TA_69080
ttacattttattacgacacctggtaaaaggaaacaataaggaaatgtatgctaacaaaaaaagtacattcagcatagcatcctagcatttctgcaacctctctgttgagaatgtgtggaaggcaactcaccttattctcctatattttgagagcaaactaccctacatgaaacaaaaaagaaacatgaattctatttggtggctagaaaggaacgacctgttttccttttgaaaatatacacatatgcgccacataaaggcccatttttcattcctcgtgatgaaaagtgtgataatattcctgcaacatcagccttccaaattatgctgaaataggctggtttccccatttcatcattgctgtttacctgatgctatatgcggctatgctcaatagagccccagcgtcctcagctccgtaacatggctaggatcaaggtctgccactggatcagctccttcaagatcctctacgatatactccttggttaactcttgctttgcaagaacatggtagtgccgttcagtgatcctctgtccacatataatagctatgaagaatccatatagcaaaccaaccaaaataacagccagtattgccaatgcataaaaagcataaggatgctgttcatagccaaacatttctcgcagctcatctccataaaatctgtataccagcatacccaataaaacaacaaccagttgtacagtgaaaaagatcaatgtgtgatctcta

SEQ ID NO: 69081 - DNA, 331 bp, Triticum aestivum
  unsure (1)..(331): unsure at all n locations
  Clone ID: PAT_TA_69081
accctcccgntgnatgcgcctnttnatgccccattgcaccgngctagttgtnggagctntngncgtnactgccaatggaactgcagcanccangctgcggtacttcanggcgtanaacatntnaaggtacggcgagtntnangcctntncaagttgctcacatacttncanaacccatacacnccggtcagggtcatnancctntcngagtacannttncangtgtcttntnataaattntnttcangcctncttcanacattttgtcccantancttggatcctnnctgcacttntcaaanaanttgaccaanatatntgcngncttgtc

SEQ ID NO: 69082 - DNA, 699 bp, Triticum aestivum
  Clone ID: PAT_TA_69082
tgtacccctttgtatttattccgttgtataaggggtttcctgcatatgttccacacctgtacatgtatatatatcggcctatggcctcatgggaatacaagttgcatatttcctaacatggtattagagctaggtcaattttttgcacgccgcaactcgtgctgttgatccttcgtggccgccgccgctgcttctctctgtcgtaacgccggttctccatgtccgctcctctctgctgtcggtccacccaaggccggctccttccccgtccgtcccgcctctctgtatcgctcgcaccgcatcctttggatcgagctggctggctgtctctctggatcaagccggtcatctctctggatcagatctccattgggctgctactcttcaaacgacttgacaccgcccgccgcccctcgttggacctccctgccagctgccggtctccgccttctgcagctccttgccgctggatctcgccgccagactgctctcctcgcaggattctgccggagcgcccgttgccaactgacggtccctgcctgctgctgcctttctcctcgtccggcggttgtcgtctgctgcggaagcccctgttactcacgcgtgactgctggtgcaatcgaaagaagaagaagcagcacgattttgcttgtctccgtcggatctggaccagatacctgtatcatgggatccatgaga

SEQ ID NO: 69083 - DNA, 599 bp, Triticum aestivum
  unsure (1)..(599): unsure at all n locations
  Clone ID: PAT_TA_69083
gatgaacaacaatggtgacataatcatatggcgtcacaagtatataatgtgccaaagtggctggggtttatttactactagtaggcgggcgtagaacatgacacatcacaacatcacagaagatcgagagagctcctgaagatcacccagtagtcagctgctgtaagttcctgacgatgagagggagcccgtacctgggcagcagggtgacgaaattgctgggcttgtgcacgtaagtgggtgacagggagaaggagaagctcctgaggatggtggctatcacgatctgcacctcaaccatggcaaagttctgcccggcgcagaccctcggcccatatgagaaggccagcagcgagcgtgaaagcttggtgtccaccgagacgccattttggaacctcatcgggttaaactcgtcggcgtcgggtccccacacctctttgtcccggtgcaacatcagcagcgggattgacatgatcgttccttttggcacctcgatgttggcgaggatggtgcccgangaggtcttcctctgtatgaaagttatggggcaatatagcctcagcgtctccaagagtaacatgttaagcagcttgagtttg

SEQ ID NO: 69084 - DNA, 590 bp, Triticum aestivum
  unsure (1)..(590): unsure at all n locations
  Clone ID: PAT_TA_69084
tctagtgaatatgttgagtgcctgaatacatggtacctcaagnactggctagaacctgaatatgtaggactaagacaagtaggcgtgagagaggagcagcctgtaggcaaagggaacatgcctagctgctcagtgcccccctcttcttcacttgcatcggcaagccgccctccatacgcaaggtcacggagaacacaacccctggccggctctcgcctccgatgaactggaagctgaacctctccaacacgcaggcagcaatggacttcatctgtatgtaagccatctctttgccgaggcacatcctcggcccggcatggaagaccgggtacttaaacgagctctctggccggaacgcaccctcctcatcgagccatcgctctggccggtactctgcacagtcctcgccccatatctcctccaaccgcgccatggcatacgcgctgtaggagacctgccaacctttaccgacgaacgtgccatcgggcaggacgtcgtcatgcttgcagcagcgcgagtccatggccacgggtgggtatagacgcatggactccgtgaccgctgcgtgcaggtagtgcatctcgcgcagc

SEQ ID NO: 69085 - DNA, 721 bp, Triticum aestivum
  unsure (1)..(721): unsure at all n locations
  Clone ID: PAT_TA_69085
aaacaatnntctctcataatatctcaataacatattgtcataaaataccatatttaaacagagccgaagaacaattctaagcagcaaaataaactaagtatctgaacaaataataagtctaagcagataattaaacatgcagcccaaaatgagaattaagccactccatgtccgatcaacaccactctgattggatcccttttattgtcacgctttttgtacagcagtatagaccttcttcaattttccctcccagtccaaccaaatcttctttgaatgaaggatctctttggaatgtttgtcgcacatatcttcaatgggcttgatcatatgttccacatggattgcatatttcagatcaccagatgtagctactgagcatactatcccaatcatcttagaatcgtaaccaataaccggggctcctagaacgcggctagactgatgcccttcttcatcatcaatgttatcaagtgtaagcatgtgatccatatacatgcaggacaacttgaaataccgtttactctcagaaacaacactattttgaagagtagacgcagtgcaattaggtgtagtgatatgaccctcataaattccaagactcccaaacggctcatttagcagtacggttgagtctggatgtaatttcgtcgcggccattgtagcaatggcatagacaacatcatattggtacttctgttccttggcaaattcacccaaa

SEQ ID NO: 69086 - DNA, 158 bp, Triticum aestivum
  unsure (1)..(158): unsure at all n locations
  Clone ID: PAT_TA_69086
aggaatgacattcacgtnntgaagatttttagtggccagntttaacttnttatnaatgtcnnctncatncaccaacaaaaccttnttcgtatngnncatctgcttgatgtactgnacgatgtttttngtnttgtggntggggacttntangtcctcna

SEQ ID NO: 69087 - DNA, 714 bp, Triticum aestivum
  unsure (1)..(714): unsure at all n locations
  Clone ID: PAT_TA_69087
agaggcaatgacattattgtgctcnatcgcagcttcaattaggtctattgagtaatcaggtgcagtgttggagcataacggagaatcaagaccggacagatcaggaggccctgataatattgtcttaatttcaggtgcagttaggtctgtcttgatctcagcttcagcaagatttgtcttgatctcagcttcagttaggtctgttggctgatcaggagcagggctggagcttgactgagaattcagaacaaacgagataggtttatgatcaggaggcggcgacattactgtcttaaccccagttcacatataatttcctctatactaggccttttgtttcgatcggcttccaagcatctaaatgctatctcaacacatgcctgcacttgtaggatatccatctcgtatgatgaatgctccgacaatttctccaaccttttcttccagttttcacttacatattcaataaactggttgggagacatttcagaataacggtaaggacccccatgtccgtccatcattcttataataatgctgcccaaactgaacacgtcaaacttgtttgatatgatgccgctgtctatgtattctggtggcatgtactcaagtgttcctcttctcatcgctatcgggtccattccttctgttgaatcaacagacaaatcaaaacctgaaatcttgggagtcatgtttttacccagcaatatattc

SEQ ID NO: 69088 - DNA, 131 bp, Triticum aestivum
  Clone ID: PAT_TA_69088
ggcaggaagcatgctcctctttctcaaacaaacttctcgtctgtgtacaaaacagtagcattgggtggacttgcttactgcatggttagaaggcattgtactaagcatgttttctactcccggcgtaaaga

SEQ ID NO: 69089 - DNA, 701 bp, Triticum aestivum
  unsure (1)..(701): unsure at all n locations
  Clone ID: PAT_TA_69089
aatgtgcagcacaaagncacataatttagcctgcagagaatgtacaacaattgagcttagtgagaaaagatctctatcaaagcaataacaacacgatgataaataaataaaatattaaaattaatctgccactaccacctctcctttccctagtagtgaagatgcagagtatagccagccatcacctccatggtccagattatttatgccccctggcgccactttctcttcactttccaattattctgattcttaaactggtaaagaatcgttcctttgttccaagaagcacgatggcaacaggtgaagatatgataaatgaggctatagggcctcgataaatgacagttcgcaatacgtccatccgctgcctgtaaccatgtgtcactattgaggtggcgttctgccaaatacagttccgtgggatgaacagttacaatggagtcacccacaatgttaggcagaaccttagagctgacactcagaatcctttcatcaataaacagaacattgtctccaatactagttaccgggacagcccgttaaggataaggtcagacagtctgtaaaccaaagggtgcgtaaaaaatccgtcgctatacccaatcaccaggacctctgagtcacattctgccaggtattgaggggcaggcattttgccagcccagcatgtagcaatcaacttctttgatggcatcgaa

SEQ ID NO: 69090 - DNA, 683 bp, Triticum aestivum
  Clone ID: PAT_TA_69090
caccgtggtgaggtatactccgtcgaacagatccgttattacaacgccaggtaaaccgcagtacagctaaaattcgtaagatttttatccgtgatactttcactcttcctagctaaacaaacctacaaggatcgagggaggcactctatgcaagggtgggtggtatccagatgtaaccgtgggtctgcatgtacccaaccttctcactcagttcatgcttccttggggcctcggctgccaggcttgtatgaaacagccttcagcttgccagcgtcgatgtcgtgcaacaagggagtgaagatctgccaggcagccttcagctcatctcggcgcacaaagtgttgctggtctcctcttattgtatccaaaatgaggcgctcgtatgcacggatgcgccctctcaacccatcatcagaaagatttgttctcgcataccccactatatgcacttcaccagattgtaagaacccctgctcaaaaaggtggtagagtgccgggaacgttttcttcttggcaagatctccagaagccccaagtacaacgatggtgaggcacccttgctccaaaggaagttctaggtcctttgctaatgagttgaaactgctttgtctcgatgacgccgagggagtcagttcccgccatgacaaataggatgatttttccttccttcaacagtacaccag

SEQ ID NO: 69091 - DNA, 744 bp, Triticum aestivum
  unsure (1)..(744): unsure at all n locations
  Clone ID: PAT_TA_69091
tgtaatacataagggaaagagatacatagttggcttacaatcgccacttcaatnaagtgcataaataacattacatcatccaaacactcatggcccgactacggagccaaaataaaagataacccaacatgtgacacggtcccgatcacccccaactgggcaccactactgatcatcaggaaaagaagcatagtatcattgagagtcctcgtcgaaatcccacttgaactcaagcgcgtcgcctggagcggaatcatcaggccctgcatctgaaatcccgcaaggaagaagaacgcgtccatgaagaagacaaacggacgtagacgaacggttcctcacaaacacaacgttaccggaaccaacccgaagaaacaacaccggaaaagagcaaacaacatagtaaacaaccacgacatgaacatggcatgatgcacaatcaagtatgatgcatgtccggtttaatgaagcatggcatggcaaagtgcacaagcaaccctacaaattaagtggagcgcaatatgcaacgagttgcatattgacgaaacaccatgacaagttatttagttcgatctcgttatgtacccaacaatattaaatgttcttaacatggcaagagagtgaagcaaagcaaaactacctatctagtcaagtttaaatgaggccggaagcaacgaacaacaattccggaaaaatcctcatgtgcatattttggtttggtgctgatatgtcctaaacacaatttta

SEQ ID NO: 69092 - DNA, 711 bp, Triticum aestivum
  Clone ID: PAT_TA_69092
agacaaattcatacaagccgtgctagcagtctgaagacgtagctccacatgaattcaagagttttggttcctagcagaacataaggattagaaggtcctgcttgctctagtttagtgaaaactggcacatgttgcatccccggaatccgtgcactgctcacattcgccaggagggttcttcatgagctccctagccttctgtagttcaccctcgatttcggcattcccaggatctaaattgtgtgcgtccaggagagcatcacgggcttgttcatactccttgagtagcatgtgagctgcagcttgacggtagcaagcttttgcccaatcaggtcgcagcattcgcacatgagagcatctgacaaagcaccttcaccatcaccaatgagcagtttacaaacactcctgtttgcatacagtgttgcactctccccatgagctattgccaaatcataaatctttgttgctatcttatactccttctgcttgaatgccgtatcagcctttgacttgatcaaagcttttcttctttgaaggtgccgttgctcatcatcaggaatattaggatctggtccagcctttaataggagcttaatgaagttggtataacctccatgcatcgtagcaagcaacaaaggagtcaacatggaaccattgcaattgacatcagcaccagccttaatgagtagcttcatgcacttcaatgaacgg

SEQ ID NO: 69093 - DNA, 689 bp, Triticum aestivum
  unsure (1)..(689): unsure at all n locations
  Clone ID: PAT_TA_69093
ttacgggatcgtatcgggcngttcggggcagtatccgagtatcggggcagtatccggctggatacgcgcactttctgaagtatccgtgcaacataggctgccagtaccggcccaaacactaatacaagagccttaaatcacaaagagtgaataagtaatcaacataggaaaggttacagataataatttttcattatcangagaggttcattgccacttaattcttcctagttgctactcaatagttgacattacggacttcaaagcttattgcttgtatggcagaaatgtcatcagaggatcctatgatttgaaacttatcttctctgagctacaatgcaagtttaaaacatgttatcatcagattttgctactaaaatcaagaaaccaatatgtatgactcacataatgtgaacgacattttagcaattttatgcatttgaaaagatgtagctacttgtgcaacaataacaaaatctgcttagcaagaatattttcatcctatacttcaacaatttagattgtataataattggaagtacgaaaccttagcttttcacttaaaagagtagcttatcaagaatatgttcatcatgcagttcatgaaattcattaggaggcagtgcccattaatttgttgagagctctatccaatcttgtgatgtacaagtggaaattttgtttttgag

SEQ ID NO: 69094 - DNA, 687 bp, Triticum aestivum
  unsure (1)..(687): unsure at all n locations
  Clone ID: PAT_TA_69094
cgtgtttntttgttctttacaagtgttagatacaatttccttccataagaattttcaagctcggttaaaacgtattttcaagcatacaaaccacaactaaacaacacgaatgtaaatatatacgaccgagcatacttcctaaagaaaggcaagaaacggactggtaataggtaggcctgtttttgagagattgtggtaaactacagttcattattacaagcaaaatgtttttgcttcggagatggagtgtgatgccttgctcctattcatggctcttgacctgctcatggagctgtgtctgaacctccatttgcatatgtagagcttctgccaagttccttcttaatgtccgaggagtccttcttgtcacatacaatatgcatcaaaattcagtataaaaaggactgctcatgagtagaaagatcattgtcacaatttggaatgacacatgttctagtaggaatcctataactgttcatggagctgtgtctgaacctccatttgcatatgtagagcttctgccaagttctacctaattgtaccttcttaatgtccgaggaggccttcttttctagttcgccgccagcttgcatcgctcgagccgcctgcaacaggcacatgttgcctccttatactctagatccgcgaggcagcatgggaggagggatgagctnctggttcctcaag

SEQ ID NO: 69095 - DNA, 542 bp, Triticum aestivum
  unsure (1)..(542): unsure at all n locations
  Clone ID: PAT_TA_69095
cgccgccggcctccccgctttcttcggctgccagcgtgaaggcgcgcgcctcgcccgtcgcggctcctctccggtggttgccagcgttccccgccctcccgcagcagctatagagttcctgccccagcctcctctctctctgaatcgatccaagnaccaccggtcagtgaccggcacggacaccgactccagactccagattcgaagcgctctagaccggccgccggccgccggcctccactgccccggcaaggttgacacggttaggtgcagctccaagaacacgtttcttgtagcgtcaggtgatggcaaacagcgagtatgagtatgtgaagagggagttcgagttcgaccgccgcctcccggcctccaactggatcgttgtccgcatcgatggctgccatttccaccgattctcgaagatacatgcctttgagaaaccaaatgatgagaatgctttaagattgatgaatgcttgtgccacctctatgcttgagaagttccctgatatagtgtttgcttatggtgttagcgatgagtac

SEQ ID NO: 69096 - DNA, 557 bp, Triticum aestivum
  unsure (1)..(557): unsure at all n locations
  Clone ID: PAT_TA_69096
ccatgnctcctcttgccaacgatgaccgcgcccgtgnaaccagggctgccgctcgagctcctcctgggtccaggtcatgctatgttttagtgctcatggagttcctctggcatacgttggttctggtgatccgtataaaacatagatggaagactatggatcttatcatggatgagctcaaagatacaggaatctcaaatccataaactgaacagggacaagcacatgaaattatatgttgtggtagatttcaaaagagacccagggcccagagtagttttgcaaaaatggaggataccagactgacccatggagcatgagatcctccttgtcaggggccaccttacttgtatggcttcaggctgaggagacccttctaattaagaagatttgtgctgctgctattgcgttcttcagtttctggtcattggttcatctgcaaatgtgtggacctcactcccttttgctcgattgctccaccttgctcctttggctgattataatagctatttccgcagcccatgacgatggttgagagatccaggcagcgtccagat

SEQ ID NO: 69097 - DNA, 663 bp, Triticum aestivum
  unsure (1)..(663): unsure at all n locations
  Clone ID: PAT_TA_69097
ggcttcttcaagttaccaggctaangccgctctggccaaggccttggtgaccttctacccgttggccggccgcatcggcgatgacggtgatggccgggcggaggtcaactgcggcaatcaaggtgtgctctttgttgttgctcgatcggaggacctcaccgttgctgactttcacggccgaccatcgtccaagctaaggaggctctttgttccccgcatggagccgccaagcatcgtctgcggcgtccaactcaccttcttcaagtgtggcggggtggccatcggactggcggtgcatcacttcgtcgtcgacggaagcagcacttcccacttcacccggacgtgggctgccatttccaggaccggtgacatgtccgccgtggaggcggagcccccttgccacgatcgcttcctcctccgtccccgctccccgccggcggtccaccccgatgctctctctgtgttctgcccaatggtgaacttgtgcgagtcctcgggggttcctctcaggtccgaggccttcctcgtctccaaggaccagctcgaggctcttaagcaggcatgcggtggcagagccgtcagcaccttctgtgccctgaccgcccatatctggaaatgcgtgtccgccactcggcccatgccgccggacgccaccacacgcct

SEQ ID NO: 69098 - DNA, 590 bp, Triticum aestivum
  Clone ID: PAT_TA_69098
tcctgtgggctcaacgggtttttaatcaatcaaattccgttatccccctccctctcgcgtaatataagtaggagtatctctcttcgtcccggcacaaggctgcgagatcttgctacaagattcctccccgcgcaagcacgagcgcagaccggagcgagcaagtggtcgccgagatttgtagggtctgggaggaggaatgtggaccggttgtttatgctaggcgcgggcgttggacacaagatcctgcctgcgtgattctttctctccttctcggtttaccggtgctgtggcgggggaagggaaatttattgcggaagatctcaacccgccgggatcaagaaggacggacaggcggattaagaaatagacagcggcaggggaggaggaggtggggctgtgtcagctttgtgctttgtgggtgtccgcccctccccgccattgtttactccccctgaggcgcttgtgctcctcgccgcccgcaacaccgccccgcataagtagggtggagtgtgcctccctcaaggaccgatcctgccgctgccgctattgtttccgttgtacgggcgccgggccgggcacgttgccatatt

SEQ ID NO: 69099 - DNA, 364 bp, Triticum aestivum
  unsure (1)..(364): unsure at all n locations
  Clone ID: PAT_TA_69099
acctgctgnngangccgtaccttctctccgctcccatcgacaccccggccggcctcctcccagcgccgccgccgccggcttccctccataacattcctcccgccgcagcctcgtctgccaagcgtgggtgccgccctccctttgtctctccttgcccccattgaccgacgctgggtaaattcttcgcttcttatccgcagcgaggggacagggtgtgcagcagggcaatgcagcagcggcaggagtgggtgggggactgggtccggagcaacgacacgcttgtccgcgccctccccatcctcgtcggcggcgcgtcactcctcgccgtcctcctcaaccgtgccgtttccggcatcgccgccgt

SEQ ID NO: 69100 - DNA, 571 bp, Triticum aestivum
  unsure (1)..(571): unsure at all n locations
  Clone ID: PAT_TA_69100
tcctgtcacccgcgtctcctcaccagnaatttgcattcttaaaaagtctcagtggaaaggtcagaagcgatataaagttgattttccggtttctccgtgaagaccttgttgagcctacgacaaagagaacatatggagaacttctgaaagacctgaaagctatcaaggcctttgcatcggggattcttgttcccaagcaatttatttggccacagaacaaggatatgtacttggagccgtctaccagtttggtcaaagatgcacatgccctagggctggaagtgtacgcatctggatttgccaatgatgatccctgtatgagttacaactacagctatgatcccagcgcggaaatcttgcagtacatagataattcagacttctcggtcgacggcgttttaacagacaatccacctaccgcatcaggagccataggaacgtacccgtacaatttagctcttcgtttttgattccttgacaacatcttcatgaggatcctttaattgcagtgtgcatggcacataccaagggcaatgcatttgtttttcctattgctaaagctggagctcct

SEQ ID NO: 69101 - DNA, 550 bp, Triticum aestivum
  Clone ID: PAT_TA_69101
tctcctctcctcccgtacgatccccaccaggctcctcatacacatccgccatttcttccgatttgccgccggcgaaggacggcgtctttgtgccccatcagggaaactaatcctcacgctatcccagatccacatgtcgcttcttttctcctgatttttcttccttggtggtggcacatgtggctgggtgagtgtgtggatctcggcgaactcgtcgactctggcaacgcggtcatggagatgtccagtgggaacgcgggctgcgctgctcaaacttgtcgtgcccggaggctctagatgttggggccgcggaggcattgagggagctcacagaggaagaaatatctgcaagacgtgagtatcttctgtgagtgttgttgccctcctgctgcccggacttctaccaaatcacaaagggccactttgagtcgcttggtgacataatgattataggagcatcacctgcaaacctaccttcaattttagctcgtggactggaattcctgggaagatcatgttgctaaggagctctgttgcacacatattctcc

SEQ ID NO: 69102 - DNA, 555 bp, Triticum aestivum
  unsure (1)..(555): unsure at all n locations
  Clone ID: PAT_TA_69102
ctgcctcatggntcctcgccgccgcctgctactcctactccaccactgctgctgcttctccaccacgctgcccttccacctcgcgttccttctatccgttgtatatgttgccgtcggcggcgcctggttccagatcgggcgcaggttagcagagtccggtgttgaggtgaaggagcatgggagagggggcgatgaggacaagcaactttcggccgttgccatggctgaggctacaggaaagaggtaggaagccggagggtgaaggagcaggccggccctcatggagacgccgccgccagccgtgggccattcgccgtcactggcctcacgcctcgtctcctctctcttcaccaccacatccatgttgttttttggagaatggtgctccgatctggtccctatgtgctaatggtttcctgctaggcaacttcaggcctgcaacatttacaggggaggattgcaggtgtcgatacgatggagcaatttctggttttgtggttggagcatagcctcattttcgcaagagtttggggtacagttagtatgaaataggat

SEQ ID NO: 69103 - DNA, 327 bp, Triticum aestivum
  Clone ID: PAT_TA_69103
gctctgctctgctcaccaatcgaacccaccaaaataggtttccaagcggagcttctcaccaccggcggcgggatgggcggcggcgcggcggaccagggcaagaccagagaggaccctcgcgtagatccgggcatcctcgaccaacgtcgccattcgtctccccgtctgctgccgtcgcgacatggcttccaagaaatggcctcgctgccgatccccgacgagctcgtggcggagatcttcctccggctgcccacgccagccgacgtcatccgcgcctctggcgcctgcgtatccttccgtcgcctcgtcgccggccgccccttcctc

SEQ ID NO: 69104 - DNA, 305 bp, Triticum aestivum
  unsure (1)..(305): unsure at all n locations
  Clone ID: PAT_TA_69104
cgaggctcatcgggatcctccccgatccacccacctcctctcccttgaattcctcatcgggcaaancccagcctttcccgagcgcagccgcgcccgaggccccaagcaactccaacctcgcaaccctgccgccccggcgacctcgccgccggcgactgacccgcatggtccaggcctcttcccctgccctgntccctccttccctttctagctccctcctttctctcatggccgtcgcttgctgtgtctctttttcacaccaccagaggccatggacgtcgccgccccttgggaagtcgctgccg

SEQ ID NO: 69105 - DNA, 115 bp, Triticum aestivum
  unsure (1)..(115): unsure at all n locations
  Clone ID: PAT_TA_69105
tcggcacgaggattatagcatgttttgtttcaatncgatcaaaacttggatgatcatatgctcaaatagttactcagatgacctgcctggtgcggtaatgccttcaaaaaaaaaa

SEQ ID NO: 69106 - DNA, 362 bp, Triticum aestivum
  Clone ID: PAT_TA_69106
ggcaaggcgaggcgcggctaccgccggcgtgtgtatccaaggtgctcgacgacgaagacctcctgtcggagatcatcgtccgcgtcggcttccccaccagcctcgtccgtgccgccgccgtctgcaggcgctggctcagccacgcctccgacggcgccttcctccgccgtttccgcgagctccacccgcccagactcctcggcttctacatcgcagaaagggactatccggcctccgaacgcttcttccccatgctgcacctgcccccggagctcgccgccgtcgtccgccgcgcaagcttcaggccggacgcctacgacggcgcgcatgcccatgtggtgggctgctccaacggcagcgtc

SEQ ID NO: 69107 - DNA, 455 bp, Triticum aestivum
  Clone ID: PAT_TA_69107
ggggattttagcctccagcgccgccgccgccgcccagcgaattcgacaagcccccgagctcgccggatccgatggccgtcacgttctccgacctccacaccgccgacgggctcaaggccctcgaggcgcacctcgccggcaagacctacatctccggcgatgggatcaccaaggacgacgtcaaggtgttcgcggcggtgcccgtgaagcccagcgccgagttcctgaacgctgcccgctggtacgacgccgtcgccgcggccgtttcttcaaggttccctggccaggcctctggggtgagtgcatcctcggctcctgctgcagctgctcctgctgcttccaaggatgaagatgatgacgatgacatggatctgttcggcgatgagaccgaggaggacaagaaagcagcagctgagcgtgaggctgccaagcctgcaaagaagaaagaaagtggc

SEQ ID NO: 69108 - DNA, 324 bp, Triticum aestivum
  unsure (1)..(324): unsure at all n locations
  Clone ID: PAT_TA_69108
gnctgcaggnaattcggcacgaggactcggtgactccacacattcttaactatggccgagtagatcaagctacaaagtctttgaagtttcctttgtcgagaccttgtgaagcaggggcccaatgtttcctcagttatgggaaacatccagggtcacatctaattaccttctatggtttcctaccaagagaagacaacccttacgatgttatacctttggatcttgatacgtctgttcacgaggaggatggaaccgcccagtctgtgagtacaagtgtaaccactcatatggttcgtgggggacatggttgtgcagatcacgagg

SEQ ID NO: 69109 - DNA, 509 bp, Triticum aestivum
  unsure (1)..(509): unsure at all n locations
  Clone ID: PAT_TA_69109
atagtattgtggcacaaggcctactttttggttgaagtgtgagaaatacacgatgaataagagttgcagtaaactgagcagatcatattggattgcatggttatctaagggccttaaactcacaaagctatggattacttttattatggctgttcgatcaaaaacttttattctggctgtaatggactgatggtcaaatttgtgaagctgctggaacaccttggatgtacatctggtgttgccttacatacaacaaggctatttatgatgtattagcagttggactggtgctatttttgggcggncaaccttgttctcatttgctgacttggtaggagctggatatgatactttctagcatctgataccactgcccactggacaccacagattctttgtatgaccagagataaagtgattttgaccactagctctatcgtgcagacgataagcttttgtttgttcatgaaaacagtgtgaatgtaggttaagtgtgttcacaccaacaa

SEQ ID NO: 69110 - DNA, 360 bp, Triticum aestivum
  unsure (1)..(360): unsure at all n locations
  Clone ID: PAT_TA_69110
gcaaatctttcgatattatctctgagnaaaatgtggaatcgttggccagttccctagtactcccccaactttacccaatctgacatacctagatttgaggtcaaacaatttatcaggccaattacaactactgcttccgtataagagttcaagatacctgtaagttgttacagacttgcaatctttgtgtcatgtgggaacgtggttttaccattgccaatgctctatcctgtcagcttagaggctcagccatacagcagttaggcttatggttaagctgcagattcagtttctttagtgcattgtttaccaaatgcaagctggctataaagtctggcaatctactcccccccccccccc

SEQ ID NO: 69111 - DNA, 587 bp, Triticum aestivum
  unsure (1)..(587): unsure at all n locations
  Clone ID: PAT_TA_69111
catgtaactacncgggtgatgggaacttttgggtacatggctccagagtatgcatccagtggcaaattgactgagaaatctgatgtcttctcttttggcgttgtcctcttagagctcattactggtagaaagcctgtcgatgcatcaaatccattgggcgatgagagccttgtcgagtgggctaggccactgctcacacaagcgctcgagactggcaatgtaggggagctgctggaccccaggctggacaagaacttcaacgaggtcgaactgttccatatgatcgaagcggcagcagcctgcatccgacactcggcaccccggaggccccggatgagccaggtggtgcgggctctcgatagcctaaccgacgtcgacctgaccaacggggtgcagccagggatgagcgagatgttcaacgcgcccaacaccgcggagatcaggctgttccagcggatggcgttcgggagccaggacttcacgaccgacttcacccagtctagcagctggaacagcagcccgtcagggcggagacgtcgacgcctctggtgggccgaggcacccgcagtcgcaaccgtagtagtgta

SEQ ID NO: 69112 - DNA, 482 bp, Triticum aestivum
  Clone ID: PAT_TA_69112
gggaaggccgagttcgtgcgacgaccgagcaacaggagcaaggagcctcctctctctccctctcagtggttgaggacttcctcaagaagaaagaagaaggccaaatagaagaagaatttggctcaaaggtcttgcggaggtgcctctgaccgtctctactttcatattactttctccaccatgcacactggaattagataatatatgttttttctaaacatggcgtgtacagatctgaggtttttatttgcaggttgtgattctatatattatggtgtagtctgatattttaagatattcacaaaaggagtgtttaatatgtccacatttatataactatgtagtcaggcatatttcatctcttttcttgatcgaatgaagcaggtcttgataactttatcagctccttacatttgttcgtgtaactttggctaggcaatggaaaacttaatgtggctggagttctacgcgcattaaatcta

SEQ ID NO: 69113 - DNA, 589 bp, Triticum aestivum
  Clone ID: PAT_TA_69113
gatgctgtctcagacacagctttacgcatcgtagctagcatgaagcgagactggatgcagactgggaggaagccaagtggattatgtggtgcagcattatatattgctgcactttcacatggctataattataccaagtcaaatattgttgcggttgtgcatgtatgtgaggcaacactaactaagcgcttgatagagtttgaaaatacagattctggcagcttaacgattgaagattttttggcaaaggctgatgaagagcctgtttcaaaattttcacccatatctggagaagtcctctgcaagcacaaggataaagctgttgagcattttgctcatggactttgtgagaagtgctacaacaaatttactaaactgtcgggtggactggagggtggtgctgaccctccagctttccaacgagctgaaaaacaaagactggaagctgctaagaaggctgaggaagctgctgctaataaggaagcaatgttaggagagtcaatttgtgagatacagaattctgatgctgaacataacatcacgagcactacagaggattcagttggagataaatctgcaacaattggtt

SEQ ID NO: 69114 - DNA, 173 bp, Triticum aestivum
  unsure (1)..(173): unsure at all n locations
  Clone ID: PAT_TA_69114
aagccggcggttgaaggtgacgagcgtgcggcgganatcgcccgcatcaaggctgccgcggncgccgccaaaaaggcggcggnagaggtggtggatgtggacgntgagggtgaggacnacgaggnagatgaggaggaggaggnggttgacggcnacgacnacgacgacgacga

SEQ ID NO: 69115 - DNA, 494 bp, Triticum aestivum
  Clone ID: PAT_TA_69115
gcgtggtcgaatggtctcagcatttctttcacatcttttctctgagattgctgattacagctttactgctaacatggagacggagctagacaatgtctctgctgggtcaactgaatggaagggcctcctgacagattactgggaacgattcagcaaatactgcgcagatgctagtcaatgggatgttagaaaggtagagagaatgcttgaagagaaattccttcctatcctctttcctgaccttgacaccgatagtaggatttgccctagttgttctgaaggaaccctgagattcaaagttagtaggtacggcgaaggctattttataggctgtgatcgacatccgaaatgcaagtacatcgcccgcacattatcagatgaagatgatgaaaatgaaacctccgaggaaactccgaagtcttttgaacctcggttacttggtgtcaagcctgatacagatgaaaaggtcttcttaaaacaaggtccttatggtt

SEQ ID NO: 69116 - DNA, 363 bp, Triticum aestivum
  Clone ID: PAT_TA_69116
gttcgtgattttagaaattgtgctgcagatttaggggcgtaaggttgtgcttttgagggttcagatcggggtattgttttcatttaaatttgatgtattctcagggtttggtatatgtagtcgatttctgtgaggtttacatgccgagatttatgaaggtggagtatttgactggtagatctcactctttgcaggtgtaggttccgatctgatcctgtgactagaagtagccgggagctgcaagggcaagtcaaagatgagtgtggttcggttcagtttaggcaacaagagctgcattgtgatcatggcacggtaacttgtcgtcgacatggttctcagtgagtaatccatatgggagacccc

SEQ ID NO: 69117 - DNA, 268 bp, Triticum aestivum
  unsure (1)..(268): unsure at all n locations
  Clone ID: PAT_TA_69117
gcaggnaattcggcacgaggcatcacttgatcttcttcttcgacattttttgctcgatcttttttacttctagaagttatgatgatataccagtagcagtatgtatctataatatatgccagtgtatgtagcagtctagcagatgcgatgagatcggccgaaacaaaaaagttgtatgatatggcaggcatggcgatcaggtgtagatgacatggtgagagatgttagatgatggatggttttttcggaggcattttcaaaaaaaaaa

SEQ ID NO: 69118 - DNA, 391 bp, Triticum aestivum
  unsure (1)..(391): unsure at all n locations
  Clone ID: PAT_TA_69118
tcggcacgaggctttagcatatagacaggnatattatcgaggaaaacgtccgcctagcatatgcattgcagactgcacatcaagagaggtcaatgttcatatcctctttgctgccaattctgtctgaatatgagaacctacgaccgcctgtccccgatgctcaatccattgttggtaatttgaaggttttgtttaggcatctgcaggagcaactaatgcttaccgaggagaaagttaaggagtcacagtatcagattaacccatggcaaaatgaattgccaaataaggccagtcttcctgtacagtcacctaacaatcctcttggaaaagtatcgaacaaaggcagccttgatattgtgccccagacgccatatcctcaagtacaatctcc

SEQ ID NO: 69119 - DNA, 616 bp, Triticum aestivum
  Clone ID: PAT_TA_69119
tcggcacgaggctgtggttcactggcagaggaggggacagtcattaagatcggtggcacgttgcaaagctctcctttatcgaatgttcctctggtcacgaaaaagggtccagaatcatgccaagatgtagatcaaacggacgatatgcggaaagaggaactacggactctcactaactcagaacatgtagatccagaactcagagatggtgagctagatgaaggccgagaaactagtgctctagttttagctgatgctctaatgcaagagagtgatggcatgcacaacggcccagttgatgaaaacgctaaagacgacttggaggccttccctcccaaatctgtagcgctgcatcggttgagatggaacacaaatagaggcagcgagagatggttatgctatggaggcgccgcaggcattattcgttgtcagaggatctaagggacaagcatatataattgggccgcaaaccaggagaatccgtgggtgtccacccatctacacaataagctgttgcagcagcaatatatggtaggtttgcctgatttttgccgatttccgcagttatggctgacagagctagctgtgtatcttagcaactccaacagcagcagat

SEQ ID NO: 69120 - DNA, 426 bp, Triticum aestivum
  unsure (1)..(426): unsure at all n locations
  Clone ID: PAT_TA_69120
ttcggcacgaggctggacttgtgactcaaggnagnaagagctttttgacaagatgaccagttcatatggtataaagccccagacagagcattatacttgcatggttgatctatatgcgcgtgctggcctattagaaaaggcagaagggatgctcaatcggagctctttcattccaacccccgcgatgtgggcagcgttagttggggcttgtcatgacaggggtaacataataattggtgaaagggcagcaaggagactcttggagatgaggacagagaatgctggtcactatgttctaattgccaacatgtatgcagctgcaggttgttgggatgagctagcagaagtcaggaagctgatgcgagactcaggtgtcatgaaagcacctgggttggcatgggctgatctcggtaatgggtttacccc

SEQ ID NO: 69121 - DNA, 509 bp, Triticum aestivum
  Clone ID: PAT_TA_69121
attcggcacgaggttcatcttctcccccaaatcgcccccaaatcaactcgacctgccctccaccccaccgccgccgcccccaatctcatgtgccctcgccaccgcaaccaaccaccgcacccccgcctacgcccccagccaccccgagtccccgaccacttccttcgtcgcccccaacaccccatcacagcgtcgccgagcatacatctgacacggatctaagccgccgccgaccggccccgtcgccgagccactccaccgccgaccactgccctccgccgtccactgtcctttgccaccaccatactctgcgagcttcctcccccgagcaggacttgtcaccagagcaccgaccaagcctgcctcctctacgtcctctgccccaagcaacggagcgtccgtcccctcccgcgagcagctctgcctcctccacttccttgtcccaaaccagagcatttgataggttgcaagttgttgggtggccgcctattgggagctaccggaagaac

SEQ ID NO: 69122 - DNA, 446 bp, Triticum aestivum
  unsure (1)..(446): unsure at all n locations
  Clone ID: PAT_TA_69122
gggtggtggtggttcaaggcggggaggagacccgcaccgtacatcccgccagggcccgcaccttcgcggcccanccttctccgttcccctacttcccgcagagacgccggatctgtgagccagcggcatgtcacatgccgtcccggagctcaaccgccaaggattcgtgatttcttctgttgttgcgctcttcctcgaccccgacgagtgcacttcctcaacctagaaagagtgctgcacttcctcccctcgatgaactgcatcttcaccggtgtcgctgctcacatcagtgttactccaaaagatgaggttcagtttcttgcattctgacggccacgccgacgtgtgtgtgcgcgggtgcagcttgcaaaaaagcccccaaaatcaactcggtgctgagtgtgcggttttgatttttttcctacaaaagatgtgctctggtgaag

SEQ ID NO: 69123 - DNA, 473 bp, Triticum aestivum
  Clone ID: PAT_TA_69123
ggtggtgataccgtcgtcaactcttccccatcactggctggccatggcttccaccatggctatcgccccgtccctgccctccgacgatcaccctcctccccagaccctctgacggacgaggaggagggatgagcgtgcgttgccggccttccggcctccccttttcgtcgtcaccagcgttgcatcccttcctcccccgtcagatccggcgacgttgagcacgggttgcctccctccaacgccgttgcgacctcccccttctccaccaagaacaccccccacgatgggatctagccggtgacctcgagcttgcccagatgcggccaagatccaccgctagcgcgggcttgggctctcttccttccgatgctcgtgggcaccaggtagcccgcgcgcgcgtgctcttcttccttccggtcctcgtggtcgccacactaggccctccctcagttctccagccagcaaccgatctt

SEQ ID NO: 69124 - DNA, 818 bp, Triticum aestivum
  unsure (1)..(818): unsure at all n locations
  Clone ID: PAT_TA_69124
agggtcccccattccgattctcgccgggaaacctccgatctaagtcgaagccaaggtctctctcgtcctcctcctcaagatgcagatctttgtgaagaccctgaccggcaagaccatcaccctggaggttgagtcctcggacaccatcgacaacgtcaaggctaagatccaggacaaggagggcatccctccggatcagcagcgtctcatcttcgctggcaagcagctcgaggatggccgcacgctggctgactacaacatccagaaggagtccacactccaccttgtgctcaggctccgtggtggcatgcagatcttcgtcaagaccctgactggcaagaccatcaccctcgaggttgagtcctcggacaccatcgacaacgtcaaggctaagatccaggacaaggagggcattcccccggaccagcagcgtctcatctttgctggcaagcagctcgaggatggccgnacgctcgctgactacaacatccagaangagtccaccctccacctggttctcaggcttcgtggtggcatgcagatcttcgtcaagaccctgaccggcnagaccatcaccctggaggtcgagtcgtctgacaccattgacaatgtgaaggccaagatccangacaagganggcattcccccnggaccagcagcgtcctcatcntttgctggcaagcagctttgaggatgggccgcacccttgcgggattacaacatccagaaagagtgcacccttncnncttntcctnccgccttcgtgggngcnttgccaaatctttttntnaagaacccttactggcaagantatnacc

SEQ ID NO: 69125 - DNA, 591 bp, Triticum aestivum
  Clone ID: PAT_TA_69125
gtgacttttcctggcttctcgtgatcgctaatttttatttccttgcattttactgggtgggagatatttgcggtacaagggtcctgttcttttgcgcagctctgccgcttgctgcacatctgggtaaatcccgtgcgcatttctggattgggaatctgcgattgcaagggggatttttgggtgcgtggagctcgggatttgcgccacgtttcgccgtcaattttggagctttctgcgcatcgtggtgttcaggaagaccagagcttgatcccatttaccgttttcaccataaaatttactagcattttgttcaatcaaacagctgggttagtaaaatctgccaatcttgataggagaacaagcaaggcctctgcatcacatgatgcacacagccatagcaaaagttggtcctatcatcagattttctagatgtggcatctctagaccagtctactttactttactttatgatccagtaattggaggagagaaaaaggcaaaagcaaaagcaaactcgcattgtgcttggatctggttgagctgtagagctagcttaactctgacataaagagagtacagcttaaacgtgag

SEQ ID NO: 69126 - DNA, 501 bp, Triticum aestivum
  Clone ID: PAT_TA_69126
gggctgcagggagattttgggcgacggagccgagctccccgatgccaggagaccgccgtggccaccgtttgtccttgtcgccacctttcggatccccgccggatcagcctcctccgcaagtccctttcgccggagccccgcagtcccgcgacatcgcctcctctgcatcgagcgggaggacgaagagaagtgcctccctgccccacgccatggacctgcgccgccattcaagttcgcgtccggccctgttctggactggattctccctctccgccatcaggaacaagcttcccttccgccggtctccaccacctcgccggagctcctaccgcgtcgcgccgccgtcgttgacccttgtctgcatcgcctcggcccctggcgctgcatcctctgtttccttcgagagagcgaagacctcgcccgcattgacttcgcctggacccggcctctcctcgatctggagtcgccttgatctggagtcgcctcgatctggagtggccc

SEQ ID NO: 69127 - DNA, 462 bp, Triticum aestivum
  unsure (1)..(462): unsure at all n locations
  Clone ID: PAT_TA_69127
tggcgttgctcagcatgccgaggaaagaaaagttgaaattgagaaagagaagttggagaaagcaaatgcacagtgatgaatgaattatagcaatggttgtttgtcttgagttttgttgcaggccagtgcctgtgatttggtgatcgcaggcaatgggtttttgattcttggaatagaagaagtcgacaacattaccatcgtgggataatctcttgcagcctcggtctatttgtttatgggcggngcgagccctacagatgatactacacacttgttatgatgctgttttggtccagagctccggctccgtttggttgatggaatttgttaaatgagccctgtgggtggggcgcgtccccaagttgtcttatagcctangaaggtccggtgtagagtgtatatgattgggcggttattggtggattaccaatacgatggnttcattattttttttctgtcgtt

SEQ ID NO: 69128 - DNA, 429 bp, Triticum aestivum
  Clone ID: PAT_TA_69128
gcatttcatgaatgtaaacacagatgtacagcacagccataacagaacttatccagaatctcattcagatattcaacctattacgtcagctgggaacaacttgagcagtaagccctatcaagataatatgtatttccagcattcactgcctggcagcctgccaaataatggatcaccttctgaagtatctgatgaagccagcggcatatccaaaggtactattgaggaactggataagttatgtgaagatgggaacataaaagaagctttgaaagctctaccggtgctgcaaggaaaaggcattgtactgcatgctcctcaatactttaaactgatgcaagcatgcgctgatgcatgtgctcttgcagaagcaagacaaatacatgatcaaatatctcaatcagaactagctgttgacatagatgttaa

SEQ ID NO: 69129 - DNA, 402 bp, Triticum aestivum
  Clone ID: PAT_TA_69129
gcccaaatgatgtatggagcttattctcctgttgcaactgttggagagggccagtcctattcccctatgcacttccccttctcaagtccttactatcagccaccggcttctcttagtatgggatactcaaattctagtactggaatgtctcaaggagaccctatgcttcagcaagagtacttccttcctgatggtcttctctattcacccacaacagtgtaccaccaaccatttgagtcatacaacagagcggcaacacaaccaagcaatgctccgggattatttgggcaagggaatgcaccattggtttctggaatgcatggatcaatgtataattctggatcctacaaggcacgccaacaagctagtaaatatggaggcattactcctaattggggttct

SEQ ID NO: 69130 - DNA, 863 bp, Triticum aestivum
  unsure (1)..(863): unsure at all n locations
  Clone ID: PAT_TA_69130
aaatccccacccaatctcgtctccgatcgactccacgctcgtcgaatactcctcccccaccgcctcaagatgcagatctttgtgaagaccctcactggcaagaccatcaccctagaggttgagagctccgacaccatagacaacgtcaaggccaagatccaggacaaggagggcattcccccggaccagcagcgtctcatcttcgctggcaagcagctggaggatggccgtacccttgctgactacaacatccagaaggagtccaccctccaccttgtcctgcgtctgcgtggtggcatgcagatcttcgtgaagaccctcaccggcaagaccatcactcttgaggtggagagctccgacaccatcgacaacgtcaaggccaagatccaggacaaggagggcattcctccggaccagcagcgtctcatcttngctggcaagcagcttgaggatggccgtaccctcgctgactacaacatccagaaggagtccacccttcacctggtgctccgccttcgtggtggnatgcagatttttgtgaagaccctcaccggnaagaccatcacccttgangntgagagctctgacaccatcgacaacgtcaaggccaagatccaggacaaggagggcattcccccngaccagcagcgcctgatctttgctggcaagcagctggaggatgggcgtaccctcgccgactacaacattcagaaggagttcaccccttcaccttgtcctgcgcctgngtggggggatgcaaatttttcnggaagaccctcaccggggagaccatcacncttggagggtgggagntncgacancattngacaaagttaagggccagattccanggacaagggggg

SEQ ID NO: 69131 - DNA, 573 bp, Triticum aestivum
  Clone ID: PAT_TA_69131
gcttcgactgacctctgctgcggtctgttgcggtggcctcctttgctctatgggcaccactggttgggttcgtgttgttgttcttcttgtgttcttccccacgcctctcttcttgcttcgctctactaatttcacatagttgggcccctttcgattgtgtgcaacttggttcgacttgccgttgtcgcctgcgtcgagccgtgggtctttctatcctcgttctggttgttttcctcgtttgtcctgatgtttggattgcgtgctcctccttcctagctttggttgtacgatctcgcccgttgctgcttgccatttggttacgtggtacagtgtgaatccggtggctgcccagatctgaactgcacgtgggggccggtgttctcggccagatttgggcattcttgctgactttctgtctaacctatccacaagttgtatgatcttttccgttgctgcatctctgttctgctcgttgcttcatcgccgttacaatttttgagatatctaagctgacgtctcgaatagttcagaacagtcagtcggaactgcaggagtcatcttcaccttaatcta

SEQ ID NO: 69132 - DNA, 654 bp, Triticum aestivum
  Clone ID: PAT_TA_69132
gcttctttcctctcctctcgccatgaacgccacaccgccatggatgtggccttcaagcacccattccccctccgtcccctctctacctccatgtcgccgtgcgtcctcaccaccacctcccgcaaagcccgtgttgaggcgacgacgagctactctgcgcccccctcccctgtgagcttgaggcgacggcgctcacacaccggcgacaccatttttttgcaagacgccatgcggctatggctttgttttttatatttagccagttgcaactttttgatttgtcggttccagctttttatttcgccggttgtagcaattttcatccacgagcaccaatctttgattcattggttccaacattttttcccgtcggtagtagcttttcacgtcgctggttccaacttttgatttcgccggtcgcaacaatcccactttcgacagtagcaactttttgagtcataggttgtagcactttatttcgtctgtagtacctttttgctggaggaaggggatcgatgaagttttttttgctacaaccatgtagcacagaagcttcaaccatgcgtgccagagctgcaaaccatggtacaccagagctacgaccggagacgcccatcaccggcaaggctgcaaccggcacgaggcagtgctaca

SEQ ID NO: 69133 - DNA, 505 bp, Triticum aestivum
  Clone ID: PAT_TA_69133
caaaattactactatcagtgtgtaggttttacaattccaaagaagtagagtaacattttatacttgttgtatataacttgatgcagtgttatcattctttgcatgttactccctctgttcctaaatataagtctttttagacaattcaacaaaaaactacatacggatgtatagacatattttagagtgcagattcactcatttccttccgtatatagtccgcattggaatctaaaaaaatacttatatttaggaatggagggaggagaatagatttttttgctaattttttttaataaaatatttttaattaattttcataaatattacgctgggtaattttttttcaaaaataatacaccgtcggcccgctgcaggctgactgggcctagtcggcccacagcaggccgattggactccagtcggcctacagctggccaactggcccctgtcggcccactgtaggcccactccagtcggcctacagctggccactggctcctgt

SEQ ID NO: 69134 - DNA, 668 bp, Triticum aestivum
  Clone ID: PAT_TA_69134
ttcggcacgaggatgacattctggcaaaacattgtttagtaaaaattatgtagaggtaaattttagaggtgaaatgttgtggatgttctgacggggagatgcttgggctaactttagcgtcacactttattcaatatctgggtattgggttctactaattgtcagcacctttattttttgttttcctcccaattccatgagatatttattagactataaatcacatgcttgcaagtcattatgtcatctttctctaaccaccccctcccatcatcttggcttgcaggtcgccgtgtgtctcccgccagtccgcgacatagcttgcaatctagatccaagaaagaagagataggaccaaggaaattaggtaaaacaccaacaatgttgtttgaggtgcatgtatcggttgtagcgaaaatgtgcatctgacgatgcaatatgaccatggagctctgcaaggcttcaggatatgtaccgcaactaagagacttgacacaccgccacttgctcctaccaccatgcaagtggccgatgctttagtgtcgaactattaattagtcccccttttttctttaatctattgaatggtgcctcttaccataaatacttgttatgtggactcaatagaaatgatgttttacacatctttgatagttataaaaaaaaaa

SEQ ID NO: 69135 - DNA, 676 bp, Triticum aestivum
  Clone ID: PAT_TA_69135
gctcttctaccacaatcttcccttggtgaagatgtcccaccgctgcagttgaaagaaggagtcttcagatgcatcatgcagctatttgattgccttctaactgaggttcatgaacgctgtaaaaagggtttaaacttggcgaagcgcttgaacagcactcttgctttcttctgttacgatcttttatcaatcattgagccacgccaagtttttgagctggtttcactgtatatggacaagtttgcaggggtttgccagtcagtcctccatgattgcaaattgacattcctgcaaataatatgtgatcatgatctttttgttgagatgcctggtcgggatcccactgataggaattatctctcgtcggttcttattcaagagatctttctcacccttgaccatgatgatttgtcacagcgagcgaaagcggctcgtattttagttgttcttatatgcaagcatgaatttgacgcacgatatcaaaaaagtgaagacaagctgtacattgctcagctgtattttcctcttataggacagattctggatgagatgccctgtgttctataacctaaatgccattgaaaaacgtgaagtgctagtggtcattttgcaaatcataaggaacttggatgacacaactcttataaaagcatggcaacagagcattgctagaacc

SEQ ID NO: 69136 - DNA, 593 bp, Triticum aestivum
  Clone ID: PAT_TA_69136
cctctctgtccactagcgtcgccggcggtggcgctcatctcgccaaaggcgaagggctgaggaggcatgcagcaacggtgcatcgaggcggagatgcatagtggcgggcgtgcagatggtggaatgtggaggacaaggtgttgtggtggcggcgctggggtgggcggatcgagcgaggccggtcctcagcggcaccattcgaggcgttcctgccatggcgggtggtggcggcaacgggcccgttctgggcctaatctaagccggcagattgtggtggccgctgcgtgcttcggccagatagctcgttatccgcgggaggcggcgacgcgggtctttttaggcctaatctccaccgaatccagcgaagtcgacgacggtctggttcgtcttctcctctacggccgccggtggcataggggctactggctcggcttgaataaaggtggttggccctactgtcctttgataattcattgatctgcttcatgtcggcctccttgatctggacgccgacgagttctggtcttcctctcgaagatctcacctattggcgcatggcgccactggatttttagatcggaattgatccggtc

SEQ ID NO: 69137 - DNA, 665 bp, Triticum aestivum
  Clone ID: PAT_TA_69137
ggaaaacttgcttgatccgaccgcatccccgtgccgcgcaccaccttgtcccaatgtgtggccgacgacttggatctcccggagcagctgctccccgacgacaaaccctggtttggagtagcgcccaacacttcaagatctcccaacttcttcgccactccctccatcttcccctcggatgccaaatccaccatggtcaccgtccgggaacggcttacgcaagcactagcctacattgaggagatgcaaagagacaaacatgtgcttctccaggtatgggtgccgaccatgagttacggtcagttggtgctgacgacgagggggatgccattcacgctcaacaagagctcggagaggctcgtgcagttcagggacgtatcgacgcggtaccagttgtctgcagatgttgcgtcgaagggctcacctgtggggctcccagggagggtcttcatcggcaagctccccgagtggtctccagacgttcggtactttaccagctatgagtatcctatggtggcccatgcgcaatatttggacgtccacgggacgatgggtctgccggtgttcgagaaggggaacccctcgtgcttgggtgtcattgagttgatcatgaccaggcagaagctcaatttcacctctgagatcaataacatctgcagtgctct

SEQ ID NO: 69138 - DNA, 600 bp, Triticum aestivum
  Clone ID: PAT_TA_69138
ggtacgatgaagctgatacagcacccaaatgttgtccgcctgcatgaggtgatgggaagcaaggcaagaattttcattgttctggaatatgtcacgggtggagagctccatgatatcatcgccgcccgtgggagcttgaaggaggatgaagcacgcagatactttcagcaattgatcaacgctgttgattattgccatagcaggggcgtataccaccgagatctgaagctagagaatttgttgcttgataccgctgggaacctcaaagtctcagactttggcttaagtgcgatatctgagcaggcgaaggctgatgggttactacatactacctgtgggacaccgaactatgttgctcccgaggttatcgaagataagggctataatggtgcgcttgcagacctttggtcttgtggggtaattctttttgtgatgcttgctggatatctgccttttgaggatgacaacgtctcagccctttataaaaagatctctggagctcaatttacttgtccctcttggttttctgatggagctaaaagactgattcctaggattttggatcctaatccttctactcggataactatccctcaacta

SEQ ID NO: 69139 - DNA, 602 bp, Triticum aestivum
  Clone ID: PAT_TA_69139
gatgcgcggtttggtacggtttcctgttgtcgcctacgtcgagccttgggtccgtccctccttcgcattgaggttagtccactcctcttgtgcttgcctatggaatgtttgatgaaatgcgtgtgtgctgacgcttgttctacggttcaacctacttctcctgtcgctggcacttcttcttctcgtccatcctgctgcttacccaacgtgcttctgcttgctgcctagggttgtacgatttcttctgtcgctgtgtcgttcgactcgtcaaggttttcttctttcctttctactacatgtgtgcgtgttttactttcagtatcttctacgtcatggtgtctaccttagtgatcttttaaatatttgtatgtcgtgttgatcgtttaaaagtttcggatatggtcagaggttgtgtgttgttcgttcttgtgctacttatattttgtgtatgcgtgcgagcaggatgtgtacgctgtttctgttgttataccttctttggaggtcgtggtagctcgatgcgctttgcgccgctttcatatttgtgtgtggtcgcagaggatggctctgttcttcctggtgtagaactcgagctcctagtggga

SEQ ID NO: 69140 - DNA, 647 bp, Triticum aestivum
  Clone ID: PAT_TA_69140
gatcttgacgtggtctttagccaattcagtgtgtctgaaaatggacggcgcctttccatgaattctatcgagacggtaccagttgagaggttaccctctcttgcatctattttatctgataaaatagatatgttatggagtggatctactgaagcacactgcagtcttccacaagatttgatcaaagctgatggaaaggggtcttttagtttgttgggcaatccaaattacaagaaggcaatctccccagttcgagtccattcatttgattctatattcagattgcatgaacgggaacaaactggattgttgcctgcttcattacatttgtccttgaaaatgagatcagttgattccttcagagatttgacaagccttgtaaaggatccgatgacaaacatgcgtagggctttttctcaaatatctcctagatcaaggggaaacttaaatgttattcttactcgcgcacctacatatctcaagtctgcttctcatatggtgagtgatggggcacggctgctgctgcctcatattggttctgaaggtgcccttgttgttgctgtctatgatgatgagccaaccagtatcgtatcatatgccatgacgtcacaagaatatgttgagcatgttacgcataaactggattc

SEQ ID NO: 69141 - DNA, 604 bp, Triticum aestivum
  Clone ID: PAT_TA_69141
accccaaccctctcgatcccaaaccacccagccaccgccggtgtcgtcctctgacctctcccccaaccccggccaccggcaacccctcccctccttctctcgcacggccgtggtcggatccgcgctccctcctcgctcatgaccaagacctagccgcatggcacgaccatgggtatggcggcggccagatccaccccctccccctccctcccacctcaatccgctgtcacccccaccatcgacgacccgcgatagcggcagtgggattgcgagccagatcataaggacgtccccttcctcccgatctcatcgtgctcctctcgagtgtatttggttctgatcggccggcgaccccatgccgtccatcatggtgatcggccaggtgctgctcctcgacatcctcaccttcgtcctcgtcatcggcaccgagcgccgccggagcacggtgagccgcaccatctcctggccaactcgttgaatcttgattggggaaactgggtgcaagctcaactcgacgaggccgagactggtggcatgcggtactgcgtgtacgacgcggatgcgtccacctggtacggcgtcggcacgctcgccctgctgctgg

SEQ ID NO: 69142 - DNA, 666 bp, Triticum aestivum
  Clone ID: PAT_TA_69142
tagccggagaagatattctatgtagccataacagattttcttgtgactatcatctaccaatgttgtgtctacatagagcttgtgtccgatataatcttaatgtgatcgttttgtaggctaaatgtttgcaaacagtggaaattgttgctattaagaaatgtgctcagattagttcaggaatactactactttgtgtgcgtgttcttcattttgttctgtttgatctaagtatgacgtgcctgcttcagaaatgtcaagggttagctcttctgaacatattcctcatggtagaaatggctggtatacatgccgacacgcccatccgtgtgttcaagactggctgattcacaccatggctggtatacatgctaggatgcctctcccttctgaatcataatttcatgaaatgttgtcaaatgcaaatagtcagtgtattctttttgctattcaattttcacacacattttcttattgatctatccagtcataagagcaggtatatttgtatgagcattagattgtactaacatttatggaagtgacgatgttttaaatttctcaagaaattaattttgatgcgcaggccattgaaatagtaccatgatctgaatttttattagcaatcacatgttataccttgatgcaagtttgggagggttgaagcta

SEQ ID NO: 69143 - DNA, 549 bp, Triticum aestivum
  unsure (1)..(549): unsure at all n locations
  Clone ID: PAT_TA_69143
ggcgcaaccgccgccaacaccactcctcgagnagtcctcgccgccggagaagcagcaagcaagatggccggaaggaagggcggcgacaggaagaaggcggtgaccaggtccgtcaaggccgggctccagttcccggtcggccgcatcgggcgctacctcaagaagggccgctacgcgcagcgcgtcggctccggcgcccccgtctacctcgccgccgtcctcgagtacctcgccgccgaggtatgcgccgatctatcctctcctagagcctctgatcttccctcctcttgtcccgattgactgatttcgttggcttttgaatgcgcaggtcctggagctcgccggcaacgcggccaaggacaacaagaagacccgcatcatcccgcgccacctgctgctcgctgtccgcaacgatcaggagctcggcaagctgctcgccggcgtcaccatcgcccacggcggtgtgatccccaacatcaactccgtgctgctccccaagaagtcccctgccgccgccgagaaggaggccaagtcgcccaagaagaagac

SEQ ID NO: 69144 - DNA, 506 bp, Triticum aestivum
  unsure (1)..(506): unsure at all n locations
  Clone ID: PAT_TA_69144
gtgaacgaatgcatgtgtgttgcatgagnatgctcgtgtgtgcaccgtgtccgattgtctttgcacgttcctctattgccatgccaccgtcccgtgggaacccggtagtcgggatcaccccaccatcttgcatgactcgctcacgtcacgcctccttttgcaccggtatctccgtgagctaccggaaccgatatgttgccgtggcatcattttcggatatgttgccgtggcaccatttccgtttcaccgccgtggcacctttttccttccgccatggcgacaaatgcttcataacgtgctgttgccaacattttcataaaaattgcatataacttgtgcatgtcatccgcatcatgataataacaatttaaatgcttaaaattgttgttgcattaaattgctaaataacatggggattttccggaattgttggttgttgttccggcctcatttaaacttgcctaaatagttagtttaattatgcttcacctcttgccatgttaacc

SEQ ID NO: 69145 - DNA, 639 bp, Triticum aestivum
  Clone ID: PAT_TA_69145
ttcggcacgaggcccttgcgcgtctctccctcccgatcccctccgctgccgctgccacgagctcccgtcgtcgagctccacctcctccattgcccgccccgggctctgcctcccaccctcctagcgccaccacctccaatccctagcgccggtggcggccgttcttccggcgacatcactggacagcggcgagaatgaatagacagatagaggtaacaaattgatcattcctctggccaaacttccatcttactccaagcccacctccagaatggcagagcaatgcaagatttctgctgccatggtatctgagcaaaggtcatatgcgcggtcatacgtgctcaaggtagatggatactccagagccaaggcgtttctcgagaccggcaagtgccttacctctgaccctttcagtgttggagggcacgtctggaccgtggaatgttacccaaacggtgacaataggattcatgcccattacatatcccttttcctacgtcttgaatctgctgatgctggagatgtgaaggggaaattcacgctcagtctacttgacaagaatggagaaccggtgccttcatacagccgtgcctcccctgtactaaccttctcaaagaaagattcatgcttgggctatcc

SEQ ID NO: 69146 - DNA, 587 bp, Triticum aestivum
  Clone ID: PAT_TA_69146
gaccggcaacgcgcccgccaccccgcccccaacggcggtggcgccgccaccggccgacatcaccccctcttcccgagatcctcttcgacgccactacaccaccggcgaacctcgcgcgccgccgcccgctgcaaacctcgcgcgccacggcctcttaccgaatccaatcggcggagctcgccacggcaaccaccgcgttcttcctctcgccgccgccctggagaggaacctcccaaacatgcgccacggtggagctcgcctgccccagtgcctcttctccacgcatgcccttcttcctcgccggagctgatgtgggccgccacatcaccccgctggccgggacccccctcccctgcccccgcgccgtcctggccggccacactgaccttctcatgagagccaccttgaccttcctggaataaggttcatccatggagcggccgctcccgcccctccatctccggcgaggtgcgccatcccctccttcagtgcccccttcgggtgaagctccacgccaccaccatcgtcacgccattccagccaccagcacgcacatgttgttctcctcgtcacggccaacctgaact

SEQ ID NO: 69147 - DNA, 541 bp, Triticum aestivum
  Clone ID: PAT_TA_69147
aaacactctccggcgcatctgccaccgccgtcgtcaaccatggccgggcggacaccactcaccaacgcgggtgccgcgacggaggccgacgcgcacaagccggacgtggccatggtgcagctgcgcacctacatctgcaccgagctactccccgccttccccgccctcaacaccaggcggctcaccgccctcccctcctcctccggcatcgaccgcatcagcctcctccccgacgcgctcctgtgcaacatcgtctcccgcctccccgtcacggacgccgcgcgcaccgccgttctcgcctcgcgctggcgccgggtctggctatccgcccccctcgcgctaatcgacgaatacctccgccccagcggcaacccgccgaccgtcaccgccgccgtgtcgcaaatccttgatgcacacccgggacccttccgctttgtccacctcgtccgcagccacatggacgcgtgccagccccagctcgcgcgctggctcgagctcctcgccaccaagggcgtccaagagctcgtccttgtgaatcgcc

SEQ ID NO: 69148 - DNA, 728 bp, Triticum aestivum
  Clone ID: PAT_TA_69148
gggcaaatctatccttcgggcaccgcacgaggcgagaagctaggagctatggtgatggcggcggcgggaggcgggaggcgggaggcgacggattcgagttcctagcagatccggttcacagggcagtacaaagtagaggaggtctgtaaagggaaaatctatttcgtgcgatgataccatccagagaaacatgaaaagtggtgcgggatgtgtacaaagtggaagttgttgaggaagggagggaactgatatgtgagtgtgctaatttcgagcacacattcttgctctgctgccatgcagttaaggtccttgatttcgtcggcatataccagataccagcaaaacatattctgaaacgttggacaaaggatgcaagagatgtattgtcaacccacttatcacaccttcagaaggatagcatttcagtgaattcaataacctttaggcactcaaatcttcacacacatgcactcgaagtggtgaggctggagatgcaaatacagaggcctatgactatgagtgtgcaatggacatcttgaagatagcaatggataaactgacaccaatagccgccatgcgagatggaatgtgattgcattggaagacaaaattcagccaaacaagagatgtctacacctgattcaggcgggggctctgttagccatgtgtcttccagctctagctcgagtgcccttgcagtcagcgatgagcatgaccggcatcttcag

SEQ ID NO: 69149 - DNA, 568 bp, Triticum aestivum
  Clone ID: PAT_TA_69149
gctcaccacgacttcttggcgattgcggaagcaagcgcatatgttcctctgcatcgccgggctgccgttcgaacggcgattgaaggtttgctgcatgaagcgcatctttttaccactgaatgtagtgatcatcctctgggtattggaatctttggttttgcaagttctttcttgagagatacggctgtcaataccccgctagagcttgaggaggaggatttgcttatcacctttgtgccgcataatgaagctcttaacagacgcactacctcatttggcccagagatttggttgatgttttttggatttccttacgattaccaaacagactactacatcaccaaggctttagggggttatggatctcttgtcaattggtacaatcctcgccaggatagacggtacatgctcatcaaagctcgcgttatccgtctgaatctcgtgcccaagagttttattgtttggcagttgggaggtgcacgagactgctggacggtccaggttactattttgagaagcagtgactggaatgggttgctgcctgatgtgctgcctccaaatgaagaac

SEQ ID NO: 69150 - DNA, 676 bp, Triticum aestivum
  unsure (1)..(676): unsure at all n locations
  Clone ID: PAT_TA_69150
ttcggcacgaggctccgacttcggntccctcggcgtcccctcgtgcagatccaaaactgggaagacagtggaatggacttcgaaagatttacttaatggactggaagaatttgtgccaatctatcagacacgccctatcaagaataacatgcatggaatgagatttgaccacagttttgggctttggtttatggctcgatggcttaagccaaacctgatgattgagagtggcgcattcaaggggcactcaacttgggttttgcgtcaggccatgccaaacactaggattatatctctcacacccagacaccctgagaaatatcttaagaagggacctgcgtatgttgatggaaactgcacttatctggctgggaaggattttattgactttggaagtgtcgattgggaaaaactgttgatgaagcatggcatttctaatcccagcaaggtgcttgttttctttgatgaccaccaaaatgagctgaagaggttaaagcaggcacacaaagctggattccggcatctcatatttgaggacaactatgacactggtacaggcgaccattattccttgagacagatatgtgatcaatcacacatcagaggcggtggacatagctgcttctgggatagtgacgaagcaagattaaggtcggaacgaatgaagttttggggg

SEQ ID NO: 69151 - DNA, 584 bp, Triticum aestivum
  Clone ID: PAT_TA_69151
atgaagttggtagactgcctcaactggagcttctctcgttcgctgataataggctatctgggcagatgccacctattcttggtaaactttcacatttgacagcactgcagattggtggcaatcaattctctggtggaataccaaaggagctggggctgctctcaagcttgcagattgccatgaatttgagctataataatctctctgggaatataccatcagagcttggcagtcttgcattattggaaagtttgtttctcaataataacaacctgacaggtgaaatcccagatacatttgtaaacctgtcaagtttgcttcagctcaatgtctcgtacaataatctcaccggtactcttccccctgtgccgctttttgacaacatggttgtgaccagctttattggaaacagaggactctgtggtggacaacttggcaagtgtggatctgagtcaccctcctcttcccaggcatccgactcggtcagtcgtcctatgggcaagatcatagcaattattgccgccattattggaggagtatcacttattcttattgccatacttttgcaccatatgaggaaacca

SEQ ID NO: 69152 - DNA, 690 bp, Triticum aestivum
  Clone ID: PAT_TA_69152
ggactgttctgttcaactgcgggcgaccgaatcgggtcgccaccctcccctatcgacgaccaggccctcaagagtcaagaactgcatcatggaggctccacagtctcggccttggtcagatcttcagtcggaactcctgggccttatcctcaagcgcctccccgtcctggctgatcgtgttcgtctgagagcagtatgtcaaccatggcgctctaatagtttggagcagcaccttcccctcccattcccatggctcactctccccgatggcaccttcctcaacattcctggtggtgaaattcaccgcatgcctataccagaaggcgcttgttgccaaggctccattgacaactggctatttctcacgcacaatgatgatgtatgctcattgatgaaccctttctccaataccacgctggagcttcctaagctagccagagaatggaagcgtgtgataggtccctgctccagatttaagccaattttctataagttggtggtgccctcaccgctggactcatcacccaattccttggttgctgcgctaatcatggatgattctaattgccgcacactttgcattagccagcccccaatcgccactgactcactcagaggtgacaggtatccaataactagactttcagatattgcattctttgatggaaagttgtacgcgttgagcggagt

SEQ ID NO: 69153 - DNA, 573 bp, Triticum aestivum
  Clone ID: PAT_TA_69153
gctcccgtcggcgccgctctgctccgctgtggctgatgctgtcacgatggatccctgccgccgggcgccagcgagggctgctggccaggctgggctcacgcgcttattcccacgggagggtattcgacgcagcggcccgggacggcgaacttcgggtgttcgttgtcgccggtgaggtctccggcgattcgctcgcttcgcgcctcatggcgtccctcaggaagctctcccctgttcccgttcgttttgctggcgttggcgggtgtggtttaacccctgttcctacatttttggttcagttatctgtgctattatagtatttttcagtgtcagtttgagcatttttttctgatgaaatgccccagtttgaacatttgataaatactagtagctctgaaaccacctaatcacttcatgcactttaagctttatatttgccatttgatgtcaatgttttttttccccaatgaatgttcatttgtgcatggtactcttatagatcttcattacacagaaatgcttcatacagtcaaggtattttggacttgaaagaaacttggagaggggtttagt

SEQ ID NO: 69154 - DNA, 141 bp, Triticum aestivum
  Clone ID: PAT_TA_69154
ttatggcaccaaggtagcagaacatgaggatgtcaaaatgggtgccgtggaggatattgatgcaaaggaagataacaacaccaaggcagcagaacatcatgatatcataatgggtgtggtagagcatgcagatgtaaaaga

SEQ ID NO: 69155 - DNA, 642 bp, Triticum aestivum
  unsure (1)..(642): unsure at all n locations
  Clone ID: PAT_TA_69155
gaggaattcggcacgaggtgataatgaagtnaagtgctgactgcaagagctatattgtttgaatagaaaacaattacctcaagaaatatttagtctacttgacagaagttctcacgactcggcttatcctcttagagtttgacttgaacgcggggaaaagtatctcccaggaattggctgttgaacttgagagttgcatggcgcagttgatgcagaaggatgatgagctactggaagcagaagagaatgttcagctcatgcaagcaaagaaccgggaattatgtggagttgttggggcgcttcagattgccattgaaggtgctaaagtggtgaaaggagaacttgagaagaaaatcatgatcctgaccgaggagggcactaccaaggatggtgaaattttactacttcgccaagcaaatgaaactcttgaaatggatgctgggattctgaaaaggaaggagcagagtttgatttctgcacatgagctcatgtcggaagaggttgagcaacatgaaagagaatctcttctgctgataggtgacacagtaacctcttctgtgaatgtcgcggtctacaaagaaatggcactagagtttatgatggaagccaaggctattgaaattagtgcaatcgcgcaaaaag

SEQ ID NO: 69156 - DNA, 598 bp, Triticum aestivum
  unsure (1)..(598): unsure at all n locations
  Clone ID: PAT_TA_69156
gttngaaggtaaagataagatgtacctttgcgagattgtctctctttgttgttaacgtctggttttcgtatttttggcgaagctgtcttcgatattttatccttgcacccagaaaaactttctatcccataaaacttcttactcttcactggggaatcagaagtttctttcctgactgctctcactgtagaacgagacagcttcagtggactcaatgtaaccttttcttctcccttgttttgccaaagttgagcattcttggcaacattattcagtgtaatctttctttcagtttgcttccctgaaggaggtgatggagatggagcatgcttatttgtagcaggtttggcagatgaatccatcgtgctagctggtgatggtgctttgattttcttcacccttggaagagttgatgtgacagtggagttgagtttcctctccttgttgaacttgttaggaacgctaggatctgcctttttcgccgttgtccttggtccatcgccgcttccagctgatgtacctgcagccttctcatgtgatgttatttcgctcttgtgctttgacatggtgtttctggttatagtcgaccttgctttcc

SEQ ID NO: 69157 - DNA, 589 bp, Triticum aestivum
  unsure (1)..(589): unsure at all n locations
  Clone ID: PAT_TA_69157
tctcccacaatacatgatgaatgattcatagatttactaaaggtcaaaaggtgtccaagcggtgataaggtatggttgtagtgacgataatactggagcaactgcagttgaagagaatgaaggcagaggagaaagattccgctttatcttttgcgacaaccgacaagagagtggataaggggatatgacgtctgcctggaagaaatcactagggaagagactttgtattgttgctaagaatgtcgccatatttgggagatatttctacattatcaaaattgttttgttaatttttttaattccgtgtcaacgcacgggcattcgactagtagtactagaatgcacccttgttattgcgtggccaagcagcttaattttaattattgtttagccttttctaaagataaagatgcgtcgctgttggttgttgagatgccattctcttctgatttattgttgattgattgctgccatgatctccatgggagttcagaagtagctggtgctggaagatgacaatattcagttcgattggtttatgacaagtatggngttcagctcagctatatacactgattctcaatgttgg

SEQ ID NO: 69158 - DNA, 715 bp, Triticum aestivum
  unsure (1)..(715): unsure at all n locations
  Clone ID: PAT_TA_69158
aggaattcggcacgaggcaacggcgagcacatagtggggaagctttaatngactgcgaactcagctccaactctgctcctctgtattggaacaaacactgcaagtcatcattggctggaagaaatgtgtctggcaaaattgtgatttgccataacacaggaccaatgaatgacacagggtcagcaatcaaccagtctgacatcagtggcatcatgagtgccggggcggctggcatagtcctgatcaacaggaaagatgctggcttcaccacccttctggaggattatggcagtgatgttgtgcaggtgaccgtggctgatggcaacaatatcatagagtatgcaagggcaacaagcaaagccagtgccaaagtcatatacaagaacactgtgcttggtgtccgtccatctcccactgtcgcggcattctcatcccgcggtcccagcacgttcagccccggtgtgctaaagccagatatattagcacccgggctcaacatcattgctgcatggccaccactcaccattcttggatctgggccattcaacattagatcagggacatccatgtcgactccacatgtcagtggaatcgctgcgcttgtcaagagctcccatcctgattggtctgctgctgctatcaagtcagccatcctcaccacagctgacatcacggacagcgctggtggcccaatcttggacgagcagcatcagag

SEQ ID NO: 69159 - DNA, 674 bp, Triticum aestivum
  Clone ID: PAT_TA_69159
gaggaattcggcacgaggaacggctcctctccctcatctctctccctcccgcaatctgcgccgccggacgtcctcgcccggtctgcgccgccggccgtcttccttcgattagcagcgtaggctacctcctccattcctcctccgaagcacatccttcctctcctccgaagggtggcggttgtacagtcgggcggcggactaggagctccttcggatgagcgaacgggtgcgcagcaccgtcgacctccaaagctgtttggcgagggtgcgccgtcgacctcgtcgttgccggtctcctcggccgggcctccccatgccagatccgaaatcgcgcgtgaccagcccgccgcggtgtgagttctttgtcgtgcggcgaccagtagcagtcagctgtgacgaacagacagcggcatgagtttctccgtaaaagatgatttgtttgtgttctagatggtgctatgcatatcgtccacagatgcatcattatccaccggatgaattttttaatttagcactccacccactctgtcatgttcgttgtggtttttacttgttgcgtgaaagagtattaacagtagtttgattttcagaaatggttggaggttcagattttgggcaatatgttcaaaatgtaaaactctatatatgtcagaggtactctcaccattctcagg

SEQ ID NO: 69160 - DNA, 432 bp, Triticum aestivum
  unsure (1)..(432): unsure at all n locations
  Clone ID: PAT_TA_69160
gaaacaataccaatccaatcccaccgtaggagaggggagaagcgcggaggatgtcgggccgcggcaagggaggcaaggggctgggcaagggcggcgcgaagcgccaccggaaggtgctccgcgacaacatccagggcatcaccaagccggcgatccggcggctggcgcgcaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggaggctaggccgagggttcatcgatncagctcgcgacgccgtcgtccgaccgagagtagtagtgctatctatctagtt

SEQ ID NO: 69161 - DNA, 929 bp, Triticum aestivum
  unsure (1)..(929): unsure at all n locations
  Clone ID: PAT_TA_69161
ctctctcctcctcctcctaagatgcagatcttcgtgaagacccttaccggcaagaccatcacccttgaggtcgagtcctctgacaccatcgacaacgtcaaggcaaagatccaggacaaggagggcatccccccggaccagcagcgtctcatctttgctggcaagcagctcgaggatggccgcacccttgcggactacaacatccagaaggagtccaccctccacctggttctcaggctccgtggtggtatgcagatatttgtcaagaccctcactggcaaaaccatcaccctcgaggttgagtcctcagacaccattgataatgtgaaggccaagatccaggacaaggagggtatcccaccggaccagcagcgtctcatctttgctggcaagcagctcgaggatggccgcacccttgcagactacaacatccagaaggagtccactctccacttggtgctcaggctccgtggtggtatgcagatcttcgtcaagaccctcaccggcaagaccatcaccctggaggttgagtcctcggacactattgacaatgttaaggccaagatccaggaccaaagggagggcattcccccggaccagcagcgtcttatctttgccggcaagcagcttgaggatggccgcacccttgcggattacaacatccagaaggaatccacccttcaccttggtnctncggcttcgnggnggcatgcaaatnttttgncaagaccctcaccggcaagaccatnaccctggagggttgagtcctnggacaccattgacaatggggaaggccaagatcagggnnaagggngggnttcccccnggaccancancgcctngatttttgcccgnaagcanntngaggatggncnnnncccttgnggatncaacatccnnaggagnccccccttnaattggggcttagg

SEQ ID NO: 69162 - DNA, 631 bp, Triticum aestivum
  unsure (1)..(631): unsure at all n locations
  Clone ID: PAT_TA_69162
ttcggcacgagggcaacatgcattatcacaggnctagaacagatgttgctattcttggtgctgaaaagaatgaagctggagccaaacatgaaatggtaaccagtgctcttaatgctaagctagctaaatgtttggaagagttggataaaagtcatggaaacttacaaaggcattcaaccgaacatcatggttaccttgagaagcttagcacacttgtaatggatgatagtatgatatcattgatggctgaagaatttggaaagaaggtcagcaccttgagagatatgagcctcacagtgaagggtatgcatgaacacctcgctgcaatggggttccagattgatcctattatggaggattcagagtttggcaagcttttctctcttcaagactacaataacttcgttaccgaaagaatgcttgacagaaaaaacagaaaagagaatattgatgatgattcatccttgagtaatattgttgaacaatgcagcaatcaagctggacatttctctggattttttaaagatctatcaggttacatgagtgacaatattgnattgntgctccgtgctttgcaattagcaagcagcaactttgctcgnactttanaagagcacgactccttgaagat

SEQ ID NO: 69163 - DNA, 207 bp, Triticum aestivum
  unsure (1)..(207): unsure at all n locations
  Clone ID: PAT_TA_69163
cgtgaagaacacagacgtctaatggcgccgcagctcctgggctactactgggnctcctcctggccccggctcccgcaggttcccccgtggccctgcgcatcccangcccatcgccgggtgatatgctttgggccgccccgntgccncgccggcgcagtcagggtgttagcggaggtggaccctgcgctggccctggaccgcggtgcg

SEQ ID NO: 69164 - DNA, 595 bp, Triticum aestivum
  unsure (1)..(595): unsure at all n locations
  Clone ID: PAT_TA_69164
gctcctcttcttcctctccaggnctcggcaatggtgagccctctctttccgacaaggactcgtcgggccaaccgcagcgaagtgttgccccctccactgagggcctccttccttccctgcagtctgtagctacgcctggtcgccgttgctggtgggcgtcgggcgcgcctttgcttggtcaacggcggaggggatctgggtccagcaagaagcggccctgaaacaggggaagtcatgtccaagaggaattgctggacggggtgaggtggcgatgatgggtcaagagacgtcgtagcgtgctggtcgatagcaccgctttggtccagcacaaggcagcaggccgtggtggattcagcacaacccatctgggcggcaaggattctcggcccaacagacgggccaggctcggcgctgcggttgaccatgggcggcgactggtcgtgggtatcgcatgcagcaggtcgcagcaccccatccgtcgtcaggtcgttcgtctccacgcctgccgacagggcatgggcagcaggggtatggtgcagatcggcatccaaaaagcaacataggattattgcgccacttgaagtatgtgagtttt

SEQ ID NO: 69165 - DNA, 631 bp, Triticum aestivum
  Clone ID: PAT_TA_69165
tcttctctctcacggctgctccacaatttcatcagtcagtcgccacatcaaaaatccagctgacacagtcgagctcttctctctcacacaactgctgcaagcgagacttcaagatacagtgttgatcaaaccaatggccgccaacggcagcgatggtatttgcgtggcccagccacggagtgctgacccgctcaactgggggaaggcggcggaggagctgtcggggagccatctggacgccgtcaagcggatggtagaggagtaccgcaggccggtggtggttatggagggcgccagcttgaccatcgcccaggtcgcggcggtggccgccgccgatggtgccagggtggagctcgacgagtccgcccgcggccgcgtcaaggagagcagcgactgggtgatgaccagcatggcgaacggcaccgacagctacggcgtcaccaccggcttcggcgccacctcctatcggaggaccaaggagggcggcgctctgcagagggagctcatccggttccttaacgctggggcgtttggcaccggcagcgatggtcacgtgctgccagcggccaccacgcgcgcggcgatgcttgtccgcgtcaacaccctgctccaagggtactccggcatccgc

SEQ ID NO: 69166 - DNA, 601 bp, Triticum aestivum
  Clone ID: PAT_TA_69166
gcgctaattgtctatgtacaccaaataggatacttgatgtgtttttttgatgagaagataagtgaggccttgttaatagaacttcaagattttgaatttgcgttttcagaggatggggaagagagaaggttctactaccatactcagaagacaagagagctggacaaccttctgggagatatttatcataaaattcttgacatggaaagagcaatcataagggatctagtatgccgtgttcttcagtttctacctcaactgacaaaagcagtgaactttgcagcagaacttgattgtattttatcattggcaattgttgcgcgccaaaacaattacgtgaggcccatcttaactgaggattccatacttgagatacagaatggaagacatgctttgcaggaaatgaccgttgacacatttgttccaaatgatacgaaaatccgcagtgcaggaagaataaacataataactggacctaactattcagggaaaagcatttacattaagcaggttgcattgggtgggtttttcttgctcatattggaagctttgttcctgctgattctgctgttgttggattgactgataggatattctgtgc

SEQ ID NO: 69167 - DNA, 583 bp, Triticum aestivum
  unsure (1)..(583): unsure at all n locations
  Clone ID: PAT_TA_69167
ggtcaatgtgctgtttatgcagtcgatggtggtcttgccccagagagcagattctctgggcacaaagcagtattgtcaggccctgcaggtggtgttgttggctactcacagaccttgtttgaacttgagacatcaaagccactcattgggtttgacatgggaggtacatccaccgatgtgagccgctatgatggaagctatgaacaagttcttgagacccaaattgctggggcaatcattcaagctccccagcttgacataaacacagtggctgctggtggcggatcaaagcttaagtttcagttcggagccttcaaggttgggccagaatcggttggagcacaccctggtccagtttgctacaggaaaggtggtgagctggcaattactgatgccaacttgatcttggggaccgttattcctgagtacttcccatccatatttggtcctaatgaaaatttaccccttgattatgaggctacaaaaaaggcatttgaggaacttgctgttgagataaactcttatcggaagagtcaggacccatcggngaagggcatgacaattgaggagattgctcttgggt

SEQ ID NO: 69168 - DNA, 594 bp, Triticum aestivum
  Clone ID: PAT_TA_69168
gcagaaaggaacttgcacgtaaccagttggttgtaatgcgaaaagcctataatgcgattcttaggaacaagaacggggaggcagcacaaacttctgaagcagctcagaagcttcagcggagtgtagatgatcttaaagtgtctgcccaaaggaaggacgatgagattagcagattgcgagcagaagctgttgctgctgaaaagaagctacagatagctcaaaagcttcagcagagtgtggatgatcttaaggcggcagcccaaaagaaggatgatgagattgacagattgcgagcagaagctgttgctgccgaaaagaagctacgggaaatgcaatccttggtcaaggagaaagatgatgaaatccaaactattaatgatgggcaagatgaaactaatcagaagcgcaggcgtgtctcctcgacttcaaatgatgatgagcagagtgaaagtgttgaggatgatgatgttcagagtggaagtgatgaggatggtgacgagcagagtgaaagtgatgaggatggtgatgagcagagtagaagcgatgacaattgtgatgagcagagtagaagtgatgatgatgatttgcagagta

SEQ ID NO: 69169 - DNA, 609 bp, Triticum aestivum
  unsure (1)..(609): unsure at all n locations
  Clone ID: PAT_TA_69169
ggnctgcaggnaattcggcacgagggtcacctcttccccgcgtgcgccgctacttccttctctcgtcggtcccggccgaccgctccctccaccccccatggccggatctcgcatctcccccattcgtcgcgtctccccgcgcgagccgtcacgaccaccaccaagtgctcccccggccaagaaccccaccccgatccaaaccgcctccgccatccctgccccgcgacgaccggatccgcctctttgacggccggatcggcctctcccacatcagcggtcgtcgcccctgctttcctaccttcttctccaccgacggccaccaccagcgccaagctccaccctcaccctcatctcccccatgcgccgaacccttccacccccacctcgcgcgagcttccctccccttcctccgactacaacgcgtcgaggtcgatgggcacactggggctcacctcgtctacccccgtgcggtccaccccggctccactgcagcccgccctcccggccgggagattctnccaagcgcaccagccgcaccctacttnttctncccttntgacgaacagacaaacatgcgagcctttgggccatgcagntctgaaagctttt

SEQ ID NO: 69170 - DNA, 593 bp, Triticum aestivum
  unsure (1)..(593): unsure at all n locations
  Clone ID: PAT_TA_69170
agtgctctttgtgctaattctggatgttaaaagaaaacaaacattgactaatgaacatgtagctggaatgaacaagtacccttgtttatctccattgattgattgatgtcagatcatttagttcactcgtcatcacgcacatatacttgtacatgtaggaaaaaaatcagatagagaatctctttctgtctcttctttgtttgctacaaatatagactgaaagtgtagtactgtttctagagtttaaagatttgaacttgcaaaagtgttagttctctgatatgaagtttattatttatgttctgtgaaagttgttttctgaatgtgatatatccatatattatataaagaacaagttcacatcggtaccaaaaattatgcttaaacttacatgccatctaatagataatagtttgtgtatacttttcaacttcaaaagcattgcagnaactacattgtcacatgaaattacatattttgataagcttctacaagatcttgatatcatttgngttctatcccttgatcctgtgcttgagcaggtgcttccctaaattgcacaactccggaaacttgnacgtgatttgattttc

SEQ ID NO: 69171 - DNA, 577 bp, Triticum aestivum
  unsure (1)..(577): unsure at all n locations
  Clone ID: PAT_TA_69171
catattccttgcaatacgaaaatcagtggcatttcctattttaaggcctctgttctttcccttgcggcgaggccggcgaattggcatccttcaatccctcctcgacgcgcgcgtaatccgagatcaccttcaagaggacaagatgctgtggcgcacgattcgcagtatggaggtgatggcgcattcttctagtttccttcttccgaaactgcatcagcctgccaagactccagcaaacaattatactctggttgttcttaaccagcagcttccacggttcatgcctcgcctctgggctcaagcaaagatgagaatatgtgctgatggtggagccaatcgtattttcgacgagatgtctcagatgactaatgacctggacaagaataggtatattccagaaatcattgaaggggatatggattctataaggccagatgtaaaaagattttactctagtcagggatccaaaatttctgataaatcacataaccaagagacaacagatttgcacaagtgtatttccagtatccgccatcgcacacctgatcaggaaaaggctaatctttgtattcttgnt

SEQ ID NO: 69172 - DNA, 182 bp, Triticum aestivum
  Clone ID: PAT_TA_69172
gagcagggaaaccgaagcagtgtctccagcctgtctggctcagaggtgacaagcctgtatgatcatgaagatgtggaccattaccacaactttgagcacctccggacacacttcttcaccccgctcccgagcatcatggacggcgagcatggggccggcaaccccttcaagtgggcagcagc

SEQ ID NO: 69173 - DNA, 130 bp, Triticum aestivum
  Clone ID: PAT_TA_69173
tggaaaactgcagaaagcttcgtgtatgatgccggatttcaaagtgaatctatggtcagcaaatgagcacaggacacaagacaaaacatgtcctttggatgcctcaaaaatatctttcctgggagctgtg

SEQ ID NO: 69174 - DNA, 368 bp, Triticum aestivum
  Clone ID: PAT_TA_69174
gctggcgtgggtgagcgggttgggcctgtgggcgctgccgaaccctgagaagccatgggaatggaggaaggagaagcgcgcgaggaaatggtgaatcatccgtgactcgtgcccaaagatctctagacgactagacgagaacagtagcttcggacactgtataatgtttactctgtacctcaacacttgcatgctgtaacagcctctgtagattgcagcagggagcatcgatttgtgtaagctccaattggggacgcattctcttgtttgcattagactgttgtaaacttataatgatttctgtaaaccacgatgtgatgatcagttggtattaatggattgatactgctatgtagccaaaaaaaaaa

SEQ ID NO: 69175 - DNA, 615 bp, Triticum aestivum
  Clone ID: PAT_TA_69175
catacttacatgacacaaaagtacgagatccgtcacaaatgggcaaaacattacttcaaaggtgtgttttgtgcaaaaaaagacaagtactcaacggagtgaaagtgcaaatcacatgttgaagaactatgttccatcggggtgccctatgcacatattgatgaggaaatacatgcttctacagtttgacagggaagcggaagaaaactacgaggagaagcggacgagaattgggaggcctcttctacgagcaaacatggctactgaaaggcatgctgacaagatctacacctgagcaatgttcaagcagtttggcatagagtttacgagtgtggtgcttacaaggtggaagagattgagaaagggaagctatatgtcgcaatccatacggatgcatgttgcagagagaagtggtgcaggatttcgtacaaggtgacggtgttggacggtgaagaggaatttgattatgaatgtggccagttttctcacatgggattgctgcgcagccacgctctgaaggttattgactttatctaaacaacagaaataccaaagaaacacatagtgaagaggtggaccggagacgccctggacatcctggctccacatctaagc

SEQ ID NO: 69176 - DNA, 437 bp, Triticum aestivum
  Clone ID: PAT_TA_69176
tggcgctcccgtcaccgtcgccgtcgccgatgttccgtccacaggtgactcctcacaaactattgcccgcctctctgcctcctaccctgctgtatgcttccacctgctcccgccggcaacaacccgctccgaggacgcggccgatcccaacgccgaccctttcatcaccctcatcgccgacatccgcgccaccaacgccgccctcctcgcctttctgaggtctctcccgtctgtgaaggctctcatcaccgactttttctgcgcgtacgggcttgacgcagccgcagagctcggtgtcccagcctacgtgttcttcaccctttgcgtgtcggctcttgccaccttcctgcatatccccgtcatgcgctccgccgtctccttcggggagatggggcgctccttgctgcacttccctggagttcacccaattccggcgt

SEQ ID NO: 69177 - DNA, 181 bp, Triticum aestivum
  unsure (1)..(181): unsure at all n locations
  Clone ID: PAT_TA_69177
tgatctcgacgntactctgccatctgccttcgatcctttngctgaggcaaatgctgnggatgctggtgcaggccccgnngcaaaagatnatgtgcatgtgcgcattcagcagccgcaacggcnggaagagtctgaccactgtccagggcctgaagaaggagttcagctacnacaagatcct

SEQ ID NO: 69178 - DNA, 539 bp, Triticum aestivum
  unsure (1)..(539): unsure at all n locations
  Clone ID: PAT_TA_69178
aggaattcggnacgagggttcgcctttggctgctcccgctcgtcggcggtttggttagcgtgacttggtagttgtgacctggctggtttattcngcttcgagctgctcacagatggtttgtagttgttgatttgctgtagttgttgatttgtagtagttaatgttgctgatatatatgttgtaaaaatgtctgctgatgtgttgtaaaacagcacagatggtaattgatcacctagagccgttgctctagtgatgccacacctgtacgcttgtaaacttatgttgtctgagtactaaatagcttagattggtagtgtcattatcatgtgctggcttagatccattttgttttggttcatcctggaagttgtcatgctccgagtgtccttgtaagacaagtttacatatccgttgtaagaaatgttattacatatacctattgagcttgcgctttgtttgttatacaccagaattgctttacatatccattctggatggtcgtcacataggactgcatgagctctattgaacctgcttcc

SEQ ID NO: 69179 - DNA, 555 bp, Triticum aestivum
  unsure (1)..(555): unsure at all n locations
  Clone ID: PAT_TA_69179
cgtggatatgcttgtnaagatcttattgtataatgcacgaagagcagttatcttacctttctggatcctcggaggaagatctaatttaccacagtgcaactcctgtggattcctttgagattggttatggaagtatgcttctgagaagttcaaactcaaaatcagcggaggaagattcagaagcaaactctgttcctgcagataataaatcataccttacaagtgaatcctattcagggactgcctcgtttgttgtgcatagtgaaagcaagggggcaagtaattcaaatgcttctcctgagaagccaaagtggtttccggtgcatacacacgaaattgctaaaaggggtaaacttcattactcaaagcagcataccctggaaaatgtaggttcaattttagtttcagtagctttagagggagaaggcactaaggaaacaggaggaaatgaaaataccagtgctttgaaagaccttaccaaatccaccatgaagcctctcaaaaggcctcatgaaagccagttgcaaagctgcccagaaggaaccatgaggattg

SEQ ID NO: 69180 - DNA, 190 bp, Triticum aestivum
  unsure (1)..(190): unsure at all n locations
  Clone ID: PAT_TA_69180
atatggaagagtggagcgagntgacatgaagacaggatttgcgtnngtctacatggaagatgaacgngatgctgaagatgctatncatagacttgacagaactgactttggtagaaaagcgaggagactgagagtcgaatggacaaaggaggatcgcagnggnggncggaaaggaaatgggaagagatct

SEQ ID NO: 69181 - DNA, 594 bp, Triticum aestivum
  Clone ID: PAT_TA_69181
aggaattcggccgagggcccaaagaaaaaggaaaccccaggcggcggtggcggcggcggagacagagatcgacgatgcgggcaagaggcggcgatgagcagcgggtcgatctcgtcggacagcgagatgctgatggaggagatcatctccctgcggagagagcggaaagacctcatggagtctcttactcccaggatttcttgctggagggatcagatctctggagcagcaatctcgtccttccataagatggactcgagcaccatcaaaccagcctccagtttccagtccgactcacagcagcaggtatacttgacagacgacttcgatgttctggaggacgtcgaggatttgggccagcggatgctatctttggcacattctctttcgacctcccatgcccccatctccttgtacaaggcggacgagctggttagcacaacatccaaattagagaggatctcggtggatttctacaattctaccgaggcggcaatggaggaggcagcggaggaggagagggataggatggtggagattcggaagacagaaggagaaggtactgctgaggagttggatgaagagatggagata

SEQ ID NO: 69182 - DNA, 529 bp, Triticum aestivum
  unsure (1)..(529): unsure at all n locations
  Clone ID: PAT_TA_69182
gtgaagacccttactggcagaccttcactctggaggttgagagctcggacaccatcgacaacgtcaaggccnagatccaggacaaggagggcatccccccggaccagcagcgcctcatctttgctggcaagcagctggaggatggccgtacccttgctgattacaacatccagaaggagtccacccttcaccttgtcctgcgtctccgaggtggtatgcagatctttgtgaagacccttaccggcaagaccatcactctggaggttgagagctcagacaccattgacaatgtcaaggccaagatccaggacaaggagggcatcccccctgaccagcagcgcctcatctttgcaggaaagcagctggaggatggccgcactcttgctgagtacaacatncagaaggagtccactcttcaccttgtcctgcgtcttcgtggngggatgcagatctttgtgaagacccttactggcaagactatcactntggaggttgagagctcanacccnatcgacaacgtcaaggccaa

SEQ ID NO: 69183 - DNA, 238 bp, Triticum aestivum
  unsure (1)..(238): unsure at all n locations
  Clone ID: PAT_TA_69183
ttcccttgatgacatcgacacanattctgaaggaagattcggatgcaatgtttcccatgtgaataattacatgtggcattgcggagaaatcgatggataagtttgctgcactgatatcgtctttcagatacgcaggctcccgtgccagtggccttcgtgctcctttaaaggatgtgaagaataccctttctgtgagatctattctcagacccccggaacagaacctccggtgtacggc

SEQ ID NO: 69184 - DNA, 580 bp, Triticum aestivum
  Clone ID: PAT_TA_69184
tctctctctccgatcgatcctggcaagcagctgtgatggagaagggcctggacacggcggcgacgaagcgaggatccgaggccgaggcggaggagccggggcggaagaaggcggcgggggctaccaagacggcgaaggtggtgccgtggctgatggattcgttcgaccagatgttcgacgaggtgaggctgaagcatgcggtggcgaggctgaacaaggcgaaccccggcgcgccgccggtcgtgccggaggagctcaccgaggagaggcgggcggcgctgctgcaggaagatacggagtggaggaacagcatgaaggaggaggagctcgcggccgcgcggagatacgtggcggagcaagcccgggcgccaccatcgccggaggaacccaccgaccccagcaaggacaggtggcagctggattatgaccttggccgccaggaattggaaatgaaactggcaaaatgggaggacttcgagggcttcgacttcgagcgcaacacgcttatccctcccatgtgtttcaccgacaacccaatgcctgatgacaccgaccacaggcttactgcgcagatctttac

SEQ ID NO: 69185 - DNA, 179 bp, Triticum aestivum
  unsure (1)..(179): unsure at all n locations
  Clone ID: PAT_TA_69185
ggttaagtcgtactgttagaatatatccaatgatgtgtgttggtaacggcatttgaatgtgccagctgattgtgtaattgcagtttatacgctctaaactaatttaaaaaaaaaaaaaaaaaaaaaaaaaaaaaagaaaaaaaaaaaaaaaaaaaaaaaaaaaaaaangaaaaaaaaaa

SEQ ID NO: 69186 - DNA, 469 bp, Triticum aestivum
  unsure (1)..(469): unsure at all n locations
  Clone ID: PAT_TA_69186
ggcaactcttctctggctctgacccgcctcccaccaaccaatcgccggcggcctcggcccctcgccattgccgcgctccgtcggcgctgctccccgccaatgctccctatgcccgccgcgtttcccttctgatttttctggtcgcttgagggtggcgtanggttcctcctgttctcgcggcggcgggcggacgacttcttggctccggcggctgtcccagtcctgtcctgtacactctgaggtcccgaggacatcaaggatgatgcttagatgacatgtgccctgtttcttgtccgtggctggtctgataggataggaagccatgaagatcagcgcgctcatgacctctgctggcatcaatattgggatctgcgtgctcttgtggtcgctctattccgttctcagaaagcagccaacatttgtaagggtctacttcggccggaggatcgccgaggagaatagactgctc

SEQ ID NO: 69187 - DNA, 501 bp, Triticum aestivum
  unsure (1)..(501): unsure at all n locations
  Clone ID: PAT_TA_69187
cgaggatgaactgaagcaatggaccaaggnacaacaagactgccagagtttatattcttggctcgatgactgattcgttggctgcggaatatgagtcggataaaacggcctgcggaataatgctcaggctggaacaagattttggagaagtttcccttgtgaaggtgcttagccttgtgaataaatttctgacatcaaagatgggtgataaaacagtcaatgaacacttcaacaagctctgtgtcttggcggaagagttaaaaactgctggctatccgttccaggaggaagtccaagtcatggttgtcctgaactctttaccaccatcatgggaacaattcaagatttctttttgtcattcagagcgcacactcaatatgaggaacctgaggcaacacttgctgatggaggaggaccgcaggctcaactcaggaaaagataaagctttttatcagccagaacttcacccttggtgagtacaagaatagtgggaatcggagg

SEQ ID NO: 69188 - DNA, 545 bp, Triticum aestivum
  Clone ID: PAT_TA_69188
agggattgatgaaaatttggcgagggagatcataaaccatcgctcgctgcagcacatcaattgttgaattagtttgaaggagctgtcaattgttgaattcacttgaaggagatggagctcgtttggctgaatttgctactgagttgccacattttgagggcctacaattgaagaatacaacacttgagataacaattgaagaatactagagtaataataactactgcaagagtgatgtattttctttttgttggagattttctgcatcttttatggatggtaacatttgagataacaatttgatgtgctaaccatcaagatcaacttcgacatgtttggtctctaaaagttactattgaccatcattggtgcatcctataagaaggggaaaataaagcattaatgtggagtatgttccaatagaaatcttcacgaacaccttgaagttctttgtgagcttaaaaatgcaactgatgtggcccatgcaactgagattaaaaacatggagaacaatcataaaagatctcgctgaaaatgccctcgtt

SEQ ID NO: 69189 - DNA, 130 bp, Triticum aestivum
  unsure (1)..(130): unsure at all n locations
  Clone ID: PAT_TA_69189
ataccggngaatgaatgaatgaaaccggggcaatatacaccatcatattcgactgngtagctttttagcgtcttgtaccatgggtggagtagctagatggatgcgccaagagcaagccgcgancttgact

SEQ ID NO: 69190 - DNA, 116 bp, Triticum aestivum
  unsure (1)..(116): unsure at all n locations
  Clone ID: PAT_TA_69190
atgttcctattgnttggaaatacatgttccacctaanatccatgtgttcctttggttgatttctcataataaaataatgcanataaccttatgaaaangcatatcatcaaacctct

SEQ ID NO: 69191 - DNA, 460 bp, Triticum aestivum
  unsure (1)..(460): unsure at all n locations
  Clone ID: PAT_TA_69191
gcaggnaattcggcacgaggggtatactccaatcaagcattgcctgcacaaagctcctgctggtatcgaagaaagaggcagtgagtggcctgaggagtggcccaagaggctcgagacttttcctgactggctcggggacctgcagacaagggcgtctgctgatcatagccattggaaggccgtcgttgagaaatcgtatctggatgggttgggtattaactggacaaatatccgaaacgtgctggatatgaaggctgtatatggaggatttgctgcagctttgtcgtccgaaaaagtctgggtcatgaatgttgtccccgtgcatgctccagacaccttacctgtaatctttgagcgtgggctggttggtgtttatcacgactggtgcgaaccatttagcacatacccaaggtcgtacgatcttcttcacgccgaccatttgttctcacgcttgaagaac

SEQ ID NO: 69192 - DNA, 410 bp, Triticum aestivum
  unsure (1)..(410): unsure at all n locations
  Clone ID: PAT_TA_69192
cgggctgcaggnaattcggnacgaggggccccctttttgacgccgtaatttcccagcttgaacaagtatattgggagtttgataatgagcagtggaagagccctcgagttgttccaacaccgaaacaactccgtgagttaagactgaatggctggaaatcaggacctgctagatgtcatggacctaatttttttgactggtttaaaactaaatgcatgaagtcacctagcattcacaatgctttacgccaaatgtcttatggttttcgcacaagagttgctacttatggctgttatgatgtgaatgggtataggtttcggtcagagaagtatgagaggaagaaatctgaattaactacagtcaatagtggggtttgtgttacttcacttgatgaagatgacaaccaattc

SEQ ID NO: 69193 - DNA, 270 bp, Triticum aestivum
  Clone ID: PAT_TA_69193
cacggtagcagatgtaaatgctatagaccatacagggcaaacagcgcttcactggagtgcagtgcgtggtcatattcaagttgcagaactacttctaaaagaaggagctaaggttgatgctgctgatttatatggatatcagaccacacatgttgcagcacagtatggtcagacagcatttctttatcacattatttcaaaatggaatgctgatcctgatgtccctgacaatgatggcagaagtcctcttcactgggctgcttataaggg

SEQ ID NO: 69194 - DNA, 105 bp, Triticum aestivum
  unsure (1)..(105): unsure at all n locations
  Clone ID: PAT_TA_69194
cacccatattttttgcagaacctatgcgagcatccaattcatttgttggtacagaggagtacatngcacctgagattattactggagctggccatacaagtgctg

SEQ ID NO: 69195 - DNA, 545 bp, Triticum aestivum
  Clone ID: PAT_TA_69195
cggcacgagggttgcttgatgaatgcctgggtgtgtcacttgtgtaatatatgttggttgatgaatgcctgggtgtgtcactgcttgttccatgctacatttaggaattgttcatttttgtgttatgacaacttcactgcatcctgccgaaacctttttaaaatcttgcagattctagtgctaccacacaactagatcagtatttgattactattacaagtggaggtctaaatcagcagagaacaggggtgagatgtacatgtcccaacctccttccctcccatgtatgaatacgctctcaagtagtcattcttgtgaatgggcatatgataagaactaagaattcaccttcactaattgtctatgatatttcatcaggatctataagtacttgaggtacatattggccgcaccaccaatatgtgtagttcttgggccctcttggtagtgggttctcagtaggactatagagttgatagtatgcttctatgcatcccaatttatgagttatgcagaataagaattacaatttgctgcaattcaga

SEQ ID NO: 69196 - DNA, 396 bp, Triticum aestivum
  unsure (1)..(396): unsure at all n locations
  Clone ID: PAT_TA_69196
ccgaattcctctcgccgctgctcttcttcctcccctcgcctcancgggccggggacgacggcgcggacctgcattgatttgtttttcggggttaagcaatggcattgttggactggattgagttgtctgatgacgaggaggtggcagtcaaagaaagacttcctccagaaaaagtcaaagaagaatttcctccaatagaagtcaaagaagaatttcctcccacaatagtgaaagaagaactggatactcatgtacatgggacagctcagttggaagtagaaattgttgatttaaccacagaagaagctgacgttgaagaggataggaatgctcacgggaaaggggacgctgctcagggggcaacaacatcacatagacaacagtttgttgcacctc

SEQ ID NO: 69197 - DNA, 414 bp, Triticum aestivum
  unsure (1)..(414): unsure at all n locations
  Clone ID: PAT_TA_69197
gcttataatnattcttcctccaccccggcggcggccactgcggtggcggcagcgccggggcccatagatccgaagcaaccgccgcggtacgtgtagaccacctcccaagccagtcaggggtttgctaagaagcgaaccatccttgaagctttagtcgctctatccatactagttgtcggctgtcgaacctggcatgttctttccccaattccaccaaaaaaattctgtttggttgatcagcactggaacgccgcaggttttacgcggggttatcttgaatctggggaagatttgggagaggatgtctaatcttgccaacatgtttgctgtccttgacctggatggcgaggacgatcgaaaggaagtggaacaaccgacatccagcaagccagaagccgccgccgccgccgccgc

SEQ ID NO: 69198 - DNA, 170 bp, Triticum aestivum
  unsure (1)..(170): unsure at all n locations
  Clone ID: PAT_TA_69198
accatactcccgctatgcatgtttaggccacaaaaggcgttcaagtgaatatctgaaggtcaattagtgggcaacccggttaggatgatgatatggcaatgccactggcacacggaggtactccagtgcccccccccccccccccccaaaaaaatttttttttngggggg

SEQ ID NO: 69199 - DNA, 582 bp, Triticum aestivum
  Clone ID: PAT_TA_69199
gtgcctgtgttgactgctcctaaatataacacacatttgcaggttatgtctgcatactgtacaattgtggtagaagcacttgttcttattcttttgtccaattagagttttaaattagtgtggtagatgatttctctagctgcatattagttacaaaacatgagcctgtgaagagacaaggttctagcatttgcttcaaatctgatataatttttgaaatagatcccaaaactttctaatcaggtattactggcacatttttttgttttactagatgacggtgctcacaaatattaggctactatattcgccctacgttagagtatcttcatgaatcgtttctgatattaccagacagaaatggcgctccaaggcccaaacctgttcaaccctggctcatggcaactatggtttgctccgtagcgaaccatgggaatgggtcgcgagcgcaagaagcatcatcgatggtgccaataacatccagcaatacactgatgtgtccttcccaacggtggttcacttcttttccgagcctcatatatactgcattactgcgtatgtaggtggtgacagtatgacaac

SEQ ID NO: 69200 - DNA, 182 bp, Triticum aestivum
  unsure (1)..(182): unsure at all n locations
  Clone ID: PAT_TA_69200
gagggagagtnagtcgtcgatgatggcgagcctgaacctaggagacattccgccggtgctgccaatcgtgggttgcccggactgcggcaggaaggtagtcacgtacggtagctcgccgcgggcagcatgtgggcgagcgcttctacaagtgccgctaccacaatccatcagcagggggatgt

SEQ ID NO: 69201 - DNA, 237 bp, Triticum aestivum
  Clone ID: PAT_TA_69201
tcgaagttaaggccgtgtagcaaatagttgtatgttttgtctatgtgtaatagactgtacatattgtaatagactatgtacagattatagtagactaatttagtgttctttgatgaactgcatttgttatgttctgtttgaaataatgattatgtgatttgaaaaaattagtgaaatggaaacctgactcgtgggaccaacttatgaaaataatctgagcaattttgaaaaaaaaaa

SEQ ID NO: 69202 - DNA, 115 bp, Triticum aestivum
  Clone ID: PAT_TA_69202
gcatactatgtatgcaattttcccatatactttagctctcaatgcctaataaacctgaggaactaaggccggaatcatggaattgagcttgcatgttttttacaccaatatgtca

SEQ ID NO: 69203 - DNA, 589 bp, Triticum aestivum
  unsure (1)..(589): unsure at all n locations
  Clone ID: PAT_TA_69203
aggaattcggcacgaggagccaacncctcgtccctcactcccacttcnccttcgaagctccagcggcagccatggcccccaaggcagacaagaagccggccgccgagaacaaggtcgagaaagcggcggagaagacccccgcgggcaagaagcccaaggccgagaagcggctgccggcaggcaagacggcgtccaaggaggccggcggcgaggccaagacgaggggccggaagaagggcagcaaggccaagaagggcgtggagacgtacaagatctacatcttcaaggtgctgaagcaggtgcacccggacatcggcatctcctccaaggccatgtccatcatgaactccttcatcaacgacatcttcgagaagctcgccggcgagtccgccaagctcgcccgctacaacaagaagcccaccatcacctccagggagatccagacctccgttcgcctggtcctccccggcgagctcgccaagcacgccgtctctgagggcaccaaggctgtcaccaagttcacctcctcttagactgacgctgcgtcgcttgttatgacagatgtagttggcttgctgttttcttctgt

SEQ ID NO: 69204 - DNA, 571 bp, Triticum aestivum
  unsure (1)..(571): unsure at all n locations
  Clone ID: PAT_TA_69204
tggaattgtgcttgcatgttttttcacaccaatatgtcaacagtaaaaccgcaacggccaatacagttggcattattaaccgtgaagcagagtccctgcgggaggatcaaccacacctgaacattctgaattgtagaatggcaccctgctctatgtccaggctgcttgtaatgaagcattgcttgacgcacaactttgccattttgttggcacatagaagttcaagcaccttgcatttgtagcagagaagatatctagctggtggtgaatttctcaggatggtgtgaaaggcatggtagctttttgttccgtcttggactacagcgcccttactttcagaattgcagcatattgcagtttgcatatcgcgggggcatgctcaatttgaaggccaaggtgacaccagatggacctggagagctggaagcagagctttcaatttgtgaacaatggaacattagaggacaccagatacagccaattctcagttcctgtgatgttagtaaatccagctttttggtggaaaaataatgngcttgcttntttacgcccctgngcttactttctcatc

SEQ ID NO: 69205 - DNA, 484 bp, Triticum aestivum
  unsure (1)..(484): unsure at all n locations
  Clone ID: PAT_TA_69205
cgaggcngatcctgatgttgttgtcttnattgctttgcagtctaacactattagctctccagttcttcgtcttgctgtcaagcaaatcactatcaaagagaaggaggtggatacattatggaatctgacattatccctgttagtgctaatagatccaagcacgcaaagaaacaaacgattttacagaccggataccatagcgaaatcaacaaagaagttgcagtggtggaggatatattctccgtcatgagtggatgcaatggcggaggacaaaaaaagaggtggggtggagcttgagcttcctacgaatggtgtctctctgctgccagataggaggctcttctggggagttggtggcacaggggcacttgctgcctatgaacaggcagctttgcaggctataaaattcttacagggattgtatgggtttatgatcagagactataatttccattgtgtttgtctatacggactcggtagcttc

SEQ ID NO: 69206 - DNA, 254 bp, Triticum aestivum
  unsure (1)..(254): unsure at all n locations
  Clone ID: PAT_TA_69206
cgtagagctgtctctaggaacagtgagatcaagaaagatgaacaaacagtcatagaaaaggaagatgacactgaaagcacattggagatagagcgaatcaggggtgaccctagnatgctccaatccatgacagngaaagaactcaaggaactcacaaggaggatgggagttgntgcgagaggtaacaagaaagattnggtatcaggctctgatggaatctntgggtgaggaagtaatnggtaaagagggcgcat

SEQ ID NO: 69207 - DNA, 657 bp, Triticum aestivum
  unsure (1)..(657): unsure at all n locations
  Clone ID: PAT_TA_69207
aggaattcggnacgaggctcgggcgccggcgcgaggcgagggccgagcttgatgctcccagcttgctgaggataatgctatccaagccccctctgatccggccggcaagctctcgatcgaaatgatggaggacgaacaatcagccacatatactgtggatgacgcccttatatcttcaggttttgggaagtaccaaatattgattctctcctatgctgggataggcttaatcgcagaagcaatggagatgatgctgctatcatttgttggtccatccgttcagttagaatggaatcttactgctcaccaggaaagcatgattacaagtgttgtttttgttggaatgctaataggagcttactcttggggtgtggtctcagataactatggaaggaggaaagggtttctctttactgccattatgacgagtggagctggattcctgagtgccttttctccaaactatgtagctttaatggctctacggtttttagttggtattggcttgggaggaggacctgttcttggatcttggttcttggaatttgttcctgctccaagtagaggaacttggatggtggtactctcagcattttggactgtcggtaccatcttcgaggcttcgcttgcatgggtagttatgcccaagtatggctg

SEQ ID NO: 69208 - DNA, 299 bp, Triticum aestivum
  unsure (1)..(299): unsure at all n locations
  Clone ID: PAT_TA_69208
taattcctgctggccaatggccttgggcgaaatgaaacatgcacatactcttgattcaattgttcctgtgcatcacaacatgtctgaacaccagattatttttctcagngactaggatttatataggtaaattttcttttatttatagttgcagattgcatatattaggacttgccaactaggcatcctaacaccggctacaacttggactcgcaaactacatcaacagacatgtataggagtttggaatatccaacattttcttctttttatttacttcatccaatatctgggaacta

SEQ ID NO: 69209 - DNA, 620 bp, Triticum aestivum
  unsure (1)..(620): unsure at all n locations
  Clone ID: PAT_TA_69209
ccccctcccctcccctctccacccacgactcctcgagccagcaaccgcggcgccgagagccccagaccgacggacggagacnnagccggaaaagaaagccagccacaggcggcggatccctgactcgccgacgagacccagagagaaccctacctactccatccattgcctaaggccaggagcggggctggggcggaggggagctgagccgtcgactcgactcgactctgctccagcaggcagcaaggtcggcgattcggatcccccgccggcgattcttgcgattcgcgcgcgccggagatccggattcccctcgcccctgccgcgccgccgtacagaggaggggaggaggggaagggggctggaggatccatgtcccagccgcacaggcgcagcaccgggaacggcggggcggtctcaggcgcgggcgggggaggggactacatcaagtcatggatcatgtgcggcaacctgcagcgcagcttcggctccctcgtccgcgagccctgcggcctcaacccggacccctactacctcaaggggggcaaaatgctcaggccagagaaatggaacgcgtgtttcgacaccgacggaaaggtcatcggctttccgtaaggccc

SEQ ID NO: 69210 - DNA, 520 bp, Triticum aestivum
  unsure (1)..(520): unsure at all n locations
  Clone ID: PAT_TA_69210
gtgaatttgttgatcggttcggagtcctagttcctgagttgatgttcggaagtnatgatgaaagggcgttgacagaggcagttcttgaaaaaatgaagcttaacaattttcaacttggtagaaataaggtcttccttagagccggtcaaatcgcgatactagatgtgcgtcgngctgaggttttggacaatgctgcacggcgcattcaaagntgtttcagaacattcgccgcccgcaaagagtttgtgaaaacaaagaaggcttnaatttcaatacaagcatattgtagaggttgttttggaaggaaaatgtataagatcagaagagaaacagcggatgccataattcttcagaagtatgcaagaaggttactgttacagcggaattaccatgaagcatgttcagcagctctgctcatccagncttgtattcgagggtttattgcccgccgctatttctnagccatcagggagcagaaggctgcgntagtgatacagtccttctggagaaaacggaaggt

SEQ ID NO: 69211 - DNA, 471 bp, Triticum aestivum
  unsure (1)..(471): unsure at all n locations
  Clone ID: PAT_TA_69211
gcctattccttccctccaccgccgccgccgccgccgctctgcacagcgcaggttctccgccgtcgctctgttcaggttctccgccgccgctctgcccctctgctcccgccgccgcctgtagatctgtgtcaacttgcttcgatttgcttgtccttattctactacttgttaccctccatcgctgatcgtcggagggaggaggatgagcggcagcattcggcggatcctgaacctggggttgttcgaaggggtcaaacgcgcgtattcgctgcggcgcctgaacctggagctctccaaggtgaagtttttccacccgacggcacaagaggcggccgctcatggcaaggtgctgccaacactgacgcccgcccagttcgaggccaccagcaggacaaggatctgcaacaccgatctggcgacggcggaggcggcggcgcccaagatcgatccgccaaaaaccgagctggncat

SEQ ID NO: 69212 - DNA, 350 bp, Triticum aestivum
  unsure (1)..(350): unsure at all n locations
  Clone ID: PAT_TA_69212
gccgccttctcctactggggcttcgacgattctgccttgcacgttaacaacctcgacgaggacgtcaacaacttcgacatttctaccttcttcgcatgagatgtttgcaaagagagaatgcaaacaaagaaacagagaagatgagcagtagaaattagagaagcagctggagatgactggccaccctctgagttctggcacttatccagggacagaggagggaagaacacaccagttcttcctcagttcacgtttaaaatttaggacataagattagtgcctcctccctcaccccccccccccccccccaaanntntttttccccntttnttttttccccccnggggggg

SEQ ID NO: 69213 - DNA, 642 bp, Triticum aestivum
  unsure (1)..(642): unsure at all n locations
  Clone ID: PAT_TA_69213
cataccccaccgggnacttggagcaagcagcgagcagcaacggcgcggtcatgggcaacaacgacatctcacgactgctcttcgagatggaggaagacgacgacacgttcaacctggcggtggagtcgaggaaggaggcggcggagacggtgaggcagagtcggcaggatctgatcgtggtggcgtcgctggtggagcggatcccgaacctggcggggctgacccggacgtgcgagatattcagggcgggcgggctggcggtggaggacatgggggtggtccaggacaagcagttccggctgatcagcgtgacggcggagaagtgggtgccgatggtggaggtgccggcggagagcatgagggcgttcttgcagaggaagcgggcggaggggtacacggtggtggggctggagcagacggccaacagcgtggcgctggacgagtttgtgttcccggccaagacggtggtggtgctgggcagggagaaggaagggatcccggtggacatcatccaggaggcggtggacgtgtgcgtcgagatcccgcagcttggcgtcgtccggtcactcaacgtacatgtcagcgccgccatcgccatctgggactacacccgccagcagcgcgtccgctcctcctcctnct

SEQ ID NO: 69214 - DNA, 664 bp, Triticum aestivum
  unsure (1)..(664): unsure at all n locations
  Clone ID: PAT_TA_69214
gttcattncgtactaccattatnctccctcgtccctgctgacgcaccagctgttccttcgtgcgactcttctcttccgttccgttgggatccctcctcctttttcgcgtggtctctctcagctgcctgtctgtcttgtgcggggaagcaaaatctcacctgggttcgtcttcctcctccgcctcagctgcctgcctttgggttcttcgccgctttggagctcaaatccggcccgcgggttcctgatttcgcgccgcgtcgaggcctcggcgggagattcgcgccggcatttcacggaacgcgctctctttctctctctctctctctctctctatctctatctatctcctccaccatttctcggcgccaaatcctgctccggggtttctttcccttctccccccttcagctcagcctagggttctcctggtttcccggaagcatccctttcggcagagtcttggtgcttttcttttttctgaaactagcagtcttggtgctggatgcgcggngattcatatacatccgtcgcacatggcaagctgctgccgctgatgacatccatgaggagggctcggcatgttactctgctgctgtgcgcgagcaggacgaccagaagccggcccacgcagtanaatcttcttctgctacagactttcagtcac

SEQ ID NO: 69215 - DNA, 111 bp, Triticum aestivum
  unsure (1)..(111): unsure at all n locations
  Clone ID: PAT_TA_69215
tttnacttgatgcttgnggccaggctcatgatttggntnggtttcttgaagatcacantcnccaataancaaagtgatagggggaaagctagcacaaccaccccttgcaaa

SEQ ID NO: 69216 - DNA, 191 bp, Triticum aestivum
  unsure (1)..(191): unsure at all n locations
  Clone ID: PAT_TA_69216
ttcatcttcaacggngcggtgctgcgccctgccggcggccaaggctgcagttcaagccatttccaggtggcccttgtagcccgtgacggagcatgtacgagagtttccatatgcgtttactcatcggagactgggatatggagcaacgtcaaatcactgcagatgaaattgagtatacctatcgaaagagc

SEQ ID NO: 69217 - DNA, 657 bp, Triticum aestivum
  Clone ID: PAT_TA_69217
gtttctccaaacattgtccaatccatacacggctgcctctgtggcaaaggcgttttttgagggcattgtgtgcctccatggacttccacagtctatcgtcagtgactgagatcctgtcttcaccagcaatttttggcgtgaattattcaacttgtccggcgttcagcttcacatgagcttagtagcctttcacccccagtgtgatgggcagactgaagttgtcaacaaaatcatcgcaatgtacctgcgttgcctcattgttgatcggccacgccgctgggtcgaatggttgccctgggcggaattctgctacaacacgtcctaccactccgctcttcgtgccactccattcgaggttgtctatggtcggccaccgccacgtctttgtgactatgttcctggcgaggccaaggtggcagctgtgggcaccgcctttcaggatcacgccaacttcgttcatgaggttggtgagcatctccatcaagcgcagcagcgggcaaagcattattatgatgacaagcatcgggagctggcatttggcgtcggtgattgggtgtggcttcaccttcaccattgtgcgccagcatcgttaccaggtcacaagcatggcaagttgtctcctcgcttctatgggcctttccaagtcactgaagtcat

SEQ ID NO: 69218 - DNA, 225 bp, Triticum aestivum
  unsure (1)..(225): unsure at all n locations
  Clone ID: PAT_TA_69218
gcggatgttatagcancatacancagcaacacccctaaagataggagaagggaaccagcacatttgaggtgncattggcataagatgatcccaaagattgcccgcttcgatgattgctggtgccaggtcaaggcaaaatatcctagnggcctgtctgacaatatgcggcatgatggacaaaacatgggtgatgttcaatgcngaagcacgggcgatgtatcttga

SEQ ID NO: 69219 - DNA, 591 bp, Triticum aestivum
  Clone ID: PAT_TA_69219
catccctctacttctggggcaatttttttcgcagtttgtcgcggcaaagtttgttcttgttcattcttgcagcttctgttttgtattgtagcttctgatgaaatattgattttagttttcttttgctaaaagtttaacgtttctttctgttaaatcattctttcccaagtctaattgtgctacttgatctattgtaaatttacaattcttaatttcaataattttctatgtgtcagaagacaacgaatgtttcagttttcagcgactataaagaaagaatgctgtagtgctaatagaagctgtattattgttggatgactgtcttatgaacaatgtaatgtcatactaaaagtctaaaacagaatggttaatagggaatgctcatttgtggcacgatgagtatgagtaaacagacaagctgtttgactgcggtgctacagttaactaaagcgttattcaaaggatggatttattgttatgttaggggtgcacatttcaaattgtagctgtttagttgacattaaaagattgcacatcattatttatgcattttatactttcacaggttagtgagggtcttgattttgctga

SEQ ID NO: 69220 - DNA, 617 bp, Triticum aestivum
  unsure (1)..(617): unsure at all n locations
  Clone ID: PAT_TA_69220
gctgatngttttcctcactagaagaccccaggtgcatgtgttgtgtgacatcacgtgtgtattgtgcagttttatgtttgctaatctaagtatacagcataacatgttggaaaatatttggtacatctttttggaaattgagatctcatgtatcttgattgttgaggtggtattttttttcttaaagaaaactgcaagggacaccagtagctttgaataactggtctcatgccactctagcagttattccaatatatgtgatgggtgtaaagattagaatctaatgtcacagtggcatccttgggaactttctttcacatgattaagttgagacactgtcacaagaattcttcacactgggaggcccttcatttcttctctcgcattcttttaagcatgaaaccggtgatacaatctgttctgacttacggtcttcattctccaagctagaccagctcttttgatatgactgatactctgccatgatttatgttctttaaatgagtctattagtggtgaaatgatctcttagctttctatgttctctagttttacaactaggcatgttctttatctttaggccttttaagggtgatagtctctttccccctcttctt

SEQ ID NO: 69221 - DNA, 574 bp, Triticum aestivum
  Clone ID: PAT_TA_69221
ttcggcacgaggccttcctctccactgcgcagcggtcgatcggccgccagccatgaccccgacggcgcggcacctcgtcgacgagatcctagaggagatcttcctccgcctgcccaccccggccgcgctcgcccgcgcctcaaccgccagcccccgtttccgccgcatcatcaccgagcgcgccttcctccgccgtttcctcgccctccatccgccgccactcctggggttcgcagctggcgtaggtggcttctacccggcccaggatccccacccctccgccccgctcgcgcgcgccatcgtcgacgctgcggatttcacctactccttcgtccccaaggccaaaagctggttcggccactggcatccctgcgacgcccgcgacggccgcctcctcctggaggccagctaccggttcgatctcgagacgatcccgagccacgcggtgtgcgatcccctgtcacggagatacgtggtgcttccagccatacccgaggaaacgaccatcccgcaggagcgtctctttgagttccgctctatcctcgccccaatagccgaggacgaggacgagacg

SEQ ID NO: 69222 - DNA, 142 bp, Triticum aestivum
  unsure (1)..(142): unsure at all n locations
  Clone ID: PAT_TA_69222
ctnccctgcacctancgcgccacctccacccctctgcgccaccgcaccacctcgaaccggctaccctccccgccccacctgccccngngcaggccagccaccggatccgcccatcgcagtcctccacagcggcgcccccgcc

SEQ ID NO: 69223 - DNA, 451 bp, Triticum aestivum
  unsure (1)..(451): unsure at all n locations
  Clone ID: PAT_TA_69223
cccgccttccccgcaagttgctcccttccccgtcgatcctccaatgagcgcgttgtggttggggagctcagcagcncatggtctgaaggacgtggggaagccgccttcctcgctgacgaacgaggccccctcgaacgcccctgcacagccacccacttccctctctcccacccagagccgccctcttccccgccgacgccgncctcttccctctctcccgccccgagccgccctcttccccgcccgcgccgctctcttccccgccggcgctgccctccactcaccttctgttcttcaagcagggacggcaagtcagcggggcagaggccagatccctcacttccacctacagatgcagccgccgccatgggcaacaaataccaggttcatttacatctgcagactgcagntgcttgttcatagactaggtctaaattagtactatccctga

SEQ ID NO: 69224 - DNA, 645 bp, Triticum aestivum
  Clone ID: PAT_TA_69224
attcggcacgaggctgaactggactgtgcgcctgatgtcttctcctacagcattgtaatcaacggctgctttaaagaaggtgaagtagacaaagcgtgcaatctcttccatgagatgatccaactgggagttcaacctaatgtggccatctacacctcaattatcgatgcactaagcaagtgcggagccatggacaaggcagaagtggtccttcggcaaatggttgatcaaggcattggacccaacatcaggacatatactagcctgatacatggatattccgcttcgggtcagtggaaggaggcagttaggttattcaagaaaatgataaggcttggtgctctaccagataccgtcatgtggaactcatttatggattcactttgcaagcatagaaggacaaaggatgctagagatatttttgactccatggctgcaaagggccaaaaacctgatattttctcctattctactatgcttaacgggtatgcgaaagaaggatgcttcgatgatatgacttgtctcttcaattcgatgctacagaatggtattctacctgatcaccgtgttttcaacattgattaatgcatatgctaaacgtggactgatggatgaggctatgcacatgttccgaagtaatgaggc

SEQ ID NO: 69225 - DNA, 628 bp, Triticum aestivum
  Clone ID: PAT_TA_69225
gctttctctccctcgctcccttgcgtcgccgccgccaccgccgccgctccctcccattctcagcccgtgctctcgcctctcttcctcacctcccttgcgccaccacccgtcgggaagcaccgcggccgctgttgctccgcgccgctgctcctgagccgagctcctacgtcggcatcaccgtgaggagcatggcctgctgagacggccgtccatgtcgccgttgcggccgttcttcgcgccatcggtggattgggtgaaccctagccgcccctctctccctctctccctctctccttctcagcctgtgctctgtcctctcttcctcgcctcccctcgccgccacccgtcgggaagcgttgcggctgctcctccgcgccactcctcctcctcccggatgagtgtgccgttgcgccatcgaaggaaggggcgccaggagccaatggcaaggaggcctcccttgtgccagcccctcgcggccatgaaggacggctgagccatcaggagcggcggtggtggcctgatatggacgcacctgtggcttcccgtggtgctccacttgtgctccctcctcgtcacccaggacctggaacgcaccgacggatctcatggaggccaaacggatcccggt

SEQ ID NO: 69226 - DNA, 583 bp, Triticum aestivum
  Clone ID: PAT_TA_69226
gctaacttcccccgctccccctccccctgtttttcttctctctgcgaaaatccaataagaaatcttaaagttgtagtttcttttttttcgcgtgtgcaatcgattcatattttcctgtccgagatgcttgaatctgtctggtttcttttttaaaaggatgaacctcagaatccctgcagttagggttcttgtatgcctctgaaccactgcacccaatttgtgattcctttgcttttgaagttacttttagggttttgaaggtttgtttggtggctagacataaattcttgctcatagactttcgatttgagatggttctctaaaagtataccgcggatcttagtgctcaggcacatttagggttcttgcccttttttcatttcaaaaagaggtcgtttttaccgaacaataatctgttattattttgattttctccttttgctctttttccattgcaaaaagagggtttatttttcgccttttctattttgttttattcttctggggatggagaaagtaattatttagaatgccctcaatcgaacctatcagctcgggaccattggtgtaggcgtgtagccaa

SEQ ID NO: 69227 - DNA, 553 bp, Triticum aestivum
  unsure (1)..(553): unsure at all n locations
  Clone ID: PAT_TA_69227
tcggcacgaggtcgcacgcatagcgcgccgtcgccacggnacagtagacgagcgcgagtatctgctccggcgttatccccgccgtctccagccttncgaagccgcgagaagcagcgcctcgtccgcccccgtcgacccccgcaagctgtacgaccggaggagccgggaacgactacgtccgcgtcctcctctacttcccgaacgtcgctggcttcttcctctacttcctggacgtcgcaggcttcttcctctacttcccgaacgtcgccggcttcttcctctaccttgatccgctccggccagcctacgtcctcttcaagacttcaaccttgtgcgcgcgcccagccatgatgttcgaagaggcggtctgcaagctcgctgccgacatagcggcgatctcgccggcagtggtgaagaaggccgtggacgcactggcgcgcagcagccgtgcctgcgccgctgcggatgccttcatccacctgttcctgggcacgttgtacgtgatcgtcgcggcaattttcttcgacacggtcgcggtccgggtctgcggcgg

SEQ ID NO: 69228 - DNA, 613 bp, Triticum aestivum
  Clone ID: PAT_TA_69228
attcggcacgagggtaagccaagccccctgcctcctcgatcccatccttctccactgcagtccacatcctcctcctcctttttctacttccaatccacttcttccatggcgtgcggagaccgggtcaacaacggatgtaggcgccggcagtgccggggttggagctgcagcactacgcgcttgggaaggccgtccctttccccttcgtatcttgtgtttagtttgacaattgttacttgggaaatcagttgattctgcttcaacttttcacctgttgaatgcgattctgcttggttcaagcctttttcagaaaatctcggtcatttttcgtttaaaattcgttcatctttcgttctaaatttcaaattttgctctgtgcttttcgtccgattttttccgaaaaaaccggatttcgcccatttcgcctttgaccggtaaaaatcacaaaacgaaatctaaaatcttggctggtgttgcatgaagaaaaaggatgaagagctcttccttgtctatgagctggtgcctaacggcaatctgcaccaccacctacatgagacagagcagccaatacagtggccaacaaggtaccaaatcatcaaagacattggctctg

SEQ ID NO: 69229 - DNA, 714 bp, Triticum aestivum
  Clone ID: PAT_TA_69229
aattcggcacgaggtcttttgaggggtacccagcctgtgcgtatgctcgagctatagagaaaaaaattgttgctcactctggaacccattgatcaatcgggggaattgcagttctggtctgatggccttttacgtgctaggccagctgcttagttaatggcttgagggggaaatataaagggtgttaaatgataggaggtgggcagggctgctttgctacaaggcactaaattttcagattattatagctagcaaactacacatatatgtataaaccttggtctgcaattggtagtagtacttgtttgttactgaactttgaaattggtttgcgtaaatttggaatatgtcttgacatattttactcggccgcggttcagctgttaggtttgcttcaaaattttactttctgtgagtttcttagggcatctgattcctaacagccctctaatggaattcattatgcatatgcatttctcaatagggaacaaaggaaaaacatctattattactaggtaaaaaaacgcggatgacaaagtgaaccaaaagcaggctcgaggtttcttgtcctaagcacctgacctgagatagcttctaaaaaatccataatcagaaagggtcaaggaaaattcatatgagatcagaatacagtagggcattgatcaagcgatttatttagaggagtattttattacatgcgtgtgtagtacgggt

SEQ ID NO: 69230 - DNA, 668 bp, Triticum aestivum
  Clone ID: PAT_TA_69230
gaattcggacgaggggccgccggaggcgaggctgggagcgactccggaggcgacggcgcggggcctggccggccgccctccaggagacgactcaagatctgcaaatgtcgtttgtcaagatgatgcagacacacagtccacaatcatggtcagccctgccatcagagcttgctggtatggtcctttgtcgcctcccttcccacgttgaccgtgtgcgcttcgctgctgtatgtcaccattggcgcttctccagacaagagcatagcctgcccccacctttaccatggcttgcattccctgatggaaccttcttcggccttccccgtggagacggggcaaaagagtccttcaagctcccaatcagtgccaactattgtatcacctgcggtgactggcttgtcttctcacagaacgacacatgtttcctaatgaaccccttctccaagatcaccttgacgcttcctaacctatcttctttctgtcttgtggatgagcctgttggaattattaatggtcgtgatgtcctggatgaagacatgtctagtcctctgctacagatggatactgcgatatctctgcgcaaggtaatcaggtgctcggaactccttgttgctgccatcgttgaaattgggcctctttgcactgttgcgtactgccaaccgggttca

SEQ ID NO: 69231 - DNA, 601 bp, Triticum aestivum
  unsure (1)..(601): unsure at all n locations
  Clone ID: PAT_TA_69231
gaggctgattgcgtaaggtgagcgtactgcgagnattgcacaaatgttgtctggataaacaggtgagagttttgcgagattggtggcacttgatttgttatttgttttgagaatactctacaaagtacaaacatcaccagtttagctatttgtggttgcctgaatttataatttgggtcagtcgaatttcgcgtgaaggaaggaatagttggagggaaggaaggagctctcctggggagccctctgggtctatcttagggtggcagccggcaggcgaccctggtatctatcttagtcttgcaggcgaccccggtatctatcttaggctggcaggcgacctcattatctatcttaggggtgtggggcatggtacaggttcatcgaaaaaaaactggtcatcaccgggcggcggaagcacggcggtgggcggcggttcaggggagcgccgtcggccgcggcggcggaggcaggcggttaggcctgtgctggatcggtgagggaagagaaacaatacacgtatcggtttgaggttgaaaatgaagcattatccgttggatcttgatccaatggttgagataggagggggagaattggctgactg

SEQ ID NO: 69232 - DNA, 914 bp, Triticum aestivum
  unsure (1)..(914): unsure at all n locations
  Clone ID: PAT_TA_69232
gaacaaatccccacccaatnctcgtctccgatcgactccacgctcgtcgaatactcctcccccaccgcctcaagatgcagatctttgtgaagaccctcactggcaagaccatcaccctagaggttgagagctccgacaccatagacaacgtcaaggccaagatccaggacaaggagggcattcccccggaccagcagcgtctcatcttcgctggcaagcagctggaggatggccgtacccttgctgactacaacatccagaaggagtccaccctccaccttgtcctgcgtctgcgtggtggcatgcagatcttcgtgaagaccctcaccggcaagaccatcactcttgaggtggagagctccgacaccatcgacaacgtcaaggccaagatccaggacaaggagggcattcctccggaccagcagcgtctcatcttcgctggcaagcagcttgaggatggccgtaccctcgctgactacaacatccagaaggagtccacccttcacctggtgctccgcctccgtggtggtatgcagatttttgtgaagaccctcaccggcaagaccatcacccttgaggntgagagctctgacaccatcgacaacgtcaaggccaagatccaaggacaagganggcatttccccggaccagcagcgcctgatctttgctggcaagcagctggaggatggncgtaccctcgncgactacaacattcagaaggagtccacccttcaccttgtcctgcgcctgcgggggggcatgcnaatcttcgngaanacctcaccgggagaccatcactctggaggtgagagctccgacncatngacaacgtnagggcagatncccggaaaangggngggatttccccggaccaanaanncctgatntttgntggcaacaactggaggatggnc

SEQ ID NO: 69233 - DNA, 576 bp, Triticum aestivum
  Clone ID: PAT_TA_69233
gccatgtcgccgcccctcttctccccgctcgcctcggccgcctcctctcctccgccgtgtcgtcggccccctccctcctcctacctcctcctccctcctctcagtcctatgccagccgccgcccaaacccgagcccccgtttccctcgatccccgcagtaaccgcatccacagccacccgctccttctcacagccgtcgcaccattcctcccttccgccccctcctccttcccggatccccaccacggtgccgacctgcaggcaaagggcgatgaagagtggcagacgaggacaacgagggagagaaagaagggagataaaaaggaggccggcggcgaggcccatcaccgccaccagatccacctcgcaatctctcttactcccctgtctgactgttgcatggtcgcgtcaggcccatgtcggcgccgccgccaccgctggatggctctgtcggtccctcccgctccaaatcgaaaactgagagagcgacgggagtgaagaaggggatcgggggaggggagatcatgggagagaaggcgagctcgcggctgactggattcaattgcatgctctgtt

SEQ ID NO: 69234 - DNA, 613 bp, Triticum aestivum
  Clone ID: PAT_TA_69234
acgaggcgccgatccaaaaatcctctcggcctccaacccgtagccctccacctctcgatctctccccaccaaccagcgcctcccctggatcccctcatccatctattgcggccgccttcgtccgcgaccataggagcaggagctcctacagccgctagcacccgaggcctcaaccacccgagcaccggccggccaccggagcaccaccaccggcgaccagaaccaggccgtcccctaccttcccttttgtctcccatctctctttcttgctgcctcctcctcaccacttttcgtgctgcttcaggggctcgccatggatttggagcagcgctgccccgagctctgccttgctgccgttttgcacccgctccagccaggaaacggacggatccgtcttccctgcgtccgtcccctgcctctccgccttgccggagtccaagacatcgccgaacccttcgctgcttggagcctcggctcacaccgcccgggtcccgcatccccgccggacctccccagcttgtggagccccaagaccccgccgccaagccagccgggaacccccgaggagcgccgtcaatcgtcctcgttctccacacccggattccgtcatcct

SEQ ID NO: 69235 - DNA, 620 bp, Triticum aestivum
  unsure (1)..(620): unsure at all n locations
  Clone ID: PAT_TA_69235
gcaccacacgccatgagnagcccccgtgcccgatccctttcctcctcccgtcaaccctccatcgctcgccgccccgcctccaagtctgccgccgccgagcgccgccctccactacctccccgctaggatccctcgcaagatcctcctcgtcgtcttgcctggtcgctggcccctgctccacctcgtcgctgcttcattctctgccatcccctgttcgtcatctgccaggagcgccaccacctctcttcgttgccgccaacaggagctccaagcgccatggccgctcccttggtgcttcgagcagcgcctcacctcctccttccggtggcctcagcctcgcgcgacgcgccttacgggagaggagctccccgcagcagcgctcgaacccatccagccacatccacctgagctccctgccacgccgaagtccttccgttcctgcgcctccatcgttcccctgttccagcgaagctgctatcgacctcgtctctctgcgagggagacgagccctcgctcgttgacctcggcctcctcaagcccggcgccgccaccgtcccctgcttttgtcgtgcgagtatgcgaggacgacgaccggcgccaagtcctgctcgagcacccgc

SEQ ID NO: 69236 - DNA, 635 bp, Triticum aestivum
  Clone ID: PAT_TA_69236
gggcacaagcactacgagctcatgctcacttgcagctcggcatcaggcattcagttgggaagcaaggtccggttacgcttgagctgaaaccatcggcattcgatcccaaggaaaaagtgtggacaaagttccctcaggaaggctcgaaacacactccgcggcacaattcttgcgacttcagatggaaggattactgcccacaggacattgcgcaagttgttcaaggtcgatgctgctgattacatgttatccctctgtggaagcgaggctctccgggagctctcgtctccgggtaagagtggaagcttcttctacctaacaaacgatgaccggtacatgataaagacaatgaagaaatcagaagtgaagatgcttttgaagatgcttccagcttactacaatcatgtccgtgcgtttgaggatactctagtgactaaattttttggtctacattgtgtcaagttagctggtgcaaatcagaagaaggttcgctttgtcataatggggaatctattctgctctcataattctatccataggcggtttgatctgaaaggctcgtctcttggccgcacaactgacaagccacaaactgaaattgaccagtatacaactctgaaagaccttgatctaaa

SEQ ID NO: 69237 - DNA, 599 bp, Triticum aestivum
  Clone ID: PAT_TA_69237
gtctgtatatacaggcatacatacatacggctgagctcgatcccctccggtccaagctagctagcagggtgggagagaattgctgggcgtggccgggagctaggcagagctcaaggaggagggaattggccggcggggagaggaggatggggatgcggcctgggtgggttggcggcctggtggaggagaccttcttcgtggcgtgctcggcgcacgagagccgcaagaagaacgagaagaacatcttctgcctcgcctgccgcaccagcatctgcccgcactgcgcccccgcccaccgccaccacccgctcatccaggtgcggaggtacgtgtacaacgacgtggtgcgcctggacgatcttgagaggctcatcgactgctcctttgttcagccctacaccatcaacagcgcaaaggtgatatttctcaaacccaggcctcagtccaggcctttcaagggctccggcaacgtctgcttgacctgcgacaggatcctccaggagcccttccacttctgctgcctctcttgcaaggtggatcatgtcatgatgcagggcggcgacctgtccaacatcctctacatgtccggtgagcccgac

SEQ ID NO: 69238 - DNA, 590 bp, Triticum aestivum
  unsure (1)..(590): unsure at all n locations
  Clone ID: PAT_TA_69238
ggnctgcaggnaattcggcacgaggcatggagctctgcgccggcggcgagctcttcgacaggatcgtgcagaagggacactacaccgagcggaaggccgccgagctcgccagggtcatcgtcggcgtcgtcgaggtgtgccactccatgggcgtcatgcaccgggacctcaagcccgagaacttcctcttcgtcgaccagacggaggaggccgcgctcaagaccatcgactttggtctctccgtcttcttccggcctggtcaaatattcaccgacgttgtcggaagcccctactatgtcgcgccggaagtcctgaagaagaaatatggccccgaggcagacgtctggagcgccggtgtgatcatctacattctgttgtgtggcgtgccgccattttgggcagagaacgagcagggcatattcgaagaggttctacacgggaaactcgacttcgagtcagatccatggcccagcatctccgaaggcgccaaggatctcgtgaggagaatgctcctcagggaccccaagaagagactgactgcccatgaagttctacggcatccatgggttcaggttggcggtctggctcct

SEQ ID NO: 69239 - DNA, 584 bp, Triticum aestivum
  Clone ID: PAT_TA_69239
gcctagcctccctcggtccctcctctcccttcgctcttgcagcggcccgcctcccacatcctcgcaccgcccccgctgctctccctcgcgctgccccgccgcccctgccgctctccttgcgtcgtcgcctccgcttgcctcgccatcgctccctcggtgcttagcagggggagcgcgggtcaccgtcggctctcgcgagaggtcacctcccccggtcaactctggccacctccaccaccacacactggcaggagcccaccgccactcatccttctcctccatcgcatggtcatcaccgggagggggagtggctctgcctggaggcgtcgctatcggctggaggagcgccggaccatcgtcttagggttcatgcacctctgggaagaaggtgaaccgaggtgagtcgcctccaatccattgtgcgaagtcagcaggggctggatcccaacgggcaaagatgcactcctccagagctgctgggaagaagaagaagaagatgggtaaggtcctcttgctcttttatgttgatttagcagacgaaaaaaataggaagaaaaatgcagatctatgtttactcgaaaaag

SEQ ID NO: 69240 - DNA, 665 bp, Triticum aestivum
  Clone ID: PAT_TA_69240
ttcggcacgaggctgaagacgaactgaaggagaagcatgccaacctgaacggtgaggttctggacaatgatcgcatgttatcaccaagcaatgatggaccgatacgaatgaacactggaaatgactcagcaatagtcgaagagaattctagccccatgcaaaggggaatggtgcttccatttctcccgctttcactcacctttgacaacatcagatactctgttgacatgccactggaaatgaaagcacaaggcgtagttgaagaccgattggagctcctcaaaggtgttagtggatctttcaggccaggggtactgactgccctgatgggtgtcagtggtgctggcaagactactctgatggatgtgttggcagggagaaagacaggtgggtacattcaaggaaacatcagcatttcaggatacccgaagaaacaagagacctttgcacgcgtatcaggatactgcgaacagaatgatatccactctccgcaggtgacagtctatgagtcgctgcttttctcagcatggctccgtctccccgaggatgttgattcaaacaaaagaaggatgttcatcgaggaggtgatggagcttgtggagctcaagcctctgaaagatgcattggttggtctaccgggagtgaatggtctgtcaactgaacag

SEQ ID NO: 69241 - DNA, 508 bp, Triticum aestivum
  Clone ID: PAT_TA_69241
cagccccctccatccaccagcgcctcctctgctcgatcccgagggaatcacgagcagctcgccagcggctactagtagcagtaccaccaggaccccatcgccctcacctaccccttcttctcattccctgccttctactccctcctctgctctaatccctctctctccttctcctgcttccgtaggaaccaaaggagctcttccccgatgccatggacagggcttgccaagtcccaagccgccccggatctggaggggatcacctcctgtcgacgccctccgccacccagggacccgccatggccgccccttggtgcttcgtgtcacgcccaacctcctcctgtgccgcccatgctccttccccagcagcgcacctcgacgcctcctcgtccccgcacagcctgcgaggcacaccggcctcctctgcttcgtgcctcccgagcagcaaccaggagcacgagctcctccttccacaccccgcggccgaggaccccaactccggcgtcca

SEQ ID NO: 69242 - DNA, 616 bp, Triticum aestivum
  Clone ID: PAT_TA_69242
gggtcgatgttgtagatgcctttttatgggcatcgtgcagcggattgcagagacccgtttatgtgctctcggtgccttgagaatggccaccgcgcgcgcggatgtcgcaatgcgtggcgtccgctcagcttgttggcaagtcttgccgcatcgcctttgacatgtcccgtcgccgagcatcgtgaagctccagctccttgccaggcccagatagaagccccaatccttcccaagacgtttcgtcgcgattcttgggcatccattgtttctgctcctgttgcctctgtggccatggcagatgtgtcattgcggtccaccatggagggacaagcggagctgctgcgctctgagctcctcaacatggcttcctttcgactcgaggaaacggttcaacctctgcgcgatgtcattgactccatgaaaggttggatgcttcagatggggaactttcttgagcgagctgaggctgttctgagtgggctcttgcaggtgtcacctgtgttgcaaactgctcctatgcagcaccccctgattgtgcctgatgtcaaccttgaggacgagaatggagatgggcttcatggacgtttctctcctcgtgctggggttggatcaccgt

SEQ ID NO: 69243 - DNA, 112 bp, Triticum aestivum
  unsure (1)..(112): unsure at all n locations
  Clone ID: PAT_TA_69243
aagaaagataaatatatttgtactccatccgtcccatantgtaaaatgtcnntttaacactagtgtagtgtcaaaaaacgtacttatattatggggcggagggagtaggtat

SEQ ID NO: 69244 - DNA, 529 bp, Triticum aestivum
  unsure (1)..(529): unsure at all n locations
  Clone ID: PAT_TA_69244
gctgcacttctcaaacgtgaatacccgtccttatnaaggagaagaataaggaaggtgtggaaatcaagcgtcatgcatcttcttgggaagattattacattaacaaggttactgaaggtgaaaatattggggaagcagctgcacatcgtttgatgcaggagttttggagtatatacaaactagttgatgattctcctgcccaaataattgaagttgatcgtattcttgaaaattctgcaaagagacaatttaggcagatgtggtaccaagcccgtaaggaagccgtcaaactgtactataaggatattgttaaggagcccatcaaagatcatgaagcatgtcaaaaagagcttaccaaaaaccaatacatgcaagctcagctttattggtgcattgatcatgaagtgtgggaaagcatatgtgactattggtgctcctctaaattcgaggggttgcggaaccttggccgagtgtcacgcttcaagtcagaggatattgcacaaaatcggggtggttcacgatcatttgt

SEQ ID NO: 69245 - DNA, 579 bp, Triticum aestivum
  unsure (1)..(579): unsure at all n locations
  Clone ID: PAT_TA_69245
gcagcgccccttccctcccccctccctcgagncagcgatggcgcccaaggcggagaagaagccggcggcgaagaagcccgcggaggaggagcccgcgacggagaaggccgagaagccccccgccgcgaagaagcccaaggccgagaagcggctgcccgcgggcaagaccgcctccaaggagggcggcggcgagaagaggggccggaagaagggcaagaagagcgtcgagacctacaagatctacatcttcaaggtgctcaagcaggtgcaccccgacatcggcatctcctccaaggccatgtccatcatgaactccttcatcaacgacatcttcgagaagctcgccggggaggccgccaagctcgcccgctacaacaagaagcccacgatcacctcccgcgagatccagacctccgtccgcctcgtcctccccggagagctcgccaagcacgccgtctctgagggcaccaaggccgtcaccaagttcacctcctcttagattcagtctctggcagctgtagttgggtgctgtttgcccagaattagtgttgctcaatggaaatcggtggaatatcgttt

SEQ ID NO: 69246 - DNA, 359 bp, Triticum aestivum
  unsure (1)..(359): unsure at all n locations
  Clone ID: PAT_TA_69246
agaagggccgntacgcccagcgcgtcggctccggcgcccccgtctacctcgccgccgtcctcgagtacctcgccgccgaggtatgcgccgatctctccactcctcgagcctctgttactctgttcttgccctgttcgacggatggctgaccgatctggttcctggttgaattctcaggtgctggagctcgccggcaacgcggccaaggataacaagaagacccgcatcatcccgcgccacctgctgctcgccgtccgcaacgaccaggagctcggcaggctgctcgccggcgtgaccatcgcccacggcggcgtgatccccaacatcaactccgtgctgctccccaagaagtcccccgc

SEQ ID NO: 69247 - DNA, 520 bp, Triticum aestivum
  Clone ID: PAT_TA_69247
gctacttgtggcgcagggcctcgaggtcaccgtcgtcctcagcggggtcggggacgccgacgacctcacaaggatcagggcggccaacccgtcgctgtccttccactgcctccccacgcccatgcttccatccgccggcgccgatagtttcgaggctaaggttttcgggctcgcgcacgcctccctcccggaccttcgtgacttcctccgctccgcctctccggctgctctcgtcatcgacttcttctgcgccagcgccttcgacgtcggcgccgaactcggcattccgacctacttcttcctcaccacttgcatctccgtcgtcgcctttggtctctaccagccagccatggatgagcagaccactctgagcttccgggacctcggcggcgaccttgtgcacgcccctgggttgccacccataccggcagatcacctccccgcgttcactctcgatcgcaacagcttgagcaccaagttgttcagggacgtgccccaccagctgtgcaactcacaagga

SEQ ID NO: 69248 - DNA, 154 bp, Triticum aestivum
  unsure (1)..(154): unsure at all n locations
  Clone ID: PAT_TA_69248
ccacgctgctgctncttcttctgctcatcagccgatccccttttccccatcctctncctntctactcctaactgtngatcgaggnccgtcctcatcagccgatnctctttnncccatnctntccntctctactcctaaccntagattgaggtcc

SEQ ID NO: 69249 - DNA, 635 bp, Triticum aestivum
  Clone ID: PAT_TA_69249
tcggcacgaggctgttatgttcattttttccttccgttcaagcaaatcaacagtccaacaatgcaaagggaagcgaaccaacatggcgccggcgcgaggaatacgggcggatccgggggcggcagcgaccgatctggctgctggtgcggcggtttgttccggtggcggcggcggcgtcctgctcattcatagaaagagagacagggcgtgagggagagaggaagaaaggagaaggagcagggggcgcagggtcagggaggctgtcgctagcggtggcggctccggcgaccggccggcgggcttcccaggcaaggctaaggagtacgctagcctgagattcaatagaggtatgtttgatttttagaattgggcttaacagcctgtttgttgtgcttcatcttctgaattggaaaccatggcgtgcctgaatattttttctagaacatggtgcttgagttggtaatcattcgtgggtgatttatcccatatactgatggatcatcctttggagtgcatgacttgaatggatttctgaattccaaacagtatgctctcgtgatgtttgattagggtcttctgtgaatccgtaccaaaaccatgcttgtattttcttgttccctctctctaatccggga

SEQ ID NO: 69250 - DNA, 564 bp, Triticum aestivum
  Clone ID: PAT_TA_69250
gcctctctctctaagcggccgccacaacacgaagccacaaaccctagccccctccttctcccttgcatgtgtgctcgtcgccgccttcccccctcttccccatcgttgcgccaatgcctccaccggctacaatggatccatggctgatgggtgggtacgaggcagcgaaggacgccgtcctcgacccatcgcttaggctggtggagcacatgttaggtttgggcgcaaggactggcaccggcggggaaaagcgtcgggggttgatgcagcggcaaatacgggcagggtcggccgcagagggaggctcgcggtccggagcagcagcagcaaagaggcaggtcggccatggaagggtggctcgccggccggagcagtaggagcaaggaggcggggtcgaccgtggaagggaggctcgctggcagaagcagcaggagcaattgcagcaggtgctagtcggcccgacgcaccgtgtcagcctcgccttcttagttgcggcccacacgctcgagaggggcagctgtgccgtcactggtggcaagttcagcggacgccacctcctcttct

SEQ ID NO: 69251 - DNA, 145 bp, Triticum aestivum
  Clone ID: PAT_TA_69251
ggtgatacgtatgaagattattttatacatattttcggccacacaagtctcaggctctagttatttttggcaccatgtaaacaagaatgtacacttgtcaaaaaataaaatagtatacaacattttttgtagttcaaaaaaaaaa

SEQ ID NO: 69252 - DNA, 458 bp, Triticum aestivum
  unsure (1)..(458): unsure at all n locations
  Clone ID: PAT_TA_69252
ggttgctccttcctttcngccncaacccacgcctccgcccgccatgccgccgccgccggcgacgctgccggacgagcttctcgaggagatcctcctgcgcctcccgccggaggaccccgggtgcctcttccgggcctccctcgtctgcaagccctggcgcagccgcctcaccggcaccgccttctcccgcctctaccgcgagttccaccggacacctcccttgctgggattcttcgagaacgatgagacggtactgtgctatttttctcccttgtcccccacttcccccttcttcccggtgcaccccggcaagtgcagtctcttcgtgctcgactcgcgccatggactcgtcctctcaaatactatcggcccgagcggcgaacccctctgcctcatcgtgtgggacctcgtcggccaccgccagtggcggttgtccttgccggatttcgtggactggc

SEQ ID NO: 69253 - DNA, 670 bp, Triticum aestivum
  Clone ID: PAT_TA_69253
gctccgactctcctcccccaatccccacccaaaaccctcgcttccacttcgctccgccgtccacgagcgcaccatggcgccgtcactcccgcctccgccgctgatcgaagacgtcaccgacgagatcctcctccgcctcccgccggacgagcccgagcacctcttccgcgccgccctcgtctgcaagacgtggctccgcaccctctgcgaccctggcttcctccgccgctaccgcaccttccacggcacccctcccctcctcggcctcctccacaggctccaggtcctcgaaggaccccccgcgcgtcgcttcgcctctaccacatcggtgccggacttcccccacccgagctccggcgacccctgggagcgcgccctcgactgccgccacggccgcgtcctcatctatatgaggacggacgacaatgcggactacctcgtctgggatcccgtcacgggcgagcgccacggcgtgccctcgccggacatcgattggctcatcgagtctgcggtggtgctctgtgccgccgacggctgcgaccacctcgactgccacggcggccccttccgcgtggtcttcgcggccacccacgactacaaagataccatatttgcgagcgtctactcatcagagacgggtgtgtggagcgtgccagtgtgtcttgacaag

SEQ ID NO: 69254 - DNA, 325 bp, Triticum aestivum
  Clone ID: PAT_TA_69254
gggcaaccgcatgtcgtgcgtacgatgatctatgtgcagttcgactgtggggatccacgagcacatagagcagaatcagcagaacacgcaaggttttaccagttttaggccgctgtgaagtgtaaaaccctactcttgctttgtatattggctgtgtttgagctcaggtaaggagtgcaacttgtggcaaagtgcgtgggaagtgcagctacacgtgtaattgaacaaagtttcgacctttgtaaaggtaggcacgagcctccttttatagatgaaggggtcatcataatggcaaaaccatcttttacataaggtaaaaaaaaaa

SEQ ID NO: 69255 - DNA, 493 bp, Triticum aestivum
  unsure (1)..(493): unsure at all n locations
  Clone ID: PAT_TA_69255
gctgcaggcaacagcaaactgttagtgctgatagtngaatattcagacaatgctgaactcaagtgctatccagcaccaacttcaacagctccagcaactgcagcaggtgcaccaggtgcagcaggcgcagcaggcccacattgatcagaagcagaagattcaatcagatcaaacatatcatgttcctactagtgcgtctctcccaagtccaacgtcgctaccaagccatctgcgtgaaaaatttggcttctctgatcctaatgctaattcgtcaagcttcaccacttctagcagcagcgacaacatgctggaatcgaacttccttcaggggaattcgaaagctgtgaacttgtctagattcaatcagccagtagctagcgatcagcagcagcagcaacaacagcaacagcaacagcaggcttggaagcaaaagtttatgggttcacaatcactgtcttttgggggctcgggtttgcttaactcacccacaagt

SEQ ID NO: 69256 - DNA, 518 bp, Triticum aestivum
  unsure (1)..(518): unsure at all n locations
  Clone ID: PAT_TA_69256
ggtgggtcttagnatcccgacacgcaccgcgcttgtctgccaccaccacctcctctcgcgctcgcaggagccgccccaacgcgagctacaggacgtcctgtagatggagacccgctccgctccagtgtccagtctccggtgccgcaaattcgccgggtcacgacgtgctctgttgtgtcctgcacacaatcccactctgccgatttactcctacaagagaagaacctggactttgagcccgaggtgagtcagatctcgtgtctcctttggagattgggctccactcagtccagcatgtttaggaggagctgctgttgagatttctaagattggtggtggtgtcctggcggcgttcgcattggcggggtaccagagagaccccagagaggagaactgggtgattcttcaattgtttgtttgatggatgtttccacaatgaaccagaaaaaaaaaacctccagtttgactaaaatgcaaaaaagaagagaggacaggctgatttatactagtaatttcca

SEQ ID NO: 69257 - DNA, 503 bp, Triticum aestivum
  Clone ID: PAT_TA_69257
cgcctcccctgtccctcctcgattccccaccaaaccacccaatccatcaattgaaccaaccaacagcaacgctggatccccctcatccccaatcacactcgatccccctcctgccctacctagcgcacactatccaaggagaggaaatcctcctcgcgcccccgaagaggagtttcttctggagctcctcctgtacgctccctctactcggccccgtcgtcgtttcgccgccaccgacaagctccggtgagcagcgggccaaccgcgcctccttccctgccctctccctctctctgcacctgatgctcgtaaccccgtcgcatctctgtccaggagcaccgacgtccacagccgcagtcccatgcgcctccatctgccgcggccagccgagcctcccccgccgcctcgccactccggtgaccacctccagcaggagcctcgagggcgcttgttgtttcgagctccaagccccggacgtcaagtccccgtccgtcgctgtcacg

SEQ ID NO: 69258 - DNA, 653 bp, Triticum aestivum
  Clone ID: PAT_TA_69258
ggtaaagcaccatatcatatctttatcggatgaagagaattttgccactgtcttaaatgggcgtatatgcaattctttcccaaataagatacgtcgtctgtccatgcaatctagtggcaaagagcataaaggtgcagttggggcaattagagagaccaagatgcatattcgctcattgactgtgtttgagctgcataagccgatagtaccccatcttgtggacttccatgctttgcgggtgttggatcttggagattgtatttggttggaaaacaagcatgtaaaagacataggaagttcacgtcagctaaggtatttgcgaattggccattctatgattactgagcttccttgtgaaattggaaagctgcagcacttggagactctcgatttgctatactgtaattcacttccaagactgccatcaacggtgacgcagttgcggaaattggtgcgcctatttgtcagcgattacacacaattacatgcaagtgggttccggagtctgcaagccttggaggagttaggcttcgtggaaactgacgacccagtgagattttcggaggaagtaaatgagtcgggcaaatgcaaccttcgctctcttcgtactggtggagagatagccgagcgtctgttctgtaactcatgctgca

SEQ ID NO: 69259 - DNA, 581 bp, Triticum aestivum
  Clone ID: PAT_TA_69259
gaaaaagctcaactggctggtgcgtgcagttctacagggaacgccttgggctggaccaggatgtggtctatgggactcgtggttgggctcgaccacatccgcatctaaagaggaggcatgcccaacaacacaagaagcgccatgcgcctcgaacgagggttgggccgattagccaggtcaagtggcaggtcaaccgagcccaccaccagaacctggtggtgcacctattgaggcctcatcaccaagtcagacctaggaggactccgcccatcagacagttctagggagccatgtgttgaagatttgcactagagagcactatcattgtgggccatcgccgccatgcttggccctcccaagcccatccagagggcgtccttgagagccattccccgtggcaacgacgctgccaccccccttgcaatacgccagtgtcggagtcggcaataaggactagatcaaggaagtaggcacgagagagaatgagaagggtagtacggagccgaaaccgtacgagaaccattggggctcaaacccacatgaaccctgagaaaccaccatcggcatctgcattaatgcgg

SEQ ID NO: 69260 - DNA, 627 bp, Triticum aestivum
  Clone ID: PAT_TA_69260
gagaaacctcacgaccgaggctaccctcatctattcgctacaacgacggcagccatgccgccgccgccaccgcgatccctgaaacgccgccgatctattcgctacatcgacggaaatcaggcgctagccacggatccctttgccggcgccgagcagtcatcgaggagtcggcgccgatgtcctaaaggaggcgccgccaccatcgttgcaggcctccaggtcgccatcgggacaccgctgccgagatccgccttcgccttcgtccggcagaggcggcggaaggcagccgggaggggaagcgcacaacgacccggaagacatccgccctcacgcgctcatcgtcttgttcgatctacccgagggctgccgatgggcgcctcggcggcggccacggcgagatctgcgtctgggacgtgacaatccctccaccccggtcgccggtgagatttcactcccagtttatcaggtcgtccctgacaaagagatgctactgccgggcacgtgcacgcacgtggggcggccgcctgcgagcggggccgcgtcctctctccttcgtcgaccatggcctccgaaccactccgttgagcggtacctctgcgcccaagtgtccgctcctcgatcttaaac

SEQ ID NO: 69261 - DNA, 207 bp, Triticum aestivum
  unsure (1)..(207): unsure at all n locations
  Clone ID: PAT_TA_69261
gcatctgtgtacatcaagnattgctaattgccagctgaagggtgatagtaaagcatgaagatgcctaagcttatgaggaagctgcaaactgcgaccaaaaattctcacttcagggtactctctcgatctctcgatctcaaagaggaaacgaggcagccacggcctccttgcccccccccccccccntttttncntttttnccggncc

SEQ ID NO: 69262 - DNA, 599 bp, Triticum aestivum
  Clone ID: PAT_TA_69262
gccttcccctcgctctatcgttcccctcactctctccactcccgcacacgcaaatccctaatctcggccgagtcacccactccactccctccgctgtcgcccccacagccgccacaaccagcgaactcgtctcccaccactaccccctctcgtcccctcccctctactcatccgacggcgctgaccgcgcagatcgagcgaccaggcggcggccacatgcgcacacaaccggcgaccaacatcacgcaaaggtcaccaccgccgtcgccgaagggcggtcttcttccacctcgacggacgagcttgcgcgccaggagaggagcggggatcctgcgcttcttcctcgctcagcgcccctgtcgccatgccatggatggacctccctctgctctcaccaaggccatgtaccgagcttgctctcctcctcgagatattatcctccaagctatatgatatggacaacacatgatttatggaacgaaaagagccgagcatagtgtgctgccgcgccgtcgatttccacgaagtagccagcccgagccgattccccaatgtgtcaatgactacggccgctgcgtgatcctgtgggacatgaccaa

SEQ ID NO: 69263 - DNA, 283 bp, Triticum aestivum
  unsure (1)..(283): unsure at all n locations
  Clone ID: PAT_TA_69263
gcgcccgcccgtgatccctccgcctctgccgcatggcccccgcgcgggcctctttctcctctgccccgtgcgtccccggcgaggaggagtgctagtagtttatagcttttgactcctccgtccgcttttcctctcttttcttccggcttcgggttccctcactcccatgccgcctcgccacaacgccgccagctttcctgtgctctcctcccccttccagtgagagagagagagagagagagagagagagagagagagagagagagagagagagcaaaanata

SEQ ID NO: 69264 - DNA, 649 bp, Triticum aestivum
  Clone ID: PAT_TA_69264
gcctcgtgccgcaacagtgttgatgttcggcttcagaagaaggcagtgtttttaataactgacctagcagactttcagctaaattctggaagctcagggctcgcattcttaagtgaacgtgtttttctgaagtcagtcactgatatgttatcgaagtttgaccttgaccttcaagaaaaggtaagatcagtgtctccttcagttttgtagccattatgattactattggttaccagttcatagtctgctctcttaatgacagttgttccttgtgtggacttgtcttgccatttggtgcatgaatatgcatttttagcgcttgacagtattattagtttaatacgcatggattttattgttcaatgctatttatgctctcagcaagcacttgacaagaatgttgtagaaaggcaagtattcctacacctgtcaaggaatgaaagtaacgactaagtgcacttgacgaaatttccgaatgccatcagtaagacctgcactgctacatgttcggactgacattggttttttctgcaggttttgttggccattaggagtctgctgaagcttccctcgacggacgccacggacttggagtcatgcggcctagacagcgtgctgtacagactgggggtgcagctggaggagctgc

SEQ ID NO: 69265 - DNA, 572 bp, Triticum aestivum
  Clone ID: PAT_TA_69265
gcccacctcccctcctcccccgatccacttcctttccccgccggcgccgtccttcttccctcgccggtgctttcctcccccaatccatcttgttcgccttccccaggcatcgccgaacttccctttcggctcgatctgcagcgacgcggacagccagcagtagggcgcgccgcccttaccctcccctcgaatttttggggcaccaacgacccagcgcgatatctggcggtcgggcttggggtggaggccaccgccgatcccctgctggatctctttccaccaatatacggcgacctccccctcgatctggtctcccgtccacaacgcctttgttgtccacctcgactgagccgccgtcgacgtcgtctgattggtcctagtggacgccagccaccacggcatcgggacggaaccccctcctcttcacactcttctccatggacggctgcgcagtcaccatctccagcgtgcggtttcagcagaaggatcccggggagcgcctctctctcttaccattgtggcatttccgacacaggggcttgcggaaatttttgtgtaatttttttcagatt

SEQ ID NO: 69266 - DNA, 589 bp, Triticum aestivum
  Clone ID: PAT_TA_69266
ctgttatttacttgcttgaggactatttgagacaagttaatcttgagctacgaggggaatggccactgctagtaaaagctaatttccgcgagctgtgttcattcaggcagtttgattcagattctacattatgcttgttcccttggaatccagggggttatttgttcagaataaccacagggtttcttacttctagtagcggttcacaatggcatgttatgtgtatcattgcggagtccagccagcgcttctctcagattgcaaaaagtgattgcttgtttccaatttgtctgaaggtgatgatgcggtgcttggttctactatcttctgctgacattgattatgagctgcggcatcgaccagatcaaacaaaagatcgtggtgtgcttgcgaagttcagaatattgcatatttttctagttccttcagtcaagctgcaaccatggccttcctgcagatatacattcacacattttgagcggcagttctttccccaattacctttccctaggactgacaaaatgccagacacaaggcgacacatgaacatttcaatacagtggcagcacctggacattatgctagttct

SEQ ID NO: 69267 - DNA, 472 bp, Triticum aestivum
  Clone ID: PAT_TA_69267
gccttcgtgaacctcacccacccctcggtcgaactcctcttctcccccacgatctcgtcgccgccaccaccacccacgctgggacgagacgggtcgccgccgtgtcccccttcttcttcttcttcttcttcttcaccggcttgtcccccttcttctccaaggacgctgccatctctccttcttcttctctgccgccgccgccttctcccccttctccttcttctctggcgccgccgccttctccccttctccttcttcttcggggtggctgccttctccatctcacccttcttcttctttggggtggccgccttctcccccttcccctacttcttcggggtcgccgccccccacgtagctcttctcgggatctggagcagagccctcgccggacccggtgggggaggcgaccatcttaggcctcccaggcccgcacttggcaatggagcctggactcgcggtggtagcggcg

SEQ ID NO: 69268 - DNA, 270 bp, Triticum aestivum
  unsure (1)..(270): unsure at all n locations
  Clone ID: PAT_TA_69268
ccgacacaccagcagctcgtttattattagtatgagactatcaggtgcccctgtaaaccaaaacccccaaagggccatctcggtgtgaccagagcgccacaccaactagtatcaaatattcagtgcgctctctctttctctcgatctttctgtcgcaaactccagagtccagacacacacgtacgcaaccatgcctagaaccttcgtgatcaccgtcttcgncgccgcgatcaccatgctcgccaccatggcggnggcggacacgccggc

SEQ ID NO: 69269 - DNA, 556 bp, Triticum aestivum
  Clone ID: PAT_TA_69269
ggcgaagttaaagctgctagtgatatgaccggattgctcaatatacttccatcaaaagcacgcctaatggtggataatgatgcagagcaatcatcattcacagaggtcccatgtggtactcttgctgttggggactatatgttagtgctgcctggggaccgcattccagccgatggacttgtgaaagctggaagaagtacagttgacgagtcaagtttgacaggtgaacctatgccggtaactaagattgcaggggcagaagtatcagcgggaagcattaacttaaacggtaaactgacagttgaagttcgacgacctggcggtgagactgtcatgtctgacatacttcacttagtggaagaagcacagacaagggaagcccctgttcagcgattagctgacaaggttgccgggaactttacatatggcgttatggcgctttcttctgctacctttatgttctggagtatttttggttcacaatttgtacctgctgctatccagcagggaagtgcaatgtctctggctttgcagctttcttgcagtgttctggtaa

SEQ ID NO: 69270 - DNA, 673 bp, Triticum aestivum
  unsure (1)..(673): unsure at all n locations
  Clone ID: PAT_TA_69270
ggcttaacgaatnaatcatctatttctgcagtgtccaacttctttcgacaggcagtccttgcactttatttctgtgggattcaagtggttactttgtaactaggcatgtttttagaagaaaaagacatggcatggaagatatttttgcatctctgacttgagaatggaatgcaacgtagtccaaatagaaagtagaagttacaaagtaaagcatgataagtagaatcaaagtctgctgccaattcttgttagttccaaagtaaagcatgataagtagaacaaaaagtctgctgccaattcttgttagttgtgcaaaatgaagcagataaatatgctcttctaaagattctttatgcttcggtttgcttctgaacttccattagttagcctgttaggttttattcccttcttttttgaaacttagctggtagattggctagcggaagacgtagccagttttttttccaatcttgtattgtctaagaaagctaatatttcaccgagtggcaaactgtatacagttttgtgacagatgcttcatcatcatctaagctgtataatttatgggcagtaattcaaatctcaaataagcagtaattaatctgatcacatctaagcagtatgatttgaacattctatataacaagaacctctcttctttggtatgctaatg

SEQ ID NO: 69271 - DNA, 552 bp, Triticum aestivum
  unsure (1)..(552): unsure at all n locations
  Clone ID: PAT_TA_69271
gatgcgaatggcatttgatngcagcaacaagatttggttgatgctgcgtcaaaagctttatcctatagacaagacatcatcgaagagaacatccgtctgacatacgcattgcaggcagcacatcaagagagatcaactttcgtatcttctttgttgcctattctgtcagaatataatctgcagccttctgttcatgatgctcaatcaattgttggcaatctcaaggttttgtttacgcatttgcaagagaaactcattatttctgaggagaaactgaaggaatcacagtaccagattactccttggcgtgccgaatcttcaaataatacaagtggtcctgcgcagtcacctcctcctggaaatgcattggttgcttctagccaacccagccttgacattgtgccccagcaaccatattctcatgtacaatctccaatttcttcccccgttcgagctagacgggattgggatttactggcaaatgacaaccgacaggtcatctcagccgaggctgctgcaacaactacagagcatggcaatgctggaaggacc

SEQ ID NO: 69272 - DNA, 664 bp, Triticum aestivum
  Clone ID: PAT_TA_69272
gccccacccttccaacctcgatcttctctccgtgtggagctggtggcagacgtacggccgaggagatgaagcaacggcggcgtgccaccgccacctccgatgcacagcggccacggcaccatcggcacaagattcgcgtgggcagcccagccgtcgagcaagagaggcctaccaacgaccggccagattagagttcccgtgacccgtgcaccgacggaagaccctggccccgcctcctctgaacgtcgcagttcttctccacgaagattgtgcccttcatagtctgacggggcggtcactgttgtcaacatcttcgtgctcttccttcacgaggaaaatagcagatggtgtcgtccatggcgtcgtccccagctctagcacgtcggagatgacgggccaccagtcaacacgagctctaccatggtttatggcaaggagaggagaagtggtcgttcgggttctgcgagaatgacaagtgcaggtaacttggaaattccggatttcggtcttcatatttacattcgagaggaaaagaagtgttgcacggtcatattttatttcagagttaatattccataattgtatgatgaactgaacctgaacattgaaagtggcacttgcaatacactaattttcagttttgcttgatactttatgaaagaat

SEQ ID NO: 69273 - DNA, 593 bp, Triticum aestivum
  unsure (1)..(593): unsure at all n locations
  Clone ID: PAT_TA_69273
ggnctgcaggnaattcggcacgaggagaggttgctaagaaggactttgagnaatcttcggcaagatagtgatgccagtgaaccagaaccagaaccattaccagaaccggaaccaaaaccacagcgtcgaaggggcaggcctccaaagaacgctgtcaagcagcaagttgagcagccaccagcagaacgtgctaccgcaaacttttctgcggcggcacttgctatggctggaaatagtggactttatgcgcactcagggtttgatatacagcggagaattgcagatgtactgaaagcttcttttgccaatagaagcaatgaacacaattggtccagtgagcgcaaattggaaagcattgaagattattcagggtctgggagtaaatggtcaggaaaaatggggaagaagccacttctggtagaagagagtcgccgaactacatattatcagaatcaaccatccagttcaatgtatgagctgccagtggcaacctcatacaatgggacaaggaaggttcttgtaccaattggtgctcagttgccacaggcctattcccgcagtctggcacgttttgctgcacagcttggtcctgt

SEQ ID NO: 69274 - DNA, 481 bp, Triticum aestivum
  Clone ID: PAT_TA_69274
gccgcctcgccgcttggtttcccatggcgaaccagctgccggtgcagcagcaggtcaacccgcttggacatggagatctcaaccagcagcgcatgtgcgccccgcggcagcaaaacctgaacaacgttcctgtcatccaccttgacattggacgtccaccgcatggagaagacgacgacctggcccagcgctatgaggatttcgtgcgaataatcatccgccggttaacgaagatctgccctgcaacctattacggaaagccaattaccccatacccaaatgcagcgaaccatcctactgagggtcatagctacttccgtgtcgtcttcttttcaagcaccaatgattatgcgagagtggaattcctgataagggacttcgacctctatctactgggactgagaaggcagctggatggcgagtggtcgccctggtaccgttttacaccttctctggggtggccgtcattcccgatgggcga

SEQ ID NO: 69275 - DNA, 177 bp, Triticum aestivum
  unsure (1)..(177): unsure at all n locations
  Clone ID: PAT_TA_69275
ttcggcacgaggnatcgagcagcacgccagcgacgggaaagatgctgctccgccgctgccggatcctcaaatctctctctctctctctctctctctctctctctctctntgatgtaaatccccatatgncccccatggatncatccctaaccctcaaatcctnctntgattttggct

SEQ ID NO: 69276 - DNA, 511 bp, Triticum aestivum
  Clone ID: PAT_TA_69276
cacgagggatttgttgacctacgtggaatgcttaaagttgttagcggatttggttcagaagcttgtttgacgatttttcatcacaagaaaaagattttcaatagaacatttcaaattgctatcaggaatttgaaagctgttaaggttccggaaagttgtcctgctgggaccttcttggagaacataatatttgaagtttctgactgtgatggagtgattgacgagtcaatacatggactccaacatacacttagcatcaggtcgaatcaattaaaagatgtgcaaggagtacaatatgcatttgaacatggaagatgtgttcttcctcgtgcacaggttcctaatgaaccaggaacagtcagttttgtggcatatcatacacattttgctgacctggaaacaataattcaggttgatcttacaaggtagctcttgttgcacaatttataattatttcagactgaagtcctggattttcctttggcagattcatgtttatgctcttgattta

SEQ ID NO: 69277 - DNA, 109 bp, Triticum aestivum
  unsure (1)..(109): unsure at all n locations
  Clone ID: PAT_TA_69277
gtggaaccagnattgcttttaacctttccgtttccatggagctctgcccatggacatggatgatgaaatgtaatatttgcatggataaaaccttgccggaaaaaaaaaa

SEQ ID NO: 69278 - DNA, 652 bp, Triticum aestivum
  Clone ID: PAT_TA_69278
actcgtgtgtgtcggtgtttgccaaaaacctggtatttctatatggtttgccatggcaggtgccttcacagcagtagccttcaagtaaggaatcatctgactacagtctcggtccttcgagcttagttaactaaagcatcttttatatcagatatcaaattatctatacttgtactaagatataatgtatctaaccagattttcacttctttaatggagtttttagcactcggatttatttgaaatagctgctcctatatttttgtcagtgcttgctatactttgtttaaatgtttcttcttggtaggatcagttttaaatagtggatgtaagcatgccttttcaagcttaagcatttgatttttggtgatatggtgttctctccttacagatgaccttctgctttcttattttaaaaaatagacaagttggatgcagttgccgccactcatgtcgctacaggaggagtgcgcgcagggggagtggcgggtcaaggtgcgctcatcggtgccgctgctgaccggcagatccaggcgcaccctctcggtgcacgcaggggggggtgatctacgacgacctcctgggcacgacaccgctggagacggtgagaaacacgcactccgtccaccattggtcaccggcagtagcagga

SEQ ID NO: 69279 - DNA, 408 bp, Triticum aestivum
  Clone ID: PAT_TA_69279
cacaagtatgagcaccgccccatgcttctcatgaagagcttctgattcagctactcatccagtcgatcctggcgcatacttgatgtcttcacaaaattagctgaacgtgtcaatatttaacttcagagtgtcatatggcgctgcaaacggcacgaggtctcgtatgtatgtttgtaaaaaatttaggtgatgcaagcattgattgcccatggttttgacagtacatgaggattgaggacgcacaccggcatgcggtggttctgcaagatgttcctgtttcctttctcagaatttgacagaaacggtctgccaaaggatgcttgtcgatgcacatgtatatgtatattgagcgcttactgccattgtatgcacaacaaactactgtaaggaatccccgcaaaaaaaaaa

SEQ ID NO: 69280 - DNA, 659 bp, Triticum aestivum
  Clone ID: PAT_TA_69280
gagggcgcgggctgctctgggcctcgcgggaggtggagcggcggccctgggggtgaggtcgccggcgggcctcgtggtggcttgcgtggggggctcggatccagagcctgggtggatctggccctcccttcaggcgtggtgcttcgccgcggggaggtgccccggcggccagcggcggagttgtgtttgtgcagcagcatgctcactccccttggagcttggcggcgaccatgatggtggagcactggctaatcccaaaatccaattgaatgcatgctgtttgatgtaattctcccagaacttcatctcgaaggcaaggagtgattagccacccccaggtgggtttccatgtcctgaactgatatgctgttgtatcctgattttcaatgtctatgttgctgacctccttgatgattcacggcctttgagccatttttaacagctatgtctaaccatttctgtctgagatactgtcatgtgagttaaaatactccacaaattgctcacatgtgcttttgctacttcggattgttttctgggaaccaaagatggcaaaatctcaaaatatcctgtgttttcctatgttggagtacttgaagtatccgtctttcgaaagtatgaccagttcaattttctgtgcacagtattttttcctcttg

SEQ ID NO: 69281 - DNA, 627 bp, Triticum aestivum
  Clone ID: PAT_TA_69281
atcgggtcaaatcaaatcccctccctcctccctcccctaatcccccaatctcgagctcacccacccaccaagaagctcagatcatcatcaaacccctcccgcactccgtctccactcctcgcggcggcaagcgagcgcgcgcgcgcagagccatcggagccccgattcggcctctggggtgtccaggaaacagggggaatcaagaaaccctccccccttgcgaggaccggggatcgatcgcttggcggattgctgttgcctccccgcgcacgccaatgccggatccggccgggccggcggccgcgtcctcctccccctcctcctgccccgggctgccgtcatggcgtctctgaatctcgcggcctgccgcggcccccgccgatgctcgctggattctttgccgaggacggagcaggagccgcagccggcggcgacgaggagcgacgatgcagatccggctctcgccgagcatgaggagcatcaccatctccagtagcaatgggctgctagacttgatgaagctcaagaccgccgcgcgccacttctcgtaccggaccgtcttccacaccgtcctcatcctcgcctttctccttcccttcgtctttattctcaccgctgtcatgaccc

SEQ ID NO: 69282 - DNA, 463 bp, Triticum aestivum
  unsure (1)..(463): unsure at all n locations
  Clone ID: PAT_TA_69282
cggtgttgaacattgtgatgcatttnagacctgagcccgcaggnaatcgatgctgctgcgtgacgtggagcccatgcccgaccccgacgacggcggtcgaccacaacctccctctccggtgagtgatcccatctcctacctctggctccctctctttctcttgtgctgctctaggtaggtataccatatgctctgttatgtgcttgcctgtagctttttttttagttattgaataaaccattggaataaacgcatcaagaattgaataaaccattggaataaaatacctctttgttcgctttaaatattgtatagtcaacatgcatgatacctctctgtataatgttatgattatattacccgctctgaaactaaactttgtttggtggttcagctagctaaggttgggattttgatttctaacattcatatcttgcttttcctctatcatattatatggtcc

SEQ ID NO: 69283 - DNA, 574 bp, Triticum aestivum
  Clone ID: PAT_TA_69283
agcactggatttgaggctatcagcactgaaagaagaaatcttggtattattgagtcgagcagttggctctaagttgttgaataaagaagtatcagatttgtctggttttgttcagcattttgggacatcagagtttagttggttggtgaggtgcctactgttgatccgggattgccagccctctgtgctacccccacaccaagcttctactgctgagagaaaggatgatgcacttgagactcgtgatatcagttcccaaaccaatatccaaaggcctatcaccagtaatgtttccccagcaaagcttgcacaagttgaacgtaaaatgtcaatggaaagcgacgattcctctgagtccaccgatgaagatgaagctgttgttgaaagaagccgcccccttatgagatctgcttctcctaggaggtctgcttctccaatgcgaagggttcaaattgggagatcaggatctcgtaggtcaacgccaattgccatcaagagcctaagttacttccctcctagccagagagttgctttggataaagatgatgaaagcagctgcaatggtgaaacagac

SEQ ID NO: 69284 - DNA, 621 bp, Triticum aestivum
  unsure (1)..(621): unsure at all n locations
  Clone ID: PAT_TA_69284
tcggcacgagggttttttccatggtatttttgaaattntgcaattgaaacaggcattactgattgtaaaagtgaagtggtttcacagttggttgctgttgattccgacaagttcaaccaaaattttactgaagcaaattcaccaacttttagcacaatcacatatttatcaagtgaaacgcatgatggttcatcgattgcttgtggtcataaggcatgccaagagaaagtggtcattataagtacctcggagactctggagagctcatatgatgtgtccaatattttggctgatgaagttcattatgctgaaggtaactcattggctgatggtctacagtttgaagagtgttccagagtctccagtggaaaattggaacaggaagatgtcaaggaaaggtcactgtcaaatcatagttctagcaataaagaagacttgtataacttgggtgttccagaagtttctgtttttgatgactctagttctcaaaccttccaagctaatcttcctgataaggatatttctgtcagtactcttgncaatgatcacatggatatttntgngaacactgntgcaatgatcataataccagctcatctnatgatttancttgtcagcatg

SEQ ID NO: 69285 - DNA, 165 bp, Triticum aestivum
  Clone ID: PAT_TA_69285
tcggggttgatggatgcaagttagatcctgttgatgtccctatggttcggtaggttcacagtctgcttctaggtggcgcagcgcttattgaatggctggacgtgtatctccacgggattctatgtagaggctggtattaccgtttgacttggaggccacctagca

SEQ ID NO: 69286 - DNA, 476 bp, Triticum aestivum
  unsure (1)..(476): unsure at all n locations
  Clone ID: PAT_TA_69286
aggccggtatctgaggattgcaactcctgcagaggaccatcgaggcggttgaagctgacgtcgaggacagtaatgcttctggagaacaccaattctgccggtaggctgccttcaagcgaattatgagacaggttgaggcgcagcaggccaggaagatcgccgaaggatggcgagacgaggcctctgagacctctggaaggcagcaagacgtccgtgaccgtgccgtcgccgctgcagaggacgccttcccattggcagcagtccgtgtcgttcacccatgacacgttgagactgccgctgccgcccggcgtgagcctgcccaggaagccgaggagggcgcccctctcctgctccgtgcaggagcgggccggggagacgaaacagagcaaaagggcggcagcgacaaggctggcgaacggtgcggacgatttggtggtgtatctactgttgctgctacngcatgatgagctgancgg

SEQ ID NO: 69287 - DNA, 478 bp, Triticum aestivum
  unsure (1)..(478): unsure at all n locations
  Clone ID: PAT_TA_69287
gaaatcgaagtgctctcagcatggttcctctcaggtgacttaattagctgtgatgctgcaaaaaatcgtcccatcggtattagttctagaggaaatgacatgccaccatggattacgagtcgaaggactagatagactagtctatgagtcgcaactccagggctgactacacttcagtgtcgactagtctatgagtcgcaacttcagtggcgacttatcacgattagtcatgattagnctacgagtctcaacctcggaacgactcgtcattcgtaaaccttgcatttcacccataggcacatgattgaaaaggcagctaatggncgcagcatgcccgttatttggctcaatctttatgcgttgccctttttgttatgacgatgttatttgcgcctcctggcgtacataaccaatcacaatggcattacaggatgacgatgcaggtcctgctgctaagaagcagcgaggaactccaaag

SEQ ID NO: 69288 - DNA, 103 bp, Triticum aestivum
  Clone ID: PAT_TA_69288
ttgcagcgctgtgggcgtgtgaccatatttcccaagatcagtggagatggaaaactgcagaaagcttcatctatgatgccggatttcaaagtgaatctatggt

SEQ ID NO: 69289 - DNA, 527 bp, Triticum aestivum
  unsure (1)..(527): unsure at all n locations
  Clone ID: PAT_TA_69289
ctgcaggnaattcggcacgaggtcccgcgcggctgcgaccccccttgatgctcccgcgccgccatcccaaccatctccgactccaccttcgtctctcaccctctatcacgcctccacagccccaccctttccccttatgcagcctactcagatccgtgatggggggacacactgccataatggcgctcccgcatccgcatcaaggtcagccccctgctcgtcgtcatgggcgcggtggttacgaggaaggtggttgaggtcggtgagatgaacgttgtcgcctacccgctggccaggaccagggacgactgccccgacacttcgtcttcttcacaatctcacgccgggaaaggagggggtcgccactgttttcttcggtactccttggcctttttcgcatcgccagaggtgacctcgctagaccactgctgtgaaggtggaggagatagctgaagtcgagcgtgnngntgatgacataaaaggngnngatgaaacagagncttntgaagaatannggngaaaataca

SEQ ID NO: 69290 - DNA, 193 bp, Triticum aestivum
  unsure (1)..(193): unsure at all n locations
  Clone ID: PAT_TA_69290
tgggaacgtaggtaacagcaactttggcagcttcgaagnacccaacgttattgagccccatgttctttacccgaagcttaccaggccacacccaagtgggtactgaagtcgggaggaccatgcaggtctactatattaaagttgcagaaagagaaggctatgcccttgagtggccgctgaaggtatatggngg

SEQ ID NO: 69291 - DNA, 116 bp, Triticum aestivum
  Clone ID: PAT_TA_69291
cttggacactttgcaatttgctgggagttgggatttatatatgtgaacgattatgctttggatggggtgccttgccaatgaacattgtgtagcgtgatgtcgcgagaaaaaaaaaa

SEQ ID NO: 69292 - DNA, 553 bp, Triticum aestivum
  Clone ID: PAT_TA_69292
aagaattggtctggcctttggtcatggtaagtgaactcagctttataaggtcagctgaatgatatcattgttgttttaaagttgattgcatcgaatatgattgaaaggctgaaatgttgttgctgtttttttccccttctgtgaagaaattaattaagttgttgtttggcctgtgatatcttgtggttgttggcgggctcccatctagcaccatctgctggtctacaaagagtcaggaggcgcatgtgaatgtttaatcaaccccatgagcagagcaggtgttaattaactaatcatgggttgattaaagtaattcaaatatactcttttgcaggctgagttcactttgatgggtggtactttcatgtcattactggctgcttattgtgattattttaccagaaatctgcaatatgctttatcggggcatacttctgctaatgttgcagatttgttattcagaacatagtgctgtcaaacatatcactatgacaattgggacggaaggttcattcaacatctgtccatgattcttggatgcatttgaaaattc

SEQ ID NO: 69293 - DNA, 553 bp, Triticum aestivum
  Clone ID: PAT_TA_69293
ttcggcacgagggccgagggaagacgccgagttcgtgggtgcgcgggtggaggccggcctccgcgccgcccgcttctcctcgccgccgtcgtcggaggagttcgcggcctccatcgagcccaagaacgtccccgccgtattccgcggcgtgctcaaggggtcagccgcctcccctcggtgggatcctctccatggtggcctcgactacttgctggagaaggtggggcctgatgttgcggtggaagccatgatgtcgagcaccgggcacgtgttctacggggatctcagaagtcatgagagggtttctatcccattctccacattcatgcattcctgcaaatcttacctggggcatctgaatgctgctagtgattcgtccaaagataaaggtattggggaggagccaacttgttcaggggaaatgtgctcagctggcttggagatttccgagcaactctacttagcacaggtgtcaatcctcaacactgagaacaaagagagatgctcgttagaagttttaaaagaggacattcaggagcctatatttctgaaa

SEQ ID NO: 69294 - DNA, 881 bp, Triticum aestivum
  unsure (1)..(881): unsure at all n locations
  Clone ID: PAT_TA_69294
ccccacccaatctcgtctccgatcgactccacgctcgtcgaatactcctcccccaccgcctcaagatgcagatctttgtgaagaccctcactggcaagaccatcaccctagaggttgagagctccgacaccatagacaacgtcaaggccaagatccaggacaaggagggcattcccccggaccagcagcgtctcatcttcgctggcaagcagctggaggatggccgtacccttgctgactacaacatccagaaggagtccaccctccaccttgtcctgcgtctgcgtggtggcatgcagatcttcgtgaagaccctcaccggcaagaccatcactcttgaggtggagagctccgacaccatcgacaacgtcaaggccaagatccaggacaaggagggcattcctccggaccagtagcgtctcatcttcgctggcaagcagcttgaggatggccgtaccctcgctgactacaacatccagaaggagtccacccttcacctggtgctccgcctncgtggtggtatgcagatttttgtgaagaccctcaccggcaagaccatcacccttgaggttgagagctctgacacccatcgacaacgtcaaggccaagatccaggacaagganggcattccccccggaccagcagcgcctgatctttgctggcaagcagctggaggatggccgtaccctcgccgactacaacattcagaangagtccacccttcancttggtcctgcgcctgcgtggnggcatgcaaattctncgngaagaccctcaccgggnagancatcactctggagggtgagagctccgcccccattggacaacgtcaagggccaagatccagggacaagganggcattncccccggacagcagcg

SEQ ID NO: 69295 - DNA, 608 bp, Triticum aestivum
  unsure (1)..(608): unsure at all n locations
  Clone ID: PAT_TA_69295
tcggcacgaggattttacctttgcagaaagnatagtacacttgcatcaagnagttctgaagtttattcagagcatgagtttggaagaccctctgcatccagtgggtattatccaagaatgcctttctaaatgtataaagaaacaggtggatcacattggcaaacaaatcctgtgcaagctaatgggtgaatggagattaatggatgaactgcttgtattacgagctatctatttgctaggatcaggtgacatgctgcagcagtttctgataacaatttttgataagctcgataaaggaaattcctgggatgatgattttgagttgaatactttgttgcaggaatccataagatattcagctgataaaatgctcctaactgctccagattcgttggttgtttcattagcaaagcatgacacacgatatgacgaggaaagtgcaccaacttccagaaaaggtcgtgcacagggtttcggcatcgatgcacttgatgcccttaacttcacgtataaggtgtcttggccccttgatctaattgccaatacagaggctctgaagaagtataataaggtcatgggattcttactgaaagtcaagcgtgcaaagt

SEQ ID NO: 69296 - DNA, 579 bp, Triticum aestivum
  unsure (1)..(579): unsure at all n locations
  Clone ID: PAT_TA_69296
tacaggatgctttggnagtatgcaattacttttgatacaacgtaccgcaccaatctatatgatatgcctttcggtcttttgttggagttaacaatcactttcaaagcataatttttggtggtgcaatgatgagggatgagaaagaggacacattcaagtggatatttagggagttcatccgcatggttggcaggaaacacccgtagacgattcttactgaccacgcgcgtgctatggagctggctattgcggcagaactaccaaacacagtacaccgttggtgtaagtggcacattttgaagaaggcgaaggagtcgatgggtgtgctctggagcaaggacagtaaatttaagatggagttccacaagcttctacatcacatgatcacaaaggaagaatttgaagctggttggcaggacatgttggaaaattacaacttgaggaagcatccattcctgacgcagatatacgaggtgcggcataagtgggcaaagccatatttcagaggcgtgttttgtgcaaagatgactagcacacaacgaagcgaaagtgctaaccatctgctgaagggntatgntc

SEQ ID NO: 69297 - DNA, 436 bp, Triticum aestivum
  unsure (1)..(436): unsure at all n locations
  Clone ID: PAT_TA_69297
attcctaagnatagaacccaccaccaaaatcccagcttccggtgcgtgccggcggcggcggattcgtagcagcactgctccggatcggcagccaccactaagctccggccgccgcaatgggggcctcgagggcagcacctctgcgggggaagctcggcagcctgcagctctccgaggccgagaagaagggggtcaggatcaccggcaagcagcagcagcagcagcagccatgcccctccccgcaggcgagcggcggcaagatccaggcggtgggcaagctgctctcggagaagccggccatagcgcagcatgtggggacgtctctgggggcggtctggagcccctccttcggggtcaaatgcgaagacctcggccggaatcggttcctcttcaccttccgccacgaggccgacaaggagaaggctctggatgccgg

SEQ ID NO: 69298 - DNA, 530 bp, Triticum aestivum
  Clone ID: PAT_TA_69298
gcttggttgctagagcattattagagaatccccaattgatcgattggcgcttggtattcaaagcactctatgggcttgtagctttgatctgcggcaacggttacattgttgggattaatcagatctatgacattggaattgacaaggtgaacaaaccatatttacctattgctgctggtgatctctctgttcagtcagcatggttactggtcgtagcattcgcagtggtgggcttctcaattgtcgtttcaaactttggacctttcatcacctctctttactgccttggtctatttcttggcactatatattctgttcctccattcagactgaagagatatccagttgctgcttttcttatcattgcaacggttcgcggattccttctcaactttggcgtgtactatgctactagagctgcattaggtcttgcattccagtggagctcgcctgttgcttttattacatgctttgtgacagtatttgctctggtcattgctataaccaaagatcttccggatgttgaagga

SEQ ID NO: 69299 - DNA, 506 bp, Triticum aestivum
  Clone ID: PAT_TA_69299
atgatgccttgcccaaagagcaggccttgatttctgatccctcagaaagctcacagaatccaatagtttttggtcctcatccagctgattatctagcagcagaaaatcacacacagccgttatatggcggagatggggaacaagatgactgttttggtatcggtgatatgtttggtgagcctgaaataacttctgatgctaagaaagaaactggcacaactggagatattgatgtgatggcttggagtagcaatagtgctgatgatgaagtggatgatagtaatgctcccgtatcagttgagggctgcttgtcattgtatactgagccagagctgctaacggaatcttggcattgtgagcattgttctatcgctgttgcacagccaaacaccaatgaattagaagagggtgaggagacggcagctagtgccaatgatagaaaggacagtgcggagatgatggcaagtggtgatgaaaaacatgttgatgataaggtcccgagctgc

SEQ ID NO: 69300 - DNA, 525 bp, Triticum aestivum
  Clone ID: PAT_TA_69300
gctcttccgtcgccgtcgattcgaacctcccccaaatcagcagcagtcgaccggaggcgccgccatggctcgtaccaagcagaccgcccgcaagtccaccggcggcaaggcgccccgcaagcagctcgccaccaaggcggcgaggaagtcggcgccgaccaccggcggagtgaagaaaccccaccgctacaggccggggaccgtggcgctccgggagatccgcaagtaccagaagagcacggagctgctgatccgcaagctgcctttccagcgcctggtccgcgagatcgcgcaggacttcaagacggacctccgcttccagtcccacgccgtgctggccctccaggaggcggccgaggcgtacctcgtcgggctgttcgaggacaccaacctgtgcgccatccacgccaagcgcgtcaccatcatgcccaaggacatccagctcgcccgccgcatccgtggcgagagggcctaagctgtcctctccgtgaacgacggtagtggatcgggatgagttgattccgg

SEQ ID NO: 69301 - DNA, 518 bp, Triticum aestivum
  Clone ID: PAT_TA_69301
attcggcacgagggtagttcccaccggaagtttctccgctcgccgctcgtcgctcgtcgccgccgccgccgtctgcgccatgctccgcctcctgaagagcatcctcacccaacagctctcttctccctccgcctccaccatacccccttccttctccctccgcctcctctcaaccgcggcgccccccgttcttgcagaccccgtcgccggcggcttcgccgtccaggactacctcgtcgccacctgcggcctcacccgagcgcgagcactcaaggcgtccacgagactctcccacctcaactcccccaccaaacccgacgccgtcctcgccttcctcgccggcctcggcttctccagggccgacgtcgccgccgccgtggcaaggaaccccagtttactctgcgctaaagtggagggtaccctctcccccatcgtcgccgggctcaccagcctcggcctgtcacactccgagatcgcgcgcctcgcctcgctcaccgactactgcctccgcaccaaat

SEQ ID NO: 69302 - DNA, 516 bp, Triticum aestivum
  Clone ID: PAT_TA_69302
gctaaggtcgatggcgccgaggaggaggctgagcggttctgtagttgggttgacggcggccggagcaggtcgtccatggatggccatctgtggcgtcgttctcaggcagagaagggaaggggagcgcgagatgaagaggggatggagagggagtctgcgtgcccatggagaagcgcctctgggagcagatctggccattggcagtaagaagatttttaaatggaagacacaaaggaggtggcgtaatgggcatagagatcctggtgttggaagaagatgatgagcagaaaaatacttctagatcttgtccagattgtcaatttaatgtgaccatgagatattctcatgcagtttcagaaggttcatttggggattaaaatgttgataaggcttctaatccattcggatgactttgctattatctgcagaaatacaattcttgatttcaacaatgggtgtgaaatagtatatgcagagctagatgcggcgaaatctgcagacgccatgagtggcggc

SEQ ID NO: 69303 - DNA, 458 bp, Triticum aestivum
  Clone ID: PAT_TA_69303
tcggcacgaggcttctgcgccctaggagccccgctgccgcctgctactcctccaccgcctcgcctcttcctccttcccgccttcccatcgcttaggttggcggttagcggcggctcgatccactccgtggtttcagatgggctgccttccccatctcttgtccgtgtccggtgccgtcactcgatctcgatcttgggagcatgcgggagagaagcatcgtgcctattgccaggacgggacatgggggtggaggcgagcgagagagtgggtgttgctgaagaagctggggaggcaagacgagggcggcgtggcgtttcgtggccgcggtggccggaggggcggctccacgtcacggtgtatgaggtgcctagaggaggatgctgcggcaggttaaactcctctcccgttattgagcagtccgcagtgccgtcaccgtcgtccttgccttcgagccatcc

SEQ ID NO: 69304 - DNA, 488 bp, Triticum aestivum
  Clone ID: PAT_TA_69304
ggaggcatcccttggtcgaggcaagcgcttaaggaaagctgtttcttacagggaaacctttgcagcaattgccaatgaagcattaagtgaggattctgacgatggggatgaacccaagcgagaatacactgcagctggactggctttgaaggaaaaatatggaaagctccgtgctagacagaaggaaaggattgctcagcggcacacaatcaagagctatgctgatgataaacttgaagatttcataaaactatatgactctagtgttaatgaatatggtgtaaaccctttgagagttgtagaagatcctgactctgcgcagccatctggggctaaacgtttcagtgattcaactgcagaaatgaggcattcctcgaagaaagcaaagagatatcctgaaatctctcgagagcttcatgccaaacttgctgcgagtgctacttcgtcgaagcaccactcaaaggcaacctgatgtcttaaatcaaggg

SEQ ID NO: 69305 - DNA, 301 bp, Triticum aestivum
  unsure (1)..(301): unsure at all n locations
  Clone ID: PAT_TA_69305
gctggaggcggacatccagcacgccaacaacctggcgtccgagngctcgagggactacnacggngcgngcctgcanatgcgcatgnnctacanccccnccgcgcgcctntnnctcttcctcctgcanngnaccnactgcannctcnccnncnccctcnnnctnctcannancctnancnacaangnnnatnnnnncngnncaaccaccangnncacccacnaaangaangccancnnnannnannncnacncnnnnanannncncnnccnnanncnnnnnnnncncnnnancannnacnnc

SEQ ID NO: 69306 - DNA, 261 bp, Triticum aestivum
  Clone ID: PAT_TA_69306
ggtcgctggtgacgatgaggaaggccggagcgcgtcttcccaggtggatccatggcatccgcgactcctgggcataaaggagacatggaggtgagggacagaaggaggcgctgtgcggcgaccttacgtattgaaagttcacttcacaaatctggagaactagctgtaacccccttctcatatccttgcacaggtaagcaacgaagtttgttttggtgatttttgccttctttgattgatacttttgaagcatcaaaaaaa

SEQ ID NO: 69307 - DNA, 512 bp, Triticum aestivum
  Clone ID: PAT_TA_69307
tcggcacgaggcagtatggattgacggcatcaaccgaatttgaatgcttcactcaagataatttactcatttatatgctttcgagaatattgatttgataattttcataagttacacaaagattcacaccgtacttgtgtgtgctctttttctgtgttgcctcatgcatgaaatggttcactttcaggaaagtgtcacccattagttgtgatttgtgacatctaaacccttttaaatctcaagagtgtaaagattcaccgaaaataatcaagaccaagcctagtgtggcctggctgggcttatcttagtagtcaacttatccggattaacctataatctctatataaggtggtttaaatcagtcactcctctctcgtacataaatttgttgtgtaaaccctgaaaaggccggctagagctgcttcaagtttatggggggcatttacacattagagtcacaaggccaaataatagactcacttggctccgtctcaaagattatttgctggtaa

SEQ ID NO: 69308 - DNA, 719 bp, Triticum aestivum
  unsure (1)..(719): unsure at all n locations
  Clone ID: PAT_TA_69308
tcgtgaagaccctcactggcaagaccatnactctggaggttgagagctctgacaccattgacaatgttaaggctaagatccaggacaaggagggcattcccccggaccagcagcgcctgatctttgctggcaagcagctggaggacggccgcaccctggccgactacaacatccagaaagagtccacccttcacctggtgctccgnctncgtggtggnatgcanatnntcgtgaagaccctcaccggcaagaccatcactctggaggttgagagctctgacaccattgacaatgttaaggctaagatccatgacaagganggcattccnccggaccagcancgcctgatctttgctggcaagcagctggaggacngntcgcaccctggcnngactacaacatccagaaggagtccaccnttnanctggtgctccgcctccgtggnggtatgcanatgtttgctgaagaccctcaccgncnagaccatcactctggaggttgagagctccgacaccattggcnngtgctaaggccaagatccaggacaaggagggcattcccccggaccagcagcgcctgtttttttttttggcnaagcagcttggaggacggccgcaccctggccgactacaacattcagaangagtccacccttcacctggtgcttcgccttccgtggtggtatgcagattttcgngaagaccctcaccggcaagacc

SEQ ID NO: 69309 - DNA, 666 bp, Triticum aestivum
  unsure (1)..(666): unsure at all n locations
  Clone ID: PAT_TA_69309
gnctgcaggnaattcggcncgagggtctctcctctgtctttcccccttaccagnagctagggtgtctgtagtcggagggcttagctgctgacggatcccggttgctgcatctagtcctttttgagtttgtcgttgtcctggcgccccatgctttccatttgtgccagccgatgaagtcccagaagttttcgatgttatccttgatgagtattgctttaggaggatggtgagttgtattcatcttatctctttacatttttttattcttgttcataacctttgtatgtgcttgcaaattctattttattttagtagggaactgaggtagtgtgtagttcaagtaatccctgcttgtcaaaattgatgttcacgcaaactgtgtacaagtgcagtattcatgaagatagtagttcgaatcctatttttttatttttatggatgagttgttgtttctgtagttctatgtagtttaaatgccttttagttaaaccaacatatctacctcactatactttaaatttcaataacagcaaggttaatatcagtagttgatgttgtaaaatgtgtttttttaattgtgatgaatgtgctttttttatttctttgtgttttgctgtacttatagtttgtgaatgtagttttgatttcctccacgtatctacttcc

SEQ ID NO: 69310 - DNA, 245 bp, Triticum aestivum
  unsure (1)..(245): unsure at all n locations
  Clone ID: PAT_TA_69310
gatgccggaaaaaccaacacaggtctgggcatggcttgaagcagaagaggctgcgatggttatgctcggagtaggggcatctcggcgccagcagctcgatgcagagcaggcgaagcagggtcgctgctgtcgagcagctgctgatagccaagcagcggcatggaggcggggaagcacgagcaaggcggtgagggtgacggngcaaggcgagatggcgcggcggtagaggagctcgagcgcgaggc

SEQ ID NO: 69311 - DNA, 103 bp, Triticum aestivum
  Clone ID: PAT_TA_69311
gggctgctaatgtggtgggcaatggtttgggacaggctggcggggctgcttagtcttctgcccaacactgaaaagaggctgaccacagggggaagtgccgccg

SEQ ID NO: 69312 - DNA, 655 bp, Triticum aestivum
  Clone ID: PAT_TA_69312
ccctctggctgctatgggaggatttcacgacagtcggcggccttaccgtgctccctcaggtcatgtggtcaacgtttgttcccgtcatccccagtagcatactgcctggcataatctgtggctctttggctgttgctgctgttgccatggcaaggatgggcaagctttccgaaggaggaacgaaatttgtggggtcgttgtctggttggactgccacacttttgttcatgtggatgccagttgcacagatgtggacaaactatctcaacccgagtaacatcgaagggctgtcagcgttctcaatgttgctttcaatgattggaaatgcacttatgattcctcgttctgtatttatcagagatctgatgtggtatgttctatttcaacctatccatttttcaaatccgagcacaactgcatgagaatatacaaagggggaagcataaaaaaatatacaaaggggaatgattctcatctgaagagtcaacttccacaacctgcttttctacttccccaacagaaacagtcaatatcttcctaatcaccgtttaagagttttgcatcctttgcacatcgaagtttatagtttaatcagatgtgttatggtaagcctgattaatgagaaaagtatccgaagcaggagctctcttggacc

SEQ ID NO: 69313 - DNA, 625 bp, Triticum aestivum
  Clone ID: PAT_TA_69313
ggccatttcccaacccaaatccgaaccgcttcatctttagatctttacgtgcttgatgaaatgccttagagactaagatctgcactttgtttttctccgttctcctgctcacggattaaccgatggctgtaagacccagagaagcattacgaactggtctgcagtgtcttccagtgtatgcgtacacaaaattcactttacttttctttttgccctttgtataaatgatgtggttgagttacgaagcctcttcttgcagtgttgtctgcaaggccgaagagaagttactaatgcatttgagctgctctatgtgattgttcatctcctgaacctgttttagttgacataaaagtgttctctatttcagaaagcgacaacacgagattgtgccccctcttgctccaggtgcatgttgttgccctcctctcccctctgatttgacttgctttaccttgtgtgaagttttatactttcaacttgacaaagctatatcaagtttgctttcaactgtacttggctacacctgtaacatgatgcatttgtctttcagtgtattgaatacatttttaaggagtaaatgctctatctggtatactgtcctatgactcatttaacagtgcgtcaa

SEQ ID NO: 69314 - DNA, 649 bp, Triticum aestivum
  unsure (1)..(649): unsure at all n locations
  Clone ID: PAT_TA_69314
ttcggcacgaggcaaaaaagnaaaaaaaaactcgacttttcgccggctttggttccgcctccgtcgccgctgcagcacatcggccaggggccctcctcccggcgaggatgcttcctccatctccgtctccaaatctatatactacgggactgaatccccaacccggccgcagatccgcgttcacgcggggaagagaggcacttgggtgctccccgtctccggtcaaagaaagagacaactccggcgaatctttcttcccctctcgcgctcacactcgaccacatccagtccacacctcgtcgtcgtcgccgtcgcggtcggcacttattaggacgcgtgcctgtaaccactcgattcagaggaccaaaagaatctgtcctcctttcttcattgtgcctatctcttcttcaccggcggcaacggcgtcccatacagacggcgttgatacaggctctgagaacgtgagtgttagtggtgtccccgtaagatccgcccaggccagcaatggcggcagcggtcgtcgggggcatggtcgcctcgggcgtcatcaaggtggtgatcaagcagctcggctccgccatcgtgggcaagatcaagctgcacaagaacctgaagaaagatctgcagaagatgaagatgacgctggagg

SEQ ID NO: 69315 - DNA, 694 bp, Triticum aestivum
  Clone ID: PAT_TA_69315
ttcggcacgagggttggcttcttcttcttcctcctcagtcgtttcgctttctcggcggtttccgttggctgcgagctaaagccggagcctgccaccctaattttagctcctccttgtccaaattggatgttaccggagggcgaatcgtagcccggttcggctgtttggctgggtttggctacacccctcctcctggtctgctcgattcaggccatggagatatggctggcaaaggtgcaggggggtggagctcgccgtgtttcttgatgcggtttctgcaagtttcagcccctcctcgcatcaatcttggtctagagcccgaaattttaagttctagtcaccaaaattagaaatttgtttgccaccttcttggcgatcctaggacacttgagccactgattgggttccccttgtttctgccgttcgcatgcggcaggattcagatgttcttggcaaggtaggtcaagggaaagggagatgcccaaggcaggagactgtagcggcggcggcggcggcggtggccggagggacctgcctctgcttttcctcagggtgggcgctgccatcacgctctccatcgctgggctcttcttctcgcggctgcggtggcagcaccggcctcggccccggcacctcctgctccctcctccttcagagccggatgatgcccgtggcatgaagggtggtggtggag

SEQ ID NO: 69316 - DNA, 683 bp, Triticum aestivum
  Clone ID: PAT_TA_69316
gtgagctttgtaatgttgttgatgcattatcgaagcttgcaatcaggcctggttcacctgaatcattgcagcagttgattgagattgcaaggagtaatttcaagaatgctgctagctttgctgccatgaaggatgaaaaggttttatctggccgtccttcatcaatatataaagaagaaaatgattctgcttttgcggatgctgttagttttcaagaccaggttgcagttttattctcggactggtgtcacatatgtgatcatccaactatgggtgattcagcatatagtcattacattgtgcagttgcaacaacatggcttgcttaagggagatgatttgactgaccgcttcttccatactctcacggaacttgccatcacacatgctgttgtctctgagcaagttattgctcctggtgggatgtctcagcagccggcccagcaactccagatttcatatttctcaattgattcatactcgaagcttgtgactttaatgttcaagtatggcgtggatttaggaccaaacaaaggcagccttcttctgaagattctctccataaccactaggatcattcagaaagatgctgaagaaaagaaagtttctttcaatcctcggccatattttagattatttataaatttgctaagtgagcttagcactgctgaccttcatgatggt

SEQ ID NO: 69317 - DNA, 630 bp, Triticum aestivum
  Clone ID: PAT_TA_69317
gcttgatgctcgctccatgacccgtgttgaatctcgttcgctcgacggctttgtcgcctttgtctgctacacctactcaatctcggagcaagaagcagtggtactgctttgccaacatcgcttcaacctctcatacatgttgcagggctcagagaagatattccttaacttggcttctgcggcactggttgccaaacacccacagcctgctgcctttggggatttcctcaattcactgaccccagctaaacttgttcgcttgcgctcccttatatccgacagaggtctgcgccatgttctctctgatgatacattggtgcagctaaagaagatggcgaccaacgcgacagcatgcgttgcagcagcagcagcagtgcaaagtatgactcctgatctgggccaatctgccttgaagacactgtccgctaggagggagaccttcaagtctgagcaggattatgttcgcacaaagttgcagaagttgctacttgactacggccacgataagggacacttctacaggcttggtattgtttgtggagtgacgacagccagatatggcttctacccaacttgctaccatgtaaactttctggcgagcacggatgtcccaaatgattctaccagatc

SEQ ID NO: 69318 - DNA, 673 bp, Triticum aestivum
  Clone ID: PAT_TA_69318
ggaacattttaccctcattgtcaaatagaaactccatctttcatgtcttgtattgacctgcctagggcacttgtggtgtaggtgcattttgagatccatgcttgtagtttctagcaattaaaatgaaatgtgcatagtgtgaataacagtgatattaggttccacgcctaacatttatgtgtattaagaagttgttagctggcactggctattcttgcagagttttactagaccatatcgaacttgtccttgctgtatgacattgtttggtgtgctttacttataagtgaacagtcctttcatctctgtgtactctctaggacatgcttttgctgctttctttttactagatataccatgtaccgagtttctgagattgcctggttccatatttatttatgttctcagtttggatgatttgttcaaactttaggctttattgcttttgccccaattgtttacatcttctttgtaatttaatatttatgcaacattgcatattgcagctgttagataagttcaaacatgcccatgcttcctcactaataaaagtaacggaaataaataaaacatccatgacctaaatgctcaaaccacttgaaatttgcttttcattttttcacactatatatcctaaaattagcttctacgtgagatatggcagtatcacttt

SEQ ID NO: 69319 - DNA, 629 bp, Triticum aestivum
  Clone ID: PAT_TA_69319
gcgaccggcagtgccaatgacccccgtgttcatggaggatggttgtctgtctacacgagtactgacccagggtctcggtacaataaacagagtgcacggtatcaggtaattcttgttattcttgattcagcatttgtgtatcaccagaatcagtattatagattgcctcatgttctgaagcacaaacctctaaattaggatataattgatctttgtgcgtgttaaaccccatgatctaatcagtgtatagtttgtaatgatgcatgtgcttgaagtttcagttttcttccatttgaagtgaagcaaaagaaaaggaaacaaaagagtatatcagttgtttgcttatgcttgtccatgcatattagtctgtcgggaaagcaagtcttgcttcctgttttacaccagcgagtcgttggtgtttccgtgttcaaccttactgcactacggaaacatcatgattgtttttaggcggggagtgattccccttattatccatctaaagtttagcttgcataaagacaatcatggcacagcacaacgtgcactttaagacagtttggattgctggggccatggtatttgtttaatcaagtagatgttgaattgtgtagtccttgcatgcatccctg

SEQ ID NO: 69320 - DNA, 638 bp, Triticum aestivum
  unsure (1)..(638): unsure at all n locations
  Clone ID: PAT_TA_69320
gttagttatgtaggtgttcagggtacctagtacagtgcttataaaaccggtagntaaggtggggactctctccccccgttgattcctcagnaccacaatctacaaaaccgtgatgtttctagataaaattccagnaggatgatgagagctacaaatcggcctagnaataagtacatccatatcatcatttgtcgaaaatagacatatgctttctccagnaagtcaggcctcatgtcaacgtgggtcactgccacatcccacccatctctcacgacgtctccgctcactttcaccttttgacgataagtacatgaaccctttcggaacatagcgggttcattgttgtagttcatttgaaatcgctgaaaaagcaactcgttcttatcctttgataatgttccctttagtatctcattagctttgttttcctcttctccagatttcactaacatccaaaagcatgtattgnattggttcctgttgtgacattctgcttgccttccaggacaaataatcacaaacgatctttggttttgggtaacagagaacttctgcttcaaacttaggtggctgcactaattctttactggggaaanattctttccacttcatcatgtaaaaggaagtgaagcatgatg

SEQ ID NO: 69321 - DNA, 624 bp, Triticum aestivum
  unsure (1)..(624): unsure at all n locations
  Clone ID: PAT_TA_69321
tttggtacataatttatncgtaacatcttaatgcttgttgctctcagtgtgaacaaaagnaaaacatatgatccctaaaacattgttaaccattactccacttcaagttccaggataaggttgcttcttgccgatgactccttggcctctcctccaattgacaggatgctgaagctacaccatcgctgatggccccttggcttctcttatccgattggcaggctgttgcagctaccaaccaaatacatccacacgggtttgtaactttgtatgcagctcccacaaggaccccatggttttgttgatggaggatgataacagcaatctggacgctgcctggatctctcaaccatcgtcatgggctgcggaaatagctattataatcagccaaaggagcaaggtggagcaatcgagcaaaagggagtgaggtccacacatttgcagatgaaccaatgaccagaaactgaagaacgcaatagcagcagcacaaatcttcttaattagaagggtctcctcagcctgaagccatacaagtaaggtggcccctgacaaggaggatctcatgctccatgggtcagtctggtatcctccatttttgcaaaactactctgggccctgggtctc

SEQ ID NO: 69322 - DNA, 687 bp, Triticum aestivum
  unsure (1)..(687): unsure at all n locations
  Clone ID: PAT_TA_69322
cagtctccaacagcaatctgacacaatatatgaacgaaaaaacagtttctaaacataactaaaacacaagtcaacacagnataaaatccaagaaaaacatccaatcataataatcgactagatataaaagaattaatcccagnaatgaagaacggcgcagcaatgcgcgcgttagcctctagtattatcgcaagctggctaaaagagagagtgcacgtggacagagagagagagagacgtactgtatatagttagacatacatctcacagtgatgaccggattaggtcactaaacttggcatatagcatgtcgtggaaatccttgataattgttgcctcgagacacacgatgatgcgcacgctgccgccgtcgccgtctccgtctccgtcaccgtccatcatatagacacggccgccgcgctcagactcggcacgcatcatcatcaccggcttcccccatccaaagtccgtgtcgtagatcggcatgccaagccaactgaccaccctcagctcagtcgtcggcaagctgccctgcgccggccggctgtccctctccgccagctcgaagtagtcgattgccgaccagaccagctcgtcatcgacccgcccgatggttcccttgattcggctggccacggagctcagctcctccgagacgatgccacgcacctcgctggtgactcccac

SEQ ID NO: 69323 - DNA, 603 bp, Triticum aestivum
  unsure (1)..(603): unsure at all n locations
  Clone ID: PAT_TA_69323
ggggtgctnttacctcaaanggnattccctctttttataatatgccagtatctgctagggtacccaaataacctgntctatgttcctggctcaacaatcttagctactcgcatatcatgatttcacatatctcattcttacctactggctaccgccaactgctgaaattgctgacatcgacctcccctgcaaacacaagctgatgttcatgtggtacatgagttaaaacaagtagagtggcaaacaagccagccaaatatacagagccaacatagctggtgctttttatagcaagctatctagtctagaggctagagctagctagtgatccacctgccgcacgcactctctgctagagcatctgcatcgatccatctgcactctctgctagagctagctagtgatccgtctatccatcatgtcgctccgaccccgaggaaatctatgaaagtcggcgaccgcgacgtgccgtccaagtgaacgccagcttggtccgtcacggcaaacacggcggcagacgatccatttgcgtcgtcagagccgaaccgtgccatctcgtggtggccgccgccgatcaagtctccttgcgccggcagcggctnc

SEQ ID NO: 69324 - DNA, 629 bp, Triticum aestivum
  unsure (1)..(629): unsure at all n locations
  Clone ID: PAT_TA_69324
ttaactgncttacccacctgnatctcttcttattgcttaaaacccaagngtaaccaaagngcagtttttacaggagggggcgggctagctatatcacccctcagacaacaagtttactgagccaaacatcaacatgccgcttgtcctcatctctaaacctacctcaagcacggcgtcgtccctgcagcacttcatcgtggcctccaaagaggaagaagctttgcgaaagaccaccgagttaactggcagattgaaaagcagggtaatgaactgtaaatgaggcatgtgctcctcattaacaattcactgcagaaacttttaaaaggataggatgatcatgcgccttatttgccattgggcatattacaatcccataatttttgtcaaacttagccatcccatcaaatcactcaaaattttgccaataccaggccctgtacatcaccttgatgaattctgggatcaggtaaagattgcataaccacttcagagtaaaatggcaattaattgaatatncaacaaacaatgcaaccttaaggctttgacaatgtagcatccaacttgtctgcaatcatagcaatccatgcctgatcaagantagtgaacccccttatagtgtcaccaccaat

SEQ ID NO: 69325 - DNA, 153 bp, Triticum aestivum
  unsure (1)..(153): unsure at all n locations
  Clone ID: PAT_TA_69325
tctaggaccaactgcaaattaccagttggtcgatttagaaggtcatttctagcatattccgattcagattagggttcgtgctctaccctgaatcggaatatgctagaaatgaccttctaantggngcagcngnnnntnngtngnngnncnnng

SEQ ID NO: 69326 - DNA, 265 bp, Triticum aestivum
  unsure (1)..(265): unsure at all n locations
  Clone ID: PAT_TA_69326
ttgtgtagtatatatgccttacatatcgagnatactgattttactggttgctgctacaatcagagagnggttcaacatcatacatatatggctacaatctcatcatacatatatgccttacatatcgagatactgattttattggttgatgcttttttacttctcctgaaacgtaacagcttaattgagggccttaattctggctccatttcttgttgcagttctccacgcagacggccgcatcagctgcatcggccggcgccgc

SEQ ID NO: 69327 - DNA, 148 bp, Triticum aestivum
  Clone ID: PAT_TA_69327
tgaaattagttacaaatttctatgacgtgaggcataggcatttatatctaagacaaaatgtgttaaaagtggatgttaaattcagaccttatcaatgcagggtgtgaatcccgaacagcaaacacgatttgcaagcataaaaagaaac

SEQ ID NO: 69328 - DNA, 418 bp, Triticum aestivum
  Clone ID: PAT_TA_69328
tctgaagtctgacccttacatctgaatacctgacaaggtccactccacaaacttgactgcttgcacggtcttagcttttggcaaggctaatcaaacgcaagataaaaacactccatgttctatattgtatccttctagatggccatattacataccaaagggcaaaagcataccaatttagtggttaactgtcgagttgcatcacaacggtcgtcaccatcttgatcaacgtctcatcaacgaatcagccctgacctccagcactggtgtcagggctattctaaccctggaggctatgggcttgagcttgaagcacggcgtttttccagcatctcatcatcctcggtctcaacaccacttgatattgtcggtgacgacaacaacgatggtgggaagtttctatatacacatggcgaac

SEQ ID NO: 69329 - DNA, 484 bp, Triticum aestivum
  Clone ID: PAT_TA_69329
accttgagttgcactctgcactcccagacaccaacatgtggacagaagcacaacagtaaaggaaaacccacattctccacatagagtagcgagcaagcaaactagcaaaattagttgccacaatcccaggagccaggcaggtaaaatcatactatgagacagagccaattggaaacgaagcacttggagggctgaacttgtgacatgagtcccaccaaacatgttccaaagcttaacacacatagcctcattgagaatctaaacgatgtgaagttgtcttgaagcaaaaactgtgttgacacctctttgacatgtcaccaacctgaaatcctgctaggaagaaaaacgagtccgtgaagaagacaagcggacatagttgaacgaatcctcacactccgaaacgaaaccgaagattgggcctgcagggacgcgcggagctgggctcgcgggcgaagggagctgggcctgcgcggctgtgacccag

SEQ ID NO: 69330 - DNA, 568 bp, Triticum aestivum
  unsure (1)..(568): unsure at all n locations
  Clone ID: PAT_TA_69330
caaatgcncattaacaaattctacttcacataacaaaacgaatcggacaagacgtaaataaagtgtgaaagctcaaggactactgacccattagaagcctcctcgagcgacgacatgagctttaccgcatcaccataccgcaaccctctagacataaaggcaacctacagacaaaacattagccccctataccaaaaataacataggtaaaagaggcctatctgacaacaacttacccttctccacatgttaacaacggaattgtatttttcaaccatcacgctctccttggtcttgaaaattttaaagccttgttcagctgcagattgttaaggttacaacaacaaagccttttttgtcccaagcaagttggggtaagctttgttaaggttaatagaaaaacataattgaataaaatgcaaacatccctgttacagcgtttttggctaggtttgaagccaaaacatccactatagtacaagttggactatcaattggctagcatggatgtaaattgtgcaaaaaaaagtgtggtggcaaaaaaatgaataacatatggatgttggtt

SEQ ID NO: 69331 - DNA, 507 bp, Triticum aestivum
  Clone ID: PAT_TA_69331
catgactggatatatgctgcctagaaaacaggctaaaaatctgcctaaggagctttgttcttcaacttgcatgggctagtctgctctgtgctgtaagatgagacacacacgtcaccaagatatggaacgctactggaaatttttcagatataaactgagaactagaagctgacgcgcgctttgctgcgccgggggattaagacgtcattcagttttgtagcttcttttgtgcttgctctccttctgtatgaagatggtgctaaattgatgagcctggcctgtccaagatagtacatgagtgtcgtgtcatgtttcattcaggactattcttattaattgtcaaacaatgcaccttaatatggttaatttcccaaaaaaaatctacaaattccaaaatatcaaaatcaagtaaattagacaaaagcaattttaatacgcagtcgctcacaggagtctatttcaagggagctgagaaacttaaaagatgtgcagaagcatcacacagag

SEQ ID NO: 69332 - DNA, 159 bp, Triticum aestivum
  unsure (1)..(159): unsure at all n locations
  Clone ID: PAT_TA_69332
ggtctccggcacgcaatatgcatntttcttctgtcagtcagtcgagacgacgaccaaaaaaaaaaggancgnganggccgatccacccaangantttcgcnngaaangaacccnggngcancaatncccccngttggctaattncactactacggtngc

SEQ ID NO: 69333 - DNA, 120 bp, Triticum aestivum
  unsure (1)..(120): unsure at all n locations
  Clone ID: PAT_TA_69333
gggatattgcccgaggtgggcagaagtactacatgtaaggggangaatactacnncaaaatatcataagtttaggtgcatggnatntaacattccacaanaatttacaaacncacttnca

SEQ ID NO: 69334 - DNA, 202 bp, Triticum aestivum
  unsure (1)..(202): unsure at all n locations
  Clone ID: PAT_TA_69334
catgcactccaagggcagctgttgggagtggaacttgagctcgttctggaacctctgtagcacgaagtgctcctcctctgttatgagggttgtcacgctgcactctgacttggagaatggttctctcccggttcttccggcacggtggaggtantcngtcgccgtcttangaaggtcgaanttgtatatgtggctggtctgc

SEQ ID NO: 69335 - DNA, 391 bp, Triticum aestivum
  unsure (1)..(391): unsure at all n locations
  Clone ID: PAT_TA_69335
aatacaacagtattaaaacangcttgatttactactcccttcgatccatattaatcgtcgacttagtataactttaagtacaaaagttgttactaagctggtgacaattaatatggaatcggagggagtaatatttctacatcaggcttaataaggttcaagacctaatactactagttcctcccgctcttgaaattaatactcatcgccctaaaagtcgtactaagtctggcgacaattaatatggattanagggagtagtatttctacatcaggcctaataaggttaatactcatcgccctcctgcaacaactttttttgatgctcacagtactccctcatatcgnctgcaaactgggcgtcactcctaaaatcaaacattaaatccac

SEQ ID NO: 69336 - DNA, 565 bp, Triticum aestivum
  Clone ID: PAT_TA_69336
tgaggtctcttgcacacatcacaataaagataagagaagcaagtagtagactactactaatttctttttcactaattatcactagtacgtagatacacaagcccgtttacaccaacccaaaatccatacaggaaactatagaacgctgctactactggtatcttctatgcaatttcctttgcacttcttcacgctgttacatataacatcagcatccatccagctccagctccagcagagaagcggatgcgtccatggatacgaggtgttgtcatgaccttgaagagacggccgtggcggtggcggtgttgagaccccgagcaaggccgtgcacggcggtgccatagctgcggttgccgaggccgatgcaaccgaagatcagcagcccgccctgccggtagggcaggtacgtgcgccgtcgcatctcttccgcctccgccctcctcgcctcgtagagcctctcatgcgccgacatccgcctgcccctccctgcccctctactcctggccgccgcccgcgatggagaaggagatgggctcctcttttggcgtggcagagaaagtcg

SEQ ID NO: 69337 - DNA, 374 bp, Triticum aestivum
  unsure (1)..(374): unsure at all n locations
  Clone ID: PAT_TA_69337
acaattcccggnactggtttacagtntcataatctagtanaancaccntatcgaaaaaaggcaaatcacagaataaggaacagcaagccatcagcgtcgggtatgcgaagggcatgtcttcgaacccttacagatgcgacaaacatccattgcataaacgcatcaagctaaacaaaacatatttaagacctacttccttnacacatagccagctaacatatttctactacataaattccagtttcttccttccagaaaacaatgtagcttctctgaatagccaattcttatgacataaagaataaatctgacgcgatatctgaatagtngctacaggctcaagtttgacacgattgaagaaggaagttggagga

SEQ ID NO: 69338 - DNA, 447 bp, Triticum aestivum
  Clone ID: PAT_TA_69338
ttgaacctagttaactcaagtaaaaaaacatagttaaccggccccatagttaactcaattaaaaaaaacatagttaaccggccagctagaggatcagagcccataacaaaagggccatttgatgctacgtactaaaccaataaggtacaaaatagaagggttttttggacatattttatctttgtgtcaaacgccaagatgcaagtcccgcatcatgagtttgctcagcaacttccattttgcctttctaattttattgcttcgtaagaatccatgacctctttgaatttttcctcagcaaccgctttgttgttttggttttggtctggatggtattccattgcttttctcctaaacgcattcttaatctcagcatctgaaaatggttctggtcttgacctgtttaggcccaagacagaattagtgatgtgacatactgtactgcat

SEQ ID NO: 69339 - DNA, 236 bp, Triticum aestivum
  unsure (1)..(236): unsure at all n locations
  Clone ID: PAT_TA_69339
ccttggtttacacttgntacggtctcctatatagttctataccggcacacaataaatcacaggaagcagagaggagggaggagcaaaaaatagagaaaattacagcggtgaataaataaataaaatcgaaattactgcagtgcagatgcagccagccagccagctgattggatccactgagcgcgtcagctcggcagatctacctcgcgttctcaccgnngngctcctcaccacag

SEQ ID NO: 69340 - DNA, 496 bp, Triticum aestivum
  Clone ID: PAT_TA_69340
atataaaaacaaagaccgtgtcgcattgatgaagcactcgcaacaacaacactcttaacaatcggcaaagtacaacattcagaccgcaaaagaggttctccaaaagtgacacctccaaaaagtaaacaaggcagaagtgttgttgtgagttttcacccagatcccaaaataatgcctttagtagggccagtgtcaggtacaaccaatgaaggccagaccttggctttcacctaggaaattgcggctcggtattcgagagcacaaccaaaaatgcttgccacaaccagaactgcttgtcacctatatgttgttgtcccctcctgcaaagaccatgtgccgtaaatcttcatcgtaaccaaaactcctctctgccattaaatcccccgattgcagccgccatgactttcttcaccactgtcaatgcatggaaatctatacttagacatgtcccatggcaccgacacgatagcaaagcttcacgccacgctctcatgaa

SEQ ID NO: 69341 - DNA, 226 bp, Triticum aestivum
  unsure (1)..(226): unsure at all n locations
  Clone ID: PAT_TA_69341
gcaaacaacagcgagnatacttgngnactacatcaaagnaccacgagaccctagacactctaatctggcggcggaggnggcctagcctccgaatccgtagagggtgcgtccctggcgcnngagggcgtagacgacgnncanggcggcgacggncttgcggaggacgngctcggagtaggtgacggcgtcgcggatgacgtntctcgaggaagatctngagcacgcc

SEQ ID NO: 69342 - DNA, 164 bp, Triticum aestivum
  Clone ID: PAT_TA_69342
caagagttcgaatcagcaagaaggggatcgggatttagagtcaggggtgggaggaaggatacatggcccaacggcgccgcaagtgttctgatccaacgataccctcactcacacccactcctgatatatatatatatggttcacttgctccaggtcggtccggt

SEQ ID NO: 69343 - DNA, 418 bp, Triticum aestivum
  unsure (1)..(418): unsure at all n locations
  Clone ID: PAT_TA_69343
agtgaagagaantaaaaaaggataaacatactagcctatacgtatatacatacccctacggacgacttattgggattaagtttgcaccttttcaagtgagatatcaatgaggatgtaccgtttttcgattcacagcaatagttttcaccacaatagttgcacttagccttgtnagtatctccaaccatgacctttgtaaagcttttccacacggttgatcttggtgccatcggttttcttttattcgccttcttgttcatctgaagaccgccaaatgagttgggcttcatcgcgtcgtcctccagctccttgtctgtaaccgtgcgtagtgtttggcaaacattttgcatggttcccgacaaggtgtccaacactgccttctgctcctcgagtgcttcacagtccgtcggcaggaaga

SEQ ID NO: 69344 - DNA, 702 bp, Triticum aestivum
  Clone ID: PAT_TA_69344
catctgaacgagcactacaaagagtcaatctgctatataatctcatcggacttcaacaactcatttgttctcccacctttactccctatacaatgacaaaatttaatataagccatgtcacttctttacaaatgtatccacacaaaagacaaaacccaaagttacacaataaaccgactcagcaatcaaaataatatacttctcaacatctacatctttctgtaaaaacaaaggcaatataatgtgtgttttcggataacagaaaaacctagccacatctgaatgatagattgataaaatagaatacttgcctcagataagtaaaagaatctacaatcaatacatgtatccactatccaaatagtacatgtatccactatgcacagaacaattttctttgccaagtaacttgcatgaatcgtagtaatttcaattcattttgggaagaacatcagagcaaagttctcggggcactggaaaaaactttccgatgaacaaaacagagtcctcgaagtgagaaataatctgcccaatctacatgcaagattacagttttgatctaaacaactaaacctgaatcaataatataaacctaaatgcaaagactccggattgcaaaaaggcgtgcatatctgaacgaaaatggggttcttcgtaacttcgaaccaccctcgcatacgcatactttggttcgatactcag

SEQ ID NO: 69345 - DNA, 137 bp, Triticum aestivum
  unsure (1)..(137): unsure at all n locations
  Clone ID: PAT_TA_69345
ctaacagctataaangnaatgattganaagaaataatcggnctacagcactgtngctaattgcaagctaaaatctgatgaagacttccgagcgcaatggctgggcctgagaactatcatgcccactgaaaactatnt

SEQ ID NO: 69346 - DNA, 682 bp, Triticum aestivum
  unsure (1)..(682): unsure at all n locations
  Clone ID: PAT_TA_69346
catggaaatctatgcgcattgacattngagatccaaccctaccagtcagcaattcctcattcgtcccaaatctagaagggtgcgtaagagacaccaattttcagtaattaggctggcacacttctttcatctctagaagtggacgccaatttcgtagaaacaaacggggattttgaccccttgcagctccattgatgacatctagatcatgacgaccagccttcagcaggcgacctagatcttaggttttcttccctcttcctttttactggtccgcctgaaacctggaaccacgcctgcttgaaggtcattatcggaaagcacaccctggaaggtggaaacatgctactcctactattatacaagcatacacagtttccataacttagtttatatccagacaaaccgctcacattaagccaacttcagcatctcgatttgtaaatgcgaagaaggcaggttcagctgtcggtgctcttcacggcgacaggctcactgcaataagggcagttcccgaacaggacatcaaacgactgccttgtcgtagtaatggtgcgcagccagtctctcaggcacacggagtggaaggctctgctgcagctagggttttcgcacttgtagtccgccgcgcacccgctctgagtcccgagttcgtcatcgacgggcagatgcgtggcgtaac

SEQ ID NO: 69347 - DNA, 710 bp, Triticum aestivum
  unsure (1)..(710): unsure at all n locations
  Clone ID: PAT_TA_69347
tgatcgatagcagcatttttgttcncaacattcatgcataaacagagtactaaacatggatgacatatatatgataataaattggtctgttctgtaggcactacttccacattgtcatgacaacgtcctttggcaccccccattcagccggaaggattctagctacaagctccttgagaacatgtgggcagctggatgtcagatgctcaaaaccgtcgcttgccatcatagctttgaaattggaaggagaagcaaggaattgcaaacaagcctctttgagacgatggaaaccatgctgctctgctaaagccaaactggtggccaccatgttggaatcgatgtgagtgcacaatttctcctcacatatcagcttcagcctgccgatgttgtacctgtcagccgccacgagtagatggctggccatcaccacatcaagcactggaggaacggagtcagtgtatatgaagtgaagcaaggacttgaaaacatcagcttccacgtcatagatttcaataggattagctgcagaactctccttcatagtgccaaggagctccaccttgaagacggatgagcgagcagcgaggacacacctgtgggctgagaaactctgtgcaccgacttgaaagattaggtctgctgcgtccttattctcgaggaggtcaccaaggtgctggtgcaggtcgcttggaggaatccttgtttcttcc

SEQ ID NO: 69348 - DNA, 118 bp, Triticum aestivum
  unsure (1)..(118): unsure at all n locations
  Clone ID: PAT_TA_69348
ctgntaacttngatcctcagtacgcctntagaaaaggtgcacncatgactcagcagcctnccctttccggcggttgctgccgcctggggaggctccggngcctcccatctncaccagg

SEQ ID NO: 69349 - DNA, 672 bp, Triticum aestivum
  Clone ID: PAT_TA_69349
aggcatagcagaactttgttctcaggcattacatcgttgttgaagaaaagttcatgttttttgacttacaaatgtcttcctgaagaaaagtgtaaatgtcttactcttttttaataaacatcgagccctactagaaacactcgtggaagaagatgcaaaggaggccgacggcaagcacggcctcttgtcggagcaccacctgtacgttctggcattcgtcatcgttgttgtgctgctctccccggcgctgtcactcccttagtgtgagaggtacctgagataggttttgctctgtgtgctgcaactcctttgtccatcaattttgaccacagaagtttgttgcatccacactccttcatcattggtacaagaaagcttgttttaccactagtccatgacgccttacactctttagcccttccttttctccaactgcatcttcaggtttctccatggctattgagacgctgtaaagcagagaacaggcagaggagacaacaaggccgagagttgtgacaaaagcagagagtttattaattctcggagagttcctcaggaagttcaggttggccgtgacgaggagaacaacatgtgcgtgctggtggctggaatggcgtgacgatggtggtggcgtggagcttcacccgaagggggcactgaaggaggggatgg

SEQ ID NO: 69350 - DNA, 239 bp, Triticum aestivum
  unsure (1)..(239): unsure at all n locations
  Clone ID: PAT_TA_69350
tagctaaatatacatgcagtagacttgaacgttagtaacactatagtacaatctgtgcatnaagaagcctcgatctcatgtacccaggctccacggtctggccactcgtagaccggaacgcccnatgcacaggcgctctcacggccgagagctncactctccatgggaaagggaagaacatggaggaggctgnacgaaggtgcagatctgnaggaggaggaagctacgcggacgcggcg

SEQ ID NO: 69351 - DNA, 730 bp, Triticum aestivum
  Clone ID: PAT_TA_69351
cgaaaacgtcgaagccttacaacatatatagtgaaggtaacaatagaccacagcttacgaccattacaagttcaaccaagcttccaactctgccatatttaaaccaccacactccgactctaatactagaaagcacagaagattatcagctaattaactgcttataacatagataattgctaagtcaagatcaataaagatcccccagggctgaaggtaattaaccacaacaatcgtacaaagagctacactggtgaaagcaacaagacttgagctgctcttccttctttccctgcaagcagtggcaaatatgaatataaagcttaaccgacccattccacagctgagaaagggtccttgaagcagtaatcggttcctcttttgaagctccaaggcctgcctccttcagggccatcactcccaagaacaatcattttgcatgatttactcaccatcttttgagacacttgtttcactctagaagatagctcatccgtagaaaatgatccagagcgcattgtaatcattgcactctcaagagccctcgcactacgaaagaagaacttcaggaaagcagcctcacctagctcccctcgaaattcacagaaagatatcaccttgatggagaactcgacacttttggtgggcttggccgactcccagaacctgagattgagcctgacattgccagcttgatagacaccttttgcggacatgatatgcagcgtct

SEQ ID NO: 69352 - DNA, 649 bp, Triticum aestivum
  Clone ID: PAT_TA_69352
ttaagacccgaatattccaacaaagtacgttccacgactgcaaaagagccattaagcgaagaaataaagcgaggaatcaagctgaggttgatgaagaggtccccgccgggtcttcagtgaaagcagcaaccgtgagctcctcctccgggatagcacatagatttgtgccaatggcttgcattgtggcaatgtcagttggaggagggagatcttcaggagccatctgatttgaagcagcagttgcaggaccagcagagacggctgtaggaacagtgcgcggttttaccttggatttagagaccttggcttcagacagagaggtggtgcgaaatccatcatatttgttagtacgagtgctgcgacggagagtggaagtgtcaatggggactggcgcctttcctttgcgtttatgagctgaagaacccactgcactgattgtagtttcagaaatggcacctgtcgcaatctgaagcaggccagtctgagtttcagagtgatgtgcagccaagtccatgaggtgtgaatcagtctccgaatcagaactgaaattgttggtttgtaccaccacagtggcagaatcctcagtttcagtcagcagcacatgagaagcttccatggagccctgtggcttcagcctggactgatcaac

SEQ ID NO: 69353 - DNA, 625 bp, Triticum aestivum
  Clone ID: PAT_TA_69353
atttatttcaacaggctgtagaaacgaatttaaacaactaccagcacaaatgaaactcacacatttttaatactcctgcctaccagcacaaacatcatcaccaactaattaggctctcacattttctcagcgagggttggtgctgcgcaccacgccgctgagaaggttgctgccggaggcgtccgaggacgacatgtactggtaggccatcatcaaccccccggcggacgacgacgacagctgcgtgcctgtgcggcccggggtccatggacaccgagactccgactccaacggcacgctatccgtctctggcgtcatctgccatatcgtctccagctcccgcaccacctccaccatggacggcctcgcgtccgtctcgtcccggcagcaccgcagccccagcgccgcgaacctctccacgcactcccacgggcacggacccatccgtgtgtccaccaccgacaatatcatccctgactggttcgccgccacaacctctctgaccaggtttttcccatgagaaatgggctgcatccctgtcagcagttccagaaaaacgacaccgaggctgtacacgtcgctcttgtccgtcagattatgcgtgaggaaatactccgggtcaaga

SEQ ID NO: 69354 - DNA, 146 bp, Triticum aestivum
  unsure (1)..(146): unsure at all n locations
  Clone ID: PAT_TA_69354
gcaaacgatagatcacgagcttattctagcaggntgcatgcatggngctagcttngntngatagacctagcttgactcctatntagtnggcgacnatcctgagcccgaggctnttctgcgcgtactcgatgagtccgtacacctcg

SEQ ID NO: 69355 - DNA, 746 bp, Triticum aestivum
  Clone ID: PAT_TA_69355
ttgctataataaaagacttgaacgttcgaatatttcccattattaagattatacataggatttaagtacacacaaacgtaccaactgagatcacaggtcactgggataaacataagcagaattggttggtcccaaagttgtagcagagcaagttgggagtacgcatgaggattccaagcagaacaaacattgcttcgttgatcacatagctgccgaagggaaaacccatgccggacgccactgcccaacacgctctagcggcacagctgctgtctctgacatcaatggtgtgatcatcccattcctgacgttgtatacaccggagtcgcgaagaggatttgcagaagagctcggcaagggatagtcacacatgaagtagatgcaatcctcttggtattcactgcattctgcagggggcagggacttggagccatgttggccaagaaagagtgcatggccacccaaatcatggacccttctccatcgacgacgggggctgctctgcaaatctgcctcaaagacctcaagtgcagccgtgcgtttatcttcaaagccatcgtcacttgcagaaatgttcacccggtgaatccatcgtgtcaccatcaacagtctaccaccacattcaactagatactcccttatagtaaatggatcccctggggccaagggttgaggaactaaacttaaatcacccaaagagtcaattatgctctcgaaggatgaaataacaaggtcatcgtccagct

SEQ ID NO: 69356 - DNA, 549 bp, Triticum aestivum
  Clone ID: PAT_TA_69356
aaatagttaaaagagttgttgttccaacaaattggtagcaaggatattgcatttcttacatggcagccaattaggcaatatacaagcttagctagcttcatcagcagaaaatactgatgctgtggctactaattggattttggagttcagggactccttccaaccacacacaggataaatcatggctgccgtgaatgatttattgatttgtaaaacttgaccttatgagtggaagtgaatcacagcaggagaagccttcggcaacgcctctgtgattttatttctcaacaaattcttctcatcgctggtccgtggataactcgaaggacgaacctcgacatgaggaaacttgacggcgcaaaccttgcacaccttcctgtcatgcagagatacctccttgatattcacagcagcctccatgacacgcctgatgtgtcctgtgaagttatcatcggactgaaagccatatatggttaacttggctagattcttatgcttgaaatcagggtcagatggctcccacttcacatcagttttctcggagtaact

SEQ ID NO: 69357 - DNA, 313 bp, Triticum aestivum
  unsure (1)..(313): unsure at all n locations
  Clone ID: PAT_TA_69357
tgaagctagcatcaactatgttttggctttagaggccgcatatgacctcagnatttgagatgatctagaaagcaaaactgttcatctcaaagaaatatacaactttatgctggtcacttttagacaattttgaacacttttcccttttgggtcagtcttgagaatcgtgacgcttaagatcgcatacatacaagccacgtgcgctgcagaaaaatatgctaaaaatagagacatttaatctagtatctggacaaaccgcagtgtatcacatgaaatttcacaagggggggggggggggggggntttnaaaaaa

SEQ ID NO: 69358 - DNA, 280 bp, Triticum aestivum
  unsure (1)..(280): unsure at all n locations
  Clone ID: PAT_TA_69358
cttcctcctccaggagctcgcgccgttcccatcccccaggagctcgcgccgtccctttcccccaggagctcgcgccgtncccttgccccaggagctcgcgccgnccccatcctncaggagctcgcgtagtncccatcgtcaggagctcgtgccgncgncttcctccaggagctcgtgtcgtcggcttcctccagaaacttgtgccgtccccctcctctagnagcttgcgccgnncccctcctccaagagcacgcgtcagtccgcatcatacaggcgctcg

SEQ ID NO: 69359 - DNA, 557 bp, Triticum aestivum
  unsure (1)..(557): unsure at all n locations
  Clone ID: PAT_TA_69359
aatgaaaacttacagacgacatggtccgaacacatgactnttacagagtaccatcgatcgaccaagaaaccggaacagactatctaagcggaggtgaacttggtgacggccttggtgccctcggagacggcgtgcttggcgagctcgccggggaggacgaggcggacggaggtctggatctcccgggacgtgatggtgggcttcttgttgtagcgggcgagcttggcggactcgccggcgagcttctcgaagatgtcgttgatgaaggagttcatgatggacatggccttggaggagatgccgatgtccgggtgcacctgcttcagcaccttgaagatgtagatcttgtacgtctccacgctcttcttcgacttcttcttgcccttcttctcgccgccctccttggacgccggcggccgcttctcggccttggtcttcttcgccgcagtggtcttctcggccttctccgccaccggcttcttctccgccttgggggccatggatgccgctgcggctgctgctgcttcgccggggaaaggtgtggggtgggttcgctc

SEQ ID NO: 69360 - DNA, 644 bp, Triticum aestivum
  Clone ID: PAT_TA_69360
acaagaatatgcacttactgtaaatattcattaaagaatcggattggaaccattctacatgtccctgtagtactaactaatgctgtattaaacattgatttaacacttatgtcaaccaggctgcgccagtaactatcaatagctggtagattgggaatgggtaatcattgattagttctgtgtatctaaagaaactgattgcagcaaacccaaaagacggaagaattcgaaggggactaagtagggctttgcttgattggctaagattatagtactaattggaaggttgcctggcaaaagtactaattataatgtaggaaggattgatacaaataggtgttataacatgtttgtggagttataatatggaaatgcttttatgttaagactttaataagatagatgaagtatcgaattagttgggtttggtgagaattggttgaactggagggagaatgggggatccatccatgcatactcttggaataagttctttactaataggtgatgcagatcttgaccaagtgtcagaaacaaataggacagagatggctaaaaaagttggtgtggaatgtggtcttcacttttgaccttgagaagtattgcactgcttaattcactggattcaccgtttctgtaattta

SEQ ID NO: 69361 - DNA, 123 bp, Triticum aestivum
  unsure (1)..(123): unsure at all n locations
  Clone ID: PAT_TA_69361
acaggcccgngatttaaattanngctagaaatggcattgacgaatcaactatcatttgtgtcaaagtcacgaatatagtgcgcaaagctttaccagcctctggcacacataccatcttggatt

SEQ ID NO: 69362 - DNA, 112 bp, Triticum aestivum
  unsure (1)..(112): unsure at all n locations
  Clone ID: PAT_TA_69362
cagcaagtttgncttgccagccactcatcgttacatccaantcagcccagagaggcacaaaaaaatggttntnntgccttttgatctacacacggcactgccatgacgtagc

SEQ ID NO: 69363 - DNA, 105 bp, Triticum aestivum
  unsure (1)..(105): unsure at all n locations
  Clone ID: PAT_TA_69363
atgactacccatggtttaaccagnattacatggcacagcttacaccttgatgagaattgngnaggcatatagcnatcaatgaaatgaatgaattacttgaaaggt

SEQ ID NO: 69364 - DNA, 607 bp, Triticum aestivum
  unsure (1)..(607): unsure at all n locations
  Clone ID: PAT_TA_69364
tatatgaaaaacatnaagcctatggtccatagattcctatttgatagtcttgtattgcagtttaccagcacaaaccggggacaatgatacagtttccctacctaacaaaaaagtacagctatgttttcctagagagagttcgctgtttcgtgccatgctccacaactttctcttcaacgtgcaatcctttcctccgcctcacagaattcataagtttcttggccaagtttggcccaatgcttgccccatctccaaattcttcaatctcctcctgtgactttgggataaaaaaagggtcctcctgaatagcatcccaatggctaaaaacaagcagcgcgctggctgcacctgatgttaatgtcctgagctgactagaaaatccaatgctctcggcaacatgcaagtaagcatgcactctaaatactgaagtcccttcttgcatttcttcttttaaaatcttcgctcgtctcctgccaagaactgcatatgttgaacctagttgctgagtcggggtggtcaattcacagaaatacatgccttcgacaagccttgggttgttctgaagaacggctgctcggcatgcttctttaactgcggttattacttg

SEQ ID NO: 69365 - DNA, 579 bp, Triticum aestivum
  unsure (1)..(579): unsure at all n locations
  Clone ID: PAT_TA_69365
tagtatggaatntacaaacagagacccacgggcaaacaaggcaagtaattagcaacagatcattatgattacactctgagcattgcaagatgcaaatcaattgatgttccagctgggactggaagaggaaggattccaagaaaataggatttgacatcgcgttgatcaagtccatggtgaagaagaactgattgtcggcgcgccagcctctggtcccctggaaatgacgttgtggcttgctacaagatcacgggagcattgaattggaagagacagtcttcgcccaaccgttaattctgccatggaggatattgtggcgtctcttgcagttgtcatgccaccccttctgagtactccatttgtatcttcctgcacctccagctgaaccactttgaagtatgatctcttccgagtcgcttccttaaatccaagtgtctggctgtctgctatgcctgcagagtgtagcttgtggtggaattggcatgattcagtcagcatgaattgtaagtgtagagcaggtcatcttggctgaggtttgtcgtcgctaccgctgcttcaggctcagcatggggagatgac

SEQ ID NO: 69366 - DNA, 197 bp, Triticum aestivum
  unsure (1)..(197): unsure at all n locations
  Clone ID: PAT_TA_69366
cgctgcaacacccatncgtatgctgacatttaagataagagagagagaaacagatgcagtaccaacaaatggcagaagtctttctattgacaaacacgacatatgtaagcaaacaactgaatacagagcgatcaatggtgaaaacagaatctgcatgtttgcattgttgactagaaagtgaaaagaaggagtttacc

SEQ ID NO: 69367 - DNA, 477 bp, Triticum aestivum
  Clone ID: PAT_TA_69367
ccagatatcatttatatttatcagatacaaaacaacttatgagcacaaacacagctgcactgtacaagagctgagctgatagcatacaagatcaacaaagattttacaaaaaaggaaacacggcagacgattccaatcaagtggatgctcttcaggtcagatttcgaagagaaattgtccacagaagatccgcatctgactgcacagttactttatctgaatccacgatgttggatgtgcttatcatgctcccaaatctcatctctgcatcactcaggttccacttgaggccagtggttgtagtgcttgtagatggtgctccaataggaaaaattccacaatgcggtccttctacagacgactcaatatatatctcatggtgatgcgttttgggaagaagttggatcaagcaatcatctgacagaaggacaattcgcatgtccgagaacacatagagaacattgatatttgcagcct

SEQ ID NO: 69368 - DNA, 130 bp, Triticum aestivum
  unsure (1)..(130): unsure at all n locations
  Clone ID: PAT_TA_69368
aacattnnaacttacgatgacagtanctgtggagacaacaaaaggngagggcttgngctcagccttccggtcactggccatatcctgagaaacattctatcttcacgtggatagaaggactggaattcta

SEQ ID NO: 69369 - DNA, 546 bp, Triticum aestivum
  unsure (1)..(546): unsure at all n locations
  Clone ID: PAT_TA_69369
ggtgttaaaacaccagagtncaaacaaaccaagtctacacgcagaaccttcaagccanctattacaacacatcaccaagtctacttaacatactccaatacttctccaaacaaaagggatacactacttcatacaaactccagttccagtaccattccaactagtctgaagtttcagacatttattcaaatacaaacttaaacctgctaccacgaaaaggtcagatgatggtagcaagcancagcacttacctanataatattttgtatggcaaagggggtgttccactcaccacagggtcctggaaactagcactgaagtttcgaggacaagtaggcgatgagcgaaagcactaccgatgccatagcccaagaatgaattgnccgcggacagccagatgacggcagggacagacccctgccctggagctggacacaatgccggcagatgctgccggtttgcgccatctcttgatatttcggctgcccgtcaccccctcaagtcatgctttgaggaggttgcagcagccatcggaggctgctgcca

SEQ ID NO: 69370 - DNA, 456 bp, Triticum aestivum
  unsure (1)..(456): unsure at all n locations
  Clone ID: PAT_TA_69370
agactnaacacgancaagacacaggactaatagcagnnggtccaacgtcagggcaattactgaccaccacggnggcggagcaccaggtgtagggtggactccttctggatgttgtaatcagcaagagtgcggncatnctccagctgcttgccggnaaagatgaggcgctgctggtccggaggaatgccctccttgtcctggatcttggccttgacgttgtcaatggtgtcggaggattncacctcaagtgtgatggtcttgccggtgagggtcttgacgaagatctgcatgcctcccctaaggnngaggacaaggtgcanggtggactncttctggatgttgtanncagcaagggtncggcattctacagctgcttgccngcaaagatgangcnctgctgatccngangaatgncctccttgncctgnatcttgccttgacgatgtccatngtgtc

SEQ ID NO: 69371 - DNA, 682 bp, Triticum aestivum
  Clone ID: PAT_TA_69371
tgataaaaggtatttgatgatgtacacatagagagtgatgatccaactaataatctgttacaagctaagatttattttatgcaccgcgcgatgtgatgattgaggttttgaataagacgaccattgcaaagatattcttgtacaatatcaggtcacagacacatgctcacccttgactctataaataaactagtagcttgggatagcgagtatagttccctggtgtcgggccgtcaataaagtccatcatggccatatcccatgggatacttgagcaagtataataaatttcttcctcggctatagccatccgcacaaaccagacgaaccattttttttatcgttctgcaagagcataaaattagaaagaaaatagccggacacatccccatccatgcttgttaaaataccaaccggaaatatgtgttgccatctacatataacataattccagtcaggttgtgctattacaattgcatcgttgaagtacctcgcaaatctcagtaattttgcctcagagttttagtctctaatgattgtgatgtatctagatgcgagaggtgattgtttttgactgagtgagtgtaatagtgatttttagtagagtggcatcccaattttaataaatgttgggcccacctataaaatccttgttgatgattattcttggaaatttactatt

SEQ ID NO: 69372 - DNA, 699 bp, Triticum aestivum
  unsure (1)..(699): unsure at all n locations
  Clone ID: PAT_TA_69372
actgaactacttatgcacgacaactcatgaacattcaggtacaagcacaaataaactacttcataagcactaaccngatcaaatcttcatcctgagctcaggcgctttgtgacagttgttttgacgatgcccttcaactccacaatttttacatctccccagcttccgaggctattttggcacgtctccaaggtcagggcaggttgtccgcttgtgaccttgtcgccgacaaatcatacagaaccttgttctcttactcagcccttgatatggcgccttttctttgcttgttgtaggccttcctatttccttcctcttggctggaggtaataagcatgccatcatattccctgattcattagctgagttgacagcatcgttctccaataccctcgccattttgactcccactcctacttggtcaccttctgcctgaaactagttcacaaccaccccattttcagccatgcggtcctccagtccaaggtcgtctctgatctccacaaatggtttcatttctacagcacagtctttgaataattcaaccagtcaatcgtaagcctaaaagcgtcccccatccgtacaagctctattgcgtgcatgtacatagtgaaatgcctgtaactaaatggattgttgctgttagcattgtccttctggtactggcttagatgtggagccaggatgtccanggcgtct

SEQ ID NO: 69373 - DNA, 110 bp, Triticum aestivum
  unsure (1)..(110): unsure at all n locations
  Clone ID: PAT_TA_69373
taagattgtcttagntggtgtggtnttaattacagctttgagttggtatacaaagaataattggatagttataggttgtacaactaagattaaagaacctgaacgtgcgc

SEQ ID NO: 69374 - DNA, 364 bp, Triticum aestivum
  unsure (1)..(364): unsure at all n locations
  Clone ID: PAT_TA_69374
tgaaactgaagctattagcccctgctgccagctacctccccctccagaccatacatgcttcagcttgcatttgcataagataaaaatgaagtcaagtaccgaacctctacaggtaccgactgccatcttctttcatgcttccattctgttggcgccaaaacgggtgctctcagatcaggggttcatcggggctgcaggtccatgggtggccaaggacaccatttgacagcatttgctgctagatctaagtttgctcaggtcaaagcatgaaggctggcagaagctttcttggtgcaatagcaaacacgcccatatcataaaaggtaacagattcatcggnagttctatgtgaatcggcctcgag

SEQ ID NO: 69375 - DNA, 537 bp, Triticum aestivum
  unsure (1)..(537): unsure at all n locations
  Clone ID: PAT_TA_69375
tcgaggtttcacaactgaacatatcaagtgataatgtgatactaatgtatgatatcatgcaatgtggatgcagtaactaaagtagtatcatgcgttattatgatactagcccatgatactatgcattgtgggtggccttaattcctgtttgtccaaacttggaatgctggccctaaaacaaaaattgcaccccagcaaccatgatgatgcttcacttggattttctaactaatgcatgctgtactatacttgtatgtatgacctatactgacgtacatttacacgagcggacggacagatggacaggttagttaattgacgcgctaatcaatgcgctatcgccggacctcttttctgcagtccanaggaaagcaatggatctcacggaatcccgcagacggctaacagggagtcctttcagagttgggtgagacagatnccttctgctgggttcttgttcctcgcatgtttcttctccgttgggctcgcccgagctagggccttcatcttggtcctcgtcattcccgacggtcacga

SEQ ID NO: 69376 - DNA, 561 bp, Triticum aestivum
  unsure (1)..(561): unsure at all n locations
  Clone ID: PAT_TA_69376
ttttaaaatcttaagtatnaatccttaaattaatagtactgcctaataacctgaacttgtattcggaagtgatatacaaatggaggggggactgcctaataaattcgaagtactatacaaattcagcctatgtgctaagattttttctgcacatcgctcccgttcactttcagttagactcatggttaggcccccatcaaccggcagcaccttttgtgaagagaaggatccacagagctctgcagctctatacattcttgttgcgacgtaatattatgtcatcagttgcaacgggttttccttcaaggttgcagacttgtgctcattgctgcattagtgcatcgtcctgactccagagcacgataccaaagtagatgaacacccttgaggatagggcagagcaaggaacctcccaggctcaaaatcagggtgcataccggcacctccaggagcgcgtccgtgcggccaccactccatccactctggcaactggccgtgacgatgcaacccccgctccatcccctctngcaaacgctngggccgtcacggacaacgagttgt

SEQ ID NO: 69377 - DNA, 121 bp, Triticum aestivum
  unsure (1)..(121): unsure at all n locations
  Clone ID: PAT_TA_69377
acccactaggctgcctgaagcatatctcatcacttngttctcctgncttctccgcctngggagccttcttctgcctggctcccaacnggcgctggttcatcctctagacgcggagctngcc

SEQ ID NO: 69378 - DNA, 242 bp, Triticum aestivum
  unsure (1)..(242): unsure at all n locations
  Clone ID: PAT_TA_69378
cacacgtnacataggctaacacagggnactagagtaattaaagatgttcaaactactcacttgacaggagagcacanacaacacaaaaatagacaagtaagctaggttcttacaaatgactagtntgataaacagagcacatatattgaacagnactactagacaaatctgaacaacacatgccatacaaatctcaattctaaacattacaaaatactaaacattatactactcaagattac

SEQ ID NO: 69379 - DNA, 636 bp, Triticum aestivum
  Clone ID: PAT_TA_69379
cgtgctggtctgctattggtaaatagaggacataagatataaccttgcaaaaagatggtaccatgaaggaaaaggtgaacaaacaactcccttgacggataaaaaaatcaagacagtagacaagagcatagacagaggcaataaatctattcaaaatgaaccaaaagaaaagggttgggtaaacttcagctgctatgtttggactgtcaatgtatgctcctaaaaggtagggcacttggttccaggtgccatgacccttgtggtatatcacgctctctgatttcaatgacaacaaaagcaggaactcgatgggaaaagctgagcatttcagacttcgaaatccaccttgtcaaatggaaaccttccagtaatgctctctggaaaaatgataaacagccttttacgcgagtcaagctgcacacattaactccattctcatcagtgtaatctgagaggatctcaaccatgcgaggttcacatttgtcaatatcagtgctatttaaggtaatcttccaatttttgtacattgcccatatttcccctttcttcgggaagattcgatagaaagacttctttgagctccagtcacactgtacaggatgagagaaagctgatatgtccttgtaagtagttcca

SEQ ID NO: 69380 - DNA, 563 bp, Triticum aestivum
  unsure (1)..(563): unsure at all n locations
  Clone ID: PAT_TA_69380
tntggtcctgacnctcggcctatacgatntatgcgctctgctcctcctgaccctccgatactgtgccatctacgtccgcatcgccgccttctcctcctgctgcctgctgatcatgggcatggcttggctggccnccaccgccgacacgctccgctcctcctccagctccctccacatgagcttaatggattgcagtccagctctaccgccgcttcagctcatcaactgtgctacactcttcaacttcagtatcaagcatgatgccgtctgagacgcctaagtagttccgctagagggagagcgccctggtgcttcagaaataagcaatcgtctatgatacactgattaactggtttcttttttgttatcttactctgatggaaaaggtgttctctatttttggtaaggtggcatttgaactaaaatgggagacttcacaacatattgaatgtgactggtatttaatctatccnggagaaccgcgccttacatgaagaaaatctcactaaaccctaaacatatattgctaaagcaactgaagggccatctttctctcacttgat

SEQ ID NO: 69381 - DNA, 264 bp, Triticum aestivum
  unsure (1)..(264): unsure at all n locations
  Clone ID: PAT_TA_69381
agcngagcaaaacaccgaagagacccgtaccctagacaaanactgctaatgtctttgcttgcttgaagatcccggcgtcggtggcctagccgccgaagccgtagagggttcggacctggcgcttgagcgcgtagacgacgtccatggcggtgacggtattgcggcgggcgtgctcggtgtaggtgacggcgtcgcggatgacgttctcgaggaagatcttgaggacnccgcgggtctcctcgtagatgagctctcgagatgcgc

SEQ ID NO: 69382 - DNA, 480 bp, Triticum aestivum
  unsure (1)..(480): unsure at all n locations
  Clone ID: PAT_TA_69382
attagagtactacctattgtttactgacgcaaaatcatctgcgtaaaccggaacaagcaacgctgcagaccagccccagaagttagactgcaagttccgcatgggccggggtccagcctctcgtctagagcttcagtatgaggccgagtgggctgtggtcactggcagaaacgtctgggaggatgtatgaatcgtggactctttctgcgatggactccgacacgaggaagtaatccaggcgccaacctctattagtcttccggnaattatgcctatagccccagtagctatatncaacaacatcagggtgctgtttncgaaacgtatncacgaaccctttggacagaaaattagtctcgaacgattncctttcttcttttgtgaagccggcacttctactatttccagnaggatcatgtatatcaatctnctgatgcgcacagttaagatcaccagttagtatgacagggtttcgatttt

SEQ ID NO: 69383 - DNA, 151 bp, Triticum aestivum
  unsure (1)..(151): unsure at all n locations
  Clone ID: PAT_TA_69383
agaatactgatggttcttaaggagaaaatgtaagggatgccnggctacattaacttgagctggcggaaaattaacctgccaggcatacatcataagtacaaaactcttccttacaaaagaatgaaatggagaaggaagttcatcctgagac

SEQ ID NO: 69384 - DNA, 774 bp, Triticum aestivum
  unsure (1)..(774): unsure at all n locations
  Clone ID: PAT_TA_69384
actgagaaaatnagatggccgtagccgtaggaggggagcgcacgtacatgagcngatgcatctcatgctcttgtcctaatgtcctttgaataagcatgaggaaaattgaagataacatgatcaaacagtctcatctctggataagtgtgatgcttcatcgttttagaactttgcccccccattctcttcagctccattacatttagttcttcacttgctaatcggagtttctgttgaagaaaattgtaagcaagaatgcaaagcattgagatggagctgggataggagaaatataggaacaaggtcaccttgtttccccaccagtgacagcaaccacctttggcgccgccgatgcccgatgccgatcccagccaccaagccgagcggcgacaccatccatgaagaccaccgtctccgtcgacacaaaatgaggcggtgctgctcaatccacgacacactttcctcctactgttcctacaggacacgtgggggtcgtgggcatcgcccccaatgagtcatttccgctgtgattacttgtagcaatgctagcattgttctggttagtaaaggagcaagtgtggcaagctgtattgcagcatctcagaagatgaacaatcaaagaagaagaagaagaagaaagaagaagatatatctcagcagaggaccaggaaacaactaggacctcactcactgctcacacgcctaaaataaactaataaataaaatagctttcagttctcatctgctactctaggcttcaatgtcctttagggg

SEQ ID NO: 69385 - DNA, 631 bp, Triticum aestivum
  unsure (1)..(631): unsure at all n locations
  Clone ID: PAT_TA_69385
aatttctttggaaacctaaatgtctaagaggatggtcatgtgagaagctgtgaatccacaaacaagaaactaaactaactttcagacnaacatttccaagtttggaagccacaaagaagcaacccagatctctcgttgtagtgcttgtacatgtccttaatcctgcatccacagcccataatttttcaacacctaaatccacgaaatccaactgaagaaaatcatggcagaaacatgcgtcgtggcttacgtcttcaagaaggacttcttggcattcttgtgcaggttggacacaacaatcctcgctgcgagctgcagaagaaccacacaggcaccttccttcaccttgccctttgggaggaggggggcaacacttgcancgtcncgacaaggcttgctccgagtgtagtcatcaatactttccattattcaaccgggtactcagatggatagaactgaacacttgactcaagaccaacggtgcttgccttgtctgttgagtaacttgcgcttgaaggccaacctattgcataatagcatccagaagaacttttgttggaatctttaacgttttccatcgcggcgtactgcattagtatgtagttgaacaaacggtatctccaaaattggc

SEQ ID NO: 69386 - DNA, 656 bp, Triticum aestivum
  unsure (1)..(656): unsure at all n locations
  Clone ID: PAT_TA_69386
tttttttcgacgccntaaacagttgctcgagaattcataaataacttaatnttcatgattattgtacaacaggaacaatgacagcatcaaacattgtggaatcctttttctttactttccctttcaaccgctgattcttctactactgttttcaggtattaccattctcatatgtacaatttatcctcgcaacagaaaatcctggagatgcttagggctgctgctccgacgccgtcctcctttggaggtcaaatttatggttgaatataattatggaattttttctaaggggaaacatgaattcttcaatttcctttatttttttcatcactctgaacctccttttagtaacttgtactggtacttcttcctcagcctgacagccaggcgcacgcatctctttacattgattttcagtatattgtcgttgaacatcttgatagcatcatctattgagtgagtatctctaataatcttgtgtcgattgattatcaagattgctgctacacagaatataggcagttcgtcgtctccattctttgtcaagacatttgtactcaaatgaggcatatgttgatgccttgcccagatagtggcacctgacaagccacacaggggatttcttgtactagatttcactccagggttgcaagaca

SEQ ID NO: 69387 - DNA, 163 bp, Triticum aestivum
  unsure (1)..(163): unsure at all n locations
  Clone ID: PAT_TA_69387
gccatnttctgtgcagtncctgccttncaaagtccaaacaggcactgtactctntcnangatattagtattgtgtatgacgcgcctgagccatcaattngncgctccttttnttgctgaaatcaacagagacaacacccactgattttnnagcacgcaatagc

SEQ ID NO: 69388 - DNA, 576 bp, Triticum aestivum
  unsure (1)..(576): unsure at all n locations
  Clone ID: PAT_TA_69388
ttaagctggcttagcactagaaaagtngtactccttgctgtaaacagggagcagtaacactacactgatagatagcaaattaagtgccataatgcatgcctgcatacactagctaaagttcagaatgactggctgaatcattcagagcacctcctcgatcctctgctggttgttgaacaagtaacgaccggatttgtgcttgatcatacggaggccacggatcagccctttgcctttgccactactgtggtcattgntttttatggcaccatttctgctattcttgcctttgccgttgccgttgctgtaggctacttccataccagtgaagagggcgaattgcttgtcaacatacatctcgttcgattccttgtcgaattgcatgtcatccaagaggtccacgaccatgaacttgccagaaccaaggctnnnacccctgggcttgaacaattggcttggctgccactcctctggcaggtcatcgtgcacccagatccgcatcttctttggcggcggctcctccccttcgacgacgccagagaggtcagcagcgcaggggaggtcgtctgcgacgcc

SEQ ID NO: 69389 - DNA, 828 bp, Triticum aestivum
  unsure (1)..(828): unsure at all n locations
  Clone ID: PAT_TA_69389
acggtcgaacccgaattcgtggaaggagtgccctcaagatggcacgccacacacaacaaacaagaacagagaaacaaatcatgagctgattgccacaaaatttcggcatcccatgttcaacatttacaagaggcagaactcacccctactaattgcaccgcgttaacagtagcctcaagttatcttgacttcccatgactatacccacctactatttacaaaagttgccatgactacctatctacctactatttacaaaagttgccatgcctacctatctacctactattcacagtttttccatgtcaaagaaacattggtcatatctaagaatgtgcatggctaaggaatgaatgacagcagacgttgagatgatgaatgggaagaggaatcgggtactgatcctatttctagattataggtaattctagggccattgctaagatacatatatatatactacttcaaaaggacaacaagaatttcacttggtaatgatgaatgaaacagatttcttaaaattgaagtacttggagtactcctaagatatccaaggatggtattgccaccatgcaaacactgggtaaaaagcatgtgcttgctgtnctgattgaatactatcaatcatgggcgagtggcaaaagagtataacaaggataatggttgaagtttatcatagaaggacaccaagaattttagtttggtaacgacgaaacagatttcaaaagattgctcaacattcaagtattactcatccttaggtatctaaggatgatatcgccaccatgcgccacactgaaaaaaaacgtgtgcttgcatgttctgatt

SEQ ID NO: 69390 - DNA, 204 bp, Triticum aestivum
  unsure (1)..(204): unsure at all n locations
  Clone ID: PAT_TA_69390
atactagtactgcatgaaagacggcccaattcagggtaacacatgcactacacgcacaaactaacatactccatacaatcactactagtagattcggttcacgcatacggnactcgatcaatcgctcgcagctagcatantgcatactctacattagtgcactcgttattcagtagtcacttatcagtacctcaggagttgatc

SEQ ID NO: 69391 - DNA, 721 bp, Triticum aestivum
  Clone ID: PAT_TA_69391
tatgatggaaacaagcatcgttcctaatagcattcaaccaaaacaaatttccatcaagtcctgaacacaagtcaacaccctgccactcttacacattttagccatcctccatcgagcagccgaacaggaggaaattcaagtctttcatcaatcaagaatacaaaaagacacatctcaatgacttgaaacggcttaactagtagtactacgaaactacacattcttctcggattcacgcaaagataactgcatttctgatgcccctctaacttgagcatgacgcgctgctgctctcgctcttgctaacgcagatgcgcacaaggacactcttgctggttttttcctcacgcagcatccccggaagcagtgggaaacagtcacgctccatcctccagtccgggcagctcgccacctccttaatttccagcttcagcttgcgcctctgagcaggaggggcatccgccctgaccgagtaggtgtacaccggcccagcggcagcagcagcgctattcctgacacacacaagggtcaccaaggggaaagggaactcctggaagaacggagcaaggtccacgaccaataggaacacgccaccgtcctccccgagaaagagttcatagcgcaccatccacgaatccatcttgtcggtgtacacaaacgacgaatccatctcgtcggtgttgtatatgtagtcttggccgtatgtgaacttgtgggcgga

SEQ ID NO: 69392 - DNA, 360 bp, Triticum aestivum
  unsure (1)..(360): unsure at all n locations
  Clone ID: PAT_TA_69392
atatcacccctaccaaacgtggctgnatgtgcaccgcctctngaccagactacccaagngacacttntgttagcaaggcttatgaggngcttcaatcgtgagcattgtagggaaatagtgttcgtcnacataacaatgaggcctgcagaactccttgaatttcgggtaatagcgtgtgtctctgatgatctcgatgccaagatctctgtctacttcaaaccattgcgagcctttgcgccattgttcgagctcaacctcaggggtcatgttataattatatcggccccgtccatatggcccaggatcatcaaacaccatgacaaagctttggcttgaattctgaaagtattcgtatgtggt

SEQ ID NO: 69393 - DNA, 605 bp, Triticum aestivum
  Clone ID: PAT_TA_69393
cagctgaaataacgtacagtacataccacttcacaacaagcacacacgaacaaacatcagtacatagttcaacacaggtaatgcagaaaaaaaaagggtctgaaaatggaaacacgacttagtctgagtcttacaataattggcagaaaatacgacaagcaaagcagacgaacagtaacagtagcagtaaacagaggcagtagcacaagtgaagcaccgtcatacgcagcagagcaagcagattgatagcagaaatggagcaaagcagattgacaggggtgcagcaggacagtcaaaggtacctcgtcctggcagccaagggtacgttttgaaacagcagaggaaactcctcaactcactgaatcgaatctggatgcggcccaaataatgaaagcttcttccttccggccggtgaccttgcgtaggtgcacatttccgaccagtgtggcaagtcaacgccgtcggcgagtatactggaacttcccttcaattgcagaacattggcgcaacgatgttaggaagtcgctggtgatttcctggaagaatagaaactggaggggcaggaggaacttatgccaggtggaacctccgtcatgctgctgagg

SEQ ID NO: 69394 - DNA, 140 bp, Triticum aestivum
  unsure (1)..(140): unsure at all n locations
  Clone ID: PAT_TA_69394
gttattatcgatcccggctctaacacaggacgcaacgncagcacgaacctaagaacagcacagcaacaatgcctcaactgaatcaacatactatcactgtcttcaggtttggatcaggatccgtggcggtggcatggtca

SEQ ID NO: 69395 - DNA, 379 bp, Triticum aestivum
  unsure (1)..(379): unsure at all n locations
  Clone ID: PAT_TA_69395
cggacggaccatggggaagacacgacacacgactctcttatttagatcgacgacncgacacgggacacacggggcgatgacgacgacggcgaccggtgggcgggcggatctagagctggccgcagtcggcgatgacgacctgcttggagcacgtgccgntgcgggagcccaccttctcgatgntcttgacgacgtccatgccctcgacgacctcgacgaagaccacgtgcttgccgtcgagccaattgcaggggacggtgcagatgaagaactgggagccgttggtgttgggcccggcgttggccatggagaggatcccgggcttggtgtgcttgtggacgaacttctcgtcggcnaacttctcgccgtagatggactc

SEQ ID NO: 69396 - DNA, 687 bp, Triticum aestivum
  Clone ID: PAT_TA_69396
taaggtagaattggtttagtgtgttataagacccaaaagatagccacccgaataccacaagtgtggatataagagagggggtaataagagcatgaacatagcaaaggagagacaaccacaaagccacaactactaagcatactaataagtggcttcactcaactgccttgtcgatcaacatcattttttttcttttcaaaaagggggtttgcccctgcctctgcatcataggcgccacttcatactaacaagtgactccactcaactgccttgttgatgatcttcataggcaccactttacatgaacctacaataaactcccttcaaatcctttgaagcatccaatttctattaggtccaccaacgccgttgatatccaaccaagcgacttgggctcgtgacaacaacggtcgtggaggagagaatgacagcaccaacgaaagggtatgctccaactttggttcgcagctccaccatcaacctcgccgtcggccatcacggaaccagagggaggcacgacaaactcgtcgggagacgtgcacctccttcgcccaccatcgtgcggggaggactgaccgtacaaatcatcaccgggctctgggagggcagaggagcttgccatcgagttggtcagattcaaccggatctccaattttccataaaatatatttttggacatgtatacgt

SEQ ID NO: 69397 - DNA, 145 bp, Triticum aestivum
  unsure (1)..(145): unsure at all n locations
  Clone ID: PAT_TA_69397
aaccccactaaagcgggtgagtatcccttgcaagttggtttgagctcctcaaactcaatagctctatcgagcacccatgcatccaaaccatcanaatcaggcattctcttncataattcggcatgaaattgtgagagatggatga

SEQ ID NO: 69398 - DNA, 141 bp, Triticum aestivum
  unsure (1)..(141): unsure at all n locations
  Clone ID: PAT_TA_69398
ataacaacgttgacctacattcnaacattagtgctccataagatagtacttnaccagangtgtntaatataacctactaaatcaacgattaatgctagctatcatctctaccaaataacgtctcgcccatgcgcttcaccg

SEQ ID NO: 69399 - DNA, 708 bp, Triticum aestivum
  Clone ID: PAT_TA_69399
caacttgcattccacatcagaaggaataagttgacacgtgctggggaaaaaactcttggattttgctgctgtacatctatctctacggtaaacaagtttcaaaaagtacccagaaggtgattcgataaaactccgaatcacctcccaaaaaaaacatactttgtgtaactctgctatttcgcagatcaagtaccacacccacaaaaaaacggatttgttgaccagcgtcaaattcaaggtgcctacatccattggtggcttgaggccgatgcagcgccttaagatcagagcataccacagaccctctccgcgacattgaagatattcgatgttgagttaaaccactttcagagcataccacctctgccaaaaatgaagtacctccttcagtgatcccagacatgcaactacttcaaatttggccttgttgacaaatctttctagtgatcctttcatattcagatttctgccgaaagaattatgcatgaagaagcacaatcctagcttgtggatctgcatttgaatctcatacctgccttaaaaggtctgcagagaagtcaagtttcagcctcctcaaagagaacaaaacatcctcctccatatgctctctgggcgaaagaataatcataatgccatcatgtgagatcatgagtgccccggcgctgaacaacccaaaatactaatgggatgctttcttagtttcttctt

SEQ ID NO: 69400 - DNA, 666 bp, Triticum aestivum
  unsure (1)..(666): unsure at all n locations
  Clone ID: PAT_TA_69400
tctttagttctctcccatgaagaggatgacctcagcctatcggatacagctaggatgaatcaccatctagaaatttgccngcatagaaacaaatgaatctctgcatagcagaagcaaaacgagcctcttctgaagataaaacacancaggaggaactcagttccaccccccaacangattgctccataatgaaaagctggtcatcgactctagctagaaaagatcagatcacaaaatggtagaagctttcgtctttagccgtgacgctcgtgatctcactcaagcatcggacttagctgatctcaccttcatncttgancaagaagccgctccacagcagcgaggtctcctccttcgagcaggccgtggtgacgatggtcacgttgaaccccccaatggtctcgaagatctcgaagtggtcctctatctcgggggagaactcgcagaactccgtggccatgaagaacttgacgcagttgccctgctcgatcgccaccttggaatccagcatcgacatcaccgtcaggaccctgaccaggaagttgtacatcccgtgccctcggatgatgctctgcctcagggacacggcgtccttctgggaccccaggtatgcgttggtcgccttccctttcagatgggcgggcagctccgcctgtatgcacctct

SEQ ID NO: 69401 - DNA, 168 bp, Triticum aestivum
  unsure (1)..(168): unsure at all n locations
  Clone ID: PAT_TA_69401
ccatantatgaccacttcatcnnctttataatctcatcactcaggcagaccatttgttgcaagtcattccgttctcattgaatcaaagtatatgtaagacacaatgttatcaccagccaatcaaaatgagtntgcacttgtaccacctctcttgctaactagttcgca

SEQ ID NO: 69402 - DNA, 701 bp, Triticum aestivum
  unsure (1)..(701): unsure at all n locations
  Clone ID: PAT_TA_69402
cgcaggcaccaggnattcgtacaacaataagcatagtggcaactgagcaaaacgcaccaccatcactgtcttctaggtcatggacaatctcccggcacaaagcaacagtatgtctcttacgaattagtggtaaaacaaagtcaccttggttacagtagcatgtcttgcttaaacacgcctaacacagccccagcgaagtacatgacaatcgatttctgataattaacaccaagacttgagtactgtatcattgagacagcatattgtcaggaccatcttccgtcgacacatggatgatatgcccccaaacaagagaccccaagagcagcaaagttagttcataccactttgtagttcatagacttggtttcgataatgatggtgggaagccaaagtacgagcaaacacgcctggtaggatcctgtggtgctactctgcagacctttgtaagttcagaagtcttgagatccagtgaaaataaatcttctacatcccgattcccaggcaaaccatgatgaggctcctgatagcctcgaaggaccatgaatccctcggttgcacccacagtatcatagagacatccgcgaggcaatgctgcaacattttttagctgccattcgttgaaagattcaccgtcattctgctgagtggtatgatagagaccatacaaggcatctggaaccgtaatcaccaatgagaga

SEQ ID NO: 69403 - DNA, 525 bp, Triticum aestivum
  unsure (1)..(525): unsure at all n locations
  Clone ID: PAT_TA_69403
atttttnnntttttttctacatatccagaacaaagtgaaacttaaaaaaatccaggcgcactgcagcaccatggcaacggaaccccgtcaagaagtggggagaactgcaattcagaagaaaaatattcaggatggcgactctaggctcgatgtggagaactgactagcaactagggagtaatcaccaccactactgctacacagaatagcaacaagaaaatattcagaagaaaatttgggcaagctaggccatgaatgggaagaacataagaaattgaccagcggaagcagccatcgctgtggctgtgctaggctcgatgacctcttccatgccactgatgtgccgtcatggtagtctttgaaccgtgcaacaggatctcctgtgcttcttccatgccacttatctctcatgcatccagcccaatgcatcgctccaccagcatgtaggaactgtaggacacacgaatgccatcttcatgaagttgggacatggtgcttaactgcttacgacggcatggtcaacga

SEQ ID NO: 69404 - DNA, 634 bp, Triticum aestivum
  Clone ID: PAT_TA_69404
cgatccgcatatacatgtatatgtctatcgtagtaatcgaacggataacaaacatgactacagagaaggaaggaaatggatggaataacaccatacagaaagggaaccaatgcaaagaacctcccttacccaaaaatgctattttttactgcagatatataaggatgaaaaacagaaattcagttagtgccttgctttcagaatatcaagaccctgcagtggagatccatgtagctcagtttttgttgcaatcatcttcacaatcaaagaccacaactctgcccctcaactgattaagagaagtattgttcttgtttgactcatcaatcttaacccatccggtgtgctccctatgtaggcattctagtattccacctgtcggtcacattcgcagatgccttgccattctcttggactaaccagggaggcacccataggtttctatcaagtactgcagcacaactcttaattcttttccgttgcctggataagccgttgggacgtattgttgctgggtctgttctagaaccccagtcgacggccactacactccttccctatgattgtcagcccacacctccaggcaagatgataatgatattataatgcatagttacgctggcacttgtgaaga

SEQ ID NO: 69405 - DNA, 713 bp, Triticum aestivum
  unsure (1)..(713): unsure at all n locations
  Clone ID: PAT_TA_69405
tanaacgctatgatncatagaatggaaggaaggccttcatcacagcgtactaattcatgtcatgacatgcattgaaacaagcttaattactgactgtncttaggntgtgcaaaggtaaataaccttgttggataagccctgttcagagtaaccaaactactcccatactaactgcttaagctctacctagcatagcatggaaacaagcttactaagttatactaccacttcgtctaccagatggattactactcagcccatctctttatccacagcagcatccgctagaatagctacgaagcagcagcactccctgcactggcgctgatccccatcaccttgctgctcccagctcgaaatcctgccaataactgagtaggtgaagccgcgtgatctgcctctgccgcgatgatgtcgctgggcctgggattcatcctccgcagcgccattccagcacgcaaatagatgagagcgaaacatgaccagatgcccagattagacgcgtcgtcaagaaggtcagaaatctctggaaatagtccacacagctgaagagtccacgagatgaatcccaaccaaaatgaccaagcaaaaagccgtgcagctgccctgcctagcggagacggagggctttcaggggcacaagaaagccgctcatcgaaatccttcatgaggaggccctncgccagctcgctgctgctccctgctgcgcgcag

SEQ ID NO: 69406 - DNA, 151 bp, Triticum aestivum
  unsure (1)..(151): unsure at all n locations
  Clone ID: PAT_TA_69406
tcggtgcgcgagagaaacagaggaggcggcgcngagcgagcgatcccntcctnctnccncgtcgcgtgancatggccatggncgcctccagatcgctctgggcctgccgcgccgcctcctancttaaganntccgccttctnagggcntnc

SEQ ID NO: 69407 - DNA, 673 bp, Triticum aestivum
  Clone ID: PAT_TA_69407
atgaaagctgtctgttgttatatccttaataaatatatgacacatgtaggattttgttcccttatttcaagattctacaatcagaattccctagcaaacttttacacatgaaatttggcacttgaaaccgtacaggttactacgtatacctcctaccatttacaaaccatggaaacacaaaatatttcaacactttcccatctactattcatagcttggacatgccccatctacttttcttggctcaaaaggactgaggcccctccaactgcactcaacttctaggatatctcttcgttcataagttcttctctggatggaaatggaaaccaatatgtgccgctgcagcatccttcttgtcggctccgaggaaccccatttggccatttcctccggtaccgcccgcaacatcttctataacatctccgcttccaccactgacatcttctccgccagctcattcacgaagccctatccaccatgtttcacttcatattacattattctcatgtatcacacatactacaattcaaccatgcatatagtcagcgggcaacaaggtacaaatatgttcttctttcatcagttgttatgtttgtctacctcaggccttcctcgtgtagtagagaaagaccatcaatgaatagtctcaataaatcttctggatgtttca

SEQ ID NO: 69408 - DNA, 679 bp, Triticum aestivum
  Clone ID: PAT_TA_69408
acatacacttcaatctattctaaacataaccaggaaagggtaaaagatgcaattatgagacatgtacaagatgaaatctaaaacatctagttggcgtagatcgttggcttcatggttccgttgagtgcagtccttttgtttgcttcctaggcttaacgatgacgtactttccatagcagatgtgtgctaagcatagagttttttgtactattcttccttcacatgccagctcaggataaacgcacctggtccaatgtggtagctatatattgcaatgatgagattccttgtcccaacattgattgatgccattacctagatataagacatcttgctccactaccttagtgacgggatgacgaaaatgccccttttgttcagacgccccatagaagaattcatctggtctttcaaagttgaaaccaagtactacttctgggaatgatgttcttgagagtaaatagtagtagcatcaagtcgatgtgatgcatatgcatatgactatggacatcgtccggtggcctttttgcccaaacttactaaagatttatttccccttacgatgtcgtttcttccatggatggctagctcctgttctcctgaattggggagagatgggggcacccaccaccaagctcctaatcaccggaagcagaggaagcagggggttgggcgcctt

SEQ ID NO: 69409 - DNA, 594 bp, Triticum aestivum
  Clone ID: PAT_TA_69409
agaagacactccagtgtgaccgtgatcgaaggaaacaaatcgtgtgttccaaacttccagcaccattgcactctcactgtttttattatttttccttagtttttaccactgtttttgtttaacatcccgagctaaactcacaactacacaagcaacgttgcacaaccccgtaattaacaactaatcagtcccagtcccagtcccagagctattgcagatctgcggtatatgtggatcatagtatcatactaaccactagcccaccatctattattagcactagcatcatctccttcagtcttctcttctgcacgctagtttcagcttccatgcacacgatcgatctgtaatctagtgccgacacgacctgatcgaccgacgacgagcgtctcccctgttgccatgttaacatcgccgccggcgcttgagctgctgatcggcgccggctgcgaagcaccggaaggggttctccggggagcagatgtccggcacgaacacggccgcgctatcggcggcagagccgtaacgcgggtctccctgccagtggaggcctgaggccgtgggcggggaggggagctccggcatggtcgacct

SEQ ID NO: 69410 - DNA, 686 bp, Triticum aestivum
  Clone ID: PAT_TA_69410
tacttgctcgacgaatctgacgggaactcagactaccggcattacatacaggatctcatcttagtccatgagaattggatctaagcaacactggctaggctatggggacggctactccttggcggcgaccttcttctttggggacttggtggtgctcttcttcttgggcgacttggcctccttctcggcggcggcgggggacttcttggggagcagcacggagttgatgttggggatcacgccgccgtgggcgatggtcacgccggcgagcagcctgccgagctcctggtcgttgcggacggcgagcagcaggtggcgcgggatgatgcgggtcttcttgttatccttggccgcgttgccggcgagctccagcacctgagaattcaaccaggaaccagatcggtcagccatccgtcgaacagggcaagaacagagtaacagaggctcgaggagtggagagatcggcgcatacctcggcggcgaggtactcgaggacggcggcgaggtagacgggggcgccggagccgacgcgctgggcgtagcggcccttcttgaggtagcgcccgatgcggccgacggggaactggagcccggccttcacggagcgggtcaccgccttcttcctgtcgccgcccttcctgccggccatcttgcttgctgctttccggcgagctggaaactactcc

SEQ ID NO: 69411 - DNA, 182 bp, Triticum aestivum
  Clone ID: PAT_TA_69411
aaccggataaatagtatctacaagcacacgggtacaatctctactaataaggagatactaatcaccatcaccgagtgacacacagtagcagatctgggcaaaatgacacgaacgaacaaatcactagtgataaataaatggatctatatgtggttgtactaggtaggtcgacggggaagacc

SEQ ID NO: 69412 - DNA, 140 bp, Triticum aestivum
  unsure (1)..(140): unsure at all n locations
  Clone ID: PAT_TA_69412
actacaacagttgtattacacaggntctaattaatccacgncattatcattcatacactaatctagcacatgcttgcttcctcttgcacacgcatnacggacacactaccacattccgaagagtacaccacaaggtacag

SEQ ID NO: 69413 - DNA, 784 bp, Triticum aestivum
  Clone ID: PAT_TA_69413
tgtttctgagctttcttgtttactctcaactacagagttgcgtctgcatttacacatttctcaccagtgaccactaatcaagtgttccacaatgcaactgtcatcagataaactaccctatcgtggaaaaccattactaccaccagaatatctgtactgcggcatcacatttgccccatctggatgacggcggtatatagtttgcgacgtgttgaatggtggaaataccaccgcgcgttgatcaggtggaggtcccctgaaataaccaggcgcacgccagccagccggtgctgcatttggttgtccgaaaaccattgtagggtttggacatgaaattgatctgccgtccatatgatgttgccaggcattgccaacttcgcgcaatggaggtggccgctggggcctctcagataaaggatgatgcatcccaactgaatttcctgggtaagcctgcgggtgagaagctgaacttacgcgccttccttcaaaatgatcatggttgccaccaacagtgtttttttgcttcgaaccggcttttcctttactcaccctagcctccgtgttacgcagaccatagttaactggtgttgttcgcaagtttttctgcgagatggcatgatttgtctccgtgttggcattttgctgagaactgctggtgccgatgccaatgttcttatccaggggggcagaatttgtccttgccttccgacgaccatcagtgaagttttttctagaagacacccagtgctcttcttttcgaatttttttggcaggatgatcagaa

SEQ ID NO: 69414 - DNA, 624 bp, Triticum aestivum
  Clone ID: PAT_TA_69414
tacattcgaaatgagggacacaatgtaacagtacaaactctcactggtcaacaaaataagtaagaaacacacatgtcttcggactgaacaaatatcatcatcacacaacaatatttttgatgaattacactcacacaaacacacatatttatataacacttgtactagagtaaacacatggactataaactggaacaaattagatgaacacacacatacacaaatacaaatatgatactataggacactgttctaatactctcaaatgaacaaaataagtactactaatcaagcacaaatctgaaattgaccaagtttcaagcacaactcaaatctgaacattacaaggcattacacatctcagcttataaaaattcagagaatatagagaggataaaagagagatagaagcagtttatggttcagattaggagcagcagcatgaggggttcagaggaggagcagcatgagcgcaagaagatcagcagcagaggtacagaaagaaggagcagcagcgaggaaagtgggagagggagcagcagcagttttaagaggaggaggagcagcagcgagattcagagaagaagaaggggggtagaggaagtggagtagcagcagcaggga

SEQ ID NO: 69415 - DNA, 182 bp, Triticum aestivum; identical to SEQ ID NO: 69411
  Clone ID: PAT_TA_69415

SEQ ID NO: 69416 - DNA, 666 bp, Triticum aestivum
  Clone ID: PAT_TA_69416
ttggagaaattttaagtccctgaaatcagcattaacgaatgcactactttgcaagcttgtgctagtcaccacacatatcacaaaaatacatggtaagcaactctataaagatggcatggcatataacaagtggtaggtatcgcggcatagcaaaagagcgggcaactagcaagcaaagatagaagcgatttggagggttttgtcatcttgcctgagatccttcgaagcatgcatctccggacggttcgggttcgatgggatgtcgacggaagtagacgttcatgggtcgtagtgggaagtagtcgtactcgcgaacttgtcagatccacggcgagcgtagctgttcacggcgcgtgtgccctgcggttcttcggacaacggtagttgtccccggttcgttgacagacttgacgggtccgagggctccggccatcgtggtacttggcgcaacaccgtgtagtcgtacatttgaagaggaacttggccatctgaatgtgtacttggcgaacgacggtcgtcgtggtactcatcggtccatgaagtcgttctcgtaggtcttggcatttcgttcaatataggttcgagcatccgtgtggtcttttcgatggtgtacttggcgaaggcggtcttggcaagcaacgagcagtgacacggtgtaccgacgca

SEQ ID NO: 69417 - DNA, 725 bp, Triticum aestivum
  unsure (1)..(725): unsure at all n locations
  Clone ID: PAT_TA_69417
gctctgtgttcnatgccggtcccaaacggaaaacaatgtacaatgttgagacagaagaaatccaagcatgtccctcccatgggcatgtatgtcgacaagcgtaagcgtatcaatcaacaaattttttaccccacaaaaaacctaacacatgctgcctaccctcaggtgaaacacaaaaagagacatttacaactcccggaccggcttgcgcgcttggttacaactctcctatcttttaacttgaatcactaagttaacatctccatctccatctcctaccctacaaatatcagtgagctctatgtattgtatgtatcaatattaatataactagtatttaaatttaagcgagagccggaccatttctggagcaactctaccatccggatggcctgcgctgaagccccactcaaccatccttgtaccaaaaaatcgatggcgtacaagttcgggcaccccacttcgctatgcagaggctgagctttccattgacatctcaaggttcatctgcatcggggggctggctttcgttgtcaagctccgggatcttttcagctgtcctcttgaaatgctttgtatatgaaatccttaaaacgcctcgagtactgccttggatccactgccgatatcgaggtcgggtcgtactggaaaggatttgtacgcgtgctcaagccttttgctgatgtcataatcttgaagtatgtctatgatcccaaaatacagta

SEQ ID NO: 69418 - DNA, 461 bp, Triticum aestivum
  unsure (1)..(461): unsure at all n locations
  Clone ID: PAT_TA_69418
gttgaatttcnttnattcnttctacagaagatagcaaacagcagcgagatgctgcgattacatcaacgaccacgaaccctagacacaggctagctaatctggtggcggcctagcctccgaatccgtagagggtgcgtccctggcgcttgagcgcgtagacgacgtccatggcggtgacggtcttgcggcgggcgtgctcggtgtaggtgacggcgtcacggatgacgttctcgaggaagatcttgagcacgccgcgggtctcctcgtagatgagacccgagatgcgcttcacgccgccccgccgcgccagacgacagatcgccggcttggtgatgccctggatgttgtcgcggagcaccttccggtggcgcttggcgccgcccttgccgagtcccttgcctcccttgccgcggcccgacatcttctcccttctccttccttctcctcggtgaggttgaccc

SEQ ID NO: 69419 - DNA, 188 bp, Triticum aestivum
  unsure (1)..(188): unsure at all n locations
  Clone ID: PAT_TA_69419
tggccgaactcccacgtgccggccggctctcgccttcgcccccgcctcgctggtgaactgcacgctgnagctcctcttctcgttnggccacctgaactccagcgtcnncggcgtcacggtcaccttnaccccgncgggcgcggngaccgnnacgttgtacctctnggggcgcgccnacaccanggtna

SEQ ID NO: 69420 - DNA, 756 bp, Triticum aestivum
  Clone ID: PAT_TA_69420
gggcacaaagaatatactgacaccaaagtcccaaaaccaaccggtcacatctcaaaatctgcaaaaccagcaaaataattagttctctagggcatacatatcttagagcagaactcttaatctgaatcatttgaggcaattatcatcctaagtgaccagcctaatcccccatgcagaaaaactgtacccttggcaaaaagctaggaagagaggcagcgcaagggatttatggaaggagctcacgtagggaggtgccaccaggggagagggagacagtggtgtgatctatcaatggcctctctcgctgacattcgtgtctgcagggacgacacacatgtggatcggccgctcctcaccgatggatgcaacctagggaggccgtagattggactctcatctctgtcttaccgagaagccgtcaacggcagcacagatgatgaggcagtggcgggagggggagctagcgagtcggccgctcgtctcggacaagcaccggggcagaacagtggtcgggcgagccaaatctcctgtccgcttcatcttgtcttctccataaacttgaccatatactccagcagtactccatgacatttgaaatcaagatcaaaaactgatggcatgggtgcactaatcaacaaaatagtcatagcaacattactactgcttagactggtgatatatacatgcatgaaacagatcaagcaaccattactactgctaagactgctgcttgaactgaattttgaactgctactt

SEQ ID NO: 69421 - DNA, 660 bp, Triticum aestivum
  unsure (1)..(660): unsure at all n locations
  Clone ID: PAT_TA_69421
actttttttgaatagactaatgttaatttgcttgttntgatttttttaagaaaatatgtttatccaaattgactttccttcttttaaaataaaatcatgtttatccaaattgttatcaaataataccaaaaatataattgatacacagatagtgcggctactatcattcttataatgttcgctctaacttgagacagaagtatgtggctagtacagtggttcgcaagaagcttgaggaatctagtgtgcgggttcgattccacgtacgacatctttttggagcgtttttggtttttggtgtgaacagcgagcgcttccatttttgccacgtgatgggccagcccatatcaggaagcgcgtgggcgccagaactccagccggcgctgaaggcgccggttaggagctctccctttgcgcgacgcaagggagctgctgggctgaagcagagggggcctaggcacatggacgaagcaggggcgcggtcaacacgctcgtcgtctcctccaggagatcgagcgaggcagggaaaacaaaacacgttcctctgcccgacagaaaatagagcagcgacggcctaggacttgcggtggaggccggcgggcatggatccgacgagggacttggcgcacggcggggacgcaagggctccaacgagcggcg

SEQ ID NO: 69422 - DNA, 707 bp, Triticum aestivum
  unsure (1)..(707): unsure at all n locations
  Clone ID: PAT_TA_69422
tacgatgtttgtgttttcggcaaggatngtactagtctgtgctaccaacacggcagcactagacatttttaagcaaatacgccagaaattaacatactgggaagagaatcagtagcttaattacattgtgagtcaggaaactatatacgtatctcacacgttcagacatactattgcaaatttgaaaccttcatgctgttctttcaaaagaaaattttcctccatgctacaacaaaccaatcaatcaatagtactagctagtggctcagtagcgttcagtgcatgctaccttaactgaaaccatggaattggcaagcatgcgcatggaaggaggatgcgattcatgagaaaccgcgtgatattggcacggctcaatcgaagggaggaaccccttgcctcctggggcgccagctctctgattgaaccgcaccaataccgcgttcactcccctcgcaggattaactcactacgaaattacaggagctagccgaggagcacaactcaccaggttcgcaggatttacccaagaattgacacacagaaaagcatggttgacgacgatcgacctggagggaaagcaccgatttgtttgtttcacgcgcgccgccggccggaaggagatgggggaagagagtggccggagagaatgaggaagaggcccggctttcccttcatgggaggcagtgcgggaaaganaaggcgtagag

SEQ ID NO: 69423 - DNA, 665 bp, Triticum aestivum
  unsure (1)..(665): unsure at all n locations
  Clone ID: PAT_TA_69423
ctggtaaatagtaaaactgaaatnatacgtactatnatgcagacacacagactacacggtatgattccaaaggccaacatgcagatggcactaacatgaatgtgaaaggatttcttcagtcgatgatgaggccacaagcagcagttgcgtcgtggtcggcgtttttccactgcctcgcaaggtgcaccaacgctgttgtggactcgccagccttgtccagcgcgtccttggcaacccgcatggccgcgtgcgttcgttgccggagctcccgcccgccgtcggactcgatcagccacctgaccttggcggccacctcctcagcttccaccatctgtttgtcgtacccttccatggccacggccagctgcatcccctccaccaaaaacagcttgttcatgcgttgctcggcgtatagaggccacgccagcatcggcacgcccgccatgaccgcctccatcaccgagttccatccgcagtgcgtcacaaacccgccgaccgcgccgtgcgccagcacgtcccgctgcggtgcccacgacattacaaccaatcccctctcccttgtccggtgcaggaagcccgtgggaaagagcgcgtccaggtcgagctcgtcgacggccaactggtggtgctcgtcgcctgtcacagggcgccgcacaacccacaag

SEQ ID NO: 69424 - DNA, 649 bp, Triticum aestivum
  Clone ID: PAT_TA_69424
aacatgacaagtaacatagttgcatgacaatctctaaagcattacacataaagtcacaaagtgccatgtttccagttttgcacagtgacaggacaggcgccaaaaaacctgaaggggcacaacaatctagtcaaccttgtccacaatgtccacaaggtgactggagggatccgtcaagaacggaatatggtcaaaaggttgccaccatcagcagctgtaaattcaagttgagcatttggagaaggcctgctatcaacatgtagctgactgtgttgattagctacccattcctcagtatattggtccttgacaccaaatatcattgactcgagcactttaccattcaggagaaagaacttggcaaagttgacatccgatctgctgccaacataaaacttcaactctacttctctgagatgatcgaggcattcaataggatcttgtggttaaaggtgatgcacattctccatatcatttcctggacatgacgtgatgtagagcttctccaagcaaggaaatattttgaggaaggctatagctgcatcaagattagggccacttagacgtgagatgcaaaaccttgacgctgcgcatcagagcttttcaagttgccagcaaccattccctgagaaatttcatacccaagctt

SEQ ID NO: 69425 - DNA, 777 bp, Triticum aestivum
  unsure (1)..(777): unsure at all n locations
  Clone ID: PAT_TA_69425
taaaatgtacttaatactgataaaattgtgtacnggagaatctcataaaaatagtggtcaattacatcatataaaaaatttgaactgaattacattatataatttggttctatacaaaaggaaatttcctcttttgtgtatatatcctaaagaccacccccttgtgatgaacgctttgtccgtcaagtcaaatggcacagctcctgccctttatggcaaaataaaggagtcggaagtttaatatgagtagcaaagaggtggagaaccataatccttcttcgggaagagacaacagcgggcggcttggtgcctgctgcaggcagccgacagcgtctccggttgtactgcttggtgaatccggacactgggcaggctgtcgatggacgcactcggcctttccaatggtgccctcgatcttgaagagtccagtgcattcacctccctctctctttctccctcctctccttccttctctctctgtccctcatctctctctcccgcagggaccgggccatggcgctggatcaaatcaaacaccccagccgttgcctcttgcctgcaggtcgccgccgctgccggagatgcccgccatcacgcccacatgcctcggtttgtacatgaaaaaagcagagaagcaagatctgtagtgttcccatcaaccattgaaagatttagttaggaatgaattagttttgcacacagtaaagaaacaaagcttaaaaacaatcaaaacatatttagtcaaatcagcagcaatctgaaattacaactaccatg

SEQ ID NO: 69426 - DNA, 140 bp, Triticum aestivum
  Clone ID: PAT_TA_69426
ttcagttagatgatatgaagttgtggctattttccgctttgcattgcttgatctcttgcaaaacggtaactgaacagggcactagacttggatctttgcacatccacccataataatatatgccccaagacattgcagtt

SEQ ID NO: 69427 - DNA, 422 bp, Triticum aestivum
  unsure (1)..(422): unsure at all n locations
  Clone ID: PAT_TA_69427
catagtcnagatgatgttgagcaaaaaaaatcacaatatattacatgggaaaggaacatgtcattcttgtacataggcgaacccctaacaaagcaatgtcctagactacttaggtatcatcttcacacctccatgagactccaggttgtagccttaaagataagtgtagacaaaccctgggaacctgtaggtacaacacactctaagcacggaggcatccatgccaatccgaaggagtacccaccgcatgcccaaaccccgccaccggacaacaggcatagcagtgtttcccagcagatgcagcagcagggaacctagtgctaaaccccaaccacaaccgctgncttgttggcaacgtcactgatgcctcccctactcccgaaggcgtcagtggcaacggcggggctgaggatgagggagaa

SEQ ID NO: 69428 - DNA, 474 bp, Triticum aestivum
  unsure (1)..(474): unsure at all n locations
  Clone ID: PAT_TA_69428
acacgttttttcttnatattatcggaaaaaatacatgtttttcaacttattattatggcctctgcaattaccttgcttctgcttcttttatttcacacccaattttcagtacagattggcatcaaacagagcacagaccggagtgatcgccttgtttgcgctgccctgggtccacatctcaccttttttttttgagcaaacatctcacttgtncaaggcttcaatctcactctgatacttggccgccactttgtcccttcttattttcatggttggngtcatcaaaccattatcaatcgtaaatggttcgtcgacaacaagaatagggccaatctggaatgagcaaccagccatccaagttttcagctcagcatgtagcaagctcatgaccgtatctttggctagtccgttgttcccatcaaggctcgactttctttttgctgcttntacgacttcatcattattgggaacaat

SEQ ID NO: 69429 - DNA, 587 bp, Triticum aestivum
  unsure (1)..(587): unsure at all n locations
  Clone ID: PAT_TA_69429
gcatgaactaggnacgtggtttattctaaaatttaggtttaaaaagggagacggacagaatgcgtccatgcattggacgcacggccaccgcatcccagaaatggttcagacacgacctcattgcccgtcccaaacgaatagaatccgagtcaaacggacgtccgtttgaggtcgtgcgctggagttgcccttactgcctttgctcggctgtcttgtgcctggctggcagccggtaaaacacacacacacaaaaaaaaaaacaggtcggcagntnttggctgacnctgttggaattttatntatcccaagnggccgntgnttcctgccgccttgngcttgtgcttgtgcggcagtaggagttgttgnggtacacacnatgcttgccttgactggtcaaaaacatttgatacgggcgccgggcgacagcagtgatggaagcaagctgcctntgtgtnaatcgcctgtgatgcgganataaggctgggcnccaaaanaagctaaccgccaatccccctatgctgctgcacaagcacccacactgttntgttctgctcaatgcttacnacggnggcatttggattgcaaca

SEQ ID NO: 69430 - DNA, 488 bp, Triticum aestivum
  Clone ID: PAT_TA_69430
agcacattagtattccgctacaccaagaatgagtatcattaccgagaaactatttgtaccatcaacttcttaaaacaaatcttggttgccagctggtaggcttcctggagaaacaaccgaacataaggtagccaatgcttgtgccgatgattttctatatccgcctgaacttggtcaacaaggacagtaattaatttctccacatgttgatcataacatgtggaattttctctgccgtccgtaccaacaaagccttcatggttaacctccataattacaaatccatccctatgtccgatcataatccatagtgatcaatgttccgaaaccaaaagatgccattggtcagctagctcatatggaactttcgttgtcgcccttgccaccaattgtttcttcatcgtcaatatccactatagatatggcgtggctttgtccaatcacgaccctccttgactccatcaagcatgcaagacccataacatctg

SEQ ID NO: 69431 - DNA, 473 bp, Triticum aestivum
  unsure (1)..(473): unsure at all n locations
  Clone ID: PAT_TA_69431
agcctcggattgcaaacaagttgtctcagacatttctagggggtcagaggccggtatggcgctatcattagcgaaataaatctcacagctactattaagtttgagtttgagggtcgtgccgcaaactatgaggcacatagactagctaaatttgctctttctcagggtccgggacgccatgtgtggcttgggaatccccatgacccttcttgtatcccacttcatgtgaattttggtgatgaataaattgtttttcacccctaaaaaaaagtagggcggcgggttagtgacgcgggcgagcgggatgcggccaggcatgggcacgtgggcgtcgtgtactgaagctgccaacgatgccgctggctcgggcgggtgcttgtcgtcttcgacagagcaagcagcggcaggggaggcacggacccatccggatccaggcgaancaggggtgttgggggaaggtgtgccggcagctt

SEQ ID NO: 69432 - DNA, 551 bp, Triticum aestivum
  Clone ID: PAT_TA_69432
tcgagagaaataggtgatacagtttgcactagttctgatagagaaaaataagtttgcttgaatgttacagcgtcagtcacaggggactgcattcataccaaaaatggcatcaaatcagtggaaaagagtagcatgttcagtcccagtgcagagccgcgcttacttcaattatcatttgagttaccagctggattaaggtggctagttcttggtggtcactctctcattcttctcgtctcctttcctcaccagagattcttttgcgacgacatcttcccactccttgtcatccttaaacatgtaattttcaaaggttctgctgacatggattctgcacttggggagcaagttggttgctttttcaatggaacactccagagccttcaccctgcctggagctgcttcgtaacaattgattttcacctcgagctgtgcaaggcctggaagatgctcgacacccaagtctgcaaaaaagtcagacacgatccacattgggttcaattcaagacggagacaatggagtgcttgcatagcacctggtgcaaatgtta

SEQ ID NO: 69433 - DNA, 701 bp, Triticum aestivum
  unsure (1)..(701): unsure at all n locations
  Clone ID: PAT_TA_69433
tttctttgattgaatggtggccagctggtttgggagaactttagcctttattctccagaccagtgggcactagtgtagaatctatttcttcctgttgggttgctgggaagaacttgactcatttaataccattgtagttgccaccctctgggctctgtggaagcacatgaatggcatggtgtttaatggtgtcgtttggctgtcattgaaacagatttggtcgctgactttaagaacaatcagaagatggcacctgatcttcaacgaatacatcatggaacaaacacatctgttctgccagcatcttcagaggctggtggggagaacagagcaaatggagtgagggtgatgccaattgacgaacccctgctctttngcaagcatggcgttcaggttgctgcgagccccacatccaccttggaagctctctgctctccggtctcgatgctgcctgggctagctacctagcccaaagctcaagaaaagcctcccctcccaggagaacgaagaatttgatcatccttgtaaaacctttacataatcgggtgttcatttctcacantgaagtatggatccatgcatgcatcttttggccgagtgctccatctacatatatctgttttgctgataagaagaaaaaggcaaaggaaaagaaaacgaaagtaaagcaaagcactgcatatgtgttacattatatagtt

SEQ ID NO: 69434 - DNA, 409 bp, Triticum aestivum
  Clone ID: PAT_TA_69434
ggtgtaattatctccacccagcaagcatggaaataaagaagttctagtgatggaactaccaacgcacacatgaagttctacaggtagtctaaacaaacaaattattgcaattgctcacaacccaatcatccgcagatcacccactttgtggcagttgtttcgcctgtgcccttcgattccacactttttgcacctcgctggcttgcgaacaggctttggggcatcacccctgtccgggcacgtagtcctcttgtgcccctgccgccgacatatgctgcagaaccttgtccgtttgctgcggaaccttaagttgctcatcatccgccccgagtcagcacctgaacctctgacattgcgttcagcaccctgattgttgccctccccaactgcaaaatcttcagtgccattg

SEQ ID NO: 69435 - DNA, 259 bp, Triticum aestivum
  unsure (1)..(259): unsure at all n locations
  Clone ID: PAT_TA_69435
acaacgacacatcaagaacactctgcttcgagctgaagcacacccatacatccatcccagctactccgacataactaagcaatggtcacctacgccttcttgggggacttggcggncttnttgggcgacttgggctccttgggggacttctcggcggtcttcttggggagcaggaccgggttgatgttggggatcacgccgccgtgggcgatggtgacgccggcgagcagcctgccgagctcctggtcgttcctgacgg

SEQ ID NO: 69436 - DNA, 347 bp, Triticum aestivum
  Clone ID: PAT_TA_69436
tacaacttccaggactatgtttccccattcgcaaaacaaacaaaacaaaaatcgaaacaactaaattgcatgcacacacgctgagcaccgcgcgaacatagtcagaaataccatgtttttatcacagattttgcacgggcgtctcggggtggaggccctcctctgcagactatagctgtcttgccgaagtgtactacatttgcaatcagcacaaatgtccctcaatatataaactaaacatacatcattttctcatggaacgaactgaaaaaagaaaaacgtgcactgcaaaaatcgccagcggtggagtcggtgttagtgactaatccctactatgctcgcctcac

SEQ ID NO: 69437 - DNA, 312 bp, Triticum aestivum
  unsure (1)..(312): unsure at all n locations
  Clone ID: PAT_TA_69437
tattacatgcacaggggcaattcgagnatacaagtgcgaattacaagctctggctagagtacaggaatggagagcgagagaaagaaggaaaggaagccgccgccaccgttcgtgatccactggataccctcttcgttgcttcctctccacttacttatagctggcaacgattcaacgggtgcacagcccagcccagcccatatgctgtccacggatgggctggccggttaggagggctcctaacatccccccccccccccccccttttttnaaaaanggntttccccnnaancnttttccnaaaaaaatnnc

SEQ ID NO: 69438 - DNA, 102 bp, Triticum aestivum
  unsure (1)..(102): unsure at all n locations
  Clone ID: PAT_TA_69438
aaacgtatcttctcgaatgaagagataaatctcggaaaacattcgggacacagaaatagnccatggtcgggtcacacaatgctacnagtatgaataagcagg

SEQ ID NO: 69439 - DNA, 131 bp, Triticum aestivum
  unsure (1)..(131): unsure at all n locations
  Clone ID: PAT_TA_69439
tcgttttgtgagnattatncatgtacttcctccgtttccgaattactcatcatagaagtagatgtatctaaatgtattttagttttagatatatctatttttgcgacgagtaatttgaaatggagggagtc

SEQ ID NO: 69440 - DNA, 558 bp, Triticum aestivum
  unsure (1)..(558): unsure at all n locations
  Clone ID: PAT_TA_69440
cataatncgagtttnaaagtgtacaagattacaatagctaattgcatttagactgtcccataaggaaaggcaacatcaagttcggtatggtcattagattacaaaagctaattagatgacattaggtacaacacttagcaggaacataagagagcaaaagcaaaactaatgcatgagattaatatgtcagatagaagagcctccgtttacaatagcaaaggagataaattagtggagatcccatccaaactactatagagacctcatcccgccccgtgatggtgttgaccattttccaataggggggaggagtcaagcaatgacatcacatccaaaaccaaagctgaaaggactactgagaatggagctaacatcacatcattggaatatatatccacggatagatcgaaactttaaacttcttcaaatactggtatagagttgcaagtactaatgatggtgctccataatgcagggaaatcataccaaacaagcacgttcagagcagcggagcgtcgccatcccttcacgcgtcttggatgttgatgcgatgtgagg

SEQ ID NO: 69441 - DNA, 116 bp, Triticum aestivum
  unsure (1)..(116): unsure at all n locations
  Clone ID: PAT_TA_69441
caaaccatggactaagaaaacggggtatcatatacccacnacgagagtncttctanactcagttagaaccgaagatgccaactggagcaacggtgcaagatggagggagatagaca

SEQ ID NO: 69442 - DNA, 658 bp, Triticum aestivum
  Clone ID: PAT_TA_69442
aatattagttgatcacatttcacatttgttagtaaatcagagaagatcatagaaaattgtacagcatgcattcatcaattctctagtgctgcccaaaaagaattgattagctgggcctaatccgaccatgaaacatttgcaaacgactgcccaatgccaatctcaccatctccttcctattttccgtcctttctcctgttattggttccatcgcctaatccgcgcagctggccgtgcatctgtgttctcctcagccgaacactgcaaatatatgccttgttgaagcatctaccagttgcatggcttcatcaaattttgaacttgcatggttcaacaaaatcaaacagtgaactctcatgaacattagttcagcgatgatgctctgtcattgggatcaggacctcacatcttaatggaaggaagcagttattaatcaagtctaaaatctgagtgagacttaggcagtcaagcccattgcagaaccatgtctgatagaaaaacactaataacatctaactaacagagagtgacttgacccatatatgtctgcaaatgcaactcacatattactacacaagaaaacaaaatcaagttgctgttgcttcttcacataaacgatcataaataagatgagaaggcagacacagcaagcaagaag

SEQ ID NO: 69443 - DNA, 162 bp, Triticum aestivum
  unsure (1)..(162): unsure at all n locations
  Clone ID: PAT_TA_69443
tcttatacnttnnataatggtacacatggtgaaaaaataatggcgtgcatcctggcgctggagaccaaacaatgtaaaaatcctggaaaaacaagtctgtctgtctgtcgcaaaaaaaaggggggaggggatcctgaaacgnaattcgcatctacacaaact

SEQ ID NO: 69444 - DNA, 554 bp, Triticum aestivum
  Clone ID: PAT_TA_69444
ccggcgtgcacagccatccctgcgcacggcctagctgccaagtcttaataggagtacaacatagctgacaaatagagcatacagccggcgtgcacagccatccccgcgcacggccgagctgtcaaattctcctaaacacacttacatgtggccggcatgcacaaccaccaaatccaaatcgacttaaacagtagtaccatagggttaagcccaataagagatagagaccaagtagccatccattcatccctgctcacgacgggccggagtgcctgctcaccaattatctgggggatactcttggtccagcggtatgaagccaggctcaagaacaggcattccataggccggggttcgctgatgcaccggcgggatcagatgagatttctcgatcctcttcagaacactgagtccattcatcatatccaggaagctgttgatatggtagattcggtcataatccctcatcttgtctctggttcttagcaagccatcattgaggcctgcttctaaggcaacttcagacatgacgccccagctgccaatgcgcttcc

SEQ ID NO: 69445 - DNA, 503 bp, Triticum aestivum
  Clone ID: PAT_TA_69445
attgcacgccgcgaagctggaaaaatgatgaactgccgaatgctgctttctgcaacatgcggcagaaggttgcaagaatacattttttttttgaagcaccacatgccattcatatagcaaacaggagtacaacacatgtagtagcacccagacgaaggacccagaacacacaggtgtccagaacataagcagaaaacaccccagaaaaagaaacaagattacaatcaggcccttgggggtccctgcacaactcgtcgtcgacgccctgcatcgcccgtcgccgccgccgaagcaccgtcgagggagaggaagacgaacgcccaacacgccgtgatccgacgaagcaccatcgcatgaaaagctttgtgagccgaatgagcgacccaccgcgaacggcgggttcgagagcattgtggcacgtcggccgggaccaaccccatgctcgccggatcgcaaatccgccaacttcgaacaacagggtcgaaggagaaggccggatccgc

SEQ ID NO: 69446 - DNA, 491 bp, Triticum aestivum
  Clone ID: PAT_TA_69446
attatttgcacttcccgtttggctccttggagagcaggaaacaagatggtgctatctcacatccacgtgcaactgaaaggactcccgtcacaaacctacagttcacaactccctctaagatttttacaaaagcatttcctctgctgatcttcggaggctaagatgctggcctatgctttaagttaggagtaatcactacggccgaatttcctacttgataaccccctaacttgctagttgacaaccaaacaccatacacatcttgattcaaaaagatccagcttatcctactacatcccagggcaacaagtttaccagagcacaaccgtgcatgcaggactcgtcttcctggggaagaattgatgatcagatcttcagatctttcttgcagttatctctcaagtcctttaacttgacaacagctgaatggagctgggcagattcacgaacaagggcattttcagtatgaagaaagagtgatctctgttgtt

SEQ ID NO: 69447 - DNA, 702 bp, Triticum aestivum
  Clone ID: PAT_TA_69447
tgcctttacattactgatgataaaaatactagcatgaagcaccagcatagaagctgcgcagtgtaaggttcagcaagaagaagaaaagtacccctctgctccgacatcacctaccatctaggatagctaggaggatggaaccaaggctaaactgtaaactcaggccaagtcagtttggtttcgcagcaggggagggtgccgccgccacatgacatcttgttcgagcatcatatacaacagcagatacagcaccacggaagaacaagaacaattatcaagattagttcgttggcaacctcctcactcgccactcggtacatcaccagtcaacgttgttccatcctttgggcacaaatgacaacggtcatgtgtcggcgtttgctctttgggaagcttcttgaaccagtccctttgcagcatgctcaggatcctctattggcttgaccatggcaacagcttctgctttgtaagtttatcaccagatgctcgagaaacagcacgaacaccagcaacacaccacgtccctcacaaagcctgcagcttctataattctctgtctctctgtttggtaaggtttgtgatccctcgaaacggctattgctgaaagggtgcgatgcagcaaacatcattatcatctgacgcaaatatgaaaaacctgaacaattgataatgttcttttgaaccccaattcatgaacatcat

SEQ ID NO: 69448 - DNA, 116 bp, Triticum aestivum
  unsure (1)..(116): unsure at all n locations
  Clone ID: PAT_TA_69448
agataaaaacaactaggcggngcagggcatgaacatncgacgacaggcagncttggcgcttagtcgacctnctgcatcttgctntcaccagcgtngncctncaggggcggcatgtg

SEQ ID NO: 69449 - DNA, 510 bp, Triticum aestivum
  unsure (1)..(510): unsure at all n locations
  Clone ID: PAT_TA_69449
cggatnatattgtgagtatatgtacataactaccagcattcgagtaacatgtgcaatagtatatcaaaattctcaacaaatttagcatgacaagtcaataacatatanagcaagtcgctaactggggcttcaagttttctccgaatttcttcaggtagaattccttttggggccccaacggcagntccgccagatgcaacagcaacacctccaacaaccacaacaacagcagtagcaccaccaataatgacctgngtggcatttcagatcatcattatagaagaaaaaattaanaaacaagcaaccaatatagcttcagcattacatgtacagattttagctttttctacctaagtacaaatagcaaaatggaacatangcaggttgattatatttgacagagctaactaaacaaaaaacanaacatancgctncgacttgttgaggacagaaataataatgnntgattcagaaattagtaatatggggattaagagcatgcacacanaa

SEQ ID NO: 69450 - DNA, 158 bp, Triticum aestivum
  unsure (1)..(158): unsure at all n locations
  Clone ID: PAT_TA_69450
ccaatttgtctntgaacagctcaacactttgatcatangacgcaagcatacccatattcantgacatggctctnaccacagntgggcctgcacccttncaaagcgcaaggacnccttnatnannnnngatacnnnnnanngcatgnaatgcattnttg

SEQ ID NO: 69451 - DNA, 535 bp, Triticum aestivum
  unsure (1)..(535): unsure at all n locations
  Clone ID: PAT_TA_69451
gggtcgcaccattgagtccgnaagnaatgcatagtatatatgtacgtagctggtgaattattatacgggcatggcgcagtattcaacaccaacttccaaagctgggtgacgagatcctagacaaggatatacaacagctaatgtattgcatagggaagttggacttttgcataccagaacgaaccggaggctggctgctggcccaagcaacaaggtcaaacatgaggaacggggcccacacagcagcattctccttttcctcctctatgggctgaaaaacacgctagtggcaaacgtgcaaaaggagctgattaggatgtgaatgcgtccatagcgcctcacctttgccatttttctctgagggaacggcaggcagcttcttcctcctccatgctgctctgcgccacgaactcatcgcccatggtggttgcctaggcagtcagggtccgagtagcgcaaagcacccctgcggtagccgagtttcatgagagggaaccatgcanccgntcanctcatcatgccgtancannaacag

SEQ ID NO: 69452 - DNA, 151 bp, Triticum aestivum
  unsure (1)..(151): unsure at all n locations
  Clone ID: PAT_TA_69452
ctcctttcaacagttgagcaatatatacatttattctcccaagagangggnccacacaagcagactgccccagcacttattcgcacactccatatataaaatgatnaanntcaaatattctctactgngaatgatttcgncctttaagaat

SEQ ID NO: 69453 - DNA, 399 bp, Triticum aestivum
  Clone ID: PAT_TA_69453
aatgtgacttgtgaattagtgtagacatggtccacattagcaggtcaggttactacaacaaaagacctcgtagggtggcaactggaccactaccgtcctccagcttactactacaaaaggcctcccaaaagacatcttcatcagctcatttcagatcttcggcatcaaccgatgagttgcagaaccacagcatccatcgtcagcctctgacttgctgcttcgtgtgtgcaatgcgtggccacctctgcaagcttggcagcctcggtcctcgagaagatgccgccgaggttgggatctatcaggccttcaaggtcgctggtggcagtgcctatcttcacttgtgagacggccctcttgcctgtgatgatctggagaacaatgatcccaaaggcgaagaca

SEQ ID NO: 69454 - DNA, 595 bp, Triticum aestivum
  unsure (1)..(595): unsure at all n locations
  Clone ID: PAT_TA_69454
ttgtttntgtttctaaatcatgttcccgtatttgggnaaatgtngcgaaatgaaaaacaacnagggnaagtaggagaaaaggaaagaacacaaacataaaaaataaaataaaaataaaaaatggaaaatataaaataatactaatccagggtgcgaacgtttggtccataaacgtggacctagagctcgactcatagaaatgtagccgatgggtgttcttggcgcaattagctggagattcgccggtcatttcctgcagatcgaaaacaaagcaactacctggagattcgccggtcatttcctgcagataaaaacaaagagatcgtttataaaagaaaaaaaagttgttcatgattttaaataatgttcccgaatttgagtaaatgttgcgaaatgaaaaacaaaaagggaaagtaggagaaaaggaaagaagcaaacataaaaaataaaatcgaaaatgaaaaatataaaataatactaatcgaaggggcgaacgtttggtccacaaacatggacctagagctcgacacatagaaatgtaaccgatgggtgttcttggcccaattagctggagattcnccggtcatttnctgcc

SEQ ID NO: 69455 - DNA, 672 bp, Triticum aestivum
  Clone ID: PAT_TA_69455
agatacggttaattgtattgaagaacctacgtacatgtttggaatgcagaatggtcgctcataatcaggcctagctagacttcaatcctactgacatgaaagactactcatccagtgtgtttttcatggtccctattcttcctgtcaaatccgaatcgcatcccggattatatactgcttatatcaggtagcacggtgattatctctgctttgccaaaaaacattttcagaaactgaaccagcatctgacgctgccttgtcttgcccataccttttcagattactgctagtagtacaattagctagcatgccgctgcagaggatgacttcatcttcaccaagtgaacatcttcagcaagcgccaacaagcttcatggtaggcctacgtggaattgattcccatgcataaggctgtatggctcccatcaccgagatatcatactggttttcaatgagcaaggaccaagcaacggttatctccacttcacaactaccaagctcacaactttctcgacttatgttgctgaatttggttgggaagacgacacttccactgatttctccagccttcatgagaatttcgagccttcctcttgattttacagatacaacttgcctcgacagatctagataaccctcttcacccacaggcatatctccagcttgtgaatc

SEQ ID NO: 69456 - DNA, 338 bp, Triticum aestivum
  unsure (1)..(338): unsure at all n locations
  Clone ID: PAT_TA_69456
acatcttggaccactctactngattttgatctttacatagagtgctgnngacaccaaaaagaatagcnactagtgcaagacacaagcaggtgccttagccttcaggaaaatacgggaccttntcgtncaagccacgatgcacgtaaaatttcatgcatgtttncagtctagagaagcttantaatgtctggcagagatcctcngcgntgctttcannaactgactgatggaaagntatggncatttnttttagcactgttgcccaattaagcaaccgttccacaaaagcaacttcattttcagttcctntncaggcactgatttcnattattatgagg

SEQ ID NO: 69457 - DNA, 624 bp, Triticum aestivum
  unsure (1)..(624): unsure at all n locations
  Clone ID: PAT_TA_69457
gcgcctctgcattttaagagagaaatgcagaggatccacttaccatccagacgcttgtgtatattcgtcatcttcctaaaaggctaaaatgnatatacatttttttccgtgtctactcattgccataagcactagctgcaaggtcaaaaagattctatgaatttgtttctcctctgaacctttgaccatataaagtcagagaagaataaaaaatgaatgatactagtctgctctagggttcaaccatccacagaaagaccccactttacgttgagattcctgtaagcttggcgaaacagcataaaccaaacaacaggacctatgtcgtcgttgtcagcctgctttctttgctgtcaaccttcagttcgtcttccttaacagcagactgaacatcatctaggggattaggagttgcacttgaggcctctgccgctggtgtagttcctgaggcttctgtcgttgagccatcaactcctttcaggatgctagattctgtctttggttcatcagacagttctgggttatctgatggttccttacaaatatgttggtcgctattagcagtatttgagtgttccttggagcctgatgttatctcagtctcatccatggcagctggaaaac

SEQ ID NO: 69458 - DNA, 537 bp, Triticum aestivum
  unsure (1)..(537): unsure at all n locations
  Clone ID: PAT_TA_69458
acttttggctngcagaagatcttgcactgcacaattatctagatattacaaagataaacatgtaaaataaatagctcagcatttgatgaataagatgccactaaaagaacaagctgaaaagatccactcaacaatcaaaggggcaagaaataaaggagaaaaatcacatgtttccagtagtaactatatgacaatagtcttattattcaagcctacagtagtgataggaaattctggacagacctcaaattgaactggcctccttgtactcgcagatccattatcctcgtcatactgtatatatggaaaatatatgtccttcagaaatcctcgaagtttagctggctccaagtgcctattcaagccgtggatttccacctgtgtaaaacttcgatgtggcgacagtgccaactcttcttcagatggatctctaactcctccagcagtcttccagctgagtttagatgaagacttctccaacagagcctccctcgaaagatgcaaggtaaacactttccttgattccttagttttagc

SEQ ID NO: 69459 - DNA, 116 bp, Triticum aestivum
  unsure (1)..(116): unsure at all n locations
  Clone ID: PAT_TA_69459
catatataaatcccaactcccagcaaattgcaaagtgtccaagatcttntctacgaagatagtagaaactacaataattaattctatcatggattaatcagacactaagcttaagc

SEQ ID NO: 69460 - DNA, 268 bp, Triticum aestivum
  unsure (1)..(268): unsure at all n locations
  Clone ID: PAT_TA_69460
antacctaaaagaaagtcgngtaataggcgccggcaccggcacaaaattgagccggtcaacgcatacccgnacgattaaagnncccagngccgtcagatctggtcctcttttntncctnctctgatncatcatgcggaaaacaatacaaaaaaaatctccagcacaccccgccacacgcacgcagnccgccatggccgcccctgccgctgacttcgaagccccgccggctcgccgccatcggtgcaccggttctngccggatctagca

SEQ ID NO: 69461 - DNA, 637 bp, Triticum aestivum
  unsure (1)..(637): unsure at all n locations
  Clone ID: PAT_TA_69461
gacaactggncgcagaacaactcagtccaaaatttattttgttgcattgtctggcttagaaaagaaagcgcacacagtttaagattctagcaacatgcacgcatcttcttattaaagctactctccggaccggttacaatttggagccgagcagcacacccataccatatgcatttgcaccatgtccagatcaacaagatgttgacacttgactgcccatatgtatgcaaaaaagaaaaagaaaaagatgcaatctcaaaacgcgttgcagcctgacgccatcacttttcctgtctctctgtgcttcttcctctcttcttcaatcttcagaaatgtcatgacataatgtctctatcgtccacatcaagcagaaattaattatcagctaagtcaacatgccttccattgctatatctgccaagaatatctcgagcagcccagtgatgccaagagtgaacttccagaactcggactagcgatagcgctggtacatcctccgcagatctcggcagtgtatgcacgtccacggggtcagtggaggatcgaggcaatacgagtgtacccactgtgatcggcagacatggcagctcaatataagctcttcgggctcacggctgtggcacatgtagcaggcgcc

SEQ ID NO: 69462 - DNA, 159 bp, Triticum aestivum
  unsure (1)..(159): unsure at all n locations
  Clone ID: PAT_TA_69462
cgctctctgctggaattctcatgtgtgtgttggtgttggtgctcagttggcgcatgaccagctcgcggtggggacgcagctgangtagtggcaccanccgcagctgctgttggcgttngcgccncggaacaccatggccagcccgatcgcgaatcctgc

SEQ ID NO: 69463 - DNA, 234 bp, Triticum aestivum
  unsure (1)..(234): unsure at all n locations
  Clone ID: PAT_TA_69463
cttgcttcnttctatattntatttttgtgagcctcggtacttcntagctaactaggtttacagccgatatcaaccacaggctggcctttgttccaattacacaagatacaatgagaggctcaagagccaagaaaataatgagccatactatacactgaggtactccctccgtccgaaaatacttgtcatcaaaatgacaaaaatgatgtatctaaaactaaaatacatctagac

SEQ ID NO: 69464 - DNA, 490 bp, Triticum aestivum
  Clone ID: PAT_TA_69464
agccgaatttttatcaacataatcgtgctgtatttacaaacgatcatggggttgtcgcaaaagcacaagttgcaacgaacacaacacccctaagctactaatacccctaatttggcccccagcagctgagggacatgactgtcctcagcccctcctcggccttctctgctcgccgcctctccgccacagccgcagcggaggccggaagctgcttggggccctgcgagacgctgccgcggacgttggtcctggccttggctgcccggtggatggacgtgagcgcgtagttccatcggcagagcctggcttggtccttgagggcctccacggcgcccacgctcatggccaccatccacgacgccttcaccggagcagccatctctcctcctcctcctccttgttcttgcttcgctgctggcgaggatactgaattgtgatccttttgtatggcagtagtggacttgcgaagttgcggcagagctgatcctcc

SEQ ID NO: 69465 - DNA, 541 bp, Triticum aestivum
  unsure (1)..(541): unsure at all n locations
  Clone ID: PAT_TA_69465
tggtgtnttacanaaatgagaaaggggttctgnttaaaactgggccaaattaccaataaaactattgagcaatctaagtgtgaaaacttaaaactaatccttaagaaatggatcaaaatatggtgtatattttagaaattaaagagagggtatgcttacaacagggccaaattatcagggtgaaagtgtataactattgagtaatctatgtggacaaactgaaactaatcttaaaactaggtttttgacgaaatagtgcaatgcaaaggggattatttcagtgaattagtactatcacatgagtgaacatatatggtctaagattaagctggctctgtgtaagaattgcatcaccagcacacgtctctcactttatcaccatggtgaacacgagtgaattaccattacaatgtatgagcatcggtaagtccatgtagctgccgcttcaccactcatcatgtgttggccaatgatcagaggtaggagtgtctcgaacatgtaacagtcataacccaagctacatctctgctactgtcggaaa

SEQ ID NO: 69466 - DNA, 583 bp, Triticum aestivum
  Clone ID: PAT_TA_69466
ccttttgattgcgtggcaatgcatgggcactatgctagtgaaagaaatactatcaagttactgtttcgctcaccagtgccctgataattgattttttcttgtcttgctcagccttctcaagaatgaactcgacaccttctactctctacacagcaaccatagcatgaatgacagggaatggtctcattttttgtatttggccaagatgtcagtgacctgagcccaggcagcaggtcgctcgagtcgaggaacaccttgttgttgtagcttgtgatggtataagcgatctccctggcagcttcaatctgtcagagcgggacaaaagcagggtcgttggcgatggcctgactaatgagctctgcactcttagcctcacccttgttgttggagcttgcgatggtatgggtgatctccctggaagcttcaatctgtcggtggtagtaactatgactgaaactgtcaacagggcataaagaacaattgcacttttcttgtcttgctcagccttctcaacaatgaacttggcatgctcagcttggtgtgcagcaacctgttcggcttcaatagcatgagtgaactcttt

SEQ ID NO: 69467 - DNA, 167 bp, Triticum aestivum
  unsure (1)..(167): unsure at all n locations
  Clone ID: PAT_TA_69467
agatccacaaaccgccggnggaggcggcccgnangaacnaaccangccagggcngaccnantaaaaggccataggctatcgaggagcaagggagtaacagcncaagaaccgaacggacaaggatangnagcctaaaggctatagccaaaggctggccnacccgacgg

SEQ ID NO: 69468 - DNA, 504 bp, Triticum aestivum
  unsure (1)..(504): unsure at all n locations
  Clone ID: PAT_TA_69468
ttattttacaggcatggatacacttctaattaaaagacagtcatttccctaattacaatattacatgtgcgattctccaacatcatatgtcacacatgcttttcctgattacaacagaggagaagccacgatcggactacgcacaacatgttttttggacacccagctcaaacttccctgcaaggcctttgacccgacattgcgatgcctgctcaccgnaatgctgaatgttttcttttgtccaaccttggagaacaccagcgtctctggatagactcgcactgtgagagacttgggaacctccatcttcagtgtgtatactgaatttattggccccacatttgtaacggttctgttcaccgtgaatggccttgtcctgagtggcactgttatggatgggtagttcaactgtgcctctggtatcttgggaagcattttgcaggacagcgtcggggcacgcgcaatggttgccaagccttgatcaccgaggagagcacatatgta

SEQ ID NO: 69469 - DNA, 594 bp, Triticum aestivum
  Clone ID: PAT_TA_69469
taattagtttacacaaatcccagcgtgtgggggaccagagcccaaccaaactattgttctaccttcaattcttgcaaatttagctaaataatcgctaaccacattttggttacgattgatatgaaatacactagttgtacgaagggacatcaagtgtttaatctcattcaccaaggaggcaaatatagacctgtccgtgtctctgtccttaaccatattcactgccactacagaatccattttcacacaaatcgacagctctgatccctggatagcaagagaaataccctccatgcaagcacatagttcggcctcaagtgcatctcggcgggagaaaagcaccttgcaagaagagaaaataatttttccaagacaatcacgcagaaccatgcctgctcctgctccaccttcctctgtccataattcatctgtattgagcttgacccaacccgtcggtggaggaacacacctaacaggtgggtcctgacctattatttcatgtggtgttttggtactagtataagttattacaacttttcgcttcaaaggatcacactctgtgttttgagcaatcgcaagtagcgagtcaaggta

SEQ ID NO: 69470 - DNA, 608 bp, Triticum aestivum
  Clone ID: PAT_TA_69470
gtcggtatctcttgctaaattctaatgtagtgaccttgggtaggacgtataggtcaggcatatgaccctaccctaggtccatggcctcgtcagtagccatgatgggataaaaaatgtattacagactactcttattactttgacatccctccactgtccccactaagccgatgctcaccttcatcatcgcctgcttgagcagctgttcgtcagcgccatcgtagtactgctcaatgtagaccacatccctcttgcgagcgtcacagaagactgttcttctgacgccataatatgttatgcaccgacagccgctcccccttcttttgcaccgtgcacactcagtggcgctcgccaccgccgtacatcgcttgcatggcaagtggtgcttactttgacctgatagttgttctcatatctctctcaactccgacattattaaatcttaaacaacatcttttgcagaagaagaaaaacaatcagcaacaacaactactgtgtggcctttgtttgtagtctgaacacaaatgtgaaaagcgggtacatccataagatagcatttgccaaagatgaagccctaagcaataatcaggtctcctagaataaaaaga

SEQ ID NO: 69471 - DNA, 611 bp, Triticum aestivum
  unsure (1)..(611): unsure at all n locations
  Clone ID: PAT_TA_69471
tattacaaggaccggggnacatgaacacaattgatacatcgttgaagcccacacgcaactggaaatgtctatgaaaatagctcgcatagtccacatatcatattcttcagtgcataccgcacccttcagttgcagagtcagtttccaccatcgatcacttgattacagcccatttggatggctgtgcttatggcataaaagatacccaaaacctcttgcagagtcagtttccaccatcgatcacttgattacagcccatttggatggctgtgcttatggcataaaagatacccaaaacctccgaatgaaacgcatccgagacttgctccagaattgttgttcctttcaggaagcgccgtccgtattgattttcaaaatttccggtggaggcctggaccatctttccttttgctgctgcttttgcctaccccaccaccatttgctcaacacttaatgaagcaatgtccgctatcctcatccaaatgaaagcaaacaggacagcgagtgcctacatgcatccctctgtgttgaagcttcatgcgcatgggtaaactgtctgtagacaggtgccataaaaagtgaagaatcttgtttggaaggggaagcgacca

SEQ ID NO: 69472 - DNA, 100 bp, Triticum aestivum
  Clone ID: PAT_TA_69472
ttgcataacaaagaactttgcattcctaattacgacaaacttgtcccgtcacaaagttacaacttccagttttctaatagaggcctcaaacattcgttca

SEQ ID NO: 69473 - DNA, 421 bp, Triticum aestivum
  unsure (1)..(421): unsure at all n locations
  Clone ID: PAT_TA_69473
cttaagattgaatgcgtatctgcgtttngattttcagaaagaantcatgcaaaactttactcaaatgaccgtagagaagaacacagcatatgcctaacagngnactgagaatctttacttcgtntctattgaactgcagtcatcagacaatgccaagcgcattattgccaggttctgccttgcaggtccattgcaaaatagaagtgcccaacatccttaccaaacctaatggctgtcaaataacggaagaaattgaagcattacagcagaatttgagtatttaatccttctgtccaatatgcatcatctagttccctgcagacctgatggtcgtcgttttttcaagtaatggtgcagccccggataccatttgcaagaactcgaactcgtagccatctcctctaaagcctttgatttccac

SEQ ID NO: 69474 - DNA, 540 bp, Triticum aestivum
  unsure (1)..(540): unsure at all n locations
  Clone ID: PAT_TA_69474
tcatagtatttaggcataacacgccaaacacggggaatgtaagagcatgatacacgatatgtttatagttgcagtaacattctgggtgattttacataatgaaccgctacacaaactgttgatggttgcatatgccgcaggcttaggtaacgaggtcatcagctatagcacagcagagtttcttcaggtcttcaaattcaccatcttggaacgagaacgaagccatcctattggaaattccggtctcagaagctcggtcaaaatcaactttggtttgataaacaaagtagccgcagcactcccaggcagaaagatagcagccagtgaccagatttttcacattcgcaatcagcagtaccccattgtttgggggtgtagttgaaggaacaacctccggttcagtatcttctccttctgcaatgcacaaaagtaattcctcatagcttttancagaatttggcttcaagcatccaaaaggatggccgaacttgtcatgtttcttgaggggaaatgtattccatttatcattcatctgaataa

SEQ ID NO: 69475 - DNA, 572 bp, Triticum aestivum
  Clone ID: PAT_TA_69475
actgtttgcttcggaatacataacggtcaacaacaatacggtgggagttaagctcatctagtcacacatcaattcactctacaaacataaaacgttctaaaataacctatggaaaaaactgtcagagggcatcgcaattaaacaccacccgcatgcaacttaacagcaaatgcattcgtgcaggtgttatgcttgtgtccttctacaccacagttgctgcattttgcctgcttcctgggattcttcgggtgatcaccgcgctccgggcatgtcgttttcttgtgcccactccctctacatatgcggcagaaccttgtcctcttactcaactgttcatacggagccttctcgcggctgcttgttgggcgcccttgcttctttctcttctccggagcatctaggccagcgaaagtatcaacatccatctgctgcctttctacgggtgcaacaagtccaccatcatcgcatttttctccggcaccacggtgagcttcaggcctgtcctccaaagctagcccgtccctctgggattcatagccagtaagagcagtaataccatccctaatgattct

SEQ ID NO: 69476 - DNA, 214 bp, Triticum aestivum
  unsure (1)..(214): unsure at all n locations
  Clone ID: PAT_TA_69476
tacattgngttccctgtcttaagtgnngtatcatcngttccatcccaagtcaagttacccttctaaacgaaactngagtgtagtatcttctgttctacttcaattacctttctgtgttttcacctctattcttcagaaggctntgtntcatcaacaccttttatgtcatcaacaacacgctcgacttcagctatctcctccaccttcacagcag

SEQ ID NO: 69477 - DNA, 359 bp, Triticum aestivum
  unsure (1)..(359): unsure at all n locations
  Clone ID: PAT_TA_69477
ccaatggtnaacaggacaacagcggcacatatgggcaaaattgcataaatatctggtacttatggtcaaggtgatatacaactgggctttcatgacgatccaaatcatatgccaacanttngttttntgaatgagctatgaanatcagattggcatgtgggtgtactccaatgagtttgggaaacttcttctntggaattacatctgaaaacttgtacaatttccagtacatgcgtttgtcatcctgatgacagacatcccagttataaatctcaacactaagaacgtaaaccgatatagtcaaagatctgtctgagccatatccttgactatcaagggaggcgatataaagtagctgt

SEQ ID NO: 69478 - DNA, 452 bp, Triticum aestivum
  unsure (1)..(452): unsure at all n locations
  Clone ID: PAT_TA_69478
gtgcaagtgaaattgtatagggaattaattaacgaaatgacattgttcttttggataacctctacggcacacattaatccttgctgtgcttgccttttggctcgatggcagccttcttcacagcctcaatatattgttctcatattcatgagttaagctagaaccatctgcaccagctgctcattggcacacatatactcatcatggaggtatcangatggaattaaatgtccgagcttaacatgcgtacaacagtggaggcaggtcatctaattagagatctgactatgcatacagtggcacatagtttggcccctgctgcatagggaggcagctcctagatctgattagagagacacacatggaggcacatgagcacgggcgcacgtctaaaaatccctccaacagttcaagtgacagcagccttgtcttggtagcaatctcgtcatttt

SEQ ID NO: 69479 - DNA, 525 bp, Triticum aestivum
  Clone ID: PAT_TA_69479
gcacaattcttacaaaggttgtaacatcgtactgatgccgccatcagttcatgaagcggcgatcaatcctagctgcctaggaggaggtgaacttggtgacggccttggtgccctcggagacggcgtgcttggcgagctccccggggaggacgaggcggacggaggtctggatctcccgggacgtgatggtgggcttcttgttgtagcgggcgagcttggccgactccccggcgagcttctcgaagatgtcgttgatgaaggagttcatgatggacatggccttggaggagatgcccacgtccgggtgcacctgcttcagcaccttgaagatgtagatcttgtacgtctccacgctcttcttcgccttgctgcccttcttcctgccccgctgcttcgcctcgccgccggcctccttggacgccggcgcccgcttctccgccttgggcttcttccccgccgtcgtcttctccgcggccaccgccgcgggcttcttctccgccgccttgggtgccatgggtgctgctg

SEQ ID NO: 69480 - DNA, 273 bp, Triticum aestivum
  unsure (1)..(273): unsure at all n locations
  Clone ID: PAT_TA_69480
ctcatngagtcatgatagccgaaagattcatgccttggttaagacctaacatagacgcctaaatactcaacagtgccttgcatgtcgaacaaccagtgattctccaaaagagctcaggtcatggaaaaatatagccaacctcaggttcatcaatgaaacggatcatcaacggtaaggtcagacgctttccggaagctccgcctncaaacaccgtcctttggattaggccctagcaccagcagcacaacatccttaccggcccatggtcatagc

SEQ ID NO: 69481 - DNA, 662 bp, Triticum aestivum
  unsure (1)..(662): unsure at all n locations
  Clone ID: PAT_TA_69481
ttaaattgagggagttncatggtgaaattctctttataacatatgaaagtctcctactattattagggagctattataaatattccattaacttggaatcacccataacacaattgcactactcttcaactcttcttttatcctactcaacttcatatatttccttgtcatctctctctcaagccacacccatgcatcatcaccggtcacttccttcttctttcatgtctttgcaagtgactttattcctcctcctttaatgttcatcttttccctataaatcttgcctctttcctacaccctctccgtcagatttcatcccattcaaagttgttttggtcaggttcaaaaatgattgaagtttgagaataattcaaattctaattatttttctagcttctaaaaatgcaagagcaatttattcaaaccctacataaatccagggttccagatatatatttatatatctcatatccctaaccaaaaacccctggattttcccctttgttgattgtttatttatataaacaaaaaaaattaaaaaaaggaaagaatttggagggagagagaggcagcagccaggacggcctgcttccccaaggcccatccatagcctctctgcagcatcagaccggccggcccatccatcccccaaggcccac

SEQ ID NO: 69482 - DNA, 731 bp, Triticum aestivum
  unsure (1)..(731): unsure at all n locations
  Clone ID: PAT_TA_69482
agcgatgtcttctctgctgagctcttgtcactggaagactatgtattgaccttgaaataatngccagtgttacactttaggcggttctggtattcgaacagactaaaaaagggaatggttgggaatgacgtaaccctgccacaaggacacacagaaaccctctcatgttcaatgcctccacattagttggagagtgatgggtgcaagatggagatctggttctcaagatgattacaaatacaagcacatttattaccttgggctgatggtaacactcccatcttacaattgtcagtgacggctttgcaacgccaaggcgaaatggatgggggttggtctaattttcactcgcttggttggtcaggtcatttatgtacagggtcaccaccagaagcttaccagatggtaatactctgccttacaatttgcaaatgatgtaattgagatgcctcgtgagtaatgtagaaagcttgcttctctgagtcgaatttccattggcctggattgttcaggtgctctgagtcgaatttccattggcatggtatgttcaggtcatctttgaacaggatatatcacactgaagcaagaggaattctaaaagatcatatttgaataggtccatatttgatgacagctctgaccagtatattccatgtgatggctggttggtacaattccttgtgcaagcacctcatccaataattggacaccctcangtgttctttgacaag

SEQ ID NO: 69483 - DNA, 173 bp, Triticum aestivum
  unsure (1)..(173): unsure at all n locations
  Clone ID: PAT_TA_69483
cccctgtgagattccgcattaatacatgatgatggtgtgataccgaaatgaatcaccgaacccccctcaagcgctttatttgcaatcactcaggagcggataaccgtcttcggcacgtcgaaagaggggggggggggggggggggnnaaaaanggnccnaaangggccccnnt

SEQ ID NO: 69484 - DNA, 673 bp, Triticum aestivum
  unsure (1)..(673): unsure at all n locations
  Clone ID: PAT_TA_69484
tagtttntttctntgttgcgtcngctcaagagtgttttgtctntttctctttgacataatgaactgtgagtttgccagccaaatgtcatacacaaagacatacagtgttaataactgacaagaatatggatttccttcctctgtcatgatttgcggtatagtttattgccgcctggtggtgatagtcaaccccccttgacactatcttatgttagcccttattttcaccatatttccttatgcagagccaaagaaggaagaaataacaacacaaccaaaagaaacaaaattaggatttgaaggacgggagggcagcactctattaatattatgaatgatctgaattgctgatcattttctttaaataaaaaacactaccaacaattgaaggattgcttgaatcaaaatacccttatacagttaatttagttctttccaacaaattgtgttcataattaccatacaatttctattgactttaaaatatgtgaggagtgatttatgaaggcatgttatattcaaccttaatattagtacttaaatataatttcttttctttagacattcattgaagctattatttcctttccctttgggtaagccaaggacgcctgctacaactagaagaaagttcactggataaaaagttattccctctgtaaagaaatgtaaa

SEQ ID NO: 69485 - DNA, 661 bp, Triticum aestivum
  unsure (1)..(661): unsure at all n locations
  Clone ID: PAT_TA_69485
atttaagacttnttacggcaagatcgatngagttctctaaactcactggtctcgaaagcaaataacacttcactgaaaaatatgagctggaacataacaggatgcatttctttactctcaaacagtttaaagaagacatgcagaatatttcccatgttctaaaggaaagctcgttggttgcaacttgttgcccagctgtcgcactgaattgcatcacgtaaaaggatcagtcatcatcatcctcatggtcggccagatgccaccgaccatccttgcctttcaccatacctttgttctgaaccacccaccaagacggtggaatcgaatactcctccttcagtgcatcttcgtgtttattcaccaacgctatgtcccgatcaacctccaactcaaaccctccgttgctcccctgcgtcccggcaaccccatgcatgtaacactccatatcatgccatgttaaggggttcccagggctcttgatgtagggtgattcccctgtgtcgatcatgagctccgtgccggcgtcgctgtatcccagctttggccagtttgggaccacgtcaggggagttccggacacggagcaacctcagatcttctgcactgtcaaatgctttctggaagtcggagttgcccactctggggctaccaaacacgaaggc

SEQ ID NO: 69486 - DNA, 553 bp, Triticum aestivum
  Clone ID: PAT_TA_69486
gcgctagggacgtccgcgacctcatcctcccgggcatgacgcactggcagagcccgcgccacttcgcgcacttcccggcgtccagcagcaccgtcggggccctcggggaggcgctcattgccggcatcaacgtggtgcccttcacctgggccgcctcgccggccgccaccgagctggagatggtggtcgtggactggctcggcaaggcgctgcatttgcccgagagcctcctgttcgccggtggcggcgggggcacgcttctgggcacctcgtgcgaggccatactctgcgccctcgtcgccgccagggacaagaagctcgccgagatcggcgagaggaggatcggcgaccttgtcgtctactgctccgaccagacccatttcgccttccgcaaggctgcacggatcgccgggatcctgcgtgaccactgccgcgcgatacacacgtgccgtgaagacatgttcgcgctctcgcccacggagctgcaagccgccatgcaggccgacgtggacgccgggctggtgccgctgttcctgtgcgcgacggtcgggac

SEQ ID NO: 69487 - DNA, 494 bp, Triticum aestivum
  Clone ID: PAT_TA_69487
gcgcaaatgtggccgcctccctcttgctatcaggttattgctagtgctttggctggcagggatgtaacggagaatgagtggaaaaagtttctggaaaagtatgctagctcacaaagcatgttctctgatgaaactgaaggagttttgtatttaagctacgatgaattaccacatcgtcttaagcagtgtttcctttattgtgctttgtatattgaaggtactatcattcttcgtagggaaattaccatgttatggattgctgaaggtttcgtcgaggagaaacaaggccaactattagaagacacagcagaagagtactactatgagctaatccatcggaatctcctccatccagatagtgtaatttttgaccaggccgaatgcagaatgcatgaccttttgagacaacttgcttgctatatatcaagagaagaatgttttattggggatgttgaaacattaagtggtcaaaatatgtcaaaactgcgacgtgt

SEQ ID NO: 69488 - DNA, 581 bp, Triticum aestivum
  Clone ID: PAT_TA_69488
attcggcacgaggatcgatactcgcacctacagtagcaattagctagctaggtagcgatggggcacaccagggcagccgtgctagcggtggtgctcgccgtcgccgtgctggggcttgccaccgatggccaggcgcagctccagaacgggttctacacgggcaagtgccgcggcaacgacgtggaggctgtcgtccagggtatcgtccaggcccgcttcgccagcaacagcgacatcgtcccccacctcctacgcttgctgttccacgagtgcggcgtcaatggctgcgacggtgggctgttgatcaacggcaccggcacagagaagacggcaaacccgaacctgagcgtcaagggctacgagctcatcaccgccatcaagacggagctcgagaagcgctgccccggggtcgtatcctgctccgacatcgaggtgctcgcaaccagggacgcggtcgccgcgtccacggggcgaagatacgcggtgcgcaccgggcgcagggacagccggcggtccgtggccaccgacgtgaaccttccagggccagatgacacggtccccaaggcagccgctttcttccg

SEQ ID NO: 69489 - DNA, 509 bp, Triticum aestivum
  Clone ID: PAT_TA_69489
gcagcatctatagcagcatacctcaagtgttggatcttctccgaaatgaataccgaagatgacaagcagactgttctaagcacgttacccaaggacctacctctagacttcttgaagaccatcacagatcagttctcagacaaccgtgttatcggtaaaggtgcatttggaacagtttatacggtatgttcatgccttaacattctttaccatttggagaagttgcgcatatttctgaatagaagtgtctgtgaggttgaacagggaactatgcctgatgggcaaacgattgctgtgaagaagcttgcagaaaatgcgccgattgcacgtgacaaaatatttaataacgaagttcaaaacatcatggcttaccgacatgaaaatatagtcaagttggttgggttttgccatgaaggacagaagaaagtagttctaaacaatgggcgatatattgtcgcagatgtttacgaaggtctactctgttacgaatatttacctaagggaagcct

SEQ ID NO: 69490 - DNA, 605 bp, Triticum aestivum
  Clone ID: PAT_TA_69490
ggccgccgccgccattcctccccattccggcggcccgaaccgcgcaggctgcttcgcgcgcgcggccgacgggtgtggaggaggaatccagcggcattgccggattcggctcgagtccagtcggaggaggtgtctgtctgaccgacaggcgacagggtttggaggaggaatcgagctgcattgctggattcggcggcactcgtcgagttggaggaggtgtctgactgacaggctttgttttaatcaagcacttcatttcctgcagttatatatggaaaatagaggcaccaacagagctatgaagtattttgtattcagatgacataaggagtattgagtcttgtatatttgtgatgaaagttggtgctcttctgacctctgctggaatcaacattggtctctgtatactttttctgtcattctattccgttctgagaaagcagccacaaaatgttaaggtctattttgggagaaggattgctgagcagcataagcggctccgaggggcttttattttggagagatttgttccatcccctagctggattgtgagaagtctgcaatgcacggaagatgagatcctatctaccgctgggttggatgca

SEQ ID NO: 69491 - DNA, 394 bp, Triticum aestivum
  unsure (1)..(394): unsure at all n locations
  Clone ID: PAT_TA_69491
tacggctccgtggtgcagatcgtgctccagggcaccaacatcttcgccggggagaaccaccctatccacacccatggctacgacttcttcatcctcgctgagggcttcggcaacttcgatgccgctaccgacaccgcaaagttcaacctggacgacccaccaatgaggaacacggtgggcgtcccggtgaatgggtgggctgtcatccggttcgtcgccgacaaccccggggtgtggctgatgcactgccatctggatgtgcacatcacctggggcctcgccatggccttcctggtcgaggatggagtaggagagctgcggtccctgggggcacccccaccagacctgccaatttgctgaagaaatcaaagttgttgttttttttttttttngc

SEQ ID NO: 69492 - DNA, 479 bp, Triticum aestivum
  unsure (1)..(479): unsure at all n locations
  Clone ID: PAT_TA_69492
gaaagagtttacggcagctagctagacatccgacgagtttgtgctctctcatcttcagagctttggctgatctgatgggactttcccccagtgtactcggcaaattcagaggagacccgccgcccatggagaatatggtgggcaaatcgccggagccggagccggagctgccaccggatatgctgtcgagcatctttgccctcctcgaggtccctgacctcgtgcgcgcaggctctgtctgctcctcctggcgctcggtgtacaccggactacgccgtcagcttcggcagcacaaacagcgccagacgccttgcctcctctacagccttgccggagagaacgcagcttgcctctacagccttgcggaaaagagggcctacaagttaaccctcccggatccaccgatccgcagtaggtatctgattggctcttcgcatggttggctgatcacttncgatgagaggtccgagctgcaaatt

SEQ ID NO: 69493 - DNA, 609 bp, Triticum aestivum
  Clone ID: PAT_TA_69493
gagcaggcgaaggctgaatctgaaggggagcaggttaatattcctgcactagtgtgacatgtgaagtgatgacggagtgttgagcttgttgggatctgacggaatagatcgctgagcggaggctacggctgaagcgaaacgggggataggcttccaagaaaagtcacggaaacgtcagtgtcacagtacccgtaccgtaaaccgacacaggtagtcgaggcgaagagcctaaggtgcgcgagagaatcatggctaaggaactcggcaagatgaccctgtaacttcgggagaaggggggcctacccggtaacgggaggctgcagagaagaggcccaggcgactgtttaccaaaaacacaggactctgccaaatcgagagatgacgcatagggtctgacacctgcccggtgctggaaggttaagagggggtgttagcgcaagcgacgcactgaattgaagccccagtaaacggcggccgtaactataacggtcctaaggtagcgaaattccttgtcgggtaagttccgacctgcacgaatggtgtaacgatctgggcactgtctcagccatgagctcggtgaaattgtagtagcggtgaagatgccgctta

SEQ ID NO: 69494 - DNA, 672 bp, Triticum aestivum
  Clone ID: PAT_TA_69494
tcggcacgaggggacaataatgagttaggctgcaagcgaaacgacgctcttcaagagctcgagatgctgacagtgaatgccaaggaagcccaacagcttatactgacaaaaatccttgagagtaaccaggctagtgagtacttgagcaaattcatgaatagatccacaaacacatccaccttcaagagaaacgtcccagtagtgacatatgatgtggtccagccgtacatcgcaaggatctcaactggcgaggattcttccattatatctggagaccgaatcgttgaactgctgagaagctccggaacttctcggggtgagccaagattgatgccagccatctccgaggatcttgaccgtcgaacctacctttatagtctgctaatgccgataatgaacaagtatgtatcaggccttggtgaggggaaggccatgtatcttctctttgtgaaagcggaaacactgacgaattctggcattccagttcgatcagtcctcactagctattacaaaagccctcatttcctgcaccgcaaacatgacttgtacaacaactacaccagtcctgacgaggtcatcctttgccctgacagccagcagagcatgtactgccagctgctctgcggcctggttgaacgccagcatgtcctccgtcttggggcagtcttcgcc

SEQ ID NO: 69495 - DNA, 619 bp, Triticum aestivum
  Clone ID: PAT_TA_69495
cctcaagcacagaaggcagttggtatatggctctttggatgtgctgcctgggtattcagcatggtcatacttggtggagtcactcggctcacacgttcggggctgtcaatgactgactggaagttcgctgggggcttgcctccaatgtcggaagaagagtggctactggaatttcagaaatacaagcagtcacctgagtacacgagggtgaacaaaggaatgaaccttgaagatttcaaatttatatactggatggagtatgcacacagaatgtggggaagagctttgggctttgtgtttgctgttccttttgcatactttgttgcaaaaggctacgttacccgccaacttggcgtcaggctctctgctctttttgcacttggcggtgcacaaggactgattggctggtggatggtgaaaagtggtcttgaggaaccagcatctgagtatgttgaaccaagagttagcccatacaggctggcagctcatctgacctctgcatttgttatatattgtggtatattgtggactgctctgtcagtagtaatgccagaccctccggctgaatcaatgaaatgggtaaaaggggcagcaaaatttagaaagctggcaattcctg

SEQ ID NO: 69496 - DNA, 505 bp, Triticum aestivum
  Clone ID: PAT_TA_69496
ggctgtggccgccggtggtgagaccgggtggagctcgacgagtctgcccgcggccgggtcaaggagagcagtgactgggtcatgaacagcatggcgaacggcaccaaggagggcggcgctctccagagggagctcatcagattccttaatgccggagccttcggcacaggcggccacgatcatgttctgcctgccgcagcaacaagggcggcgatgctcgtccgtgtcaacactctgctccagggatactccggcatccgcttcgagatccttgagacggttgctgcgcttctcaacgccaatgtgacaccatgcctgccgctccggggcacgatcaccgcctccggcgaccttgttccgctttcctatatcgcgggcctggtgactggacgggcaaactccgtggccactgccccagacggcagcaaggttaacgcagcagaggcgttcaagatcgccggtatccagcatggcttctttgagctgcagcccaaggaagggcttg

SEQ ID NO: 69497 - DNA, 429 bp, Triticum aestivum
  Clone ID: PAT_TA_69497
ggaaatacggacgcggctcgggcagtgcactgcacggcgtccagttgaaggaaacgcacgggcgcgaacgctgttgaggtcgtctcgtctcggcctctttcttggctcgccattaatggccgtgcgtttcctcgtactactgtcgctcctcgtcctggcctcctccagctcgggctccaccacctcgctcgccaccaacgccaccgccgatggcggctcgctggatattctggatgcggggagcgtcaccgagttcagcttctccaacttccaccccgagtaccgcggcaaaaacctgacggtggtcggcgacgccgacatcaccaagggcgcgctccagatcacgccggacacgggcaacgaggccgcccacttcctcaccaacaagtccggccgcgtcctctactacgccccggtcaggctctggcg

SEQ ID NO: 69498 - DNA, 823 bp, Triticum aestivum
  unsure (1)..(823): unsure at all n locations
  Clone ID: PAT_TA_69498
ttcggcacgaggctcacgggcaagnaccatcacccttgaggtggagtcgtctgacaccatcgacaatgtcaaggccaagatccaggacaaggagggcattccgccggaccagcagcgtctcatcttcgctggcaagcagcttgaggacgggaggacccttgctgactacaacatccagaaggagtccacccttcaccttgtcctgcgtttgcgtggtggcatgcagatcttcgtgaagaccctcaccggcaagaccatcactttggaggttgagagctctgacaccatcgacaacgtcaaggccaagatccaggacaaggagggcattcccccggaccagcagcgccttatctttgctggcaagcagctggaggatggccgcacccttgccgactacaacatccagaaggagtccaccctccacctggtgctgcgcctgcgtggtggcatgcagatcttcgtgaagacccttactggaaagaccatcactctggaggtggagagctccgacaccatcgacaacgtcaaggccaagatccaggataaggagggtattcccccggaccagcagcgtctcatcttcgctggcaagcagcttggaggatggccgtacccttgctgactacaacattcagaaggagtccacccttcaccttgtcctgcgtcttgcgtggtggcatgcaaattnttcgtgaagaccctcactngggaagaccatcactctgggngttgagaggntnccacaccataagacaacgtcnagggccanatcccaggacaagggaggggtattncccccggaccagcnagngcccttntcttt

SEQ ID NO: 69499 - DNA, 881 bp, Triticum aestivum
  unsure (1)..(881): unsure at all n locations
  Clone ID: PAT_TA_69499
caaatccccacccaatctcgtctccgatcgactccacgctcgtcgaatactcctcccccaccgcctcaagatgcagatctttgtgaagaccctcactggcaagaccatcaccctagaggttgagagctccgacaccatagacaacgtcaaggccaagatccaggacaaggagggcattcccccggaccagcagcgtctcatcttcgctggcaagcagctggaggatggccgtacccttgctgactacaacatccagaaggagtccaccctccaccttgtcctgcgtctgcgtggtggcatgcagatcttcgtgaagaccctcaccggcaagaccatcactcttgaggtggagagctccgacaccatcgacaacgtcaaggccaagatccaggacaaggagggcattcctccggaccagcagcgtctcatcttcgctggcaagcagcttgaggatggccgtaccctcgctgactacaacatccagaaggagtccacccttcacctggtgctncgccttcgtggtggtatgcagatttttgtgaagaccctcaccggcaagaccatcacccttgagggtgagagctctgacaccatcgacaacgtcaaggccaagatccaggacaaggagggcatttcccccggaccagcagcgcctgatctttgctggcaagcagctggaggatgggccgtacccttgncgactacaacattcagaangagtccancctttcaccttggtcctgggcctgnggnggnggcatgcaaatcntttgtggaanaccctcaccgggnaaaacntcactttgggagggtgggaagctccgacaccatttnanaanggttaagggccaaattccaggacanggnggggntttccccgg

SEQ ID NO: 69500 - DNA, 438 bp, Triticum aestivum
  Clone ID: PAT_TA_69500
ggcgaatttccccgaaaacgaagagaaactcatacactaacaattttggagaaagtccttccttcgagtactacaataatatttgctatgatgcaagccaactaatggatcaagaaacttatcagaaaagactttcaaaaagcatgacaacacttcaaagaagagaagcaacaggatcaagtacttttaataaccataataacagtaatcatgacaaaacgtcctctccctcttcctctccttctatgcctatgcaccatcatttggatagaaaacatttatctaaatcatcggactatcaaatgaaaaggaaaaccattagacaatttcaaatcagtctcaatgaagacgaggaatcattgagaagagttgtcacaacagagaggaagagtttatttgcagccttatttagaaagaaaaaaaccgactatggtggag

SEQ ID NO: 69501 - DNA, 485 bp, Triticum aestivum
  unsure (1)..(485): unsure at all n locations
  Clone ID: PAT_TA_69501
ggaattcggcacgagggagagagagagagagagagagagagagagagagagagagagagagagagagagagagagagagagagagagagagagagagagagagaganntcncncncncncnctctctctcnacnncncnctctctctctctctctctntnttntctctctctctnctctctcncgcgcgcncnnnanngagannccccccccccccctntttncnccccccacacacncnccctctctntntntgtgngcgcncnctctctctctcncntctntntatatntntatannanncncncncnctctctncgcncgngngcgctctctntntntctctcncacananananacacncgctcntcctntgtgtgngcnctntgtnnnnagcccccccnctctgtntgtctctctctctctctctctctgngccccacactctnnnnncncantctctctctcncnctctctctctctnt

SEQ ID NO: 69502 - DNA, 396 bp, Triticum aestivum
  unsure (1)..(396): unsure at all n locations
  Clone ID: PAT_TA_69502
gccccaacaccattccatgccgttcaacagnattagctgttctacctgtagtactactatggctaggcgcagttcttgccacaaggttcccactgtttgtagcagcatcaccacaacctagcagtaagtgccaaagaaaatgcggcagcgtagacatcccttacccatttggtatcgtccattcacccgatgacgacgatggtccctgcgccatgaacggcttcggcctgacctgcaacgagacagggattaatggtggccgccacaggccattttatgacgacgtggaagtcgtcggcatctcgctgcagcaaggtcaggcccggatgctgaatgatatctcctattattgctacaacgccacaactcgggagatggtccgggacgagtggtggc

SEQ ID NO: 69503 - DNA, 475 bp, Triticum aestivum
  unsure (1)..(475): unsure at all n locations
  Clone ID: PAT_TA_69503
gnacaaggnagggcatccccccggnaccagcagcgtctcatctttgctggcaagcagctcgaggatggccgcacccttgcggactacaacatccagaaggagtccaccctccacctggttctcaggctccgtggtggtatgcagatatttgtcaagaccctcactggcaaaaccatcaccctcgaggttgagtcctcagacaccattgataatgtgaaggccaagatccaggacaaggagggtatcccaccggaccagcancgtntcatctttgctggcaagcagctcgaggatggccncacccttgntnactacaacatccagaaggagtccactcttcacttggtgctcaggctccgnggtggtatgcannatcttngncaagaccctcaccnggcaagancatnanctntggaaggttgantcctcgnacactattganaatgttaaatggcacacacccangncaaggagg

SEQ ID NO: 69504 - DNA, 555 bp, Triticum aestivum
  Clone ID: PAT_TA_69504
cttggttgagatcgagggtcctggagagcagaggcatccccttgccaactggcgatcagagctttatctgaactttgggcgtggccgatcgaacccgactcttccggtttgcatgcggatcatcaccggctcaccgctactgctacacctgaacagtgggcctccttccaaggcacgtgctgctcggccacttgatggacgttgcgctcgcgctcgccctcggcgagctcctcccgcacatcggcggcgcatgtgccagcgccgggctgtgcagcctcgagaggttgaattaggtgtccggcgacgcgggcggcctggcgggggtcaccggggagcagtaccgcagctcgagggacgcgtttcgccggaactgctcgatgaactccgcggcgcggctgtcgatgtcggcggagccagggctgtctgtcgtcgagtggacggacggcggcgtctccgctggcgtgcttgccgccgtgtggaagctcggagacccgccgtcgtcgtcgtcagtgcagtccagcaggctgggcgggagacggcggcagggtgttgacg

SEQ ID NO: 69505 - DNA, 643 bp, Triticum aestivum
  unsure (1)..(643): unsure at all n locations
  Clone ID: PAT_TA_69505
gggctgcaggnaattcggttncgaggggacagtaaggccagcaacccccgatggaccgtcgaagagaccgtacactgaagaagtgctagtgccactgccttctgctactctatctcgaagtgatgagcaagagtcacccgacgtgttcagatgtttgtcatgcttctccttcttcattccagcaggatgcagtttcaacatattccgtatatttgggaggagggatgtggacggacaacctgatgttctgcctcctcctgcatcagaggacacgcctcctcgctctgaaaactgcacaagctggcttctgtcatgtttccagccaggagatagcccaaaccaacctgctcctgctgcagatccactgacggtaccgcagtcgacagtcgaatcttcttcggagaaccaagctgctgaagatccagcgacgatgccactgcagtccgagacgcggaactccaatgatacaaccacaacaactgaatctagcacatcctatattcatcatagtcatggcacagttgtgaaaccagagcactcaataaccgnatcatcgtcggaagatcagacgacgacaaccaccacaacntggacgacgaaagcaacatctacgtcatcctctacagccacatcaaaagcagct

SEQ ID NO: 69506 - DNA, 524 bp, Triticum aestivum
  unsure (1)..(524): unsure at all n locations
  Clone ID: PAT_TA_69506
attcggcacgaggatacgacaaacaccagcaacagccccccgagctagcgacgaccatggccaagctcgccgccgtcctgaccctcatcgcgctgatcggctgcgcggtgcgtacctgccaagcagagtacgggaatcccacccctgttccgtccataccgagcataactagtcccccgccgccatacaccccgagcacacatagtcctccacctcccaccccagctaccccaagccctccgccgccatacaccccgaccacacctagcccgccaccgcccacgccagctaccccaagtcctccgcccccatacaccccgagcacacctagcgctccaccgcccaccccagctacccctagtcctccgcctccatacaccccgagcacacctagccctccaccggccacccagagcccacccaccgaaggactcgcggtcggctactacaagaagncatgccctngcgcggaagacatcgngagggaagttgtgcgtgatgccaacgccggnatcatggctgga

SEQ ID NO: 69507 - DNA, 518 bp, Triticum aestivum
  Clone ID: PAT_TA_69507
gctcatggggcacctcgtccccatgatcgagctcgccaagctcttcgccgcccgtgggctagccatcacggtcgtcctcatggacccgccgtacgataccggcgctacgggccccttcctcgccggtgtctccgcagccaacccctccatttctttccatcgcctgcaacaggtcaagctcctggagtctgacgactccgtgatgccagccttggcattcgcccgcctctccaacccgcacctacgtgacttcctcgctggcgcttctccggacttcctcgtggtggacttcttctgcagtgccgccatggacgtagccgcggaactcgacatccccgcctacttcttctccacctccggcgcccagatcctggctttctttatgcacctcacggttctgcacgggaaaagcacgaggagcttccgggaaatgggcgaagaactcgtgcacgtcccggggatcaccccgtttccggcgacgcactccatccagccactcatggatcgtgacggtgcgt

SEQ ID NO: 69508 - DNA, 561 bp, Triticum aestivum
  Clone ID: PAT_TA_69508
caccacaccacgaaggccctatgccccgaggcagctcgcagcggtgcaccgcctccgggccgccggcctcgatggtctccgcctccgcctccgaggacgaactcgccctcctcaccggcccgcagctcgtgatccacctcaccaagacccaccgcagagccgacttcgatgcggtttcgcgcatcctcgccgcgcgggaccgcgagagggccagtctcgaggcgaatctggcggctgcggaggccgaactcgaggcagcgagggcgcgcttggtgggggtcgacgaggtgcactccaacctaaaggccgcgctcagggagctcaaagcacaggaggagaagaaaaaggcgctagccggcgcgtaccaccggccgcgggacgagaccgacgagatggcgttcgtgcccggtgacgccgccccagaagcggtgcatcgggacgaggggcgcgtcaaggaggccaaggaaggggaggggaacgacgacgacgacattattgacctgtgcagcgacggggaggaaggggataggacggcggtggccggcgagatggaaatggaag

SEQ ID NO: 69509 - DNA, 672 bp, Triticum aestivum
  Clone ID: PAT_TA_69509
gcaaaactcgtccatctactccagtcaaaaactgtccttatggttcccgctccatggccaactcaacctctgtgaaggcaacatctgcgcagaactcaaggtcatcaactccaacctctcggccccgaagcgtttccagctcatcatcaagcacagctccttcagtgagtcatcccagctcatcctctggtagaattcctgcaattgttcgtaccagctcttcctcaagtacagcttcagtgacccgttctagctctcggtcgtctacacctacacgtcagcctgtcatgcgtccatcagctccatccatagctcgctaacctaaggacaaagctaccagaaaggccactctctgctggtagagcacggccaggaattggtttgggagccaggtcaaccccgaatgctgaaccagttacctctgctcctgtgaaaaagatatctgtgcctgctattactcgaaataagttttctgatgcaccatccaagacaccttctcttaccaatggacaccagaatcgacaaactgagagatctgttatggacagtcagcctgctagaccctctcggtctgccacaagtgaagaaaatggatttggcaggacaatatcaaggaagtcacttgacatggcaatcaggcacatggacattcgacataacctgggtggcatc

SEQ ID NO: 69510 - DNA, 612 bp, Triticum aestivum
  Clone ID: PAT_TA_69510
ttcggcacgaggcagcaactcacagcccccaccaccgaagctcccaaccccacccgaagcggcagccatggcccccaaggcagacaagaagccggccgcggagaacaaggtcgagaaggcgacggagaagacccccgcgggcaagaagcccaaggccgagaagcggctgccggcgggcaagacggcgtccaaggaggccggcggcgagggcaagacccggggccgcaagaagggcagcaaggcgaagaagggcgtggagacgtacaagatctacatcttcaaggtgctgaagcaggtgcaccctgacatcggcatctcctccaaggccatgtccatcatgaactccttcatcaacgacatcttcgagaagctcgccggggagtccgccaagctggcccgctacaacaagaagcccaccatcacctcccgggagatccagacctccgtccgcctcgtcctccccggggagctcgccaagcacgccgtctccgagggcaccaaggccgtcaccaagttcacctcctcctagactgacgatgcgtcgcttgttgtgacagatgtggctgtctgatgtatctgcaagtagaagtagtagttcgtgtggtagaagat

SEQ ID NO: 69511 - DNA, 611 bp, Triticum aestivum
  Clone ID: PAT_TA_69511
gtttgatcgatgagtcttacaggtgcaaaattctgggagcacacttgcagatgtaacattgctcttcacatgggctaattcagttggtgggagatcagagctgactggaaatcacaccaactccaagatgatagagcgtgatggtgtgcatggtgttcttctccgtcacagggctgcggatgggcacccgccggtgacgttcgcgatcgcgtgtcaggaaacagaggacgtccgcgtcacagactgccctttcttcacgatggggtcgtcggactccggcgacttcacggccaaggacatgtgggaggagatcaaacagcacggttccttcagcgaagcccgcactggcaaagagccaagggcgtcaaagtccggatcatccattggagcggcggtcgcagcggcgacgacagtgccggcagggggaacccgcgtggtgtcgtttgctctgtcgtggtcgtgccccgaggtgaagttcccagacgggaaaacgtatcacaggagatacaccaaattctgtggcttggatcgagatgcggctgcagagagcttggctcatgatgcccttcttgaacacatggattgggagtccaaaatcgaggagtggcaga

SEQ ID NO: 69512 - DNA, 531 bp, Triticum aestivum
  Clone ID: PAT_TA_69512
gcttccaccgcgtgatccccgacttcatgtgccagggcggcgacttcacccggggcaacggcaccggcggcgagtccatctacggcgagaagttcgccgacgagaagttcgtccacaagcacaccaagcccgggatcctctccatggccaacgcggggcccaacaccaacggctcccagttcttcatctgcaccgtcccctgcaattggctcgacggcaagcacgtggtcttcggcgaggtcgtcgagggcatggacgtcgtcaagaacatcgagaaggtgggctcccgcagcggcacctgctccaagcaggtggtcatcgccgactgcggccagctctagatccgcccgcgcgcgggtcgcctttcgccgtcgtcgtcgccgccccgtgtgtcccgtgtcgtgtcgtcgatctaaataagagagtcgtgtgtcgtgtcgtgtcttcccctggtccgtccgatgagatctccgtggttggtttaggagggttttaggtggactctttgggctgctggatctctgtccggcc

SEQ ID NO: 69513 - DNA, 643 bp, Triticum aestivum
  unsure (1)..(643): unsure at all n locations
  Clone ID: PAT_TA_69513
ggctgcaggnaattcggcacgaggctatctttttcctcttcccccgttctcttctcttcctcattgctcctcctcctccaatctctcccatcaggaaggttggaggcggcgcacacggctaggtagctcatgagggtccgatggggtgagcagcgagggcggctacctgcagaagaggagagctcgagacaagcaacattgaggaatgatggcgattattggtgcagggactcctaatcatccctcccctgttcttcttggcttcagggactaccattgggcagcctcttcttctccatggtgctccagcaactgcacaaagaggtcagttatctcgatcggtgccccataactcaggccggagatgatggaaggatctgcacaagaggacatgtctctggacagccgccaagtgttcttcgtgctatgctactgcatgaatcgcctcctggccaggtaatagttacactataaatctgaaatgcataaggaggactaagcataagacattagggatgattagggttggtttgttccgtgttaagaaagtaaggtttttcttttggcttggcatatgcttctcaggtggttttatctgcccaaacagggcgctcaaattgtgaattgagatcactcctccaag

SEQ ID NO: 69514 - DNA, 452 bp, Triticum aestivum
  Clone ID: PAT_TA_69514
acaactgaagccagtgtcgcaacatattgcacaaataacgaagatcaagtgtgcaatgtgaaagggctagaagcagcagcagcctttcatctattccgagaagaggtacgcagaacgaagtcaacttcacatctaattaagcacaacagtgacgagctagatgaacttattttcaagtgtggaggtcttccgaaagtgatagttgctcttgcggaattattggccacacagacggtgaaattgatggataatatacattctttgaatcacagatttatgcatcatctagaaacaaatccagagtatgatagcctgcggggcctatttagttggatgcagtcatacttccgtaattgcccagatttactcaagccatgtatcttttacctgtcaatctttcctcgggactataacattcggcgtaggcgactggttaggaggtggattgcaga

SEQ ID NO: 69515 - DNA, 617 bp, Triticum aestivum
  unsure (1)..(617): unsure at all n locations
  Clone ID: PAT_TA_69515
gtcccccgggctgaggaattcggacgaggctgatgtggatgttgaccaaagcctgatcntatgtagaggtaaatgctggtaaccttagaagcatcacaaactctgtacctgaggagcagaacccagagtggaactcgacttttgctttctccagacgccagttggacaatgcacagataactagaatctatgttgttgtctatgacgggttcacagatgattctgttgggttgatctcatttgacctaagtgacattcctgagcgttcccgaaatgacaaaccagtagtaccgaagtggcaccaacttattgaccaaagcggaaggacagcacaaggtgagttgatgctttcggtttggaagggcatgcagtctgatgaggcattctgtgattcatggaagtccgactggttagaggcgagcggagttgtgcgaccgcacattgtgcccaaagtgtacaacttacccaggctgtggtgtctgcgggtccatatagttgagttcaaatgtattgcactagcatgtggaagcaaaattgtagagtcatatgtcacagtggtggtaggttgtcagcgaaagacgacgaagagaatgaagaagccactagcacattatgtc

SEQ ID NO: 69516 - DNA, 591 bp, Triticum aestivum
  Clone ID: PAT_TA_69516
acgacgaggcacaccgccggcatcggcgcaacgcccaccttctcctgcgctccgcggcccaccccgagctgcaaccccatcctccccaccttctttgttgtgaggcggcccacccacccaagccgccgccccaccctcccaccttctccggcccggctcgccgtcggccagcgcgccaccttcctcggctggatccgtggtgccaccccggtgacctggacctccttccccaatttttctcactccgccaccgccaccgggtcccgatcaatcccaccaaaaccaccggatatgcatccagatccatccccattttaccaaatctggctcgatccacggtcgtgtagaagacgattgggctcgccggagctaccccacccaatccaccttcctcgacggagtgctccaccccatgacgctctggacggaggagcgcccacacctgcatcgccccttcaacctcctccagatcagggaggcactagttcaacgcaccactggtggtgtcctacgacagccgcgcttgcagtgcagtccggtggcgagcgtgcttgcagtgcagttcgacggcgagccgtttccaatgtagtc

SEQ ID NO: 69517 - DNA, 611 bp, Triticum aestivum
  Clone ID: PAT_TA_69517
gcccgcccgcccgcgccgcctctcggatccgctccttcgggctcgttcccccgtcgcctccgccgccggcggcgaggaggccgcataggagtacttgcatacttagtggatctgtgcttggtggcattgacattcaccgcaaatcttctgtagccttaatctgccttgactgcctgcagctggtgattttgttcttgaatatcctagggatatatcaaatatggtgaaaagtccacgttctccagttaccacaggaacaaaaaggtgcagagcaaagccacaaaagaagggtgaagaattcactgcacaaggaaaattggtggatgggcctaagaatgcaacaaatggtgttgaaaagggtgctggttctgctactcacaagaggccaaggagggcagcagcctgttctgattttaaggagaaatctgtacgtttatcagaaaaaacttctgttgtcaagatcaagaaaaatcgaatggaagaggaagaaatagatgcaatcaacctgacaaaattagggccagaagattcgccgccttgccgggaagttgattgatttcatcttgcatgatgcagatgggaatctgcagccattttgaaatgtctgaaat

SEQ ID NO: 69518 - DNA, 570 bp, Triticum aestivum
  Clone ID: PAT_TA_69518
gagctcagtgaagcagcggccatggagggcaaggaggaggacgtgcggctgggcgcgaaccgctactcggagcaccagcccatcggcacggcggcgcagggcggcggcgcggacgagaaggactacaaggagccgcccccggcccccttcttcgaggccggggagctcacctcctggtccttctaccgggccggcatcgccgagttcctggccaccttcctcttcctctacatctcggtgctcaccgtgatgggcgtggtgggcaacccgtccgggtccaagtgcggcaccgtcggcatccagggcatcgcctggagcttcggcggcatgatcttcgtgctcgccgagatcgtcggcacgttcgtgttggtgtacaccgtcttctccgccaccgacgccaagcgcagcgccagagactcccacgtccccatcctggcgccgcttccgatcgggttcgcggtgttcctggtgcacctggcgacgatccccatcacggggaccggcatcaacccggcgaggtccctcggcgccgccatcatctacaacaagaagcaggcgtgggacgaccac

SEQ ID NO: 69519 - DNA, 299 bp, Triticum aestivum
  Clone ID: PAT_TA_69519
acccatggtgtcaccaacaacaccgttttctgaaggaagagaacttgctaccacattatctccatttcagcatgcgcagagggctcggcattttctcaccagaccatcaagggttgccgaaggtgctgccttcgatccaatgagagatggttttccacatcttcgtgttgccagaccacctgctgaaggaaggggtcgcaatcaattacttccacggtattggccaagaataacagatcaagagctgcagcaaatttctggagattcgaattcaaccatcgttccactgtttgagaagg

SEQ ID NO: 69520 - DNA, 601 bp, Triticum aestivum
  Clone ID: PAT_TA_69520
cgagggtccaccccaccgtccgcatccatggcgcccaaggccgagaagaagccggcggcgaagaagcctgcggaggaggagcccgcggcggagaaggccgagaagactcccgccgggaagaagcccaaggccgagaagcggctgccggcggggaagtcggccgccaaggagggcggcgacaagaagggcaagaagaaggccaagaagagcgtggagacgtacaagatctacatcttcaaggtgctgaagcaggtgcaccccgacatcggcatctcctccaaggccatgtccatcatgaactccttcatcaacgacatcttcgagaagctcgccggcgaggccgccaagctggcgcggtacaacaagaagccaaccatcacgtcccgggagatccagacctccgtccgcctcgtcctccccggcgagctcgccaagcacgccgtctccgagggcaccaaggctgtcaccaagttcacctcctcttaggctgttcgtcttcctgtgtctcgtagttagctgttcgggtgtgtttgtggcccgtgttatcctgtaagaatcgcaccgcgatgtttctgtatctcgagaaatggtaatggtgcct

SEQ ID NO: 69521 - DNA, 278 bp, Triticum aestivum
  unsure (1)..(278): unsure at all n locations
  Clone ID: PAT_TA_69521
ggtccgatncgcccctcccgaatccggtcgtcgataccgcggcagaagcgtacagccactccccgcttgctccccacatcctcgtcggctcgtcgcgcgtccccaccggcactccgcctccgcttcggctcctcctgctcctctcccgccggactccggcagcggcgccttccccgatccagctcccagcctcagctgcccagccatttccaccgcgtgccgcgcaaccgtggtctcccacctgccacctgccttcgcagctgtggccactggccgtc

SEQ ID NO: 69522 - DNA, 632 bp, Triticum aestivum
  Clone ID: PAT_TA_69522
gcacccccgacgcggcggccgcggtgctgcgccggtgccgccacctccccgtgccgtctctccggttcttcctctttgccgcggggctgcccgggttctctcacctgccggattcgctcctcatcctggccaattcgctcgctggtgcgcggctcttcccgctcctgcgctcgctgctgtctgacctcccaccggctgcgctctcgcgggacctcttcccgcggttgttccgtgcttactcacgtgcgcttctcccggatgatgcgatccgggccttctcctccatggcggggttcggcttccacccaacgctggccgatttccactcgctgctattcgccttgtgccataatggccttgtaaatcatgctgaggtcttcttcaaagagtcggggacccatttcgatgtctcagccaagacctacaccatcctgatctctgggtgggctgttgtggaaaagccggaaaacgcgcaaaagttatttgatgaaatggttgagagaggtgttgagcctgatgtgcctgcctacaatgcattgattgatgccttatgccgcggaggtgatattgcacgtgcgcaggaacatctgaaagatatgcaacagagccgtgggcttgttccagatgctgct

SEQ ID NO: 69523 - DNA, 634 bp, Triticum aestivum
  Clone ID: PAT_TA_69523
ggctgcgctggctgcgactgcccttgcttcccgcaggtcagacccgaccattggggggcggaaggcaacaacatcctcggacgttgcgcccactgctcttgcgtcgcagatcattgctggaggcgaccgattcgtcccgcctgtgcgccctggttggggggattggcgtggatgctttcgtcgggatgacgcacctaccgttgagtgttgtgcggccgctccgcccggggatgagctggggggctggcagctcgtctcgaaggggcgtcgttcggcgtctcctccggcttttcatcgccctaccttcaatgcacggctgcctcctccgacatggctgaaagatagatgtttccggtgtttgtgtcggggtcatcgagcacactcttgcagagatccaatccgttgcaggaattgcctccgtttcggccacattgctcgcttttgtcgtgcgaagcaactcgtcgacgaggctatgccgcaaccatgtgttgctccaccgcctgcatccgtcatccaagctgatgtgccattacaacctgtccttgagcagcaggctgagctactttgcgttgagcttcgcgaatgccttgtgcgtgttgagagtgtcttggcaagggcggaggttgctcttggt

SEQ ID NO: 69524 - DNA, 643 bp, Triticum aestivum
  Clone ID: PAT_TA_69524
ggtaacattctgggttgaccacatagatgaagtataccaccagtctgttgaaggctctgctagttttgctggtctccacattgtcccgcacccatgtgaagtacagagcaacggggtggtggctgatgaacttaagcttgagaagacattggagaagtcagagtcttccccatcaaatctttctgatagaattgacttggcatggactggctctggcgtggagacacttctagttgcacctactgctctgatgaatggctcctcataccagaatgttatggctccaattagaattaaatcatttgattctggaatcaatttcagaaatgggttatcacctgtcgacgattcaaatgtaagcataagaagagcttattcccaaaggcctcctagggcgcttgagagaacaggcaggggtttgtccccgaccttcacaaataagctgtcacttcctggtatggttgatggtgagggtcgtttccttctatcacaaagtgtttcagatgttgttattccagtgtatgatgatgagccgtccagtatgatagcccatgccatgactgttccagaatatcgtagtttcatgttgccagtgctgaatctgcataatgaattggacagacctagtgttttgaactctctg

SEQ ID NO: 69525 - DNA, 647 bp, Triticum aestivum
  Clone ID: PAT_TA_69525
gaatctcgagcccccctctcccgtccgcccgtcccaacccgatccgatctcccccctcctcctccgtcgccatgggccgcaagttcttcgtcggcggcaactggaaatgcaatggaactgtcgaacaggtagagagcatcgtcaatactctgaacgctggacagatcgcctctacggatgttgtcgaggttgtcgttagcccgccctatgtcttccttcccaccgtcaagggtaagctgcgcccagagatccaagttgctgctcagaactgctgggtgaagaagggcggtgctttcaccggtgaagtcagtgctgaacagacaaaagcaattgctgacaagatcaaggactggaccaacgtggtcgtcgcctatgaaccagtgtgggccattggcaccggtaaagttgcatcaccggctcaggcacaggaagtccatgccaatctgagggactggctcaagaccaatgtgagccccgaggttgctgaatccacgcggatcatctatggaggatctgtaactggcgcaagctgcaaggagttggccgcgcagcccgacgtcgatggtttcctcgttggtggagcttccttgaagcctgagttcatcgacatcatcaacgccgccaccgtgaagtctgcctaagcaaga

SEQ ID NO: 69526 - DNA, 381 bp, Triticum aestivum
  unsure (1)..(381): unsure at all n locations
  Clone ID: PAT_TA_69526
caacgngcangataagctcttnctgcggatcatggaccacnacaacttntncagcgacnactnnctnggncaancaacnatcaatgngaccgacctgatcancatggncatggagagcggnncgtnnnggntgaacccggncaagnncagggnggncaccgncnacaactnnnaccacggnnagatcaananngnnatcaccttnaccgncgnanaggnngattcccatngccaggnngaagaanacngancacannngnnggctggnnncacanntntnnngagcanaangnctgangatncttnnnncgngcataannanccnngctgnatgnggncnnngntgntncnnnaacngnntnntntgcctnngnntaactg

SEQ ID NO: 69527 - DNA, 500 bp, Triticum aestivum
  Clone ID: PAT_TA_69527
ggcacgatccccgacccccgtagcttctgccgccggggccgccggcgcatatagcgcagcccctccccacttcgaccacaccttcctccccagcaccggtaggaggtacgccctcaccccaccccacccccacgccctactaaaacttccaccggacacctccctcttcctcctaccttcttcctcccaaatcctccgaacttcttcccgtcggccagtgcaccccaggccctcccctagccctcctacttcttcttttccctgtccaccaagcaccaacgcggccacctcctacctcccgcgcgcgccgcactgctctccaccccgcggccgcccagctacctccaacagcagtcgtcctgctggatccggagagatccggcgtatccgccctagatctggcgcggcccgccgccactctcattcccggtgagccgccccgccactcctcgccccgacggacgaatccacctcctcctctggtgcccgatcctgccgcc

SEQ ID NO: 69528 - DNA, 513 bp, Triticum aestivum
  Clone ID: PAT_TA_69528
gctgacttcttgcagaggagctggtatctacgaagtggaggtggagtataaccagacgtacctcctccgcatcatcaacgccgcagtcaatgttgagctcttcttcaaggtgtccggccacaacttcaccgtggtcgccatcgacgcgagctacaccgagccatacgccacagacgtcatcgtcatcgcgccgggccagacggtggacgccctcatgaccacctcggcgacgcccggcggccggtactacatggcggccaacgtgttcgagagcaagaccgtccagatccgattcaacaacggtaccgtcaccggcatcatcacgtacaagggagcggcgaacggcaccgccccctccatgccagccatgccagcccccacagacgtggtgaccgcgggcaacttctactggtctctgaggggcctcgtccggccgatcgacccgccgttgccaacgacggtggaccaccagatgctggtggagttcggggtggaccaggcgccgtgcgcgcc

SEQ ID NO: 69529 - DNA, 424 bp, Triticum aestivum
  unsure (1)..(424): unsure at all n locations
  Clone ID: PAT_TA_69529
gcactcgcaccgcgcgcctggggccccgtcggcgcccgtttagccgcacccgctaacccccccgggtcacagcctagtggggcccccagccccattttcctgtaaaaaaacaaaacaaacaaaaaatatattaataaaattaattagctaattaattaattaacttaattaattttgtttagttaagtctaattacctatttagctaattaaagtttgttagttaactgtgtctatgacaaccaggacccacatgttagctgacccagtgaacagccctgttggctactgacatcatgctgatgtcataaccctgttttcattttaattaaatctgttcatttcagaatattactaaaactttagaaaaccatttaaaataatccgtaagtcagatgaaaaacttnttatacatgaaagntgct

SEQ ID NO: 69530 - DNA, 488 bp, Triticum aestivum
  Clone ID: PAT_TA_69530
ttgtttctgctgttccaccgtacccacaaaactccacttagatgatgagaaaccagccttacgtggggtcgcaccactattccacccaaaccatggccgacggcggagacctgtcctacctcgattactatttcgagcaggacgctgtgtctgagtctgcgccggccccggtgaacccgcaggggagcaagaagaggggggcgtcagcgatggaggttgaggcgccgcaggggcagggcgtggtgaatctgtggaatgagatgggggcgagggagccggggtttaagaggcagaactcgctgtgggagtcaatggataccagtggcgggctagcgcttcatgtggtggagtcatcggtggggtttggggtgccgcatgtgcagggcatggtcaacctgggagcagagtggatgggaggggtgccgtcggtctcgggggcgcgggggtccaagaggcagcgctcgccgtcgggctcaatggagaccgct

SEQ ID NO: 69531 - DNA, 578 bp, Triticum aestivum
  Clone ID: PAT_TA_69531
tcgttcgatttgatttctcctcccttttctcttcactccccggctgccgagactagttcatgtagcaggtgaatgtagagaagcagggtgaggaaaaacatggaagagttcaatggaagtgtgatcaagaggagtagtacatttcctgagctgcggaccgtgtcttggatgatcttcctctgtcctacaccaattattcggttccacttgcttccctcgaggctgaagaactccaacaggtgtgagtccaacgatgctaatacaacatggactccaccaccagagggctcagcaatgctcattgttgacgcaacaatcttcagtcaatccaggcgcatgggtgctggatacatcctgcgtgaccatggaggaagatcaatgagcgccgctttgatcgatctttagctggagccgtgatctatgacatcaagcagctggcgatgaagtttacttctctctgattttcccatcagcatagattctgtaacaaggcggcccatattgggcggagcattatgttgatgccgtgtgggtaaatgtttttccggaggtgatccggactgtcatttgtaatgaac

SEQ ID NO: 69532 - DNA, 273 bp, Triticum aestivum
  unsure (1)..(273): unsure at all n locations
  Clone ID: PAT_TA_69532
gataggagctgccaatgtagttctgatggggaataatcttactttgtcgttcgacgatgttgaggcaaacttttctccggcagtaaaagggtcaggtgttaatggcttagtttatactgccgaacctttgaatgcctgcagtgcattgacaagcaaggcagtcgagggtccaccgtctccgtttgccctggttataagaggtggctgcacatttgatgagaaagtgaaaaacgtgcaggatgctggattcaaagctgcaatagngtatgacaa

SEQ ID NO: 69533 - DNA, 599 bp, Triticum aestivum
  Clone ID: PAT_TA_69533
aggaattcggcacgaggtggtcgactgccgtcgtcggcgatgggcgacggccgcggcggagggtcaaaccgccccgcgtggctgcagcagtacgagctggtgggtaagatcggcgagggcacctacggcctcgttttcctcgcgcgcctcaagccaacgcatccccaggctgctggccgccgcggctcccccatcgccatcaagaagttcaagcaatccaaggagggcgatggcgtctcgcctaccgccatcagagagatcatgctcctgcgcgagatcaaccacgaaaatgtcgtcaagctcgtcaacgtccacatcaaccacgccgacatgtccctctatctcgccttcgattacgccgagcatgacctctatgaggttattcggcatcacagagagaagcttaacctctccattaaccaatacacagttaaatccttgctctggcaactgctcaatggcctcaactatctccatagtaactggattatccatcgagacctcaagccttctaatatactggtcatgggagaaggagaagaacatggaattataaagattgctgattttgggctggctaggatatatcaagctccact

SEQ ID NO: 69534 - DNA, 590 bp, Triticum aestivum
  Clone ID: PAT_TA_69534
gctccggcgcagttggttgccacgacgaggggcggacccacccatcggacgaggtccgtcgccggacattccagccggtggtgagcggagggcggcaaggcgtgggagctcgcggcgacgtacaaggctgggtgagagtggcgcttgaggcggacggccaactccgacagcggacccctcagccgacgacgccaccgtctctgatctatttcaccagcaaccgctggagctgataggaagttggtcagcattagctgcttcaggcttctggccggtgtgaaaagttgctaggtcaccatcccatgtccttgaaggtgttgagctttgtgatggtatcctgaagaatcttttcctatgcttgcaaatcaatgatattgagccattttgtcaagacgaaattgtgctatacaaacaatgtgctgagaaaagggataaggaaataagggaacgacttcaggatagtgagtataaattaggtttctcgatgcccctcgaagatgcaaaggaaagagtcactcaactccaatcagaactcacactgctcgaaaggcgcatgattcttgctagtggtcttccgggtatggaaggat

SEQ ID NO: 69535 - DNA, 582 bp, Triticum aestivum
  Clone ID: PAT_TA_69535
gcagagatcgcttggggacttggatcgtttgacctatccacagggcatttcgataacctctcccatggctcactacaaagatgatatcaagtatgaagagggcttcaccctgaattcacgaggcagcaggctcttcacctgcaaatggacgcccaagaaacaacagcgcaaggctctgatcttcatctgccatggttatggaggagagtgcagcatatcgatggcagacaccgccgcgcgactggtgcacgccggctacgccgtccacgggatagaccaagagggccacggcaagtcctccggctccaagggctacatatcgagcttcggcgacatcgtcaaggactgctccgactacttcaagagcgtctgcgagaagccggagaacaagacgaagaagaggttcctctacggcttctccatgggaggcaccgtggcgcttcaggtccacaggaaggactccatgtactgggacggcgccgtcttgctcgctcccatggtcaagcttggtgatggcatgcggcctcatccggtggtggtgagcgctctcaagatgatctgcgccgtcgtgcctagctggag

SEQ ID NO: 69536 - DNA, 441 bp, Triticum aestivum
  unsure (1)..(441): unsure at all n locations
  Clone ID: PAT_TA_69536
gcgctgccagccccgctggccccgcgggaaataaagagaaggggaggaagggcagcggcgggtgcagggggatcattgcgtgcgggaagcggacggacttcggctacgacaaggacttcgaggcgcggtacgcactcgggaagctgctgggacacggccaattcggctacaccttcgctgccgtcgaccgccagtccgatgagcgcgtcgccgtcaagcgcatcgacaagaacaagatggtccttcctgttgctgttgaagatgtaaagcgagaagntaaaatactcaaggccttacatgggcatgaaaatgttgtacatttttacaatgcattcgaggatgataactacatatatattgttatggaattatgtgagggtggtgagttgcttgaccacatattagccaaaaaagatagccgttatagcgaaaaagatgctg

SEQ ID NO: 69537 - DNA, 537 bp, Triticum aestivum
  Clone ID: PAT_TA_69537
aacttaacctccccacacgctcgaaccagcggcacccatggcacccaaggcggcggagaagaagccggtggcggcggcggagaagaccccggccgggaagaagcccaaggcggagaagcgggcgccggcgtccaaggaggccggcggcgaggggaagacgaggggcaggaagaagggcagcaaggccaagaagggcgtggagacgtacaagatctacatcttcaaggtgctcaagcaggtgcaccccgacatcggcatctcctccaaggccatgtccatcatgaactccttcatcaacgacatcttcgagaagctcgccggggagtccgccaagctcgcccgctacaacaagaagcccaccatcacgtcccgggagatccagacctccgtccgcctcgtcctccccggcgagctcgccaagcacgccgtctcagagggcaccaaggccgtcaccaagttcacctcatcctaggcttcgtcgtcgtttcatgagttgatggcatcgtgtaggtagttggcagtatgatgttacaatct

SEQ ID NO: 69538 - DNA, 526 bp, Triticum aestivum
  unsure (1)..(526): unsure at all n locations
  Clone ID: PAT_TA_69538
ggaggaagcgagttcctatggccccganaggcggtcacgcggcggcgagctccggctccgaggacgaggaggaggaggcggaggcgggcttctccaggagctatttcctcgccaaggagaaggagccctcctcggccaagaagcgggcccgcgccgccgccgccggcaagctctccgacctcaacctcgtcgacgagcaggtgttgcgagcatccctcgccgagatccccccgaagcacgagaaggaggtggaggccctcacgagaagctacaaggaccagtaccgcaactggcttttcgagctgaggtgcggttttggcctgttgatgtatggcttcgggtctaagaagctgttgctggaggattttgcctccacgaccttgactgatttcactgtcatcgtggtcaatggttaccttccgtccatcaacttgaagcaggtattggcaacaatagctgaaatgttttgggaacagaaaaaacttaagcgaaaacgtcactcaggaacaaggtcccaacaatcaca

SEQ ID NO: 69539 - DNA, 599 bp, Triticum aestivum
  unsure (1)..(599): unsure at all n locations
  Clone ID: PAT_TA_69539
aggaattcggcacgagggccgtcnctgccgcttctacttctgcttctgctgcccgctcgcccacggtagcgcatcgattggaggaggacttggtgcagaggaatggagtacgagtatggatcctgcttccattgatctcagaggcggcagaggaggcgggaggaagtcatggagtagtaccagcagaggcagaagaggtggcgggaagaagtcgaggccaatcgattagaagtagaggcagcaacagaggtgggaggcggcacttgtcctgcgagcaggtgggtggcggcggccaaaggaagcgcactcatggaggaagcgcaccagcggctcggggcgcgactcctgtacatcgtattttcaacgggtggcatcacctgtgccgctcggaggagagatggaggccggcgccggcataggagatggaggccggcggtgggggctccggcgaggcggcggaggccgtacacgttatgcaggggtggtgcaggtgagcggctgctgcggaagttgacggcgtggggaagacgaccacggcatggggaagacgaagacttgctccagccacatgccactgccccgtgctcgtcttgccgctg

SEQ ID NO: 69540 - DNA, 439 bp, Triticum aestivum
  Clone ID: PAT_TA_69540
aggaattcggacgaggggtggacgcggaggctcccttccttacggaagacgcggtcgatgagccaccgcttgccggcgtctccgacttccgtggccgccccgtctacagcagcacctccggcgggtggcgctccgccctcttcgtcgccgtgatggaggtcgccagcgctttcgcctactacggcgtgtcggcgaacctgatcacctacatgacggggccactgggccactccaacgccgccgccgctgccgccgtgaatgtctggtcgggaacggccaccctgatgccgctgctgggcgccttcgtcgccgactcgtggctggggcgctaccgatccatcatcctcgccggcactctctacgtcctggggtatgccatgatcactctagcatctgtgctcacggcacaacatccatcgttgtcgggcgacacctcttc

SEQ ID NO: 69541 - DNA, 597 bp, Triticum aestivum
  Clone ID: PAT_TA_69541
ttgctacactatgctatgtactatgtagctatcatgtctccactattgagcttgcacagtggacaggataatagttaaacagcagctagcatcaaacattgctgcagctaacatatggaatgtatctactaagataatagacatgcacagttgatgcaaaagtacaatagatcgactatccattgtttcatcaggggcatttacccttgattccttctatatgttcatacatgggctaagattaaatttgtataagcctagaaggtgggacttcctaatggatgctctttgatatatgcggcatatcattgtgttattgtcctgttcacctttctcctaagcacatcattctttgtatgtgtttgcatccttatttcatcctcaaagatgagtgcatccttcatttggggtaaaattacatttgttcttcggtgacacatggtatctttatgaatgtgttaaaagttaaccctaacttgatatttctgtaccatcgcatcctacagacgtggattgacatcactgagtggggacacgacaactgctagctaaccattcattaacgatggcagaagcaacatagaagatagcgactat

SEQ ID NO: 69542 - DNA, 523 bp, Triticum aestivum
  unsure (1)..(523): unsure at all n locations
  Clone ID: PAT_TA_69542
ggctgcaggaattcggttncgaggctttctcctccctccctccccccctctcctgctcgccgccgcctttctcgctctcgatctcgatctgttgattgcctgttcatccgatcgatctgctgatccgcgtttacttctgcagttcctgttgcgatttctgctgtttgtttctttctttctttctttctttcttctaaccatggacgcaggctcccactcgatctcttccggcaagaacagcgccgccgccgtgcagcgccctccgctccaggaggccggatcccgcccctacatgccaccgctcagcaccacctcgcgcaacccgtcggccaagtgctacggggacaggttcatcccggaccggtcagcgatggacatggacatggcgcactacctgctcacggagaccaagaaggacaaggagaacgcggcggccattgcggcgtccccctccaaggaggcgtaccggaggcttcttgcggagaagctgctcaacaacaggacgcggatcctcgccttcagg

SEQ ID NO: 69543 - DNA, 517 bp, Triticum aestivum
  Clone ID: PAT_TA_69543
gctgagatcgagctgtggttgtgcggccgtgtaatcgcccgtcccttggtttgcgagatggccggggtggtggaggagctggtgaagaaggccggcgggtgcgcggtgatcgacggcggcttcgccacgcagctggaggcgctcggcgccgacatcaacgactcgctctggagcgccgcctgcctcatcaccaagccgcacctcatcaaggaggtccatatgcagtatcttgaagctggtgccgacgtcatcatctcctcgtcctaccaggcaactatcccggggttcctggccagaggactgctcctggaggaggcagaaggattactgcgaaccagcgtccagctggcacgggaggcccgagacgagttctggaagtcgacgctgcggagctccaagcccgtctacaaccgcgccctcgttgccgcctccatcgggagctacggagcctacctagcggatggatcagagtacagtgggtcgtacggagacgacgtcacgtcggagaagctcaagg

SEQ ID NO: 69544 - DNA, 587 bp, Triticum aestivum
  unsure (1)..(587): unsure at all n locations
  Clone ID: PAT_TA_69544
aggaattcggcacgagggatngtttgttcttcctctagcagagcttaccgtttttcatttctcgtgtgtagcaggttcaccgccagcttcggttgctcctgccctccaaggctctaggggccttactggtgtttgcttcctcaagtttcaggttctttggtcaaatagccagttgaagctgctctttggtgctgaacaatgtcaacaactgaaagtagaaggctgtccgacgactatgaagtcgcggatgtcctcggccgaggcggtttctccatagtcagaaggggtgtgagcaagtctgatgaaggaaagacccaggtcgcgataaagaccctccgaaggctcggccctgcgatgacggggatggggatgcagcaggggtcaaagggcgcgccgagctcgggcggcctcccgctgtggaagcaggtatccatctccgacgcactgctcactaacgagattcttgtcatgaggaggatagtggagaacgtcgcgccgcacccgaacgtcatcagcctgcacgatgtctacgaggatgcgcacggtgtgcacctcgtcctcgagctgtgctcgggcggcgagctgtt

SEQ ID NO: 69545 - DNA, 637 bp, Triticum aestivum
  unsure (1)..(637): unsure at all n locations
  Clone ID: PAT_TA_69545
gaggaattcggcacgaggagagaactgctgaagaatntgttcagaaaaaattaaacttgagggtgaaaaagcagaggcacacagggaaataaagaagttacaaagccagaggacccatcttgaacgtgatttaaggaaacatgattctgtcactgttgataaaagacatgaattgaatgtgaagccagaagaacttgctggattttttgatcaagctgtgcagttgcaggaggagtaccaaaggcttgagattcatgcttctgatatggaagatgaaattgcttctttgcaagaaactttagctaccttgactgcagagaaggaagaagcgctatctaaagtagagtttatggtgttggaacaggaagatctcgaaaacaggcttacttccgcagaatcaaagataaattccttgaacgaagagattgctgtattgaccaaaaaacttgatgaatctgagtattttggtagaaaattggaggcttctctcagttctatatcaaaggaaaaagaagacttgggaatgcaacttactgatgttcttctggaaatggaatctgaaagatcaatgtggatagccaaggagaaagcatatttagaaactaagcagcaattggatatatgcactgatgagaat

SEQ ID NO: 69546 - DNA, 660 bp, Triticum aestivum
  Clone ID: PAT_TA_69546
ttcggcacgagggttggtagcagagggcaaacccaacaacaccggcgaggtcccaggctgctcctattctggctccatgcaaaactgggaggacgtattgatggcgaagctcaaacccagccataccggcgaggtgcccgtgcctggcagctcctctgctggctccatgcccaaatgggaggaagcattgctggcggaaggcaaacccaacaacaccagcgaggtcccgggctactcctctgctggctccatgcaaaactgggaggacctgttggtggcggggctcaaacccaacaacatgagcgaggtgccgggcagcttttctgctgactccatgcaaaactgggaggacccgttgtttgcggagcgccacaccggcgaggtcccggaagtcggcatgatcgtctacgagcagggccatatgaacaacactctcaaagaccacctggtacacggtgtctggtcgccggtcacggagtcctggaggacccgcctggaggtgcttctgggtgcatcccggggcgtagagcacatgcaccgctgtgcgatcatccacggcaacgtgagctcgtccaacatcctcccggatgccaactggaagccgcgcctgtccggcttcctcggcgtacatgtcttgcaagcgggccagcttgtcgtgga

SEQ ID NO: 69547 - DNA, 416 bp, Triticum aestivum
  Clone ID: PAT_TA_69547
ggagagagagagggagcttgagtttttagttaagggaggcaatcccttggatttcaaacttggacatgtagtgtcgctgagtgtacagtccacttctgtcacagatcagatagccgaacaaaatgtgatgagtgaagcaaaaggtagtttcacatttgctgcatcacctcatggagattcgtttggtagtagtggcagaccaggaagttcatgtcgtgaagccaacacagctgataatcttatgcttttagatggagataccagcaaaataggtggggagaaacttgtgaaacgcggcactaaaagaagtaacacacctcaacccgagatgtccttttgcaatgatggccagaataacacaaaagaagctgaagattctggtctgttcccccatggggcaaagagccaagcgtatg

SEQ ID NO: 69548 - DNA, 277 bp, Triticum aestivum
  unsure (1)..(277): unsure at all n locations
  Clone ID: PAT_TA_69548
ggccgctgcgaccggnactcgcgcgctcgtctccaagacgcatctccgcgactctccagagggacggcctcgagacggtggggaaagctgctgccctggtcggcggtggctcctcggcgggcggcgccaagaaggccaaggcggatgctgaggtcgccggttcgctcctcgagaaggccgcgccgatcattgtttgccggaagcggagctccattgcgaaggctgctgctgctaacaaggagaaagtggagaaggaggacacggatgaagatgagga

SEQ ID NO: 69549 - DNA, 360 bp, Triticum aestivum
  unsure (1)..(360): unsure at all n locations
  Clone ID: PAT_TA_69549
ttcggcacgaggggttcgtgatcgaggtgttcgaggcggcggtgcggctgctgccctacgccctgccgttcgagtacgtgaaggcggcgtccatgccctacgacgaccttgtccaagcggttggcaatgggacgttcgacgcggcggtggcggacatcaccatgacggcgagccggtcgaaccacgtggacttcacgctgccttacgcagggacggccatcgccatgttggtgcgggtgcgcgaccaacggagcaacaagcgaacatgggtcttcctcaagccgctccgctacgacctctggctcgtcagcgccgcnctttttcctcttcaccggcttcgtggtctgggccatcgagcac

SEQ ID NO: 69550 - DNA, 659 bp, Triticum aestivum
  Clone ID: PAT_TA_69550
aggaattcggcacgaggaaaagtctaaaaactccttcccctttttctcccacggagaaacacataccccaaaccgctttccggcttttcttttctctcctctctcgcgcacgcgtcggatccccggcgccgggggactccgccggctcactcccacgactggcgcgggcagagtcctgctagtagcctcgagcagagctgaccacggcgtgccggaatcttccgtcgtccctcctcctgaccagctgacttccgatgggatggggaaccctcataaccaggcgcctcaaagttttttccttggcgttgttcgtctacttcgactacaaggctgttcagaagagagtccagtgggttagcactgttaagaagaatgctatatgggcaaagacgcacgagcggaatgctcgtcgtgttctcaacctgatgatagaattggaaggtttgtgggtgaagatgggccagtatttatccacaagagcagacgtgcttcctgagccctacatagaggtcctgaagcagttgcaggactcgcttcctccacgccctcttgaagaggtttgtggaaccatagaaaaagaacttgggaaacccatgcgtcaactatttgctacttttgacgttgaccctcttgcgaccgcatcaatagcacaagttcat

SEQ ID NO: 69551 - DNA, 102 bp, Triticum aestivum
  unsure (1)..(102): unsure at all n locations
  Clone ID: PAT_TA_69551
catgcagcttntncaccaagatggaggcggncgcgcttgagaagagcgaggagttggccaccaaagagctggccttctgatttcaaaatgtgcgtgctgatc

SEQ ID NO: 69552 - DNA, 380 bp, Triticum aestivum
  Clone ID: PAT_TA_69552
ggtacaactacactctactcaacagaaccaccatgggcgtcccactcgcgcttgatttcgccgccggtgaggctgcgtgtccggcaaaaggacagccgccgcctccggactatgcctgcgtcagcggcaacagttcttgtgccaacgcaacctttactcctggatatatctgcaagtgctgggaccattacgctggcaacccttacgtccctgacggctgccaagacattgacgaatgcaagcgaccccaagtgtttccctcctcaagtggcgcagtctgtagaaacaggctgggaggctacgactgtccatgcaaattcggattgaaaggagatggcaaagcgggaacctgcacacatatattcagtccagcagcaaat

SEQ ID NO: 69553 - DNA, 555 bp, Triticum aestivum
  Clone ID: PAT_TA_69553
gcaccaaccaaccgcgccgtcgatggactgtaccgtccgagcggcgcctccttcatccgccaccacctcaggagcctcgccgcgtaccagcccatcctgcccttcgaggtgttatctgctcggctgggccgtaaaccagaggatataatcaagctcgacgccaatgaaaatccatatggtccaccgccggaggtagctgcagcattaggaaatttaaaattcccttatgtgtaccctgatcctgaaagccgccacttgcgtgctgctctcgctgaagattcaggtcttgaaactgagcacatacttgttggatgtggtgctgatgagcttattgatttgattatgagatgtgtacttgaaccaggtgacaaaattgtagattgccctccaacttttaccatgtatgagtttgacgcttcagtcaatgctgcacttgtcatcaaagtcccaagacttcctgatttctccctagacattgcaaacattgtcaaaatggttgaacaggagaagccaaaatgcatatttttgacatctccaaacaaccctgatggcagt

SEQ ID NO: 69554 - DNA, 105 bp, Triticum aestivum
  unsure (1)..(105): unsure at all n locations
  Clone ID: PAT_TA_69554
ttttggatgagggcggtgaggacgcattcatgatgctctgggcgccncccgtgggcctaagtctggccatctaagccagaagacaacctccaaccctagccgcat

SEQ ID NO: 69555 - DNA, 356 bp, Triticum aestivum
  unsure (1)..(356): unsure at all n locations
  Clone ID: PAT_TA_69555
gccggtgacatcgccgtcatcgcagaaaagtcaggtgagatagagagagagatgnttctccgagctagccngctaggctcccgcggtagcagtagcgcctagcggccggcgtggagagaggatggggacggagccgacgatgctgcagcggtggtcgtcgtcgatgtgggggatgagcgggcgcgaccggctgcggctgngggaggacaaggcgtggcgggcgcacgcgggcatggccttcacgcagctcgcctacggcggctaccacgtcctcaccaagtccgtgctcaacgtcggcatgaaccagatcgtcttctgcgtctaccgcgacctcgtcgcgctcgccctcctcgccc

SEQ ID NO: 69556 - DNA, 137 bp, Triticum aestivum
  unsure (1)..(137): unsure at all n locations
  Clone ID: PAT_TA_69556
tgtggagtnacagtagtggagctgtttccagatgccacagaatatggagacatttctcaaacagcaccagaagaagaaagcagaataagttcagatgatgacttggacatgtcctcatcatcgtctgtccaatctga

SEQ ID NO: 69557 - DNA, 488 bp, Triticum aestivum
  unsure (1)..(488): unsure at all n locations
  Clone ID: PAT_TA_69557
tcctctgcatcaacctccaggtctgctactagaccatctgcaggaacactggtggtttgcccggctagcattcttaagcagtgggctagtgagatcaaagccaaggttgctgaaagttccagattatctgttttggnttatcatggaggttcaaggacttcaaaaccaactgagttggcaaaatatgatgttgttgtcaccacatatactattgtaggccaagaagtgcccaaacaagactctgatgacgatatggagccaaataacgatgaaaagtatgggttatgtccagattttgctgctcgtaaaagaaaactgtcaaaacagaccaagaaaaaggcaataaagaaaaagaaggttaacagttcagctgctgacctggatggtggtccacttgccagggtgcgatggtttagagttgtgctggatgaagctcaaacaataaaaaatcaccggactaaatctgctagagcctgttgtggactgaa

SEQ ID NO: 69558 - DNA, 486 bp, Triticum aestivum
  unsure (1)..(486): unsure at all n locations
  Clone ID: PAT_TA_69558
ccatttcctggtcaaggctcattccaagtacataattcctcacaaggtccatcacaaaaagccctttctcaatttcgtttttttctaactatttcagcaaaatttctggtttgcagatggccgtggagctgtcaatccaaaagggttacaattctataataacatcatagatgagcttgtgaaacatggtaattgttctttctatttctctatacatgtccttggcctcaggagtctccgccaaatatttgtccattcagggaatcaagtgtagttgatacaatgcttctacccctactttaatgatttggaagaggtcatgtggttgtagcatgtcacatgataaggctatgcatactcatttctcattaactcttttgtagaattagttttctctttgtatgtgtgtggtggcctggtgggcttaggacatacatagcagagcgagnggagtatatattttggtctttgagcatccaaatgcag

SEQ ID NO: 69559 - DNA, 142 bp, Triticum aestivum
  unsure (1)..(142): unsure at all n locations
  Clone ID: PAT_TA_69559
gcgttcncggcggtnntgaggctcgggctcntcggcgcgaacttcgccgacctgtgcgacatcacatgggagccgcagaacgccgcgatgacggacggaggggagcacctcacgctctccctcgtcagcaacatctcaggcg

SEQ ID NO: 69560 - DNA, 455 bp, Triticum aestivum
  unsure (1)..(455): unsure at all n locations
  Clone ID: PAT_TA_69560
gaggcggcggttgcggttaggctgtggggctggctgcggcggcatggtcattgaaggccccaagactggcttcgtcaagtcgggcggttgcggttcgggttgtggcggcggttgtggttcgggttatgacggtggctgcggcggaatggtcattgaaggctccaagactggcttcgccaagtcagctggttgcggttcgggctgtggcagcggttgcggtggtatggtcacggaaggctccaagaccagccatgccaagtctgggggctgtggttcaggatgtggggccggctgcggtggcggcatgagccgtgccaagtctgggggctgcggttcangctgtggcgccggctgcggtggcggnggntgtggcggcctggtcatggaaggatccangatgagccatgccaagtctgggggctacggttcangctgtggcgccggttgcggcggcg

SEQ ID NO: 69561 - DNA, 143 bp, Triticum aestivum
  unsure (1)..(143): unsure at all n locations
  Clone ID: PAT_TA_69561
agggagctcggggctgaccacccggacctggacgcggngaaggtctcccttggcgtcctcggngtnatctcacatgtgactctggccatgcagccgttgttcaagcggtcggtgacgctggtgaagcgcgacgactcggattt

SEQ ID NO: 69562 - DNA, 255 bp, Triticum aestivum
  unsure (1)..(255): unsure at all n locations
  Clone ID: PAT_TA_69562
gcgcgctcacccaccaccgtgaaccagaagatggccatcgccggcagcgggaggggcaaggcgaagcccgccgccagcgccaagtccgtgtcccggtcgtncaaggccggnctgcagttccccgtcggncntgtcgcccgctacctcaaagtcggcaagtacgcgcagcgcgtcggcgccggcgcccccgtctacctggccgccgttctcgagtacctcgccgcagagaccctggagctcgctgggaacgcggcg

SEQ ID NO: 69563 - DNA, 593 bp, Triticum aestivum
  unsure (1)..(593): unsure at all n locations
  Clone ID: PAT_TA_69563
gatctctttgccccgagnactagggttccggccccgccactcccgccgccggcgccgccatcccctcccgccccccgtccgattcatctcctcccctcttcaagccatacagtcctcgtcatctcctccgccaggtcccgtggcccaccttcgccgcggctctctgccacgactccggccgtggtccaccacgacttctggcggctgcgcccgtcagctcgcgcacgatctcgcacacggctgcggttccgcacgagctcgcctccgcctatctgttcgcaaggatacaccaaaaaatatctacgccccaaaatttggaagatcaccaagaattagcaggataacacgagtgctgaattctggaaatggatcgtgggcgatatgctccacagcatggatgggagaacaacagtgcacctgatgggtatggcgccattaatgagccagactttagggctggtgaatcctacattggtaggagatatgtggatgaaggctttcctagtgatcgaaggggtggatttggtccagatatacatgatagaaatatgtatccaccaccaccctctgctggcaccatgtggtctcagcct

SEQ ID NO: 69564 - DNA, 661 bp, Triticum aestivum
  Clone ID: PAT_TA_69564
ttcggcacgagggcgagtctctgccctcctgaccaatgcgcccttcatcatcaactttgatggtgaccactacgtcaacaactctaaagccttccgtgctggcatatgtttcatgctcgatcgccgtgaaggtgacaatactgcctttgtccagtttccccaacgcttcgatgatgttgatcccacagataggtactgcaatcacaatcgtgtcttctttgacgccaccttgctcggcctcaatggcatccaagggccgtcttatgttggcactggttgcatgttccgccgtgtcgcactttacggtgttgacccacctcgctggagacctgataacgtcaagatcgtggacagctccaccaagtttggcagttcagcatcattcatcagctcaatactgccagcagcagaccaagaacgctccatcatgtcgccgccggcacttgaagagcctgtcatggctgacttagctcatgtcatgacatgtgcatatgaggacgggactgaatggggcagagaagttggttgggtgtacaacattgcaactgaggatgtggtgaccggcttccggctgcaccggaatgggtggcgatccatgtactgccgcatggagccagatgcattcgccggcaccgcaccaatcaacctcactgagcggctc

SEQ ID NO: 69565 - DNA, 530 bp, Triticum aestivum
  Clone ID: PAT_TA_69565
ggctcccttacatgttgtcatggctatcttcgaacaattggcagcgtgcaaccaccatggacgatctcttcaatgctcatttcctgaccccgggccaaaaagatgtccaggacgccagcaaggctgccgatgcctctgcagccgctgccgctgctaatcctgctgcttctccttctcctactactagatggggaaagatcatcgcaagggcaaagagcaacccctgctcttgcttgctaccgagtgttgctgtggcacttgcactggcctcgctctttctagcgatgctctactctgcagtcgagggaagctccaagccggcgatgaacttaggcccgctgcagtatcccattctcacagacagcaactatgctgcatgggccatcaagatggaggcatacatgcgtgctcaaggagtttgggacgcggtggtagccaaagatcatcccaaagtttctgcgagaaacaaccaaatggcattagccgccatttaccaagctatcccggaggggacgttgttcctcctatcc

SEQ ID NO: 69566 - DNA, 565 bp, Triticum aestivum
  Clone ID: PAT_TA_69566
tgggctccctttcatgaagtgcctgctcttcacctcggcagtcgccgttgtccttgctcttttccccgttgccgctgtcggcgccggcctgaaagtcggattctatagcaagagctgcccatcggcagagaacctggtgcagcaggcggtggctgctgccttcaagaacaacaccggtgtcgccgctggcctcatccggctgcacttccacgactgttttgtcaagggttgcgacggatcagtcctgatcgactcgacagcaaacaacactgccgagaaagacgcgccccccaacaagcccagcctccgcgggttcgaggtgatcgacgcggcaaagaaggccatcgaggccaaatgccccaagacggtctcatgcgcggacatcctcgccttcgccgcccgtgacagcgtcgcgctagcaggaaacgttacctacaaggtgcccgccgggcgccgcgacggcaggatttccaccaacgcgagcgccctcagcaacctaccctcgccgctctcgacggcggccgagctggtcggcaacttcaccctcaagaacctcacggccgag

SEQ ID NO: 69567 - DNA, 482 bp, Triticum aestivum
  Clone ID: PAT_TA_69567
agcgcaagacctgcccagtttctagcttgcttgttttcctacttctttgcacatcacgatggagtacgagaacagagggcacgttgccgccaacgacgatggcttgtgcgtcgtgcagcctgcgcgggctgacccgctgaactgggggaaggcggcagaggagctgtccgggagccatctagacgcggtgaagcggatggtcgaggagtaccgcaggccggtggtgaccatggagggcgccagcctgaccatcgccatggtcgccgcggtggccgccggcagcgacaccagggtggagctcgacgagtccgcccgcggccgcgtcaaggagagcagcgactgggtcatgaacagcatggccaatggaaccgacagctacggcgtcaccactggcttcggcgccacctctcaccggaggaccaaggagggcggcgctctgcagagggagctcatcagattccttaatgccggagcgttcggca

SEQ ID NO: 69568 - DNA, 339 bp, Triticum aestivum
  Clone ID: PAT_TA_69568
catcatgaactccttcatcaacgacatctttgagaagctcgccggcgagtccgccaagctcgcgcggtacaacaagaagcccaccatcacgtcccgggagatccagacctccgtccgcctcgtcctccccggcgagctcgccaagcatgctgtctccgagggcaccaaggccgtcaccaagttcacctcatcctaggctcctcttgtgttgattcttgtgtttctttcctcttcctcgtctgatgaattctgtagctagctgtgtgtgttctgacagtgtcatcttgtaacaatggtgctgcctgaataaatagtcgtgttgctgcttgaaaaaaaaaa

SEQ ID NO: 69569 - DNA, 674 bp, Triticum aestivum
  unsure (1)..(674): unsure at all n locations
  Clone ID: PAT_TA_69569
ggnctgcaggcaattcggcacgaggagacatagcaaggnattgacagactgagnagctctttcttgattctatgggtggtggtgcatggccgttcttagttggtggagcgatttgtctggttaattccgttaacgaacgagacctcagcctgctaactagctatgcggagccatccctccgcagctagcttcttagagggactatcgccaacgccgagagccccatcgcggcgtgcaggctcgtgctctcccgcgacggcaacctcgccctccaccacctggccaccacggtctggtccaccagggccaacaccaccgccaacaccaccgtcgccgccctcctcgacaacggaaaccatgtcctccgcagcgtcggcggcacgcccaattcgtccaatgttttctggcagagctacgatcacccaaccgacactgttctccagggaagatccaccggcctgatccgccgtctcgtctccaggaagaacgccgttgaccagactcccggcatgtactcgtacgagttatctggccacaatggtgatacttccattgtttctatgttcaactcgtccaagcaatattggtccagcggggagtggggcggccaatacttcagcaacatccccgagagcgtgggtcagaaatggctctcgcttcagttcaccagcaac

SEQ ID NO: 69570 - DNA, 731 bp, Triticum aestivum
  unsure (1)..(731): unsure at all n locations
  Clone ID: PAT_TA_69570
cacgaggtagggtttactgtgctcaatggaggtcgacgccgcctaccccgccgccaccgctggcgatgagctccggcggctcctcaccgccaccctcagcgacgacaaagcgtccgtggacgcagccactgctggcctcgaccggatctccgcggccggcgacccccgcttccccatcgccctcctcgccgtcgccgcaggggatggtgatcaaggtacaagaatagctgcggcgacttacttgaagaatttcgtccggcgcaacatggaaggggggctctcgtcgtccgatctctacagggagtttcgcgaccagctcgcgcaggctctgcttcgagtggaacctgcaattcttcgagtgctgattgaagtttttggccaaatcgtggagaaagattttgtcaaggagaattcgtggcctcaacttgtgcctcagttgaagctggtgatccagagcagcgatgcaattagtccaggccagcatcctgagtggaaaaccattaatgctctcacggtactccaggccattcttcgcccctttcagtatttcttgaacccgaaagttgtaaaggagcctgttccagagcagttggagcaaatcgcagctgagattcttgtaccactgcaagtgacattccaccactttgctgacaaggttctactatcgcatgatgggaataagctggaatatgagcagctnctacttatcacatgcaagtgcatgtatttca

SEQ ID NO: 69571 - DNA, 677 bp, Triticum aestivum
  Clone ID: PAT_TA_69571
tgcaggcaattcggcacgaggccgccgcctcaagtcgcaagtggccgtggagcacgccgccgccttccccgacctcggccccgtcgccgtcaagtcctttcaggtgctacgcaagggtgcaatgtaccacctctctgattcgatggcattgaggagtgcattttccaaagtcaaagctgggtgctttctgcatgtcaagatggtagcagttgcgacggactcacactactgcagagacgaggatagagggagatcaagtagaggttgtcttggagttgatatggacaaatgtcttatggagttgcctgcaacaatatcaggcggtgtaaatcctcaaatgctggaaggtagtgaggaggctgcagcattgcttaatgttcatgcacatgatgcagtgccaaatgatgtgcagctgtcatcctcgtcacatcccaatacggaaacaaagaaggatgcagcagtaagcctggctactgatgtacaaacaaattctgtggcaaatgtcagtagattttcaaatcaaagcaatgcggccctggttggagaggagttacttgcaagaaaggaaaaccttctgcatagtgtcaaagaccatgatcttggtgttgtttctggcgacaagcaagtggggacaagggagggaacggtgggagagcttcatgcactggatgatccct

SEQ ID NO: 69572 - DNA, 344 bp, Triticum aestivum
  unsure (1)..(344): unsure at all n locations
  Clone ID: PAT_TA_69572
accttcgtccgtccccggcgccggnggagaggacggagagaagtccnttcgccgtgcctgcgcgggcacaagccacgacccgatccgcttgcgccgtacctactggataaaggcaagagttctgttggtgcattgagaagtgacactgcaattttcttagataacngatgaggcgagctcggaggcgtacgtgggtgggatgactgatgagggatgatagtgacattgatgaactttctacgggcgtgttggagaccttcatccaaccggnatgcccggacaggctcagatgctaccggtaggcaggatggacttctatggtacaaggacactgnggagcatgt

SEQ ID NO: 69573 - DNA, 138 bp, Triticum aestivum
  Clone ID: PAT_TA_69573
ggtggcggcggcggtggcggctgcttctcctgcggcgagtccggccacttctcccgcgagtgccccaacaaggcccactaggcggcacagctcttcagatctgagtgccccgtttacccttgctcctttacctacctc

SEQ ID NO: 69574 - DNA, 620 bp, Triticum aestivum
  unsure (1)..(620): unsure at all n locations
  Clone ID: PAT_TA_69574
gtttcccggtccttcttnatcattaccctcgtcgttactatgcattcttctactgcaacgcggcgagcttcatggcatccgtaaccctcatccttcttcttgtcaatccgaagctatacaggccgggcatacgttgttatgcgctctatgtgtgcatgctggtgggcacatttggccttatgggtgcctacgctgccggaagctcccggcatctcaagacctccatctatgtattgaccttggtcggcgcggtggttgccttcatagccttgctgctagtccttttccggttattccctttatttggcaaacccaaagataaagtgccagtaactcccaagagcagcggcagcaacagcaacaagagcagcggcagcaagaagaaagaaaaacttcaatacttgacgctgctagggatcctggctgcaagtatgacataccagacaggcctaaaaccaccaggcggcctatggcaagacaacaatgatgggcactctgctggcaaccccattctccgtgacatcaacaaggaccggtacaatgctttcttctacagtaactccacctccttcatggcctcaattgtggtggtcgtcatgctgcttccattgacgatgttg

SEQ ID NO: 69575 - DNA, 655 bp, Triticum aestivum
  Clone ID: PAT_TA_69575
ggcacaactttaactgtatacacacagcaaaaaggttcatcaaaaagggccatggcactcaaggaaaggaacagacgcgcgcgtgtgtgttctgattgtccatgtggattcctggtaacactgcacgctcttttactagctctacaaatttagctaggttgatgaagaaattttgcatcgtacgtctaagagcatcttcagccgcgcccccaacaaggccccccaggcgatttttcggtcgccggcgtaaaaaaaggcccagtcgcgcccccaagagcccagttttcgccggctcgggccgaaattggcgccggcggacccaacccgaacccggcgcgctgggggcgctcgggggcgccgggcgaatcgtttttggcgcgaagagccgcaggccccccttgccagcgactcgactctcttctcaccgcttcgtcgtcctcatcgcctcgttccccgcggcgaatcaatgccaaagctgcgcgcgctgccgcgccggtcagcctccattgatgcctcacgggcggcgcagtgaaggccggacgactactgccgcgacgagatggtccggcagtgccgggccctggaggagatagaagcccgcaaacgtgggcgcgaggacgagcacgacgtcgtgatcctcgacagcgatgacgac

SEQ ID NO: 69576 - DNA, 638 bp, Triticum aestivum
  Clone ID: PAT_TA_69576
ttcggcacgaggcttgcttctcctctctcgtcctttcttcgcctgagtttcctccccgttcttggactgtcctctctccatctcggtgatttgcggcggagcggatcgagagcaggagggtcgcataagcatcgtcattcaaccgacagctggagggatggatcgccggagctggccgtggcgccgcaagtccatctcggacaaggcccccgcccccaccgaaaccgaaaccgacagctccgcctcctgcccatccgaggctttaactgatgaacaggataccaccctcaagagttccccgaaatcgccggaggtcgcatccaaggaagcacaggacaacagcaatgtgaaagtcaaggtgctgagcgagaggctttcctctgtggtatcggatattcgtgccaaagatgatctcgtgaagcagcattccaaagttgccgaagaagctgttctaggatgggagaaggccgaaaacgagatggcatcgctgaaagcccagctgaatgctgcaactgtcaaaaacgcaacgctggatggcgcgctcaaggaatgcgtccggcagctccggcgcgccaaggaagagcaggaccaaaaagtccagggcgcgctggcactgcagtctcggcagtgggagtcag

SEQ ID NO: 69577 - DNA, 724 bp, Triticum aestivum
  Clone ID: PAT_TA_69577
gcggacatagccccgttcttctcgccgccggctccaccgtcaccatccagacggcttccaagatgctgtgcctgacgctcgatgagttcttggagcagcctccctgtgatgccaagaccatactgctcagcatatttgtcccggattggggttcagacaatgtcatcttcgagacctctcgtgtagctcccagaccatttggcaatgccgtctcctatgtcaattctgcattcctggcaaggacttcaggcgatggagcatcagggaagctcataattgaggatatctgccttgcattcggcgcatacggtgtcgatcataccacccgggctcggaaggttgaagagttcttgaaggggaaatccgtgagtgcgcctgtgatacttgaagctgttcgattgctgaaggatattatcatgccgtcagaaggcaccacacaccctgaatacagagtcagcttggctgtcagtttcttgttcagtttcctttcttcacttggaaacaacctgactgaaccagcaaaggctattgctcccaatgggtcatgtgcaaatggaagcatgaatggtcaggttgcgagcgaagacttgcagattcgctcaaggcaagaactggttttcaatgacgaatacaaacctgtcggcaagccgatcacgaaatccggggccgagctgcaagcttctggggaggctgtgtatgttgatgacatccctgctcccaagga

SEQ ID NO: 69578 - DNA, 353 bp, Triticum aestivum
  unsure (1)..(353): unsure at all n locations
  Clone ID: PAT_TA_69578
catgctcttctcgcattttgtggcggttgcttaggttacactttgaaaatgctttgtcatcatttgccttcaccaattcagctatacaagtactctctctgtaactgaatgtaagacatttttgcagttcaaattaaactgctttaaacgtgttacattaagttncngaggtactacttgctattataatttgtattagaatgcagaaattgaaattggtgacggngtttacaacgtaactgttataatttgtgtaagaatgcaggagtttaaaaggtaactgtttttactttctttatctgttatcatcaaaannatgtacctctctctaatatagaaccatnaatttanta

SEQ ID NO: 69579 - DNA, 347 bp, Triticum aestivum
  Clone ID: PAT_TA_69579
ggtttccggcgctggctgcagccatggcggccgagcgagagccgaacccctccgtgctcgacgccgtcgcctccctccagacctactcgaccgccctctccgccttcacttccgcatggcgcaccctctattccgatgccaccacaatcgactccaccctcgcctcctgcctcgaaggcttctcccagctcgagctgctctgctccgggatggacgggccaggcctccgcgcgtacctcgccgagcacagggacgagttccgggaccccgttcgctcactcgacgccgccctgctggtggctcccgacccggggctcctggtgctcgccgcggccgcggggttctgc

SEQ ID NO: 69580 - DNA, 819 bp, Triticum aestivum
  unsure (1)..(819): unsure at all n locations
  Clone ID: PAT_TA_69580
gncgctcccccaccacttctgctacgcatccgccatggtacgcagttgccgcgctgcgagttggtgctgtgagccaccgccactagccatgccctctaatctagcccgcacctgctactccccagctgcaatccatgggagaggggggatttccgccattgctgcagaacagaggaaagctgcacaacaccgagctccgccaggcagcaacgttgtgctgtgtgccggcagtggagctgcagtggaacacggcggtgtacggcggagctgaagtgcagcggcgtggtgctgcgcgggggtgcggtggagccaaagtgaacctgcgcggtgctgcacactagagcgacgcagctacagtgcaacatgccggagctgtgacgggccgctggagcaccgtgtgccgatgtcgcgggttgcaattaagcatggccggcgatgcgacgggtcggcggcgctgcgttggagcacctcgtgccggtatcgcggatgcagtgaagcatggccggagctgcgttggagcactttgtgtcagtgtcgcggctgcaatgaagaatggccggagctgcgccgggtcgccggcgctgcgttggagcacccgcatgccggtgtcgcggctgcaatggagcatggacggagctacggagggacctcggcgctgcgttgtagcaccgccgcgccggtgttggcggctgcaatgaagcatggccggagctgcgccgggtcgccggcgctgcgttggagcaccgcatgtnggngtcncggctgcaatgaaacatggacggacctacggagggacnnnngngctnnnntntancnccc

SEQ ID NO: 69581 - DNA, 674 bp, Triticum aestivum
  unsure (1)..(674): unsure at all n locations
  Clone ID: PAT_TA_69581
agggtcgcactcgcttcgatttcttcttctaatnctcttatattttccacaatgaactatagttctgcttctctctacgtcggagacttgcacgaagaaatttctgaagctctcttgttcgaccttttccatgaagttggtccaattatttccatccgtatctgcagagatgctatgactcgtaaatctcttggatatgcctatgtaaatttccaaaatccacaagatgccgagagagctctcgataccttgaattatgctagtgtaaagggaatcccaattcgtattatgtggtcacaaagagatccatcaattcgtaaaagtggtattggaaatatcttcatcaagaacttggataaatcaattgataacaaggctctttatgatacattctctgcctttggtaatattttgtcttgcaaagtctgtcaagcaacaaagaaaggtgagattgaaagcgttgaatctgctggttatggttttgttcactttgaaacacaagaagccgctgaaaaggctattgctaagattaacggaatgttgttaaacggtaaacaagttttcgttggaccatttgtaaagaagactgaacgtttgaagattttgagcaatgaagattcattcaccaatatttatgttaagaaccttgacgcttcagtagatgaaaaggaact

SEQ ID NO: 69582 - DNA, 553 bp, Triticum aestivum
  unsure (1)..(553): unsure at all n locations
  Clone ID: PAT_TA_69582
ggnctgcaggnaattcggcacgaggcgctcctacgcgtacggcatcgttgccgaggaagtggaggcgcgcctcctgccactgctcgccgacgccgccgacaatggcagggtggtcgacctccaggacgtgttccggcgcttcgctttcgacaccatctgcaagatctccttcggactagacccgggctgcctcgagctcgacatgcccatgtccaagctcgccgccgcgttcgacaccgcctcgcggctatccgccatgcgcggcgcggcggcgtcgcccctggtgtggagggtaaagcggctgctgaacgtcggctccgagagggagctcaggaagtccatccgcctcgtcgacgagctcgcggcggccatgataaggcagcgccggaagctgggcgtcgccgggagccacgacctcctgtcccggttcatggcctcggaggcgcacggcaccgccgtcgacgacaagtacctccgcgacatcgtggtcagcttcctcctcgccggacgcgacacggtgtcctccgcgctcaccaccatcttcatgctgctc

SEQ ID NO: 69583 - DNA, 912 bp, Triticum aestivum
  unsure (1)..(912): unsure at all n locations
  Clone ID: PAT_TA_69583
ggctctctcgtcctcctccgcaagnatgcagatcttcgtgaagacccttaccggcaagaccatcacccttgaggtcgagtcctctgacaccatcgacaacgtcaaggcaaagatccaggacaaggagggcatccccccggaccagcagcgtctcatctttgctggcaagcagctcgaggatggccgcacccttgcggactacaacatccagaaggagtccaccctccacctggtgctcaggctccgtggtggcatgcagatcttcgtcaagaccctcacgggcaagaccatcacactggaggttgagtcctcggacaccatcgataacgtgaaggccaagatccaggacaaggagggcatccctccggaccagcagcgcctgatctttgctggcaagcagcttgaggatggccgtaccctggctgactacaacatccagaaggagtccacccttcacctggtgctgaggctccgtggtggcatgcagatatttgtgaagaccctcaccggcaagaccatcaccctggaggtggagtcatctgacaccatcgacaacgtcaaggcgaagatccaggacaaggagggcatttcccccggaccagcagcgtcttatctttgctggcaaacagctcgaggatggccgcacccttgcggactacaacatccagaaagagtccaccctncacttggngctcaggctncgnggtgggatgcagattttttgtcaagaccctgaccggcaagaccatcaccctggaggtcgagtcgtctgacaccattgacaatgngaaggncaagatccaggacaggaggggnntttccccccggaccagcanggtnttattnttcnnttggaagcanctttgaggatgggccggaccctttgcggattacaacttcaaaaaggagncc

SEQ ID NO: 69584 - DNA, 196 bp, Triticum aestivum
  Clone ID: PAT_TA_69584
cattctttgttaagaggatgagaaaggtggacggataaggagggaggatctgtgctccccttttcctatttttcttcttctgttactacttagttgtactattttcccttcaccaatcttgtagctattttgatcccctcaacattgtacttgatcaactaacaatattaaaggaattttttatgcaaaaaaaaaa

SEQ ID NO: 69585 - DNA, 508 bp, Triticum aestivum
  Clone ID: PAT_TA_69585
atgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaagaaaaagaagagcaaatccaaggacgcctccgccgaccccgccgccgccgccgccgataccacgtcgctggcggacgccgaggccaagaccgatgggtacatgatcaagccccaggccctggtcccgtccctcgaca

SEQ ID NO: 69586 - DNA, 871 bp, Triticum aestivum
  unsure (1)..(871): unsure at all n locations
  Clone ID: PAT_TA_69586
caaatcccacccaatctcgtctccgatcgactcccgctcgtcgaatactcctcccccaccgcctcaagatgcagatctttgtgaagaccctcactggcaagaccatcaccctagaggttgagagctccgacaccatagacaacgtcaaggccaagatccaggacaaggagggcattcccccggaccagcagcgtctcatcttcgctggcaagcagctggaggatggccgtacccttgctgactacaacatccagaaggagtccaccctccaccttgtcctgcgtctgcgtggtggcatgcagatcttcgtgaagaccctcaccggcaagaccatcactcttgaggtggagagctccgacaccatcgacaacgtcaaggccaagatccaggacaaggagggcattcctccggaccagcagcgtctcatcttcgctggcaagcagcttgaggatggccgtaccctcgctgactacaacatccagaaggagtccacccttcacctggtgctccgcctgcgtggtggtatgcagattttngtgaagaccctcaccggcaagaccatcacccttgaggttgagagctctgacaccatcgacaacgtcaaggccaagatccaggacaaggagggcattcccccggaccagcagcggcctgatctttgctggcaagcagctggaggatgggncgnaccctngccgactacaacatncagaaggagtccaccctncancttgtcctgcgcctgcgnggnggcatgcaaatcttccgggaagaccctcaccggggaagaccatcactcttggaggttgagagctccgacccatcgacaacgtnaaggccaagatccaggacaaggagggattccccggac

SEQ ID NO: 69587 - DNA, 757 bp, Triticum aestivum
  unsure (1)..(757): unsure at all n locations
  Clone ID: PAT_TA_69587
ccccctacgatctaccgggaaacctccgatccgagcgaagcgaaggctctctcgtcctcctcctcaagatgcagatctttgtgaagaccctcaccggcaagaccatcacccttgaggtcgagtcctctgacaccattgacaatgtcaaggcaaagatccaggacaaggagggcatccccccggaccagcagcgtctcatctttgctggcaagcagctcgaggatggccgcacccttgcggactacaacatccagaaggagtccactctccacttggtgctcaggctccgtggtggtatgcagatctttgtcaagaccctcaccggcaagaccatcaccctggaggttgagtcctcagacaccattgacaatgtgaaggccaagatccaggacaaggagggcatccccccggaccagcagcgcctgatctttgccggcaagcagctcgaggatggccgnacccttgcggattacaacatccagaaggagttccaccctccacttggtgctcaggctccgtggtggcatgcagatatttgtgaagaccctcaccggcaagaccatcaccctggaggnggagtcatctgacaccatcgacaacgtgaagggcgaagattcaggacaaggagggnattnccccggaccagnagcgccttatctttgctggnaaagcagctngaggatggccgnacctttggcggactacaacattnagaaggagtcaaccctttccttggtggcttcgnnntncgnggtgg

SEQ ID NO: 69588 - DNA, 520 bp, Triticum aestivum
  unsure (1)..(520): unsure at all n locations
  Clone ID: PAT_TA_69588
cgaggagaagccgttntgaaggctgaagaagaagctgcacagcaagcagaagccngcagcgccgacagcagcggtagtgaggcctgcagcagcgagagtggcagtagcagtgatagtgacagtggtagagacaggaagcggagacgcaaggacaagaggagcaagcgcagcagcagccgcaaagacaaagaaagagacagtaagaagaagcgtagcaagcgcagcaggaaagacagtaaaaggaagcggagcaagaaggacaagagtgaggccaagctcacagctggtgaacagtatggtcgctttggcatcttgcgggagacggatgccaatgtcaagcgtagtgaatttgtgttgtgggctacagaggtcaagaaggttgatgtggagctactgggaagaccagaagagagggagctgttcagagacttcatggaggactacaacacagggacgttgccacatagaaagtactacaacctggagatctatgcacgtgagaaggctgtcaaggctgcta

SEQ ID NO: 69589 - DNA, 544 bp, Triticum aestivum
  Clone ID: PAT_TA_69589
acgaggggacgttccttgacggagcgacgtcgcgccggcgagcgtctcagccttggcgtgtctcaagaacaacagcgcggcttacacgtcatgcatgcccgacctggctcaggtgaacgccgttctcgcggcctactcgccgcatgtgtacctccaccccaacgacccgtatctcccttcgtcagttacgtggttcttcgagaacggcgcgctgctgtaccagaagggcaacccgacgccgacgcccgtgaccgccgacggctcaaacctcccgcagggaggcggcaacgacgacgcctactggctggacctgccggcggacaacggccagaaggagcgggtcaagaagggcgacctcgcgggtgccaaggcgtacgtgcaggcgaagccgatgctgggagggacggcgacggacctcgccttgttcttcttctacccgttcaacggcccggcgcgggccaaggtcggccccctcaccatccctctcggcatgatcggcgagcacgtcggcgactgggagcacctgacgctgcgcgtgagcaac

SEQ ID NO: 69590 - DNA, 439 bp, Triticum aestivum
  Clone ID: PAT_TA_69590
acctcgacgatgtcttgctgcggaggaaactgcggctgcggcagcgcctgcaagtgcggcaacggctgcggcggctgcaacatgtacccggaggccgaggccgccggcgccaccctcctcgtctccgccaccgccacccacaaggcgagctccagcggcatggagatggcggcggagaacggcggctgcggctgcacccagtgcaagtgcggcaccagctgcggctgctcctgctgcagttgctagatccatcatcggtcatgcatgcaccgcgtgcatcatatctttgatcgatccatccatctacttaccatgtaacgctacctgatcgagggtctttgtatgtatgtacgcacctgcctgcatgagcagagcaggtgccatgccatgcatgtaaacccctaaataaaatctcccgtggtttaacctaaaaaaaaaa

SEQ ID NO: 69591 - DNA, 598 bp, Triticum aestivum
  Clone ID: PAT_TA_69591
gcgcttgtgctgtcccggtgacaagcttctggtgaactacctgtcagatgtcaagtacgtgctgcagatgaggagcctggccgccggagagctgctccacggcatacccatcgacataggcagcgtcaacgggatcaccggcaggcgttgcgattccgaggtgttcgtcgagttctcgagcttcctcacgccggggatcgtctaccggtgtgatctgagctccggggttcctgagatgagcatatacagagagatcaccgtccctggcttcgaccgcacggacttcgaagcgaagcaggtgttttacccaagcaaggacgggaccaagatcccgatgttcgtcgtgtcgaggaagaacatcgacctcgacgggtcgcacccggccctgctcttcggctacggcgggttcggcatgagcatgacgccgcagttcagcgccgcccgcgtcgtcctcatgaggaacctggggttcgtgacgtgcgtcgccaacatccggggcggcggcgagtacggggaggagtggcacaaggccggctcgctcgcgaacaagcagaactgcttcgacgacttcatcgccgccggcgagttcctcgtgtcc

SEQ ID NO: 69592 - DNA, 238 bp, Triticum aestivum
  unsure (1)..(238): unsure at all n locations
  Clone ID: PAT_TA_69592
ttatcagcataactctgatgatacaagtaaccaacaagaaacttccgcccccaaggataaccgctacatgatacaggttgtgcctggaaattagagtaccgacatcattcatagtgctcaacatggncggtaagaatgggggagaatncacaatggtncttggatgtatgatcaaaggatgctcgngcactctcaacgccttaaaccccaattaccgagagaagatnctgcctaacat

SEQ ID NO: 69593 - DNA, 337 bp, Triticum aestivum
  unsure (1)..(337): unsure at all n locations
  Clone ID: PAT_TA_69593
agtacttcctgccatgcgcgccattgcaattgtagctcgccccggtggcctggtccactctgaggtcgccggcgtagccagggtacgcgcccttgccgaagactcctgggcaggcggtggcggcctccagcggggcatcactgctgccctggtagtacccgtcgccgaacgggttggtcgccgcgccggcgagcatgctcgcgaagttcatgaccatggngtccgncccgacgtcnncattgggcgccacgaggggcgcgtnctgggggccataggcggnctgatggaagggccacgcgcacgcgccggnacactgcgtctccgggttgccgaccca

SEQ ID NO: 69594 - DNA, 518 bp, Triticum aestivum
  unsure (1)..(518): unsure at all n locations
  Clone ID: PAT_TA_69594
caaattaaatgaattgaacgtgcggtcagaacggagtacatcgagnatgaatccgaccaaaaccaataaaggaagaaaaaaaaaaaccccaatccgaccggaaataaacacaacangcacaccattaattgatgtctcctcagaaaatgatgatgatttcatcagttgaacttggtgcanaccctgcggacctntccntgtgtgccggtaagcaccttgacctcccccagnttgacgagggcctgcgggaagagccaggtgaaatggtcggtgttggcgagcctgtcnaccatccaccgngtggaactgtcgttgtanaggttntggtcgaccatgancacnccacggngctgntgcagcatnttatanaagctgttgtccaccttggacncnctggaccggtcgtcgaggtacaggatggtgttgtcggacaaagccgtgttggggcacggataccttttgtntgtggccgcggtgttggggtccatgctcgggtcggttgctccggccttgccgcc

SEQ ID NO: 69595 - DNA, 683 bp, Triticum aestivum
  unsure (1)..(683): unsure at all n locations
  Clone ID: PAT_TA_69595
gcagccttttggtacatacaaagttctggcagacaagnatctatcggagcacacacttttggacagcacccccagaatgagatactgcatgcaaaattgtgatatactccctcagctactccagcgacatgtatttcggtagagggagtatcaaaggaactttcagaagggtttgtaatattggcgccagaaaactatgaagcagccttacccaagaatcgattttttttttacaaatactttagcaaccaaagaaacaagggggccagtgcaagttagaagggcaaaaaataccaaataagctggtgactgattcatggcgtggtatcaggttgatttcacagcagatgcaagtgacttcaagagagctggtgatggtcttcttaatgtgtgagtgagaaggatcatcagtgacagcagtgtcaatgccccggcttggtgagctgagcctaatgacgtaggaacatacatcaaaagtgtagatattcccaatgtaacctgaagagcagccatcccaagtgtgcttccaaccagagacttgaccgctggatgcatatctactttccttgcagccagccatagggcactcacagacaataaggtgcttgtagcaagaattcggtgattaagctgcacagtagatgtattttcaaagaaattatgaataaaaggctccatactga

SEQ ID NO: 69596 - DNA, 590 bp, Triticum aestivum
  Clone ID: PAT_TA_69596
atggccccgccgccccgagcacatatttcttatatcaaatttgatgttcttcattcaagaaataaaagaatacatactaattaccattgcttaggatttcagcacaaattgactacctaccatatgcacaaaaagggtttctataaagctagcttgtcaaaattgttacactattaattaggatcaagaataatcctaaatcttctctagggcttggagaatgtcatccctgagatcctcaaacttctcaaccccgaagctaaacctcaccaagttgtccttgatcccattcttggccttctcctcatcattctccccccagaaggacatgaccgccggctgttgcacgaggctctcacacccgccaagagaggttgcaatgaagggtatctccaatgcgtcgatgaacctcatgacgccgtgcaggtctgacgccaccttgaagctgatgacgccaccgcaaccggtcatctggctgttggcgatgtggtgccatgggctgctgatgagtccagggtagtacacccgctcaatcttgggatggttctcgagcaagcgcgccatgcgcaatgcagtgctgttttgtgttt

SEQ ID NO: 69597 - DNA, 158 bp, Triticum aestivum
  unsure (1)..(158): unsure at all n locations
  Clone ID: PAT_TA_69597
catacaacagtagcagcttgttggtccagcctcaaccacgacaaacaaagtgagaagcccagcccnaagtaacaaacaaacaaacaggggagaaaacgaaataagcccagatgctaagccgtttgaacccagcagaaacagagntacttaacaggcct

SEQ ID NO: 69598 - DNA, 652 bp, Triticum aestivum
  Clone ID: PAT_TA_69598
agctgacagtctaaattactgtagttttttgatactttgatttttacatacaatacttaactatcacacatagccttagctttttcagctgctctgtgggccgagcgatgcctgaaaggctgaagcaaatttacttgattccgcatgcatggccaattcctccgcagttgttcatcttggagcctgaaaggtgaactttgctcagtttggaactaacttgagtgacctaccacttttgcctccctatgaataatttgcgcacataaagagttggtaatgttgccttcttattttgggtgtgtgtgcatgcatctactgcctggtaagctggtcaccatttccgttcgaactgtgaggcactgacaatgttgtttggctctccgtcaattcagttccctctccattgctgttttgatctccttgttcttccatcttcttcttttcctgcccaggtctagattcattttggtcatcccgtttgttccctgcattttgttgacgttttttatagcggctcatcagcatggctactaaaagggaaccggttgtcacaattccagatatgaggaataatcccccacaactttcgaagttgatagtgcctgaaccatcaggcatgtcatcattttcatggctattttgacctatccat

SEQ ID NO: 69599 - DNA, 322 bp, Triticum aestivum
  Clone ID: PAT_TA_69599
cggcagcttcctcccttccccttcctactctctcctactccttccccttcctactccactgacgcggccttcttcttgtcttcctctccccttccccctcccgccgccgccgccttcctccgccggggctggttcagctactaaccgcggccggggggaggagaaaggccgcctcttgtccggccacctttcggctggttcagcccacgcgggagccggattgagagatggagtcggccgccggcggcgggctgggcagcatgcgagccgtgcttgccatcctccagtggtggggcttcaacgtcaccgtcatcatcatcac

SEQ ID NO: 69600 - DNA, 495 bp, Triticum aestivum
  unsure (1)..(495): unsure at all n locations
  Clone ID: PAT_TA_69600
aagggcctgtgtatacatactttcnagctctacaagtgtaacaagctctacaattgtaatatagtactgtttcacaagctcttgtcatgaacaacatactggactcgctggactcgctcgtatttctaagcaacttcaataggacaaaaacttcggtagtcagggctgggaccgtagtcagatgaacaacacgtcggactcgctggacagcgatagtcagggctgggaccaaacaaaacagcaacatggcttcctttgtcatcctgtggatgatagcgtcgacgatgatctggattgagttagcattgatgaggaagtggatgatgtccatgatgtgctttagatgcacacaaccatgagcttcttgccactgttgcatccgtccgctcgatgatgggtaccaatgcatccaagtagaacaaaaccaccaacattaacccacagcttcaagtacaagcaagtatatatcaagtggcagtgaaaacaagttgagaa

SEQ ID NO: 69601 - DNA, 203 bp, Triticum aestivum
  unsure (1)..(203): unsure at all n locations
  Clone ID: PAT_TA_69601
gtncttattatgtatgctacattttagctccacanaaanncattatctanctgacagagctactctgctactgatcatgaccaaaatccaggagtaacctcttattccatccaggcacccgaggattcatcttcccagtagaccgctccgacgacggtggcgagctatncatnctgactgccgccgatggctnggctgacaca

SEQ ID NO: 69602 - DNA, 533 bp, Triticum aestivum
  unsure (1)..(533): unsure at all n locations
  Clone ID: PAT_TA_69602
cagagccgatggatnatgcaggccggaatgtgtgcttatttacgtacgcacgtagcgtttgtagacgtataaatattcaaaccacacacacataaagacacgcacgtacgtacacatgcatgatcacattcacacgtacgtactacttggcttcggcgccaagggtaaggaacgcgaacgggcgctcgccgttgaagttgcccggggggttgtagttgcaggtgatgaagacgccccggttcccggcgcagaccacgcgcgcgcagccgatgcgggtcgacttgcgccacaccacctgcgtgtagtgcccgcacaccttgccggcgtcgcaggtgttgctgtcaagatggtagttctgcttctcgtccacccacagcttcaccgcgtcggcggccgtccacgactgcccggaaccccagaagatgttctcgccgaacggcccgccggagtgctggagcangcaatcgccggcgcgctgcgccgcccagtcctgcgcaaacctcgccacgttgttgtcccacgccacagggccg

SEQ ID NO: 69603 - DNA, 241 bp, Triticum aestivum
  unsure (1)..(241): unsure at all n locations
  Clone ID: PAT_TA_69603
aatacgncaatnccttnattncctagtagatnacaaactgtacatcaacgaagcatggaacacaaacaaatactactagcaagcaccatttgcacataaacgaagaaagaatcaatcaactggcagcaatcaagtcaaccacacggcggtcctctactctctacactcactgacgccatccatggcgaccgaacgcatgaaacggtcgtcatccatggcgaccgaacgcatgaaacggtcg

SEQ ID NO: 69604 - DNA, 573 bp, Triticum aestivum
  Clone ID: PAT_TA_69604
caggtaaggacttatgacttataagttgggacttaaaaaagtcctaggacttatgaaacaaacagggcctcaacagactaatttattcgtccaccatcatgcagagctggaggtgttatgccgggagcaccacctgccggagaatatggtagagagcccggaggaatcccttgtgttgctcttcttcacgcagcctcagcatgctcgccaccttctcgaacttgtcctgcccaaccgacgcgacccccggcgaggctaccggcccgaggtccttgtggagctccggcggcgacagcgcccactgcatcgcccagatggagaggggccgcatgtagtgcagcccgcggtagccgccctccgccgtccacgcctccggcgtctggaacgcgtacccgaagccgtctttggaccagctggcgtcgtgggcgcccttggccgtccggaacgcggcctccagcatgccctcgtggatcatggcggccgcgacggcgtaggtggtgccgggccatatctccttggactgcgtggacgacatgtcgatggtgccgtccggccgcatcccgttcaccgccc

SEQ ID NO: 69605 - DNA, 676 bp, Triticum aestivum
  unsure (1)..(676): unsure at all n locations
  Clone ID: PAT_TA_69605
ctgcgcttacattacatggtatnaaacaatataaaaatgcttcattggcagaaccattcctgttcctattatcagtgcccaactgctcacattctagattccaccagatagcacaacataaaaaatttaaacactgaaaattgaaaaggacgcacatcaatagtactgaaggccaaaattacaatcctttgtactcagcaatccttgtctccaattaaatggtttgatttgatcatgtcatgtttgttgctccatgaatctcccaagtattctaattttagcagcaaccaaatccttgctccaaatccaccaaaccaaatcacatgtaaaaacaggtggaatcagggtgcgcaatccagactaagatccaatagtaagcaaaaaaaagacaaagtaaacagaaataactatgcgagcagtagtacaggagaaacaaagcaacatacatgatgcctagatgcaaattgggcatcagcacatagttgatgtgcctacttcttaactgatgcggcatgcagatggacgactgcgtcaatgccgatggtgccaaggacaaaggtggagttgagaagcagcaagggcagtggttgtgtatctgtagaaggggaggcatgagaaaatggatggtggcgccactgattttttcccttcaagttacccatgtggctcggttctt

SEQ ID NO: 69606 - DNA, 509 bp, Triticum aestivum
  unsure (1)..(509): unsure at all n locations
  Clone ID: PAT_TA_69606
aagttctttttttgcggaagaatgaatnaagttttacatatcaggctatgacaaataacggcaagcctcgtcatataaattttctaatacaagcaagtctaaggacttattcatacaaataaatctaaacattctttggaaggaacaacgaaatggagctaaaatttaaagatgctatcttaaagtggtaactccaacgtaggcaatcttttatgctagtacaacgtaacagtcacgttgccacagctcagaacagaaggagaaatccaatcacccttgacccattcaccctttaggtcgaacatggtagttatttttcaagctccacagcaggtggtgtgcttggatggccggcaagcagctgggtctcgaggtttgtcttgatatcaccattgccacccttcagcaagacttgtttgagttcaggtagaaaattcaggccagtaagctgatacgacgcagtgtagcagtcaaccttgagcacctcaagattttgcattgagtttgat

SEQ ID NO: 69607 - DNA, 637 bp, Triticum aestivum
  unsure (1)..(637): unsure at all n locations
  Clone ID: PAT_TA_69607
tggtgccaattggtgtgtttgttnacatgcgtggagagaaaaaggcttacaacaacatgattgtgctttgcatgaaaaccgagtcttgcaacacgacgatgacacaacaggagattacaggagagagttgcaaccaacagattcaagaaactgtacaaagtagcaaaaaatagttaccacaaacgagagcagccagcagactcaatgggcatcaaatagtacagaagatattcagagcacactgtcggccttgtgcgacaatcacctatagaagttccaaacaaatgacggcatcttccgttgaagcttggggtgcctcatgatgtagagtccaaccatcgcgacgagaattttccatggtgtaaaacacatgataacggctgctgctaaagtaaagagcccaaatactgctgttgctgtaggatccctccatgttgtcaatgcagtgatcctctcgccacaagatgctacgtctcccatgaccgtctgtatcctgctggcaaggcacctcagcctatcatacctcatcattgttaaaccagagctacgagaagtagggaaggtatcaaattcctcgtcaagctcatctgggtgtacagtgtctgtcaaagatatcttgatgtcgacgtgggaagga

SEQ ID NO: 69608 - DNA, 507 bp, Triticum aestivum
  Clone ID: PAT_TA_69608
aatgtttgtataggggggtctaaccccctgcgattgttgacacacgaacaaacgaaaccaactgacaagagactcggtgggcggcaggcaatctaagaggaggtaaacttggtgacggccttggtgccctcggagacggcatgcttggcgagctcgccgggaaggacgaggcgcacggcggtctggatctcccgggaggtgacggtgggcttcttgttgtagcgcgcgagcttggccgactcgccggcgagcttctcgaagatgtcgttgatgaaggagttcatgatggacatggccttggaggagatgccgatgtcagggtggacctgcttgagcaccttgaagatgtagatcttgtaggtctcgacgctcttcttggccttcttcttcttcttgtcggcgccgccgtccttgccgggcacgcgcttctcggccttgggcttcttctccgtctccaccggcttcttctccgcggcgggcttcttctcggccttgggcgccatggcc

SEQ ID NO: 69609 - DNA, 276 bp, Triticum aestivum
  unsure (1)..(276): unsure at all n locations
  Clone ID: PAT_TA_69609
tcacgcaggcaccagnatgataatttccaattcagcaattaagcaacttgattcacgacagnacagnacgggggcagnctgcatctaaccaactatgtatgtacatggcagacaaaaacacctactaggtagcaataagggagaacatagctctnccttatgctgcacagatctggaagctncantattccttctccatcatcagcaaatcctttccttccttggaagagattttagncggaatcaatttctgctntgacggangcctgnggaact

SEQ ID NO: 69610 - DNA, 644 bp, Triticum aestivum
  unsure (1)..(644): unsure at all n locations
  Clone ID: PAT_TA_69610
caaatgagnaaacagttttaatgttggaatttattgatagcatcctgattctcaaggagaagtacacgaagctgacaaggaaaagctaggcacacttaaaactccatcaccaattgcttgaccaggaattgagcattctatcctattttcattaactaaccagtctacttagtctattgtattagtacaacttccatatgacatagactggacattttactatcaataaatagggagacaaacaacaaaatagtacaccgtagagggcttgtaggcaagccttatgaatcactcttcaatctcctagtttccatttccccctccattcattctcatcaagatcatgccctgggagttcttggccactgctcgcgcttctagtttcatcagccctcttactactgcgcatgatacttgccatttcttgtattgtgcaggaagtgctccgcctcatcctatcaatgaggacctcaagttgatccctcagaccatgccttgtcagcctatccctcaaaacctcacaagtagcctggtagggtgggatacctccatccaccatcatcacaaaatagccgcaggcctcctctaatcttcccttcttgcaagataacccatggatcatgacagcataagttgctgcgcct

SEQ ID NO: 69611 - DNA, 680 bp, Triticum aestivum
  unsure (1)..(680): unsure at all n locations
  Clone ID: PAT_TA_69611
ttgcctcatcgattaattagaagaagagagttgtccggttaattaatggaaaaccgggcgaaaaccaatacaaacaaatcacatgcggactactcccaaagtctaaacccccaagatcgcactgtcgaccctacaaacatttccaacaagcaacatacccaagcccacacgcatctacatcgcaaaggaatccccaaaaagaacacctcggatgtagagaaatgaccccccaaaaaccacgatgataagctaaaccatgaggacggcccataagaccaaggagcagccattaagcagccgcagacgccttccctaaggcatcactcttcttgtttttgcttttgagagacttctccacctttttggtcttgtctttgttaaacttttcggtcaggatgcatgcaaccactttaccagacccagggctagccgcctccaagctagagagcaagctgcaaagctcttttgcaaagagagcatcggaacaaggtgccaacgtatttgtcccaacaacatctccacctgggggcaccacgtgcccaacggtcacaggcaagcgcgtgaccgaggcatccaaacctgcacacaccataaagtctatctggctagactccaagggcggtggtgagggtgtcatgggcaccgccaacgccccctagcaagcccatctncttcggaat

SEQ ID NO: 69612 - DNA, 702 bp, Triticum aestivum
  Clone ID: PAT_TA_69612
cacggtacattcgaacaatggtcttgtccatacaatcttttgtacaatgttgagattgacatttatgttgcgccatataaacgaaaacgatgccccggcaaaaggaatttttaagcctcggcatcgcccaatggtagtagatttctggaaatgtagcacgatctcgaagcggattttcctacaacttggacgatctgacctgggcaatgagctctcttctcaagatcttgcctgcggctgactttggcacgctctccacgaaggtgacccgcctcagtcttttgtagtgcgtgacctgcttggcgataaatttctggacgtccacttcggttaatgaactggcaggtgacctcaccacataggcaataggaacttccccagcttcatcatcagggaacgggataacgacggcatccagaatctctggatgagatagaagtaatccttcaagctcagcaggtgcaatctggaaacctttgtacttaatcagctcttttagtctatcaacgacaaaaagctggccttcatcatcaaagtatccaagatcaccagtatgcaaccatccttgcttgattgtaaaatcagtggcctccacattgttgaaatacccttccattatttgtggtccccggatacagatttctcctagttgacttggtggtagatgtttttgcgtctctacgtcaaccacttttgcttcaa

SEQ ID NO: 69613 - DNA, 716 bp, Triticum aestivum
  Clone ID: PAT_TA_69613
aaatctgtggctggtagtacattatatttgtagtacatatgggcacgtcaggtgtcccgtacaatatctcacttctctatcgacgaacttgtcaagcattcaagcaatgtgtagatgttgcttcagtagcacttcggaaagtcctcgggaggcggaggaaggatattcggcgccgggccattgagcacctcgaacaccattgccagccccaacggcaggtgcgcgtccaagtgacagtgcatgaaccacatacctgggttattcgccacgaaccggatgacggtccacccaccgccgggcacgatgacggtgttgcgcacgcgcgggttcacgaggttgtacgtggcgttgaggtcgaagcgccccagcccctgcgccagcacgaagaagttgaagccgtgcaggtggatcgggtggttctccgtgccgagggcgctgctgtacgcctggctctgcagcaccacctccaccacgtcgctgtggttcaccctcttcaccgatgtcgccttccggatccccggcagcagcggcggcgagctcgggaagtcctccgtgtacacgcccgggacgccgtcgaaggacgcctgcaggagcgacgcgttcttggggaactggaacgagttcctgttcatgaacgccaccagcgcgaacccctggcacctcgtctggtccggcgcgcacggcgcctggtccaccccgaactccaccagcatctg

SEQ ID NO: 69614 - DNA, 202 bp, Triticum aestivum
  unsure (1)..(202): unsure at all n locations
  Clone ID: PAT_TA_69614
taggaacctngatcnatcctatgcttatgctaggangcangtgaaccgaccgntcattattaactaactaggagtagtnctagctaggcagcacaagcacacgacgcacacacaancataaagccaccgcgcgtgcntatacgcacggacacggntagctgaggaacgctncntngnatggaacatgtnttacatgncggac

SEQ ID NO: 69615 - DNA, 139 bp, Triticum aestivum
  unsure (1)..(139): unsure at all n locations
  Clone ID: PAT_TA_69615
acatgaanaanttnncacgccctaaattaaatttctcctaccatttaagtntnccggactngntncaatgccaannacgacaagcnatccaccatgaaaccntacttacctatgcncacacacaanatancacacacag

SEQ ID NO: 69616 - DNA, 137 bp, Triticum aestivum
  unsure (1)..(137): unsure at all n locations
  Clone ID: PAT_TA_69616
tncatcatcatatnctcaatacccatatcatctatganaccactctttttnctgagctgctgaagggtatncaagnacgtncttgcatnanggatgcccttnnngaaagnntnaatannatgnnnaatnntntnang

SEQ ID NO: 69617 - DNA, 193 bp, Triticum aestivum
  unsure (1)..(193): unsure at all n locations
  Clone ID: PAT_TA_69617
caacgccnntccatgttgtgattngatgatgcgaacancgccntnccttatnattatnctgtttgngtgttgnatnctntncaggntgntntntacttgtnccntantgtnngcaacagntgnntntntgttgtctgtttgctcancttnnttnntgnnnntttgttcancttggtttgncannttntgctgt

SEQ ID NO: 69618 - DNA, 246 bp, Triticum aestivum
  unsure (1)..(246): unsure at all n locations
  Clone ID: PAT_TA_69618
acatatatccaacacatgttaccaatagtngcaagntnnatccatacatatacatacgtnncatcaatattacacagttncatccataggnagcaagntncacaaggtcaaaacaaaaactaaatacaagcactccatnaacccaagcttccgtgatctnaancaaatctnggnntnntatcnnagaatccatcccaaaaatggtatgcaagctagcgtgacctgcntttnnctctttctcagact

SEQ ID NO: 69619 - DNA, 100 bp, Triticum aestivum
  Clone ID: PAT_TA_69619
ggatgctgaaaacatagcagatgcagcctctgaaatgctgggtacagattttatttcaacacaacattattattgtttctagaatacagagtgccaattt

SEQ ID NO: 69620 - DNA, 496 bp, Triticum aestivum
  Clone ID: PAT_TA_69620
aatttttgaagaaaaagaatatctctgcattctgcaatgcagtcacctacactacacattttttcacttgacggtgctcgccgccctctcctcgagccacgaaatcacatctgtgaagatccgctccacgtcggccggcggctcagccatgagaacgtgccacatcccggggtacagcttcaaggtcttgtccctgctcgatgcccgctcgtgtagcagcctgctcccctcaggatcggccaccacgtcgtcctccccttgcagcaccaagaacggcaaagtgacctcgtgcatgttcttctcaatgtctaagctgaccgcgaggagttcgtggcctgtctgcagcgcgaggtttcccttgtacatgtatgggttggaacgaatctctttcttgaactggggatctttgcagactttgtcgagctgatctggagcagggatgaccctccagctaggcacgacggcgcagatcatcttgagagcgctcaccaccacc

SEQ ID NO: 69621 - DNA, 403 bp, Triticum aestivum
  unsure (1)..(403): unsure at all n locations
  Clone ID: PAT_TA_69621
acttgcanctncagtgtggcaagnnttgncaaatatcagnatggcgggccaaggtgaatatcacctgccaaatgattgagaacttgtctatgcctcggcaaacagatagcgcagcgaaggagccacaaccgctacgctcagactattacccagcatggcatactgttgtctgaggcttatgtgatccggaaaacggaaactcgggggaaatgaatgcaaatttgcgacctctctgaggggtgaaaaaccgtagacccaactcattcagtgaagacatttcaaggntctcttttggaactggtttgaggtttttagatgtaaccagtacagagcctgtgcccttcacatagcaataataacttttagtaaaacagcagcaccgttttgattcanggtatacaat

SEQ ID NO: 69622 - DNA, 363 bp, Triticum aestivum
  Clone ID: PAT_TA_69622
tttagccgacgcaggtaatagaaatacagtaattaaacgacagtacagatcattgctcgctcgggaataagcagtctgaagcaacaaaagcaatgaccgtgaacaaaaacattctgctagatagcacgcctatttcttcttgatggcagccttggtaaccttggcgccggtggggtccttcttctccacgcccttgatgacaccaacagcaaccgtttgtctcatgtcacgcacagcgaagcggccaagaggagggtaggtggcgaaggtctccacaaccatgggcttggtgggaatcatcttggcgataccagcgtcaccgttcttcaggaacttgggcagcgcctccagctccttaccagc

SEQ ID NO: 69623 - DNA, 182 bp, Triticum aestivum
  unsure (1)..(182): unsure at all n locations
  Clone ID: PAT_TA_69623
gtgctggataatcgatgtacaacagaatggaatantcaactggagttattttcatggtaacactacaacntagcagataaatcctctctctttgctaagagttttgctgaatcaaataatcaaccaaaaaggtaaacagtcaggatatcaggccaattcttgcngcaatttccccagcgcat

SEQ ID NO: 69624 - DNA, 247 bp, Triticum aestivum
  Clone ID: PAT_TA_69624
ctgaaaacggcaaataattaacctgcagaaacaatcagaccactccactagctcaggatggatcgtcaactggttgatcagttgtggttaaccctcctgcagttgctcctgatctcgccgttgcggccagtgatcggcgagatgttgcccatcttcaccatgggactgcgcgaagtgctggaagaagatgtcctggttggctgcgtagagcttgacgagttccgcggtggctgggctgccggtgaag

SEQ ID NO: 69625 - DNA, 648 bp, Triticum aestivum
  unsure (1)..(648): unsure at all n locations
  Clone ID: PAT_TA_69625
ttaattaatatagncgctggcgtatgcagntatacatttgtatctacccaattcatggngtgagaaattctttgtagctcatcgatcacctggatttgtagacacgcattcataatttatcgtcccaaatttcagtatacaacaacatttttgtaagggaatggcaggagctctgcattttgtagtacatggtaggtccttgcttcagcggagcctcttgtagctgtagacgtaggtgcttgcgcaccggaggaagagcgccagctcagtggcgctgaggccggcaagcagccagtagaagtagtcgaggtgagcacggttgagattgtccgcgaaccagctgtcgccaccaccgctgctggtgatgcggtcgatcagggagatgagagcgccactgatgaagttgcccatgccgatcacgctatagtagagtgccatgcccaagctgcgtagctcactgggcatctggtcgtagaagaattcctgcatcccgacttccgcgaacacgcctgccaccccgatcaaaacatattgtggcaccaaccatgcccagcacattggcactgttgcgtcagcattgtccaccagctcatgctcgcgtgctgtctcaaggcgtcgtgtttccaccaatgccgccaccaacatcgt

SEQ ID NO: 69626 - DNA, 308 bp, Triticum aestivum
  unsure (1)..(308): unsure at all n locations
  Clone ID: PAT_TA_69626
aataatnaataatatataatgaataaacgcgagcatgttttgtctcgttccaaattttggcgaggnagcgtctagtcgtggcgcctctagttggtcttactgcacacctccctgatctcgatcttggaagggtcgctcgtggcggggagcttgctgagcttttccatgggagttgccgaactctatgtaccacgtgtcggctttatccttatagccggtcaccttggccttggcgccctcccacagcaccctgtcggatgggaaaagcgccatcttctggctgatggcgttgtagaagctgttgtcca

SEQ ID NO: 69627 - DNA, 541 bp, Triticum aestivum
  unsure (1)..(541): unsure at all n locations
  Clone ID: PAT_TA_69627
taatgtatgnacgaactgtttcaccagcttcttgcgatttcccaggnacttctattgattcctcggngcacattcataaatcacattgtgccgttacaaatgatcttcatcatccttaacgcactgcacatacacatcaacagctcatcatgtcaatctttgctgcaacagnagcatccttcaaaccggcacagnacacctcgtcaggcaccatcgaatggagcatggcggagctgctcaaccacccggacgccatggcgaaggcgagggcggagctcaacgaggtcgtcggcatggggcgcctcctggaggaagccgaccttcccagcctgccctacctccagtgcatcatcacggagaccctccggctgcacccaatcgccccgctccttgccccacacgagtcctccgccgcctgctccgtcgcaggctacgacatcccggcgggaaccatgctccttgtcaacgtccacacgatgcacagggatgcgctcgtgtggnaggagccgacaaggttctcgccagagaggtttgaaggcgc

SEQ ID NO: 69628 - DNA, 206 bp, Triticum aestivum
  unsure (1)..(206): unsure at all n locations
  Clone ID: PAT_TA_69628
cacagtaaagtcagtacatcagcagtatatacccaggtattttagcctattttctgtacacaaacaggagctgtccagttcaaggagattgctcgcattgttcgtcctatcggntatgggcgaagctgctgctgaacatgccgggagtgtgaagccttgggtgcaggcttggntacctnagggagtgccaaacacgttccagaagc

SEQ ID NO: 69629 - DNA, 572 bp, Triticum aestivum
  unsure (1)..(572): unsure at all n locations
  Clone ID: PAT_TA_69629
tgtttaacncacaaacggcgcagcatgtactgtttttgttccccttcccagtttacagcagccggtggnaggaaagacagtagttcagacaggnagactgcacgttcaactagtacaaattggatctgaatggagaagcctactgctgcccggggcgcagggnatgagaggaccacgtcctggagggcgctgtccttctgcatcgccgccttgaactcgtcgaaggtgacctcgccgtcgccgttggcgtccatggtgtcgaacatctcgtccagcttccccggctccgcgatgtccccggggaggcactcctcaggcagcgcccggagcatcgacgccagctcttccttgctgatgcagcccgaccgatcggcatcatacatctggaagcagagtcggagagcattgtcaccccgcgagttcctcaggctggagagcccgcagaggatctccctcatgtccacggttccgtcacggttgttgtcgaacaaatcaaacacacgaggagctagagggatcagggagtccatcttcattgctttcagcacctgctcgaattctgttagtgtggc

SEQ ID NO: 69630 - DNA, 292 bp, Triticum aestivum
  unsure (1)..(292): unsure at all n locations
  Clone ID: PAT_TA_69630
gtacagcatattacaatttcagnaccggnaatgctagcaaagctatcagtagcacgaggcaccagcggtccaggccggaatacgacggtctctacgcaccataaacgactctgtacaacctggcaatcttaatgtagcagactcaagcaccagtctgaaagagtcagacctgcattgaggcaattatcgccgctgccaacacgtgaaacggttccactaggttaggagcacgtagttccgaagaagaaaggttactgcgtcagtttgacgtggcttctggtcgtttaagctc

SEQ ID NO: 69631 - DNA, 265 bp, Triticum aestivum
  Clone ID: PAT_TA_69631
aaaaccaaagtgaaattaagcaatctgtatatgcacgtgaagagtcaaatcaaatcacccgctcgatttaacaggtggatacatcagtcccatatcatgaccacggccatgacagcgacgccggtgagcacaccgaggaacttgaagatgggcttgtcgaagtaatttggttgctgtgggcggtaccccctggccatgaggtggtttatggcgacgtagacgaagatccccgtggcgatccccatgggagatggcgtatgtccag

SEQ ID NO: 69632 - DNA, 226 bp, Triticum aestivum
  Clone ID: PAT_TA_69632
tttacactgttcgataggggaatctaaccccctgtaatatgttgttgacacgggaacaaattcagaccagaccatactaaacagactcggacggacggcagcaatctaagaggaggtgaacttggtgacggccttggtgccctcgggagacggcgtgcttggcgagctcgccggggaggacgagacgcacggcggtctggatctccctggaggtgatggtgggctt

SEQ ID NO: 69633 - DNA, 273 bp, Triticum aestivum
  unsure (1)..(273): unsure at all n locations
  Clone ID: PAT_TA_69633
ctttagtggtcgttttatgcgcgcgcgcgcgcacacacacacaagnaaacagtcctttatggacgtcattggatctgctcaaactcgcaatacattcataggcccattgttgcgcatgatcctgagcgccccctcggggtttaccgtgacgcttgaaattggcggccggtccttctcgtttcgtgacaggcagagcatcgctgtgtgcgccatgagattcagcgcatccaaatgtatcatgggttgcaacaccgggcggccgtccaacacagc

SEQ ID NO: 69634 - DNA, 241 bp, Triticum aestivum
  unsure (1)..(241): unsure at all n locations
  Clone ID: PAT_TA_69634
caaatggaataatcgaatagggttatntntcagncatatttgcatacataatctcttttattataattnatcgatgnaattgttattagatgangaatntatgtttgcatttgttngtnactttaggtttgaccaancataactgctttcaatgctcatccaacaacatacagganaagaatacaatcataaggctgatgctgcttatcaacatctttgtagtttgtncacaataacccag

SEQ ID NO: 69635 - DNA, 468 bp, Triticum aestivum
  unsure (1)..(468): unsure at all n locations
  Clone ID: PAT_TA_69635
tcaaantcaacagtggnattcaatatctgcattcttcctggggacaaaaaccgccttgtaatgaactttgatcatcttggcaggagtttgtgtctccactagaggcatctgttttacttgtgaactgaggggttccggcaacaccagcagagaatgggcttgcaactcgctgtctagcagctgtccgtatgcgttttgtaggaatggaaaggaaatctggaggtcttttactattcgataaaaatggatggtttcctggcttgctctccgagcatggatcataaggcagatcaacaccattatcatacggccttctgccattcatcctctgctgttgtttcttcttgtgactcgatttcgatgccaagccaccatcatatgtttcaggcaataaataagtgtatgcctcggcttcatcatcttcatatgcattttccctatgnaaatctggaacataatcncatgtag

SEQ ID NO: 69636 - DNA, 583 bp, Triticum aestivum
  unsure (1)..(583): unsure at all n locations
  Clone ID: PAT_TA_69636
gagagagatctgacattcttttttcnaagcagagcacaccattacccatacagcgaacactaattctattacgaagtaatcctacgagacagtaaccgactaagccttcttgggggacttggcggccttgggcgacttgggctccttctcggccgccttcttgggggacttggcagccttcttgggcgacttgggctccttctcggccgtcttcttggggagcagcacggggttgatgttgggcagcacgccgccgtgggcgatggtgacgccggcgagcagcctgccgagctcctggtcgttccggatggcgagcagcaggtggcgcgggatgatgcgggacttcttgttgtccttggcggcgttcccggcgagctccaggagctcggcggcgaggtactcaaggagtcaaggacggaggcgaggtagacgggagcgcccatgccgacgcgctgcgcgtactggcccttcttgaggaagcgcccgatgcggccgacggggaactgcagcccggccttgacgaaccgcgccaccgccttctttctcgggccgccgccgagcttgcgccccaccacgtacttct

SEQ ID NO: 69637 - DNA, 566 bp, Triticum aestivum
  unsure (1)..(566): unsure at all n locations
  Clone ID: PAT_TA_69637
caactctcttgatttggttactattgaatntgaatgcagagtttcagttaacaaatactgccagaggatacaaaactagaaggcccgactaatataaaccttatactgtatggaaacaagctcaatcaattgaaaatctccagagtttcaggaaagaggccccatcgaagatctaagagctcatagtagcatcaagaactacacttctgaccaccacaagaattacatataggataataccatcaagataccaagttttcatctggagaaaggtcatgtcaagaaaaacttatccaagttcacaatcccatatcagaattaaatatgggagttgactaccttttggagaattattaaacagccctgtttctttcgagttcagcttgcaaactagcttatgaagatatgccacacatatacgtccagttcaatccacgtggagcagtcagagagcactaatccatatggtgtgagctgaagatgaaggggatgattaggaacgaaatctcttgctcaggtctgtcgaggtgagcatgtccagtaaatcatatcaaccaatgttgaac

SEQ ID NO: 69638 - DNA, 438 bp, Triticum aestivum
  unsure (1)..(438): unsure at all n locations
  Clone ID: PAT_TA_69638
ttttctaaaaaaacacacatcgcggaaccaaaactgctccacatatgtactcagcgcagtcggcaggacaaacggcgcgcggtacactcggcatgcccatgcagaatcgatggctactgggtgttgcatgatccttggtgcacaggcgcgtcgttgtatggcggcggcggcgggcctccggctgcggctggcatgcccgcgtagtagccgtagccgtagccgcagtggggggtcagctttttgcgtcccttctcgatgccgacgacatgcgctgcgaagccccgcttcttcagcaccttgacgattcgcaacgggtccacggtgccgaccaccgtcagcttgtacccgccatagtcctggtcgtgctggatgtcgatggactcgagtccatccagcttggaaacagttgacagaatcttcctcttgcacttctcgncg

SEQ ID NO: 69639 - DNA, 591 bp, Triticum aestivum
  unsure (1)..(591): unsure at all n locations
  Clone ID: PAT_TA_69639
ctatatacaagtcaaagggggtaaaacataagcagttgggcaacacaagattgttttgtaaccgtgccaacaatttacacaacaggggaaggcagatacaacagaagcaaagtaagaacactcgagcggcctgatgtgccaaagaatttggaactcctactttgatttttcccacttatgcactgagctccagacataattgcttcgcaagtntggcattacgaaaatcaacgaagaacagtttgtttgtactgtattgcagagtcagatcccagacagtaatagaggctttgatcactgaagctgttccttgacccatgaagacaactgttgaaactgaactatcatcgcacatcgttagcatcttctgcggctgctaggagaacgataattgcgacccatttccattccagcttatgttgagggtatttgggtatgagatgtaacttaatccaatggtagagaaggtaaatacaagctttctgatactaatatacaacgtaattctgctgctgctgttctggaaaaataacagagtcatctctcctccgagtcttagggatcaattgagctggaattttcctgtctctt

SEQ ID NO: 69640 - DNA, 676 bp, Triticum aestivum
  Clone ID: PAT_TA_69640
tgcagtatagctgagttcccaaacagagatatattacacaacgcaccagtctagcagggagttcccatgcgttgtttttccatgttctaacttacgtggaatgtagttttcaaattaacaaatcctgaaaatagtctgaaccagaagaatacgttaactacatgcttcacatttacaaagtatcggtcttcagcctgggatgttgtttctatgtcgattgtgcttcaagcaggatgttcgaggctaaatttacgtcattatttgtcagtgcaagagcctgaattgcagaagcagggtcaaaacccatggaaacaagcgtgacaattgacgactccgttggatctggggtagttgtgtgcgtgccctgcatttgatgagtctggcgatgaggaatgttctcatcagttgttgcaattggcaatctttgataagagttgttagagaagggccatgataaccgtgaaaacaatgaagttacatactctgggacctttagcctgcggataccaaatatattcagacggtacaaaagcccagccaatataccagacagtccaggtataacagaacgtcttccagatgagaaaagaagctggagccctgccaaatatacgaatgacttgtcacataattgcagtccaaatatgcgaaactttgttgagatgggaatgtcaaa

SEQ ID NO: 69641 - DNA, 584 bp, Triticum aestivum
  unsure (1)..(584): unsure at all n locations
  Clone ID: PAT_TA_69641
ctgaacttgaaattactcgggcgggcgaattcacagttttacagaagcaaattgactgggtcggtcatcccagatcgagatcatccacgcttttacagctccacgcacgcaccacaaactgactgatgacgggaaggaagggggagacgaagcatcacacggacggatggacggcgactccgatcctaagctcgctgcttagtagtcggtggtggggagctgctcgtgggtgcgggagatgaagagcagctcgtagatgacgccggcgaggccgccgccgatgagggggccgacccagtacacccactggtacccccactcccagctgacgagggcggggccgaaggagacggcggggttcatggacgcgccggagaaggcgccgccgaccaggatgttggcgcccacgatgaagccgatggcgatgggcgcgatggtgcccaggctgcccttcttggggtccacggcggtggcgtacaccgtgtacaccagcccgaaggtcatgacgatctccagcaccaccgncttccacgcgccgatgccggtcagcccgaaggtgccggtggggagcccgccggtggaga

SEQ ID NO: 69642 - DNA, 148 bp, Triticum aestivum
  unsure (1)..(148): unsure at all n locations
  Clone ID: PAT_TA_69642
acagtgncaactttgngcctgagcatattgncatccgtnacgatcctgcatgatccgngcgactcggaatgcatgctgatgccaagatagtggatatggncttgcacgctatttccactcacggacctgntgcaagtggggtnttnac

SEQ ID NO: 69643 - DNA, 331 bp, Triticum aestivum
  unsure (1)..(331): unsure at all n locations
  Clone ID: PAT_TA_69643
taagcaacaaaacactcgtcttaatgcattacgaagatccaacatactaagagaacatttcaacttttgtgcttctgcccaaccaaaataccagcatccaccacagcccaatcacatgaacaggttcggcctcgtcgccttgtaggnggnnttcagcttcctggttggtggcctgaccttttggtagccggttctgctctggtaacgcagccaaatgccatagttcttgatcgtggntgggttcttctcaaagatctcgttgatggcgagcatctggccgntgctcttcttcaccttcttcagctttctcaggaaataccagaacttgctc

SEQ ID NO: 69644 - DNA, 469 bp, Triticum aestivum
  Clone ID: PAT_TA_69644
ccggcaccggcaccctgcacgtaggcgtattgcggtatagctacaccgtcgtcgacccgtcctttcggcaggtcgagagatgtgcgatgttttggcagttttctcagccagtatgtggttacagtaagcaatccaaaactgtgtgctgtcgcatcattctctgcgggaatgacccatgaattctgtacaagcaaatgaaatattctcctctctacgcaaacgaacgagacgatcgtcttagcggcaccggctaggcggctagcgtgcccctgcggtgcggcgcagcgcgtgggtgtggttgaggatggagttgatgcgctccagcttgagctcctcccggaactgccggatgaactgctccgcccgcgcgtccacctccgccttcccttcgacgtcctccgttccccgcccgcatccgtaggctcctcgccccttggccttctttggcaccgtggccaccgtgtcggcg

SEQ ID NO: 69645 - DNA, 398 bp, Triticum aestivum
  Clone ID: PAT_TA_69645
cgaaccctagacactctaatctggcggtgatggtggcctagcctccgaatccgtagagggtgcgtccctggcgcttgagggcgtagacgacgtccatggcggtgacggtcttgcggcgggcgtgctcggtgtaggtgacggcgtcgcggatgacgttctcgaggaagatcttgagcacgccgcgggtctcctcgtagatgagccccgagatgcgcttcacgccgccccgacgcgccagacgacggatcgccggcttggtgatgccctggatgttgtcgcggaggaccttccggtggcgcttggcgccgcccttgccgagccccttgcctcccttgccgcgccccgacatctttctcgcttctcctttcttctcctcggtgaggtcgacctgtctttgc

SEQ ID NO: 69646 - DNA, 668 bp, Triticum aestivum
  Clone ID: PAT_TA_69646
taaatgaaaaagaggaatagacttgatgtacttccgttttctattgaggaccttgttgaccctctgcgagaaaatgcacattttccagaatcagataaagagaggaacgactcaatcgtccatttcctcttacacaatctcatcacaaagcatacaattggtattacaacctcaggtatacatccagcaaaaggaatcagtaattgtggcgccggcatctgacgaaaacccttctatgtcatcctccaaacagcccggacaaacggttggagatcaatgaaaaataaatttcaggcccttagttcgcagcagcgagaaattcaattggttgaatttgcactatgaggcctccgtgcaaatgttgcagctacgagtaacgggaaagcgatagtagcatcacagtgaacctttacaggctttgctgaacctttgatctttccccatgaaactgcttcatctggatgtgctcctgagtcgcttccatcaaactcttgagctgtgttgatatagactgcataatctgcaccattgcgaaacatatttgcattgcatatgtggtgctttggaaggcctccaccaagaattatggcccctgtcttccttgggcttgcatgaatggcttcaccatttatcagccttatatcttgtacaatgtcgataataagacc

SEQ ID NO: 69647 - DNA, 554 bp, Triticum aestivum
  Clone ID: PAT_TA_69647
tgagacatgtagcgtggtagcatatatatatatatgatctcagtttacataatctatcaaacaaatacatgatcccagtcctcgtgatcacaaaagaagtcaagagttagtgtgctaaagaaaactttctaacccactttaattgccaaagagaaccattagtcattgaattgtcatccatacatggtcaacttatttcagttcggccacccctcaaatgttttgtatagacgaagacttcacataattatagtgcaaaataaacacctaccgaatatatggatcattgcatagcctctcatcaatacatttgtaaagaaactctagcaactcattaaggaaacacaaatactatcaacttgttttaaaatgcaaaaatggatttcaagttccttcttctttcttgtgatgaaattcacccaattcaagagatggcgaactaaactcaacaatctcatgactcaagttagcaatccttttatactttttttgtgagaggcgtgttttaaatagttggcacccatcttcttggatgcaatattaccatctaacct

SEQ ID NO: 69648 - DNA, 201 bp, Triticum aestivum
  unsure (1)..(201): unsure at all n locations
  Clone ID: PAT_TA_69648
caaattngttnttatagtacatgaacaacatgtgtgagtatttnctgntatgcccccaaaaaagaacattngatacatagctntggacatatactcatgtangaaacatgtnnaacanggctggnncaaaggactacaagggcttcaggccaagctatttacttagatttctcttgctctcccttggtgccactngtttnc

SEQ ID NO: 69649 - DNA, 124 bp, Triticum aestivum
  unsure (1)..(124): unsure at all n locations
  Clone ID: PAT_TA_69649
gctacacatntgncaacgcatgaccaggagtcgaagaantgcccggngcagagcttntgnccagnttcatnattcttgactntctncacacatctctcatagtcatacaatgattttacacatt

SEQ ID NO: 69650 - DNA, 644 bp, Triticum aestivum
  Clone ID: PAT_TA_69650
ggaaggagcaacgatgataatgtactgctactaagaaaatgaaacatttccactcatcatgtgaccatctaacatcggtggatccatattgaagtttgcccggcttcatttcacgggtacatgcatctcacaggacactaactcatactactggcaattaataagtctaccttcagtccaccatcttcaccagaacttgttggaccaagcactcccttcagcatagaaagttttcaaatccaccaaaagatacgaagaatcgctgtgggtgaccgaacagcttcggcggtggaaaagggcaagggcaaaatttcatcacaagggcagcacttcgctcaaaggttgaagatctgagctggccagctgcgcttccggccatctgagctgattcccgtggtttcgattgatatgtctatgctgcggtgctcagaggccctcacaatgctgatgcgggatctgatcgtcccagctgggcactccgctgagccaactgatgcagatgagccaacgactgatttctcatttgtaatcgctatgggctcttcaaaggtgaagattgtttgcgaccagtgagttggtgtggagaaaggagaggtggacagaaccacaggcttgtccttgcagaatctgtcggtgaagccagt

SEQ ID NO: 69651 - DNA, 586 bp, Triticum aestivum
  Clone ID: PAT_TA_69651
acttgttgtaccctgttatataagttaaaacgatcacaacgacaacaaatttatacagtcactagtcagagacactggctctacgaccaagaagcagcagcagcatgtacagccggttatcatccatccgacagagacacggaaaacaaaagttagctgtcgcacgcaacaagcacctcctccttcctcctccaaaaccagctaccagctaccataccaccatcatcaatctatctctcttatctagactcactgcagccgaccaacctcagaaaggaggggtggcaatgcattgccaaatcatcttacttatctaccacctaacaacaaaataccaaaagtagctttgttcaggaccactgtcagcaacgacttccattccgttccatcggtccaacacctgtacagtaactttggatttcagagagaagggatgctccatgaatacgaccagccagtgtcagagatttcgtcaccctgaccctggattcgggggagcatacatgctgcctggagcaactggtctctgctgatgatgcgggggaggcaggtgtggcctagacagctgttggtggtgccatgagcc

SEQ ID NO: 69652 - DNA, 710 bp, Triticum aestivum
  unsure (1)..(710): unsure at all n locations
  Clone ID: PAT_TA_69652
attatcgcacacnaagtgccngataaataacatnaaattgttgcttacaaactgaattattgagcaaattgtcgcacaccaagtgccggataaataacatcaaattgttgcttacaaaccgaattattgaggaaatgggaaaacgtttgatttaagacgaatgtctatgcgaaagccatatctactgtgtagatatattcctggtgctcgtcctggacctctttctttttttggtagaaactccatcttcagaaattgcctttgtctggtctggctgctggttttttcggagtgaatttctgtcactgttgagtatgtcatgtgcaagttgtctcctatacatatctatatctttctttgaaaatgttttggatagtttggatcccgtccaaagcattatgtacttgagaaggtagagtccacaagagctcccgtctttctgggttggcagccctttgattgtcttcttgttccacgaggccacgttgaagtctggccagtttgttgggtttggaagttgtttaattctttcttcagcctcctggaaccacaccgttatcgcttccaactgaagagtgtttgttgggtcgaagaacatcgaggcaggacacggatagcggggtcgaagaacatcgaggcaggacctctggtggcggggtcgaaaaacgtcgatctggacggcgaacggcggtggcgcgcggtgggttcta

SEQ ID NO: 69653 - DNA, 236 bp, Triticum aestivum
  unsure (1)..(236): unsure at all n locations
  Clone ID: PAT_TA_69653
acttgtacagcccnatatatgattcacaccaaagcctnaaaaagaagaagaagaaaaacccacaccacaaaggaaaaggaaactcccagcatggggaggaacttacaaaccccagcttgtgggaaaagtggcgccacctgagcttttgaagtggaaccgaacaaacccagagcgcatggcctggatggcgatttttnncaaggcgatcaaaatagangnnnngacaaacagattnt

SEQ ID NO: 69654 - DNA, 356 bp, Triticum aestivum
  Clone ID: PAT_TA_69654
tgtgcttctatgtttccggcataaagaaaatatttcccgccttagttgtttgcatgttgtacaacagctagctctgcgttcagggtcaaaagaattaatatgtaggcaaaattaaatggcggctgctacaaatcatcctattgatttgttatagaaataagacgcccaaccagcagatcgatctaatggatggtggccgtgcgatcagcaaacggaatcatcatcttcttccggtgttcttccatccaccaagtactctccatccaccacacacatcacctagcatgtgcacccttcggcgacctcagagcactggtgccatcggcgaccaccagatcacaacaccggggagccat

SEQ ID NO: 69655 - DNA, 472 bp, Triticum aestivum
  unsure (1)..(472): unsure at all n locations
  Clone ID: PAT_TA_69655
acatataccctcgttcgcatgcatgtgtgcatggaacctagtgtttagcagaaaggtaaatccccatacaacttattaatcacgttggattgcagccatacatatgtaaggcatgtatatacgtaaatgtatgcttcgaaggtagaaaacaaaacttgtgccctacacatgttggggcgtgttgtttggtggcgttgcagatgtagcaaggatgacgttgcgcctgccacgctcggagcgggagttctcggcgaatttttggcctgcgatatggaggccgtttctcttctcctcctccgaccactcggagccgtagtactcctcctccgtggcgtctgcgctggccggaaagaacatggagccccactgtgggaagtgcacnanggtgacaggaagagtgcatgccatgatcatgattnccatgtactcaanacccctaccantggagtattganatnaanngaaaaacana

SEQ ID NO: 69656 - DNA, 654 bp, Triticum aestivum
  Clone ID: PAT_TA_69656
atggagtataatgttgtccatattttttgaaagtagtttttctccatcatctcttccatttcctgaatttagaatgcgtaaatacaagaacaaaaacatcccattgtcatcttggtaaaattcacaacacaccattcccatgcgcaacattaacttttatcttgcatcgttacaataaaaactaagaaacagacggaacaacacaaaaaaagcaggacgatcgatcttcagttgttcggcatgcttgttttctttgtcaaatcaagggcctaaaaagccactagctcgtcgcgatttcagcgaattcaccatagtcgggtccattattgatctcaagaccagcgctccctttgtttatgaccctgcagctgagccttatctctccttgcgttcctgtcagcacctcaatgtcccccatcttcaccatggacttgacaaacttgctcttccatctcttctcgctcttgacaaactcgtcgaccgatgccttcagagtcgagttcgtgagcaacgcctggtccgacgtgaacatgcccaggttgttcgtcagacccacgtaatacttgttgtcgagcaccgtcggggtgatgatgtccatatcagtcgtcgtggttgggaagaactggctgctgttggcagggcatatgcttttca

SEQ ID NO: 69657 - DNA, 250 bp, Triticum aestivum
  Clone ID: PAT_TA_69657
gccgtaggcacaagtacggtgggcagtactgtgtattttattccgagaagagcatggacgatgcccgtacacgacgtacgtacgcgaggtcggcgatgaaggccttgtcattctgtcatacgccgctggctcggaagagcctcatgaacccaaaggtgacggccatggcggccagccctcccaccaccacgcgcgcacgacctcgcgactggggcccgcccaagcacggctcccacgcagccgaacgcgc

SEQ ID NO: 69658 - DNA, 417 bp, Triticum aestivum
  unsure (1)..(417): unsure at all n locations
  Clone ID: PAT_TA_69658
acatagtantgacaatgcctagngttaaacctatcaactttggcatgtacatacttgaatttgtaccattgttcctgccatcttctgttacatagttataactgaattactatgcaatcattgttactgaaacaatacataagaacatgcagtctgcatgtcaagttttctctaagaataaatttaggtacacgtcacaataaaaccagagtagtgattgttcaacagaaaactggtagttcactttgtttcctatatccagttgcctctagtaagatttttactgcaagcaaaaaaacatggaacaaatctgaattatgattcataattaaaatctgcagatttggaaataaaaaaacagggaccattataacagaacatggaaactaagtagttcttatttcgaacaacttanat

SEQ ID NO: 69659 - DNA, 164 bp, Triticum aestivum
  unsure (1)..(164): unsure at all n locations
  Clone ID: PAT_TA_69659
gcaanatggtgagtncatctcaaggagcttgggttatgggtagcgagggatgttacaactaggacggcttnntcttgngcacggnttttncaatncgttngaaaacttgatctcctttcttcattnccctctggngtaaaaatactatgagatanaacacaggc

SEQ ID NO: 69660 - DNA, 230 bp, Triticum aestivum
  unsure (1)..(230): unsure at all n locations
  Clone ID: PAT_TA_69660
cagngccnnnccnatgaacggaccaacccanaanatncannggncgnnccacgcctgcttnttgntgnanatgatggnngnnccnancgacctnnncnnnttgatgcccntnccgnngatggngatngnnnncaggngcaccangaacaccnnnaacccaatnnnaancnnnnccaaaatgnnnacnnnnnantntntgncnctgnnctngnnnnnnnnnnnnnanaana

SEQ ID NO: 69661 - DNA, 765 bp, Triticum aestivum
  unsure (1)..(765): unsure at all n locations
  Clone ID: PAT_TA_69661
tcggtttnctccgcaagttacagttttgtccaaaaaagtatgctgctatgccattaattcaatggactacaactcacaagatgcctatactgctatgctgcaactggccatcacactgaaatacatatgaacaatcaactcaatatctgaaatatacacaggatgctcgcagtgagcctagctcacttgggttcctttcctcatgaactcagtttcgaatttccacatcggcagttcctccaacacgtcttgtaatgcttgtctccccagaggtaaagttgacacagaatcacatgacatcatgattgttacgggcctgcgccaccaacctgggtatctgctgccactttggggtcttctttgggcttttcttttctatggcagaagactgacagtgctgcgtagagcccaatgtaggccaacacaggaacgatgaggaccatgacattcctggatgtttcccacttcctagtactgcctgctgcgtatgccaccaggaggcccatcatgtccagcaagatggccgtatgcattggccagagtggccatgtgccttcgtcggtcggctccgggtcattatcggtcggcttctggtctttctgggccgactctgtgtctttcttggacaacattgtttctttctcgggcgacttcgggtctttcacgggcaacatcatcgactgaagcagcatgaccgactttggttctttcttgggcgacttttgtgtctttctcgggcaacatcgtcaatggaagcagcatgac

SEQ ID NO: 69662 - DNA, 631 bp, Triticum aestivum
  unsure (1)..(631): unsure at all n locations
  Clone ID: PAT_TA_69662
cacttttgcttcttctatatacactcaagttacaacaatncactagtctatgggcgtacacatacagtccttatcaaaaatcaaacttcaggaggcacatcaaaagataataaacatatggcatgccccgaaaacgtcaaaatacgctagcacagatcaaactgtcttggcatggtgttctcgagatgaagaaaaaggtgcattttgactctactgatatattctaccattttcttcatgcaagaacacgagcacaagacctgcgcataacatgtgaaacatcagccgccaaattgctctgaggaaagctactcactccagctatcctcgtcatcgtcatcagcaaccgcctggtgaatcgcgttggccctctcgagaatggccgccacttgcaagtttgttcttggaccacccatcacatttggtctctttgtaacaaccggtttcaagttgaaagtcttgttctttatctgatccagcactgtgttcttctcatctgaaagcttacttgatggctgaaccaaagttggagcctttctcagcatgcttctatcatgagaaataacttgaagcagaggatatctaggtagttctggcactgaatgagcaggcaactttactagttctctcc

SEQ ID NO: 69663 - DNA, 657 bp, Triticum aestivum
  Clone ID: PAT_TA_69663
acatatatagatggacataaggttttccctttaggtggatacaggcacaagtgcaagcacaaacagaatacatgcataatcaaatcttggacatttggcgccctcatggttacctgtcagctctttctgccccgcgcagacttgagaagctcaggcaacaccatagggcagcttgcctctagatgcttatatccatcagtcgccaacacagcatcaagaattgcaggagtgctaacgatgaagtcgacgcatttcaccttgagctgcaggcagttgtgctgctctgctaatgccagagtagttgctgccgtgtcgatactgatgccatcagagagcttgccttcgcagatctccttgagcctgtccagtccatacttgtcagcagctgcaagtaaatgctgggccaacatcgtgaccgcctcatgctgcagatcgaattccagcacagagtcagtgtagatgaagtaaagcaacgacttgaataccaccgcatcaatgtccttgatctcgacgcgctgagagctcgtctccttcatgtggccaaagaactcggccatcagtacaggggaccttgcagcaagaatgaccttgtgtgcagcgaaggacttgccggacacgagaaatgtgacatccgcttccaacccactgttcaggagc

SEQ ID NO: 69664 - DNA, 125 bp, Triticum aestivum
  unsure (1)..(125): unsure at all n locations
  Clone ID: PAT_TA_69664
ttttgactagtactccctaccgttgccaaattactcgtcgtggttttagttcaaattactcgtcgtggaactaaaaccacaacgagtacaaatttgaactaaaaccacgacgagtaatntggaag

SEQ ID NO: 69665 - DNA, 523 bp, Triticum aestivum
  unsure (1)..(523): unsure at all n locations
  Clone ID: PAT_TA_69665
agatgacactgtngaacacacacagctagctcagaattatcagacgaggaagaggaaagaaacacaagaatcaacacaagaggagcctaggatgaggtgaacttggtgacggccttggtgccctcggagacagcatgcttggcgagctcgccggggaggacgaggcggacggaggtctggatctcccgggacgtgatggtgggcttcttgttgtaccgcgcgagcttggcggactcgccggcgagcttctcaaagatgtcgttgatgaaggagttcatgatggacatggccttggaggagatgccgatgtcggggtgcacctgcttgagcaccttgaagatgtagatcttgtacgtctccacgctcttcttggccttcttcttccccttcttgtccccgccctccttggacgccggcaccttcttctccgccttgggcttcttccccgcgggggtcttctccaccggcttcttctcggctgccttgggggccatggatgctgcggcggctgcttcgaaggcgc

SEQ ID NO: 69666 - DNA, 652 bp, Triticum aestivum
  Clone ID: PAT_TA_69666
catttgctttattattaggtaagattggaagataagtccaaatacaacatcaattttggcttctattaaggccctgctcaaagtaccaccactccacaactccactcccggagctgctcgagttttacagttgaaaatcgtggagcacctatttcctggctctgtagctcccggaagttggcggagctggtggaattccaaacagggtctaaaggccatcaccttcagtgtctacgggagtagttattggccggttttgcttgaccttgagcagagcagcagcacccaagcgccattcctgcaggcccttgtgcacgttctcgctgtcattggcgaggtcacggaaggtctccacgtcgtccatcatgctcacgacgctggacaccatgagctccttcttccactcctcgagcggtgcgatgtcacaatacttctccccgaactcgaatattgcgtgaggttcaatgccaccgatgttgtgcgtgagcttccttggcacaccggcggcttccctggcgcagaggttctcctccacgcaccgcagcatctcctcctccggcggcagctcgcggcggccggacagcacctgcgcgacccaccgcgcctgcacctccaagaaccatgggatcgggatcttcctcggcacgcccac

SEQ ID NO: 69667 - DNA, 111 bp, Triticum aestivum
  unsure (1)..(111): unsure at all n locations
  Clone ID: PAT_TA_69667
ttgactccaattggaataaaatagctgcagcggcatgcaggtctcaagttaagggccataancaagtactctgactccnattccaagcccgngtcattcactaaaatattt

SEQ ID NO: 69668 - DNA, 280 bp, Triticum aestivum
  unsure (1)..(280): unsure at all n locations
  Clone ID: PAT_TA_69668
atgttttnttncatcgataggaggagctgtggacaaggaaataaacactcgcaaaggaccttaagtttttcgtttgcatggaccnaactaccaccatatcggaactcttttgcctcaagatacagacaaacctcggttcgcacagctatacatctatgataccgaaaatgaggtggaaaacaggataagtgcgtcaagatgcaatgataataaaccaacagtggacccctaacatcgtcaaagaactggaaaataatgctcgacgacaacaacatcctcg

SEQ ID NO: 69669 - DNA, 104 bp, Triticum aestivum
  Clone ID: PAT_TA_69669
atttcgttcagaatgggcattttcttcaatgaatttgattccatcccccaaatgcaccttcaattgctcatccattgaaaagccaaaatatttcgtcgcgacct

SEQ ID NO: 69670 - DNA, 214 bp, Triticum aestivum
  unsure (1)..(214): unsure at all n locations
  Clone ID: PAT_TA_69670
atttaatnctccagaagggaaaggatccancttaangatgatggaanttntangcttatcacttangctgggncangataatatccttgcaancataanaaactccntttntttttnttcatnggngttcacgatccatccntncntaancaangcncactgcannggtncttgagagtncncctttnggntaaacttttganaanggcttnac

SEQ ID NO: 69671 - DNA, 721 bp, Triticum aestivum
  unsure (1)..(721): unsure at all n locations
  Clone ID: PAT_TA_69671
tgacacgtagactcggnacggacgcccgcacaggacgaccgcccacgggatcctcgcgtccgggttctggtccaccacggtgaggcccgtcgcgaggccgacgagcgagactattatgccgccagtgctgcatagcagcagcggcctccggccgacacggtcgaggaggaacatggcgaccaagatgacgagcgtcttgacaacgcccatagcgcaggtcgcggccagcagttggtggtcgccggtgagaccagcgctctcgaacacgcgcgggctgtagagcacgacggagtcggagcccgtcaactgctggaacaagaagacgccgagcgccgcgaccagtattcgccgcatggaaggagtcggcgacaggataagctctctccacacctgcttctcctcgccgcctctcttcctgggcacgacgaccacgtcgccgtcgaggtcgtctggaatgccggcggcggtctttatgtcagcgaggcgctcctcggcctcctccggcgtgtcggtgatcttctccagcacgaccctcgcgtcggcgaggcggcctttcatgacgagccaccggggagactccggcatgccggacaccaagacggcgagcaggacggacggcaccgcgccgatgccgagcatgaagcgccagccaaggtggagcggcaggcgagcgaaggcgtagttagagatgtagccgaggaggatgcccgatgttgatgaa

SEQ ID NO: 69672 - DNA, 671 bp, Triticum aestivum
  unsure (1)..(671): unsure at all n locations
  Clone ID: PAT_TA_69672
tggtnatgtctagattcttctgtgtgctaatgtatagtaatggagtatgagtaaaagaaggtaccaaaagaagggggagaaagctaaccaacaaaagcgccagaacatgaaactaattttatccgccgatcttattgaagaactgtcccacacgtcagacaagacatgctcacgtcatggcagtgccctccgccggctgctcgaccttgacccctcccgccattgccgccaggccgtcgcgggcatgccgccggaacactatggcgcactccggcagctcgcctagccccgcgaacatcgcgtcttcttcttcgcctcctcccccgccgatggcctcgccgccgaactcgtcgggaaggagcgcggccgtgtcgacctcgaccaccgctttgccgaagaacatgggcccgtacagtagcatgtcgtcggccgcctcgacttcggagggcgacgtcgacgaggtgacggacacgacgtcgtagagccaccggaaatcgtcgtgcacctcgatggccggcgccgggctcgcggtgactaggccgccggcgacgttggcggtgccatggtgcgtgccgtcggatttcgctggctcaggcgacgggagcggccgctccttgttgggcttccgggggctctgggtctgccggttctgcgccctcgccaccgtgctg

SEQ ID NO: 69673 - DNA, 674 bp, Triticum aestivum
  unsure (1)..(674): unsure at all n locations
  Clone ID: PAT_TA_69673
aacatgaaaattcttactncgacttttattaatatgtagtagcatttgtcgtgcagagatatttgctagtatcatttaccttactctcccacaaaataaaataaaaacatttaccttgctgtttcttttacgaaaggaggattacccccgcctctacatcatttcttactgtgaatcacaaaaatcaatattggaccgaattgtggaatgaaggaaggaaaacttgccttggccgtgatggttatgatgacagtgcaggccgtgaacggcatgacattggcgtgggtgacggtgaggtggagcccctcctccacctccgacagcaccctcaccaccacccccttgacgtcgtggcagaggatcctcaccatgatgccggtctccgagaaccgcacctcgatctccggcagaggtttctccgctgccggcgcccccgacgacgcggacgagggtgagccgttttcgtctgcaacggcggcgtagcacggcttcttgacgagtaccacggtctcgttgctcctgctgctgcgtccggcggctgcctccagggccttgatcttctcctgcagctccttgacgtgcctcgtcgtgtcggaaaggatcgtcgccttgtccatcttcttgaggccggggatgacggtggagagctcgatgaagcgctggttaatcttctc

SEQ ID NO: 69674 - DNA, 708 bp, Triticum aestivum
  Clone ID: PAT_TA_69674
actaatttgcatcttgattgagtggtaaaactatgtctaatacgaaaggataacaacatagtgtatcatgataaagacaacatgaggggcagtagagaactgccagttaagtcaaataataaatatcttatatttttattacatacaatatatttggctctctaaaaggttagtagtaagtctctacgaggccggtagtcttactagatctttaaactggttgttcacttgctcgatcacgtccttcatgccttctaatctccaagaccaaagagtcgattggcatgtcacaatcatgcaatattgtgttcatctgagttaagtccatttaatatttctcaagaatatgggcgtccatcttgatattccatccttttttcgatactgaatagctagtgaggctcaccaaaggcgtacaagattccatcagggaatacctctatcctgtaaacagtccaacaagaataccatgcaggtttcctttagttccacagattacaatgtatccaatgtatacccagtactcatccatttctaattcccggaggtgaaaaaacaaagccaatactcccagcttggacatcattaatcctgatgattttatgaaccttcgatgagactaccaacgtgattcagtggaagcacacaacgtggttgcaactgggatgcctcccggcgtacacggccttattgactctgccgtctcct

SEQ ID NO: 69675 - DNA, 233 bp, Triticum aestivum
  unsure (1)..(233): unsure at all n locations
  Clone ID: PAT_TA_69675
gcgctggcagggaaaaatatacaattgatnggataagcggctggtaaggaaatggactccaggcacgcacgcaggccggcaggcgcgcggcggatcattnatcacgccgggacgggccgggccggacgccctcgcggaagtccaccttgtgcgccatgccggccttctcgangaaggggcggcccacctcgtannactcgcggtcggtgtcnatggccaccaccttgncgtcc

SEQ ID NO: 69676 - DNA, 492 bp, Triticum aestivum
  unsure (1)..(492): unsure at all n locations
  Clone ID: PAT_TA_69676
ctttatactggtnaagtctggaccaaatacgaagtgcccaataaacccggacagaggtagtagtaggactagtagtgtatgcccaactcttttggcgaccggcaatcttttaaggcggctgctaggcgtcaaccgactgatttcctggagaaatcagtcgggtcgccagccgttcgatgcatcctcctagggcctagaactgcccgattcagactctcccaaccacacgatctgcagccccaagccagcaccacgcaccagctcacatggcagcaccgcacagcacaaacggcgcccggcggcgctccattgcagcgttaacggcgcttcaaagcaaccccgacaaagcttcaacgccctctgcggtgcttcaatgcagctccggcgatgcttcatagcaactcggcggagctttcgatgacgccacgatgcttcattgcagctccagcagccctggcgatgctccactccagcaacgcatctggtgagctc

SEQ ID NO: 69677 - DNA, 717 bp, Triticum aestivum
  Clone ID: PAT_TA_69677
ggcatttctactttttattgggtttttgatctttcttttatggcttataggtttaagttcaagtgtacaacaacatatttcctcaatattgagtcaacggaattattgatcattttgaccgtgttcaaccaaaaccttgacagcttccttaatcttttgattaagagcgtctggtgagtcgatcaaagtcaaaatatcagaaacttccatatccaagagcataccagtaatctttggtgcattctttggttctctcaagtgaacgagtgggaaaagtctttcacccaacaattgcttttgatcttgttcagaaagtttggccaagtattcagcagtcaattgatcagatggagcttgtgtggtttgagcttcttgagtgtttggagtagtttgttgtggttgttctcttggttgattacgagcattgttgttgtatttaatacgaccagcattcttggcagcattacctccacgggaagcaccacctcctctttgagatgatccaccacgggacattccaccacgagtgttattttgacggccaccagcaactggttgccatcttggcttaatttgaccacccactggagggaaggcaccttgtggaccagcaatgaagaattgtggcatcatttgtggaatcatttgtggttgctttctggcattgtattgagcctcgagttgagaacgacggagatcctttggttgagcgaagtt

SEQ ID NO: 69678 - DNA, 711 bp, Triticum aestivum
  unsure (1)..(711): unsure at all n locations
  Clone ID: PAT_TA_69678
tagaagatcntagccttctgaaatctgaagcacactgtcttctcttcagtttcttgatcctctgttcagcagataggcaagggctcaccgttccactctttgaggcactcgagcagcgcgtcgatgtgcttgccctggttcatggcgacgaacaccttgtccacctcttccccaggagaccgcgtcatctctccagtcaagtactcagtcccaagctccttgcgcacaaaccggtagagtgggtacgaccggcattcggtgatacggttctgctgcgcggcggtgccgttctccactgaggtccgtgcagcctcgacctcccttggtagaactgcacggagctcctgctcgaacgtggcaagcttggcaaacaccgacgtctccacatcgcgctcggcctcaccgttggccaaagcgtgctcgacgagaactgcacgcatcttttgcatcagtgggtagttggagctgcaagggtcatctgcatacgcgaacaccgcctcacggtcgatcgtgagcagcaagtccttctcgcagaagcgtgcgttgtggagatgtcaatggcctcggcggtcttcctggaggagataagaccaagagagttgacatcttggttgtgttgctcggcgctctggacatggttggtcaccgggttgcctaagaactggagctcggagcagtatgaggccatggcaatctcagcacccttgaacc

SEQ ID NO: 69679 - DNA, 122 bp, Triticum aestivum
  unsure (1)..(122): unsure at all n locations
  Clone ID: PAT_TA_69679
aggaagctcacgagatcgagcngcaacctcaccacaccctgcttagatacatctcaaaggctttccctgaccaaccnagttccggaagcctacacgaagagtttaggtttttttttttttng

SEQ ID NO: 69680 - DNA, 679 bp, Triticum aestivum
  unsure (1)..(679): unsure at all n locations
  Clone ID: PAT_TA_69680
aattctttttccaatgatggccaacctttttngttttagatctgataggtcaatgtggggaaatacatctctgaaatacatactgcaagcacgatgagacccacagcatgcacgggagacacacatatcattcattattcatattacagacataagaaaggccaacacacaaatactgccattttggaaaataaatgctgatgggaaatcacaaagtaaccagcttgtggcaaaagggaggcgacggaggctgttctgctgtcgctttgaatcatacaggctctgtccatgccccctgatccttgtccctgttaatgttcaggatgccggcatgagaaagcagagcccagatatgggtgaggaactgcccgccattctcaagatgctgcatgtgttgcttggcggtggagtgcgagggcgcgacatagacgattgtctcagcccagaaatcccccatcaccttccagtgctgaagctcttctggcatgctcgcgagctgcttaccaagcttgacgcctttcttgaagactgtcccagggtcatctccctcatctgtcccttctaacttcttcattttatcgtaaatctcagaatgtttataggatccaaagagctgcttacgttcttttaacacctttatttccaactctcttatgtccaccttcgtggtacggaagca

SEQ ID NO: 69681 - DNA, 273 bp, Triticum aestivum
  unsure (1)..(273): unsure at all n locations
  Clone ID: PAT_TA_69681
aagtgctctgctgcttccttttgtatntnttactcttttgacaattttgcatgtaaagtagaacttgnaagtacacgatttgcactggataatctgcctgctgaacacatgataagatggttggctatgtcctgcactctagctgaactgnnngttgctnctcctgctggtccagcttttgctgntgcagtgccttttcggnctcgatctttatgaatgctgnagagctgatcttgttccctgnagatttctatggnactagttccaccacct

SEQ ID NO: 69682 - DNA, 709 bp, Triticum aestivum
  unsure (1)..(709): unsure at all n locations
  Clone ID: PAT_TA_69682
gggttgatggtattctccttgccttcgcagagaaattgaggattnaccgtcgttacatatgtaggtacatgcatgatttgctgctgcacatacttagagaaatatacatgtttcaagtgctggtatgataatcggtactggccnctgcttctggggccttattcgttgacgtgtcgttctggcgagctgccgacgtgtaggtcaatcacgagttcaccttggagcagctgagcctgatctgcccctgcgtcccggtgagcggcgcgatgtttcccatcttgatcatcgccgtcgtgaaggcgctgctgaaggccgccgcgttggatgcgaagttgcggacggtgttgtcggtggtgtcgttgttgaagagcacctggtccgaatgcaggagccctttctgtgacaggaggttggtgtagtaggcgttgtcgaacgtgttgggcgtcgtcgtgtccaggttcgccaggttgccgttgccgccggactgggggcagttggccttgagagacgtcgcgaaggcagtgttgatggtggccagagccctgggacacgacgtgtcgtagaacgtcgacgagagctgccccgtggcccgccgtggccagagccacgagcaccaccagagaaatgcaagaggcagaacccatggccatggttggctacaaggccagagctatgtgtgctatcactgctatctgcacttgttatctgc

SEQ ID NO: 69683 - DNA, 635 bp, Triticum aestivum
  unsure (1)..(635): unsure at all n locations
  Clone ID: PAT_TA_69683
tgaaactaatacagntaaggtacatggaccgcgaaatatctatatatcaactatgtgatattcatatgatcnaacatactatcctaatatgttngatcnttggtcatttattttttcagggaaaacacacaacgtggaatcagacattatttctctcaangcattgatacacttttgctctganangtngcaagaattaactgctctgagcgagcttctgctccttgaggnaccctgcnnantnctcancagttgcagccagaggtccnnngctgaccntggntcnangcccggggagngnttcatagntaatntnanacacannggctnngcttannactnnacannngnaggcttnnganaatancncaaacctcannatgtnnaanagnaagancganctttaggatgtgagatnaacnatganactcnnccctngctngaagncataggtgaggacctgganctaatggctgccanctgctggagaanantgcagggntcccttangggngcangnanatcncctcagagcaggtcattctttgccacatnctcanaaccaaaagtgtattctangctttcgagagaaataanngnctgntnccccnncgtgtgnctntnccctgnaaaaa

SEQ ID NO: 69684 - DNA, 115 bp, Triticum aestivum
  unsure (1)..(115): unsure at all n locations
  Clone ID: PAT_TA_69684
caatgaatgaanggatgcagggagggatgggcttgcgagacnaacagatcagcccaacagagccaacgaaggtgtgcatctacagggcacacgccacaaggtgcaaaagcgcaca

SEQ ID NO: 69685 - DNA, 445 bp, Triticum aestivum
  unsure (1)..(445): unsure at all n locations
  Clone ID: PAT_TA_69685
gatgcctgttattgacacagtgctttcttggcgaacacccgaaagctttgcgtcgctatccataggtgtgcacaaatagctgcctgcagttacaattgcccgtataccttgccaatcacccaggcttcgaccgagagcaggagatggaactcaatcgatccaagagacccccatcgtcttggccgcgaacgcgtaacgatccgcagcctcgtcgatgattttctgcgtggagcggccgcagccgtggccgctcttgcggtcgatccgggcgacgatggggttggtctgcgggctctgctccacgctcgtgcacaggacgtgctgcatcgtcgcgaggaacttgagggtgtgcgacggcacgacgcggtcgtcgtggtccgccgtcagcagcatggtgggagggtactgctggcggcggngctggtcgccgccggcgcccttctnc

SEQ ID NO: 69686 - DNA, 515 bp, Triticum aestivum
  unsure (1)..(515): unsure at all n locations
  Clone ID: PAT_TA_69686
cctttcctctatacagtttatgcccaacactcgtgtgatcatattgtgcttattcactatatgctttattccaagatatccgcaagcaagcaagctgacacttctacaaaaacgccaggatcggcaaaactaactcgtcttatgaagacacacacacacacacgcacacacacacacacacaaacacacacacacttatcagcgtggacgcagcacaaacatgagaactggaagagtttccttattacctcaattttgcataggcggtaggcagcacgcatacacatatcaaagcttcttcgggaacttgtatgttttcttgaggaactttgtggccgcctcatcgtaccggtagcacaaaactcgcaggatagtgttcgggtcatttgcgctccactgggcgggcacacgangaggtttcgggaagctagatttggttggagatccctggcgttcagtaatcgcttgcttgaaacgctggatgagggattctgtatctgttcgtaagagtggca

SEQ ID NO: 69687 - DNA, 392 bp, Triticum aestivum
  Clone ID: PAT_TA_69687
aacggtaagatagcagcagacacaggaagataaccaaggcggccggacagagatccagcagcccaaagagtccacctaaaaccctcctaaaccaaccacggagatctcatcggacggaccaggggaagacacgacacgacacacgactctcttatttagatcgacgacacgacacgggacacacggggcggcgacgacgacggcgaaaggcgacccgcgcgcgggcggatctagagctggccgcagtcggcgatgaccacctgcttggagcaggtgccgctgcgggagcccaccttctcgatgttcttgacgacgtccatgccctcgacgacctcgccgaagaccacgtgcttgccgtcgagccaattgcaggggacggtgcagatgaagac

SEQ ID NO: 69688 - DNA, 603 bp, Triticum aestivum
  Clone ID: PAT_TA_69688
gatagataatctaagtaaaacatccgttacatcaccagacatcaaaacatagttcccagtatcacgacaagtaggtcataacagcaagactcatcgatacaaaatagtgcagctctctttaacaacacaagaccaggtaagggataacagcaccaaaaatttagagcttgtcctcgaaatcggatagaggggtcatctgctccttgaggcccttcctcttgcggatatccgtgacgagcgtcgccgactgggtgcctgggtccaaaggatcagaagccatgatgtcccagtggtcaaacacacactgggggaaggcctggccggacgtcgcggccctcagggtgcttgagaacccaaaggattcaatgacggggaggtaggccttgatgttgtagagcggggtaccttgcctctgcatctcctcgaacacgtgccctctcttctgattcagaacaccatagataccaccaagcgcatgttctcctcagccaacgcgccttcctttgacgcccactggaaaccagccacaacagagtccttgatttcattaagatactgcactcccttacacatgtcgacgaccatgttggggccagtcgtctc

SEQ ID NO: 69689 - DNA, 368 bp, Triticum aestivum
  unsure (1)..(368): unsure at all n locations
  Clone ID: PAT_TA_69689
gttccttattgcagtgcaaatataacaacaatatcgaaaatcaaaaccaccgactgcacatgtcggtcagcatacacgatttaacaatcatttattgttggggtaataaactacggactatcggcactgtgaacttaagaagacaatggtcgaaggatgtgtgtgtgtgtgtgtgtgtgtgtgtgtttggcgttgggtctagctacttggcgtgatggatcctgaacatttcaagcagggcctccctatttcccgcagtggcctcatacgcctngatgagctcnctccccgtgaagtccctatacttangacgatggttggtctctcnattcaccatcacccggcgccggaccaatnctggagcccat

SEQ ID NO: 69690 - DNA, 447 bp, Triticum aestivum
  Clone ID: PAT_TA_69690
tctacagaagatagcaaacagcagcgagatgctgcgattacatcaacgaccacgaaccctagacacaggctagctaatctggtggcggcctagcctccgaatccgtagagggtgcgtccctggcgcttgagcgcgtagacgacgtccatggcggtgacggtcttgcggcgggcgtgctcggtgtaggtgacggcgtcacggatgacgttctcgaggaagatcttgagcacgccgcgggtctcctcgtagatgagacccgagatgcgcttcacgccgccccgccgcgccagacgacggatcgccggcttggtgatgccctggatgttgtcgcggagcaccttccggtggcgcttggcgccgcccttgccgagtcccttgcctcccttgccgcggcccgacatcttctcccttctccttccttctcctcggtgaggttgacttgtcttc

SEQ ID NO: 69691 - DNA, 116 bp, Triticum aestivum
  unsure (1)..(116): unsure at all n locations
  Clone ID: PAT_TA_69691
agactcctgggcagcgnagccnangncancccttgcccttgccggccttcttgcggaggagcgtggtgtggatgctgggcagcaccccgccggcggntatggtgaccgagcccanc

SEQ ID NO: 69692 - DNA, 479 bp, Triticum aestivum
  unsure (1)..(479): unsure at all n locations
  Clone ID: PAT_TA_69692
aactggcaatgataacccccaaacagcacagcaacgcgcgcgtttgcttctaccacatattacatgcccatagacgctgtatgggatccatccccttattttgaagcaactgctgcaacagaagcctagacgaactactaaaacaacaacgacgacgaccgacatgacaaccctggacgaaatctaaaacaacaatcgcgatgaccgacacgacatgacatgtaaccaagaaagggganntgcgtggaacgtgtgcctccgctctccctccgcttgaactcgactaactcgctagcagctactgcttctggtgcgcgcatcccgtctcgcagtcttggagcccgccacaacttatggggtccccctggcatgtttccctgcacttgttaacgcaggacaggcacttcgccttggttgggccgcaaatgtccttcgccggggggtggctcgacgtctgtatcgcgcatcccggctcgcag

SEQ ID NO: 69693 - DNA, 513 bp, Triticum aestivum
  Clone ID: PAT_TA_69693
gaaattgaggattcaacacgtcgttacatatgtaggtacatgcatgatttgctgctgcacatacttagagaaatatacatgtttcaagtgctggtatgataatcggtactggccactgcttctggggccttattcgttgacgtgtcgttctggcgagctgccgacgtgtaggtcaatcacgagttcaccttggagcagctgagcctgatctgcccctgcgtcccggtgagcggcgcgatgtttcccatcttgatcatcgccgtcgtgaaggcgctgctgaaggccgccgcgttggatgcgaagttgcggacggtgttgtcggtggtgtcgttgttgaagagcacctggtccgaatgcaggagccctttctgtgacaggaggttggtgtagtaggcgttgtcgaacgtgttgggcgtcgtcgtgtccaggttcgccaggttgccgttgccgccggactgggggcagttggccttgagagacgtcgcgaaagcagtgttgatgttggtggcaccg

SEQ ID NO: 69694 - DNA, 708 bp, Triticum aestivum
  Clone ID: PAT_TA_69694
tcggcacgagggagagagagcgcaggggagcgcgtcgtcgacggtggccgagtggggcctggtctgcggcgagcggtacaaggtcggcctcgtccaggccatcttcttcgccgggtgcatgatcggcgccggcgtgttcgggcacctgtcagactccttcctgggccggaaggggtccctccaggtggtctgcttcctcaacgcgctcttcggcctgctcaccgcgctcgcccccagctacagggtctacgtcgtcctccgcctcctcacgggcttcagcaccggcagcatcggcttctgcgccttcgtcctcgccacggagcccatcgggccatcccgccgtggcaccgccggcatgtccagcttctacttcttctccggcggcatcgcggccctagccggcgtcgccgcgatgttccagtcctcctggcgcctcctctacgtcgtcacctccctcccctccctcgtcttcgtgctcgccgtcatgccgttcatctccgagtcgccgcgctggtacctcgtgcgacggcgcactgacgatgccatgcgcgtcttgcgcgacattgcggccaccaacggccggcgcatcccggacggcgtcacgcttaagctcgatgatgagggagatgatgctaacggcggcaagcagatcgaggagtcgtcaccgtcgtcgtcgtcgggatcgatcctggacgtgttccggtcgag

SEQ ID NO: 69695 - DNA, 512 bp, Triticum aestivum
  unsure (1)..(512): unsure at all n locations
  Clone ID: PAT_TA_69695
gctggaaaagcgtgggttagggttcgcaacattcccatagagaaaaggtgcactgaacatgtggcttatgccggggctctagtggggattacattagaggtggatgaatcgactgtgcataaaccagagtatgctagaattcttcttggctgcatagatgttgagaaaatccctccttcagctgaaggagtgctgggagagcaaatatatgatttcttttatgaagttgaaaaagttgtgactatgggtgctgggaaaagtcaagcctatactgctgtggacagcagtgcatcaccttctgtccccaagaaagcaaggatggattcatatcctgcttcttcaacggggcagggggagactagtgcttcccccccccccagaactntgataagggaatacagaggcttcctgcagtagttganagtgaanaanaggaggatagngaggaaggtaacnccacagagcttctgattganacgatggccanagaacatgcagctgaaaaaatatct

SEQ ID NO: 69696 - DNA, 516 bp, Triticum aestivum
  Clone ID: PAT_TA_69696
ttcggcacgagggcctgccgggtgacctgtacacgatgcctgaactgcagaggctgagcttacaggacaacaacctctccggtgacctcgacaacctcggtaacctgtcgcagcttgtgcagattgacttgtcatataacaaattcaccggcttcatccctgatgtgtttgggaggttgaggaagctggagtccttaaacttggcaaccaatggcttcaatggcacattgcccggttcgctgtcaagctgtccagcgctgacagtggtcagcgtaaggaacaattcgctctccggtgagatcacactcaacttcagcaggctgccaaggctgaacactttcgatgctgggtcaaataggctgagtggtaacatacctgctagcctcacccggtgcgccgagctgaagacgctgaaccttgctaggaacaagcttgatggggagattccggagagcttcaagaatttgagttcattgttgtacctgtcgctgacaggcaacggcttcacgaacctgt

SEQ ID NO: 69697 - DNA, 102 bp, Triticum aestivum
  unsure (1)..(102): unsure at all n locations
  Clone ID: PAT_TA_69697
tctccctcatccacgacggacttgcccgtggtctgcgcgaggcctccaaggcccttgaccgtcgtgaggcgcacatgtgcgttntgaacgaggcttgcnatt

SEQ ID NO: 69698 - DNA, 590 bp, Triticum aestivum
  Clone ID: PAT_TA_69698
gggtcttaccggcgtgtcctcgccgacgggtacaagcggtgcagctgcgagacgctggccgtggacgcccgcggggacagcggctaccacctgctcatggtcaacggctactcgcgcaccaaggagctgattcccaccggtcagagcatcaccgccaactctttcaatgtgggaggccatgactggttgatcgagtactaccccaacggcgagaacccgggctgcgccgacttcatttcgctatttctgaaccttctctacgacgccgatgacgacgacgaagagcccgtggaggtcaggttcagtttcagtctcgtcgaccaggtggagaagcagatgccaacgtacattcgtgcgaccggtgagacccgcagcttctccagcaccacttcaatctggggcaacgacaggtttatgagaagagacgcccttgaacactcagcggatctcaagtgcgattgtctcaccatccgctgcgacgtcgtggtcgtcagcaacagcagggttgatgatgatgatgccggtggccatggccatggcggcaccaaggcgctcctgccggacatacaccagcatttcaacagcctcct

SEQ ID NO: 69699 - DNA, 596 bp, Triticum aestivum
  unsure (1)..(596): unsure at all n locations
  Clone ID: PAT_TA_69699
atgtgcaagtatgaaccatttgaactgtgaaactgcgaatggctcattaaatagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcctcttctccgtcacctccctcgtcgtcaagctcgaccacctccagcagcgcgtcgacaagctcaagaagcgcgacgactgatcccctcctncccgtcgcgtcccggccccggcaggccg

SEQ ID NO: 69700 - DNA, 152 bp, Triticum aestivum
  Clone ID: PAT_TA_69700
tggcttggctagcaagcaggagccatgatctggaagctagcttcttccaggccgggtacttcttcaataaaataaatctccggtttagttcatgtgatctatgtatgtgcgggaatgaacgtatgtatctacgtacgtacgtaaaaaaaaaa

SEQ ID NO: 69701 - DNA, 243 bp, Triticum aestivum
  unsure (1)..(243): unsure at all n locations
  Clone ID: PAT_TA_69701
gacattctctgcctcctcgaatccgagcgtgaggccaggcgtctgcgataagcccgcaaacaactntcggggaaaaagggaaagcggcattttctacattcggttaccggagttctttgcgaaagctatgggcatctatacggacttcacgaggatggacaatatgatggcgtagtgtttcttgctagcgctgcggaagcggaggatggggatgagttgatctgtgggagatacgattacgac

SEQ ID NO: 69702 - DNA, 883 bp, Triticum aestivum
  unsure (1)..(883): unsure at all n locations
  Clone ID: PAT_TA_69702
gccgctccagcaacggaaccacaaatccccacccaatctcgtctccgatcgacccgaggctcgtcgaatccccaccgcctcaagatgcagatatttgtgaagacactcacgggcaagaccatcacccttgaggtggagtcgtctgacaccatcgacaatgtcaaggccaagatccaggacaaggagggcattccgccggaccagcagcgtctcatcttcgctggcaagcagcttgaggacgggaggacccttgctgactacaacatccagaaggagtccacccttcaccttgtcctgcgtttgcgtggtggcatgcagatcttcgtgaagaccctcaccggcaagaccatcactttggaggttgagagctctgacaccatcgacaacgtcaaggccaagatccaggacaaggagggcattcccccggaccagcagcgccttatctttgctggcaagcagctggaggatggccgcaccctttccgactacaacatccagaaggagtccaccctccacctggtgctgcgcctgcgtggtggcatgcagatcttcgtgaagacccttactggaaagaccatcactctggaggtggagagctccgacaccatcgacaacgtcaaggccaagatccaggataaggagggtattcccccggaccagcagcgtctcatcttcgctggcaagcagctggaggatggccgtacccttgctgactacaacatncagaaggagtccaccctncaccttgtcctgcgttntgcgtggnggcatgcagatcttcgtgnagaccctcactgggnaaaacatcactctggaggttgagagctccgaaccataaaaacgtcaaggccaagatncaggacanggngggatttccccggac

SEQ ID NO: 69703 - DNA, 171 bp, Triticum aestivum
  unsure (1)..(171): unsure at all n locations
  Clone ID: PAT_TA_69703
gggatatagtatgtgtggggtgtatagagagaagcatgagttcagttnatttagttaaattcagtcagacataagtttagagcaagagattcagagtgttatttatcttctttttgtatcccagttacttcttggttattcgattattgtattttttagtcaaaaaaaaaa

SEQ ID NO: 69704 - DNA, 558 bp, Triticum aestivum
  Clone ID: PAT_TA_69704
acgagccgtcatttcgctcctcttgatcctctcgatcacctttgtcttctttgctcagagcattgaggctgccaagggacccaagatcacccacaaggtgtacttcgacatcacccatggcgatgaagagctaggccgcatcaccattggcctttacggcaagactgtccccaagaccgccgagaacttccgcgctctggctaccggcgagaagggcttcggttacgagggctctactttccaccgcgttatcagcaacttcatgatccagggtggtgacttcaccaagggtgatggcactggtggaaagagtatctatggggctaagttccccgatgagaacttcaagctcaagcacacccgcaagggtcttctcagcatggccaacagcggaaaggacaccaacggctctcagttcttcatcaccaccgtcgtcaccagctggctcgatggccgccacgtcgttttcggagaggtcctcgagggctacgatgttgtggagaagattgagaacgtgaagaagggacctggagacaagccggcccagaccgtcaagat

SEQ ID NO: 69705 - DNA, 860 bp, Triticum aestivum
  unsure (1)..(860): unsure at all n locations
  Clone ID: PAT_TA_69705
atctcgtctccgatcgactcgagagctcgtcgaatcctcctcccccatcgtctcaagatgcagatcttcgtgaagaccctcactggcaagaccatcactctggaggttgagagctctgacaccattgacaatgttaaggctaagatccaggacaaggagggcattcccccggaccagcagcgcctgatctttgctggcaagcagctggaggacggccgcaccctggccgactacaacatccagaaagagtccacccttcacctggtgctccgcctccgtggtggtatgcagatttttgtgaagaccctcaccggcaagaccatcactctggaggttgagagctctgacaccattgacaatgttaaggctaagatccaggacaaggagggcattcccccggaccagcagcgcctgatctttgctggcaagcagctggaggacggccgcaccctggccgactacaacatccagaaagagtccacccttcacctggtgctccgcctccgtggtggtatgcagatttttgtgaagaccctcaccggcaagaccatcactctggaggttgagagctccgacaccatttgacaatgttaaggccaagatccaggacaaggagggcattcccccggaccagcagcgcctgatctttgctggcaagcagctggaaggacggccgcacccttggccgactacaacatccagaangagtccaccctttaccttggngctccgcctccgnggggggatggcaaatttttcgggaaaaccctcaccgcnagaacattaccccttgaggttgngagctccgacccattggaaaangttagggccaagantccaggacnagggnggcattnccc

SEQ ID NO: 69706 - DNA, 898 bp, Triticum aestivum
  unsure (1)..(898): unsure at all n locations
  Clone ID: PAT_TA_69706
aatcccccagccgatctcgtctccggtcgactccgctccccctcctccggtcctcccccaccgccccggaccgcagcgcctcatctttgctggcaagcagcttgaggacggcaggacccttgctgactacaacatccagaaggagtccaccctccaccttgtcctccgccttcggggaggcatgcagatctttgtcaagaccctcactggcaagaccatcacccttgaggtggagtcctcggacaccatcgacaacgtcaaggcgaagatccaggacaaggagggcatccccccggaccagcagcgcctcatctttgctggcaagcagctcgaggacggcaggacccttgctgactacaacatccagaaggagtccaccctccaccttgtcctccgtcttcggggaggcatgcagatctttgtgaagaccctcactggcaagaccatcacccttgaggtggagtccttggacaccatcgacaacgtcaaggcgaagatccaggacaaggagggcatcccccctgaccagcagcgcctcatctttgctggcaagcagctggaggatggccgtacccttgctgattacaacatccagaaggagtccacccttcaccttgtncctgcgtttacgaggtggcatgcagatcttttgtgaagacccttactggcaagaccatcactctggaggttgagagctcggacaccatcgacaacgtcaaggncaagatccaggacaaggagggcattccccccgggaccagcagcgccttaattttttgttggcaagcagctggaggatgggccgnaccccttggttgantacaacatccagnaaggagtcccnccctttaccttggcctgggtttncngaggngggttgcanatttttgggaaaacc

SEQ ID NO: 69707 - DNA, 606 bp, Triticum aestivum
  unsure (1)..(606): unsure at all n locations
  Clone ID: PAT_TA_69707
cnatgatgcccggctgcgaccccgcgcttgttgcggcgagcgccgatgatgcccggctgcgaccccgcgcttgttgcggcgagcgccgatgatgcccggctgcgaccccgtgctgccgtgtgtttggtgtctgcctctttgccctccccctggctgccatgcccgtgtgcacgtcatcgcttgcctcttgccgttcctcctaccacgtcgctcctcggtgcttctagatggaggtggttgctacacctttgtcgcctcccaagtcccaacccacctccgtcgcctcacctaatccccaaagctccaccttcggcgagccaaatcaaggatgaccagggcaagctccaccgcatcaaaggcttcaccgcgggtccgtggccaccttggccaaggccgatgctgcacgccgctgttgccttcttgctgacgggccgccctgctcggttgctctgccagcccgcacgcacatgcacagctcgagcttgcttctcttcccctgcaaagcttcccctatgtgtcctcaccctgctcgtgctcgttagataataacgagaaataaacgagacaaagagacacggatttttacgtaaaaacccttgcgggaga

SEQ ID NO: 69708 - DNA, 553 bp, Triticum aestivum
  Clone ID: PAT_TA_69708
agaacctacgagtagctgcatatctgtatttcgatactcaagtaaacaacacacctagtttccttattcgaacactagcaaccatggcgaccgatccgtccaagtacaagcttaaccactccatgatccggatcaaggatcccaagcgatcagtccagttctatgagtttctgggcatgaagcagatcaaccagatcaagaaccctgacgccaagttcgacctttacttcctcgcatacgacagccctaaggccgtctcacacggcaaccactggaccgatcgcgagggtattgtggaattgacgcacaactacggcaccgaagacgacccaaactacaagatcagcaatggcaacacggaacctcacaagggcttcggccacctctgcatctcggtggacaacctacaggcagcgtgccagaggctagaagatgccggatacaagtttcaaaagaagctcacagacggtcgcatgcgccacattgcgttcgtgctcgaccctgatggctactgggttgaggtgattggccagaagccattggaggagacgga

SEQ ID NO: 69709 - DNA, 119 bp, Triticum aestivum
  Clone ID: PAT_TA_69709
atactgtctagctcctctagtagtaagtactgtaatgcaatatccaacgattttcatggagcatatgaatgagagtatgcaataaaatttatgaagtgccatatatatgaaaaaaaaaa

SEQ ID NO: 69710 - DNA, 265 bp, Triticum aestivum
  Clone ID: PAT_TA_69710
atggagtggctgaatgaggatgaagaggatccagttttggatggagccgatgcggccagtgctgtttttgagaaaataaggcgcctcaactcaagcaggaaggattcttatgttggtacaaaggctaataagaagaaaagaaagaggaatcatgatgaggagaatgagtatgttgaaactgacagtgaggatgacgacaacgataatgaatatgttgataatgagagtgaggatgatgatggggtgagtgaggatgatgaggatg

SEQ ID NO: 69711 - DNA, 311 bp, Triticum aestivum
  Clone ID: PAT_TA_69711
aattcggcacgaggggacgagctcgacggcgccctcggcgaggagctgctcctcgaggcccctcgccggtgtagtggtagccactaggctccccgtggttgcctggtcctctgtccccctccattggtctgcgcaggcaggcagggtgggtgatgcgcatctcgcggacggactcctggctggcattgttgcctggcaagcaaagcttggattggatcgagcttgtagctttgagtgaacatggacaagatctccactgcactgcactgtttgaatattacattagttttgatataattataaaaaaaaaa

SEQ ID NO: 69712 - DNA, 169 bp, Triticum aestivum
  Clone ID: PAT_TA_69712
cggcggtcggtgccccactccggccgcgacccagtccgtcgagaaggaaccccgttcgttcccccttccctcctcagtccgtggccatgagctcggccggcaaggagcttattctcacagcatagctcaaaagaactggccctgaagcggactcgcgcggaggagctcc

SEQ ID NO: 69713 - DNA, 623 bp, Triticum aestivum
  Clone ID: PAT_TA_69713
aggaattcggacgaggattccctttgcctcgctggtcctccccctccttcgtcgcggcctcggtcgacataggaaagatcgcccaataccaacgaagcggaaggacaaagccatcgtcagtgtcgtgttttgcggctcgtcgtcgttcagattcgaggtctcatgcttcgatctgatttcttacatgagcaagtgaagagccgtgattgctgcatgtgtctgcacagtttaagtggattggtaaattctggaactgcattggcttctccaccggcaaacagttggagaaactacacagatcaggaggttgtctgccaaccaaatgtacgctaatgcttgcctggcgatctggagatgcagacagttgtggatcgcacttgcttaatctgcatgaatttctgcttcaagtacctaggcaggcatcagtgtaacagctactcagctgatttgaagcaaatggatgcttacattacagggacttggccaccaacaccgttgacgttgaactcgagctccttcaatctgggaagtttcttgatgccggagagagatgtggaagatgaccagacaatcttctcgagcctaggagctgacccgctgttgaaatcaatctcggtaatggc

SEQ ID NO: 69714 - DNA, 852 bp, Triticum aestivum
  unsure (1)..(852): unsure at all n locations
  Clone ID: PAT_TA_69714
atctcgtctccgatcgactcccgctcgtcgaatactcctcccccaccgcctcaagatgcagatctttgtgaagaccctcactggcaagaccatcaccctagaggttgagagctccgacaccatagacaacgtcaaggccaagatccaggacaaggagggcattcccccggaccagcagcgtctcatcttcgctggcaagcagctggaggatggccgtacccttgctgactacaacatccagaaggagtccaccctccaccttgtcctgcgtctgcgtggtggcatgcagatcttcgtgaagaccctcaccggcaagaccatcactcttgaggtggagagctccgacaccatcgacaacgtcaaggccaagatccaggacaaggagggcattcctccggaccagcagcgtctcatcttcgctggcaagcagcttgaggatggccgtaccctcgctgactacaacatccagaaggagtccacccttcacctggtgctccgcctccgtggtggtatgcagatttttgtgaagaccctcaccggcaagaccatcacccttgaggttgagagctctgacaccatcgacaacgtcaaggccaagatccaggacaaggagggcattccccccggaccagcagcgcctgatctttgctggcaagcagctggaggatggccgtaccctcgccgactacaacatncagaagggagtcaccctccaccttgtcctgcgcctgcgtggtggcatgcaaatcttcgtgaagacctcaccgggaagacatcactctggangttgagagctncganacattcganacgtnaggccagatccaggaaagggnggcattnccccggacc

SEQ ID NO: 69715 - DNA, 587 bp, Triticum aestivum
  Clone ID: PAT_TA_69715
gaggtttcttctcttagactctactggaagcgtgcttcctgacattcttttcttgaaatccacatagaagcttgcttcttttcaaacctccatcaaccgaacacttttgaacccgaaccgaaccgtcccaatcgaaaagtagcaaccatgcatttccgcggatcctccatctacttcggcatcgttgccctctcctcgacttcagctgtccttggagccgtcgctccctacggacaatgcggtggtaacggcttccagggcgagaccgagtgcgctcaaggctggtcttgcgtcaagagcaacgactggtacagccagtgcatcaacggtggtggaaacgccccggctcctcctgctgctactggcgtcgcgccggcacccgtcgttccttctgccgcccctgtaccgtcgatgaacgctagcgagcccgtcgccgcccctgttgcggttgctcagcctgctgccaccggcggtgccaacggctctactcctgatgttgccggaaccggtgccaacggtgccaagtgctcgctcgatgctgcattcaagtcgcacggcaagaagtacatcggtgtttgctaccgacc

SEQ ID NO: 69716 - DNA, 612 bp, Triticum aestivum
  Clone ID: PAT_TA_69716
cagagcctgcggcagcgccaaaaagcaaggatgttccggtccctagcgatgtcgaaatgaagaatgctgtcaaggatgatgacgaagacgaggcggtatgtgatctgcacttcattgcaggctgccagtcgtgtaaagcctgggacaaggaggaggaggaagagtcagatgatgatgctgggtggatgtcccattctttgagtttcgcaaaggatagacttggtaaggatctggaatggaagcgaaagaacgaggaggagctgcttgtcattgatccactagaagaggctaagagacacaaggcggcgacgagagggaagcgagaatgggatggcggaaaggacaagaaaaagatgaaggcgtgaacatgatacattctcaagaatgcagccgttcttcgtctaggggaatgtccaacctcgtctctacacatacacagcgttcagggatctttttctacggcagtcaaaccaaattctgacaggaggatgtagacgtcagctgtgggcgaacacagccggcttcggttgtcgtgagctggcacctgcccagttggtgtttcactttcacttaagttacagcatcttgatatacagtggggctcgatgctgc

SEQ ID NO: 69717 - DNA, 237 bp, Triticum aestivum
  unsure (1)..(237): unsure at all n locations
  Clone ID: PAT_TA_69717
tcttcgctttnacgcgcatgttcgccagccccatccgaccccgtaccatgacaaaggaatggcaagaagccaccgaggagtacatgaagtcgcaaggaaccgagcccatcaccggctacaagggaatgatggtacagagcaagtcggagaaggatctcccagcgggccagaagctcaacgacgagtaaagagtccgaatagaagagtcacaacaatcaccataccaataccgatacc

SEQ ID NO: 69718 - DNA, 540 bp, Triticum aestivum
  Clone ID: PAT_TA_69718
ggcactcgtgaacgactggcggcggcggcgactggaaaacctcctccgtcaccgctctggtctgcctccgtccaccgctcctgcctcctccgaccggcgactgcgacgccccctgccctcctcccttcgacgctctgcccctccggatggggtgacggggccggggtcgccatcctactacttcccggatctcgtctccgcccccaagatcttcaccttccgatgacgacgacggccaggagatcatgctcctcttcgtccaagatccaagagccctctctcctgtttgagttttgtatcacaagaaccaatacgaaagaacatccatcgtttgcagtagtgtttctacctaactatcatggcctcacaatgctgttaagtcatcaattactaatatactgttagaaaatggcctttactgattgaaggagaaaattgctaccaaggagaaaacataagtttttctttgtggaattaccatgtcggcgctggtggcattgaacgtgtcgacgatgggggcaatgccatccttgacgattc

SEQ ID NO: 69719 - DNA, 663 bp, Triticum aestivum
  Clone ID: PAT_TA_69719
ctctctcgccccttgttgcatctgccgtctgcgcaagcttcgcgacggcgacgacgtggttaggctgccggagaatgccgagcatggggcgctcacagacgctaggtggccaacctcctctcctcccgagagaccagctgaaaagaaaacctatcgtggcgcatgtccaaaaggaaactgggaacgatgtgatggtcagcacggaggggttgctccaagctcagcttgagctctaccaccacgccatggcgtacgtcaagtctgcggcgctcagggcagccgcggacctacgcatccccgacgcaattcaccgctgcggtggtgccgccaccttgtccgacatcgccactgagatcggcgtccagccgacgaaggtttcccacctccgtaggctcatgcgtgccctcaccatccttggcatcttcctcgtcggccaaggccccaacggtgaggccactgatgtgcactacaagctcacctcggtctcgcgcctcctcttggagggcagctcatgtacccagtctcccatcgtgcgcgtgctcgtggacccgctgtccttgaccgctctctgcagcataggggagtggtttactgatgagagagcctcggccctcacactcttcgaggtggcgcatgggtgcacgcgggaggagatgacggcga

SEQ ID NO: 69720 - DNA, 104 bp, Triticum aestivum
  unsure (1)..(104): unsure at all n locations
  Clone ID: PAT_TA_69720
gagttcctgcaatctttacggacttttgcnaagaagctgctcatctggcttcttgctgcataagctccataactggtcaacccctgggactccctatacaggta

SEQ ID NO: 69721 - DNA, 645 bp, Triticum aestivum
  unsure (1)..(645): unsure at all n locations
  Clone ID: PAT_TA_69721
aggaattcggcacgagggaactgtctcgagttttttgcaagtngcgtacacgagtaagaaaagctgtccgtttgtcacgagagaaagcactcaaattggaggcatccaagacagcactcaaattggaggcatccaagacggctaccaatgtatgctccttgaacactgagcagacacctcttgacattgagacacatgctcaagttgttgaacctttgagtactttagaaccattggagatgttccaaagctcttcacaactagcggaggcccctcagagctctctacaacagccagaggtccagcagtgcactgcaaccccaatccctatcacccctacgggatcaatccaaccaactgatgctaagattaatccagattctgttcaaaaggaaaccaaacaagaggaagttgcccctggtgttgagtcagaagataaaaagtttttggatagtatatttgccctaatgcagaaggaggaaacattctctggacaggtcaagttgatggaatggattcttcaaataaataatgctacgattcttagttggttcttaacaatgggcggtttgactattgtctcaacatggctgagccaagcagctactgaagagcaaacaactgttattcttgtcattttcaagg

SEQ ID NO: 69722 - DNA, 613 bp, Triticum aestivum
  Clone ID: PAT_TA_69722
attgcgaggttggaaccttgcatcatgtgtcaatcgcatcaactcgctctggccattcgtcgcaatgccacgagatatccaacatcttcgtgcgactttgcaacaagcatgcgagtccagaactatgctaccaagcaaagaattgacgctccgaggttgcgcgctgatgtcgatgcacgcggtcgacttggcttctacactttgacgaagcatgaaggaatacacaaaatagagcctcgtactgccatgagcatctatgatgatttcgttgcgcataagaacaccatgccccacggcaaaaacgtcttgcgcatagtgaacaaatacaacgtgccgctgaacgatgtagcgtctcttgcaatcgtcactttcaagatacctgatattggcgatgcggcgaaaagagctcaattgcctccaagtcaacacaagaataccgctggactgctgcttcagggatgtgcgcaaagtggagaccctctagcgataacacacatcctgaccgccgtctatcttggcggctcaggccatagttctgctcaagagatcacgagactatttccaaagcaagaaatagcccagtatcgtctgtctctcgacgcgatcgacctac

SEQ ID NO: 69723 - DNA, 554 bp, Triticum aestivum
  Clone ID: PAT_TA_69723
gaggaattcggacgagggcgccatgtgcgacggaatgcgaaggccgatgtactccatcatcggcctgctctcatggtgcggcaggcggaggacatgcgccccgagcagaggctcgtggccgacgccattgccaggacgagcaccctgtcgctggcactgatgaacgacgtcgacacggagacgttgacggtgaaccgcatgccgttcgacctgcgctccttgatgagggaggccatgagcgtcgccgggtgcctggccagctgcggcggggctggtttctcgtaccagctggagaacgccttgcctgagtgggtcgttggcgacgagacgagggtcttccatcacctgctgcaaatggcgggtgatgtgctcggtcagcggcgcgatggagcagggcgtctctcattctccatcaagagctgcagtgcggaccaaaaggattgcatcccggtgtgcccaaatctgtctgcaggttgtagcatatgcgttgagtttcaggttgccatggaaagatcaactggatgcagccagccacccagcagcccggccagctc

SEQ ID NO: 69724 - DNA, 375 bp, Triticum aestivum
  Clone ID: PAT_TA_69724
gacgctacgaagatatttctgccaaagatctaaacctgtacatttagactagcaatccgcagccaccaaacttattgcacatactcctttcagcgcctgacgagtggttagtacctatctgagataaaattcaccgtgatgtgattactcacgattactagtaattcctttttcatgcagtcgaatttcagacaacaatccatactttatcctgttttagggattagctccaattcgcattattgcatccctttgtaaaggcacatgtggcacgtctatagcccacaatattaaggccatgatgacttgtcttagtccctattatcacatccaattgtaagcggagagctgctttattataataaataaaacaag

SEQ ID NO: 69725 - DNA, 618 bp, Triticum aestivum
  Clone ID: PAT_TA_69725
cccttgacatatgaacaacaaaacctgtccttaacaggatggtactgactttcatacaggtgctgcatggctgtcgtcagctcgtgtcgtgagatgtttggtcaagtcctataacgagcgaaaccctcgttttgtgttgctgagacatgcgcctaaggagaaattgccaccgagtgacgtgccagcgctactacttgattgagtgccagcacgtagctgtgctttcagcaagaatttcaccattgggagccggtgcctttcgaagcactttcacgtgtgaaccgaagtcgtcttgcccaagacccacggagacctacctatagtgacgtcaaagtaccagtgagcatggaggtttggttgaaattggttacgacgacgtcgagttggcggcggaggaagactcggcatgaaggccagaaaatggtgtggaacgtagtggtaatagtacgcgccccgctccgaaacaaagaaaaaggtgcgtgccgcgaaaccatctcccgtgtcactggtggcatgaaggtcaaggccgaccgtgacgagagctctccctacgccgccatgttggcagcccaggatgttgctgctcgctgcaaggaactcggtatcaccgctctccac

SEQ ID NO: 69726 - DNA, 444 bp, Triticum aestivum
  Clone ID: PAT_TA_69726
aacttcgacctcaacaaggtctttgacagccacgccggtattgcccacacccgatgggccacccacggtcccccctcgcgtgtcaactgccatccccacaggtccgaccctaactgggagttctccgtcgtccacaatggaatcatcacaaactacaagggagctcaagaccctgctcgagagcaagggcttcaagttcgagactgagaccgacaccgaggccattgccaagctcacaaagtacatctacagcgagcaccccgacctgagcttcccctcgctcgtcaaggccgtcatcaaggagctccagggtgctttcggtcttctcctgaagtccgtccactacccccacgaggttgttgctgcccgcaagggttctcccctcgtcatcggtgtccgaacacagaagaagatgaaggttgacttcgtcgacgttcgagtaca

SEQ ID NO: 69727 - DNA, 566 bp, Triticum aestivum
  unsure (1)..(566): unsure at all n locations
  Clone ID: PAT_TA_69727
acttcctactgccccatgctccctcgnngagcatgaccgaccccgtcatcatcgccagcggccggnacttacgagnaggagaagcatccagaagtggttggacgcggggcagcgaacgtgtcccaagacgcagcagccgttggcgcatctgtcgctggcgccgaattttgctctcaagaacttgatcctgcagtggtgtgagaagaacaaggtagnagatgcagacaagagctgacgaacctcctgttgaggaagtgagtaaggaggtgctcatcccgtcattggtgaaggacctctcatccccaaacctcgacgtacagcgcanggccgccaagaagatccggacgctttccaaggagagcccagaggaccgcacacttatcgntgacagngatggcatcgcggcccttgncggtctcctgctgtacccggataagaagatccaggacaacgcggncacgtcgntgctcaacctctcgatcgacgaggccaacaaggncttgattgccaaggggaacgccatcccattgatcatcgaagncctcaagaacggcaatgncnagggc

SEQ ID NO: 69728 - DNA, 315 bp, Triticum aestivum
  unsure (1)..(315): unsure at all n locations
  Clone ID: PAT_TA_69728
gcgtgttcntacttcgccggnngctcggcgctgctcctgccggccaccacgctctgcctgctcaacgctgcagcgctcgtcggcggggtctggaagatggtcggcaggggcggcaacgtgatccggcaccggcgagctgttcctcctctgctacgtcgcggcacttagntatccgctgctgcaagggatgttcctcaggcgcgatcctgcaagagttcctgcgcggatcacggcagtgtccgtcgccattgttgccactctgctatccntgtttggttaggccggccacttccacagagtttgagtgacacctaa

SEQ ID NO: 69729 - DNA, 677 bp, Triticum aestivum
  Clone ID: PAT_TA_69729
gatccaatccgcacagaaatccccatctcaaaaccctagccctcatccccgatcccggcgagcgagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaagagcggcaagccgctgcactacaagggcagcgccttccaccgcgtgatccccgacgagaagttcgtccacaagcacaccaagcccgggatcctctccatggccaacgccgggcccaacaccaacggctcccagttcttcatctgcaccgtcccctgcaattggctcgacggcaagcacgtggtcttcggcgaggtcgtcgagggcatggacgtcgtcaagaacatcgagaaggtgggctcccgcagcggcacctgctccaagcaggtcgtcatcgccgactgcggccagctctagatccgcccgcccgccggtcgccgtcgtcgtcatcgccccgtgtgtcccgtgtcgtgtcgtcgatctaaataagagagtcgtgtgtcgtgtcttcccctggtccgtccgatgagatctccgtggttggtttaggagggttttaggtggactctttgggccgctggatctgcgtc

SEQ ID NO: 69730 - DNA, 588 bp, Triticum aestivum
  Clone ID: PAT_TA_69730
atgcctggtatggataatcatgcagcagctcaaggaattaaagatgacagaagtggggtaaactcagctgcacaggaggctcctaagaaggttgaggtggagaagcaggtcctagactccagagagaaattagagtactaccgcacgaaaatgcaagatcttgttctgtataaaagtcggtgtgacaatagactgaatgagatcacagaaagggcgtcttctgataaactcgaggtggaattgttgtctaagaaatatgaagaaaaatacaagcaagtggcagagttagcttccaaactggcagttgaggaagctgctttccgtgatgttcaggagaggaaagttgagctgaatgatgcattaattaaaatggtacaaggtggaagtgttgatggtttgcttcaggttcgagctgatcgaatccagcatcaattagaggagatggagaaagcttttaacgaacggtgcaagcactttggactgcaattcaagccatctgcaacagtcgagcttccatttggttgggaacctgggcagcaagagggagcagttgagtgggatgaagactgggataaatttgaggatgaa

SEQ ID NO: 69731 - DNA, 714 bp, Triticum aestivum
  Clone ID: PAT_TA_69731
gatttgatgcacaggatgggatgcaaaaacttctgaatatattacaagttgctgcatccgtaaggtcgggtggtaactctggagcattaggatcctccaatgcgaatcaagggaatgaccgatcgcctgctgaaattctgactcagtcagaaaagcaggtcgcgtatcattcatgtgttgcactacgtcaatattttagagctcatctccttcagcttgttgattccatccggccaagcaagagcatccgtagtattgctcggaatacttccagtgcaagagctggttacaaaccttttgacatcggcaacgaggctatggatgctatttttcgtcaggtccagcgggacagaaagttaggacctgctctcgtaagagctcgctggcccgtgatggataaattcttggcctctaatggtcatattatcctgctagaattatgccagagtctacctgctgatcggtatcttcatgacttggctcagtatgcatttggagttcttcacatcataactcttatgccacacagccgcaaattgatggtgcatgctacattaactaacaaccgtattggtatggctgttatactagatatagcaaacagtgttgttggctatgttgatcctgaggtgatttgtccagcattgaatgtgcttgtcaatcttgtatgcccccctccatcgatcagcaacaagccgtcctcagctgttaatc

SEQ ID NO: 69732 - DNA, 928 bp, Triticum aestivum
  unsure (1)..(928): unsure at all n locations
  Clone ID: PAT_TA_69732
attcggcacgaggcaaatccccagccaatctcgtctccgatcgaccccaggctcgtcgaatcctcctcccccaccgcctcaagatgcagatcttcgtgaagaccctcacaggcaagaccattacccttgaggttgagagctccgacaccattgacaatgtcaaggccaagatccaggacaaggagggcattcctccggaccagcagcgtctcatcttcgctggcaagcagctggaggatggtcgcaccctcgctgactacaacatccagaaggagtccacccttcaccttgtcctccgccttcggggaggcatgcagatcttcgtcaagaccctcaccggcaagaccatcacgcttgaggtggagtcatctgacaccatcgacaatgtcaaggccaagatccaggacaaggagggcatccccccggaccagcaacgccttatctttgctggcaagcagctggaggatggtcgcacccttgctgactacaacatccagaaggagtccacccttcaccttgtcctccgtcttcggggaggcatgcagatcttcgtcaagaccctcaccggcaagaccatcacgcttgaggtggagtcgtctgacaccatcgacaacgtcaaggccaagatccaggacaaggagggcattcccccggaccagcagcgccttatcttcgctggcaagcagctggaggatggccgcacccttgcggactacaacatccagaaggagtccacccttcaccttgtcctgcgtctncgtggnggcatgcaaatcttcgtgaagacccttgacngggaagaccattactctgggaggntgagagctctgacaccatcgacaatgtcaaggtcaagatccaggacanggagggcattcccccggacccacagcgtctgatnttcgntggcaagcanctgggaggatgg

SEQ ID NO: 69733 - DNA, 441 bp, Triticum aestivum
  Clone ID: PAT_TA_69733
gcaaacacagcatctgcaaccacaacaaccaatttcgcagcaacaagcacaacaacaacaacaacaacaacaacaacaacaaatccttcaacaaattctgcaacaacaacaactgattccatgcagggatgtcatcgtcttgcaacaacacaacatagcgcatgaaagctcacaagtattgcagcaaagtagttaccaagtgttgcaacaattatgttgtcagcagctgcggcagatccccgagcagtcgcggtgccaagccatcaacaatgtcgttcatgctattattctgcatcaacaacaacaacaacaaggacaacatcaacagtcgagccaggtctcctaccagcagcctcagcaacaatatccatcaggccagggctccttccagccatctcagcaaaatccacaggcccagggctttgtccaacctcaacatct

SEQ ID NO: 69734 - DNA, 278 bp, Triticum aestivum
  unsure (1)..(278): unsure at all n locations
  Clone ID: PAT_TA_69734
gctggacctgacgaccacgccgggcggcgtggcggaggcggtgaccacggcggcgcggctcaaccaggagcgcccgtaggcgtagcgccctctcctccctccatctagagtcgtacagcgagcgtacgcccgaggtggcgcgcagcggtgcggtgcaggatttgtactttgtgtccgaataaaacggtgtgtgctcgtcgagtcggttttttttttgtgacgtgctcgtctagtcgtttcttgtataatatanaatggaagtgtgcgtaaaaaaaaaa

SEQ ID NO: 69735 - DNA, 871 bp, Triticum aestivum
  unsure (1)..(871): unsure at all n locations
  Clone ID: PAT_TA_69735
aggaattcggcacgaggcgaagcgaagccaggctctctcctcctcctcacagcctgtttgatgcagatctttgtgaagaccctgacaggcaagaccatcaccctcgaggttgagtcctcagacaccatcgacaacgtcaaggccaagatccaggacaaggagggcatccctccggatcagcagcgtctcatctttgccggcaagcagcttgaggatggccggaccttggccgactacaacatccagaaggagtccacactccacctggtgctgaggctccgtggcggcatgcagatcttcgtcaagaccctgaccggcaagaccatcaccctggaggtcgagtcctttgacaccattgacaacgtgaaggccaagatccaggacaaggagggcatccctccggaccagcagcgtctcatctttgccggcaagcagcttgaggatggccggaccctggctgactacaacatccagaaggagtccacactccacctggtgctcaggctccgtttctgcatgcagatnttcgtcaagaccctgaccggnaagaccatcaccctggaggtcgagttnctctgacaccattgacaacgtgaaggccaagatccaggacaaggagggcatccctncggaccagcagcgtctnatctttgccggcaagcagcttgaggatggncggaccctggctgactacaacatccanaaggagtccacactccacctggtgctcaggctctgttttaagaccctgaccggcaagaccatcaccctggaggtcgagtcctntgacacatngnnnancnnnnaaggccaagatccaggacaaggngggcattcccccggaccanntgcgtnttatttttgntggcaa

SEQ ID NO: 69736 - DNA, 277 bp, Triticum aestivum
  unsure (1)..(277): unsure at all n locations
  Clone ID: PAT_TA_69736
ctgcaggnaattcggcacgaggggcggccgccgggtcgggcggtggtggtgccggctgcacgtttgcgtttggagtggacagtgggtactgagtagtgacgcccgacagaaattgcgccgcccgcgtgtgctaactgcttggtttatggccgaattattggcattgcgtgagtctgccattttgaccgctacatgttcccagtctgccttgttccagggatgacacaatttgcaaattcgtgttttctctgtacgttttatccatgcaaaaaaaaaa

SEQ ID NO: 69737 - DNA, 464 bp, Triticum aestivum
  unsure (1)..(464): unsure at all n locations
  Clone ID: PAT_TA_69737
gcttcgcgacaacgctacactcatttctgtgtctatccaacttgaagctcgggagagtcctggaggctgaggttattcacttcgtcaacgtacacggaaacgccatcgatactattccgacgacatagtggaaaaagcattcgccttttgtctcaacagtcacccttatcgcaagagtactccaccacttctacactcaacccaagccgactacactctcaaccatgaagtctgtcgcatccatcgccgcggcagctatgctgtccggctctgccaacgctttctggcgcatgccctgccacgaccgcactgccctcgcacgtctggaccccatcgtcgacgaaggaactgcttnctcccacgcccacaccatccacggtggaagtaacttcgctgagacgaccacctatgacatgctccgtgagtcggagtgcacttcgtgccagttcgacgacgacaagtcc

SEQ ID NO: 69738 - DNA, 590 bp, Triticum aestivum
  Clone ID: PAT_TA_69738
cctcctgccatccagcctgcgagcaccaatgagcagcactccaacacagccttgcgtatgctcgacgagctccgcctcgcaagccctgtgctccgggagttcctccgctcgctccctgccgtcgacgccatcgtcctcgacatgttttgcgtcgacgccctcgacgtcgccgctgagctcgccgtccccgcctacatgttctacgcgtccgccgccgccgacctcgcaatctacctccaggttcctgatgtcttccgcgcggcgcctttctcgttcaaggatatgggagacgcggcgctgcccttctccggcgtgccgccggttcgcgctctggacatgccggacaccatgtcagaccgggagagcgacctgtgcaagagaagagtgcagcagctcgcgcggatgccggaagcgagaggcattctggtgaacagcttcgagtggctggagtcgagagccgtcaaagctctccgggatggcctctgcgtgtccggcggccgctccacgccgcaaatatactgcatcgggccattggtcgacggcggcgcgagcggtcaaagtggcgagaggcacgcttgcctcgagtggct

SEQ ID NO: 69739 - DNA, 278 bp, Triticum aestivum
  unsure (1)..(278): unsure at all n locations
  Clone ID: PAT_TA_69739
ccaaggtgaccttccgccacccgttcaggtncaagcaccagaaggagctcttcgtcgccgncgagggtatgtacaccggncagttcgtctactgcggacgccgcgccaccctctccgttggtaacgtcctcccgctccgctccgtgcctgagggaggcgtcatctgcaacgtcgagcaccacgtcggcgaccgtggtgtcttcgccagggcctccggtgactacgccatcgtcatcagccacaaccctgacaacggcacctcaaggatcaagctcccc

SEQ ID NO: 69740 - DNA, 495 bp, Triticum aestivum
  Clone ID: PAT_TA_69740
ccgcagttcctggccggggagcattcggtgctgcaggtgatcggcaaggagatagtggcgctggctctgaggcagaagaacacgaccgccgtggagaagctgctgtcggcgaagagcgggtcgaccataatggcgtgcatctcgtgcgcggaggagctggagaggaaggcggagcaggaggaacaggagggcgggaagggggagcgggagcgggaagaggaggagagggaaaggaagcagagagaggaggaagagcggaagaagcgagaggaggaagagagggcgaggagggagaaggaaaggaagcagagggaggaagagcagaggaaacgggaggaagaagagagggagaggagagaggagaaggaaaggaagcagagggaggaggaagagagggcgaggagagagaaggaaaggaaggagagggaggaggaagaagcagcgaggagggagcaagaagaggaagaagaaaggaggagaagggaggaggaagaa

SEQ ID NO: 69741 - DNA, 441 bp, Triticum aestivum
  unsure (1)..(441): unsure at all n locations
  Clone ID: PAT_TA_69741
caagtgactctctctcacaagacagagaaagattaccgattcatccaatccaatttgatnagaagtgagttcattgttgttgtatagcgaaacctttccttgacaaaaccattctcagctaatagaagccgagctatctatccagatcagggttgaacgaagcgaatggaaaagccaaagaaaacttaaatccattgcgattagaaaccagtgactctacagccagggctcgatggcgatgtaagatagaaagaatggggagttagggcttcggtttcctctgtagccagtttcaattctaaatcatttgccgacatgcggactcacttctcttttatgggatgacttttattatccaagttgtctatttacgtgggtgaatcaagtacaacaagtcaggtcagagcttgtggtagaagattgggctctgctacgcagatc

SEQ ID NO: 69742 - DNA, 586 bp, Triticum aestivum
  Clone ID: PAT_TA_69742
caagtacaagtttggcaagacactcggagccggcacctacggcatcgtcagagaagcagagtcaccccaaggaaaatgcgccgtcaagatcatcctgaagaagaacgtcaaaggcaacgaccagatggtctacgatgagctacagatgctccaacgccttcaacacccccacatcgtcaagttcttcgattggttcgagtcaagagacaaatactacattgtgacacaacttgcgactggtggagagctgtttgaccgcatctgcgaaaagggtcgcttcaccgagaaggacgcttctgccaccataagacaagtcttggaagccgtcgactacctccaccagaacgatgtcgtccatcgcgatttgaagcccgagaacctcctttaccttaccaaggccgacgactcgactctcgtgctcgcagacttcggcattgccaaacatctcgacagccccgatggtgtgctcaagaccatggctggatccttcggttacgcagcacccgaagtcatgctcaagaaaggacatagcaagcccgtcgacatgtggtctctcggtgtcatcacctacactctcctctgcggt

SEQ ID NO: 69743 - DNA, 379 bp, Triticum aestivum
  unsure (1)..(379): unsure at all n locations
  Clone ID: PAT_TA_69743
agcgcgccgcctacccgacccccctncagttcgccgccccgctgcacctccccctgccagcgctgngtgtcctngcctcccacctcccgacggtccacacgccctctcctcccacctcctgcgcagtccagtggtccggcgcgcccctgcctcccacctactagcgatcagccgctcctccacctctcacccccgaaaccagccgncaccccgacccagccaccaccgtcggccccaatcccagccacctccgccatcgtgggacctaaccaccaccgcctcccccggatccagcccacctnctcccttntctcgtccccacgacctccgtcgacctnctcgtaactgcgtcaggccagtactctcggctggacctcgt

SEQ ID NO: 69744 - DNA, 928 bp, Triticum aestivum
  unsure (1)..(928): unsure at all n locations
  Clone ID: PAT_TA_69744
atccccacccaatctcgtctccgatcgactccacgctcgtcgaatactcctcccccaccgcctcaagatgcagatctttgtgaagaccctcactggcaagaccatcaccctagaggttgagagctccgacaccatagacaacgtcaaggccaagatccaggacaaggagggcattcccccggaccagcagcgtctcatcttcgctggcaagcagctggaggatggccgtacccttgctgactacaacatccagaaggagtccaccctccaccttgtcctgcgtctgcgtggtggcatgcagatcttcgtgaagaccctcaccggcaagaccatcactcttgaggtggagagctccgacaccatcgacaacgtcaaggccaagatccaggacaaggagggcattcctccggaccagcagcgtctnatcttngctggcaagcagcttgaggatggccgtaccctcgctgactacaacatccagaaggagtccacccttcacctggtgctccgcctgcgtgggtggtatgcagatttttgtgaagaccctcaccggcaagaccatcacccttgaggttgagagctctgacaccatcgacaacgtcaaggccaagatccaggacaaggagggcattcccccggaccagcagcgcctgatctttgctggcaagcagctggaggatggncgtaccctcgccgactacaacatncagaaaggagtccacccttcaccttgtcctgcgcctggggggggggggcatgcaaaatcnttcgngaaanaccctcaccggggaagaccatcactcttggaggttgagaggttccgacaccatcgacaacgtnaagggccaagnatccanggacaagggngggcatttnccccggacaaacagcgccttgatctttttntggcaagcaactgggaggatgg

SEQ ID NO: 69745 - DNA, 636 bp, Triticum aestivum
  Clone ID: PAT_TA_69745
gctcaccctagtgtgccgccgcccccagccctaccggcgcgaacatcaagccacgactcaatctctcgatctcgaccctgagtggcggtcgccaccgccaggcataggcatcgaacggggtgcgacgaatttatttcaaacttcctccatgtcataggcatcgcgttgtcgttgtgggccgccggccgccggacggtcggagcatcccaatctcgcaagaagagcttatggaagggatgaccttaaacggccgtcgacacattctaccccccggtcaagctggttgcgatgaacaagggctggtcctccaccaattctgctgcaagcagttgcttgccctgttcagcgtcaagaattaacaaccaggactttgaaggatggatgacggtgcttattatgtggtagaaatcaaatatcgaaaggagaatataatgttatcgaagtcgaggggagagacatatgggctgggagttctggatttgatgtcatcacactgatcaattccaccgtgctagatgaaaatcccgtcgtcatcgatgcctcgttcgccgtgtgtgctggcccttacctccgcactggcatatggtagtttcttccttcctgatgttcaattgataagcatgatcatgttgtgtc

SEQ ID NO: 69746 - DNA, 562 bp, Triticum aestivum
  unsure (1)..(562): unsure at all n locations
  Clone ID: PAT_TA_69746
ggcggtggctcggcgagtacgcagctcaagnaaggcctacggcagcgcgctctactgggtgtcgccgacggtgatctccgccgtggtcttggcgggcacggccgcggtccagagcgcgcccctggacgccggcgtggtgttcaccgtcctcgccaccatgcgcgtcgtgtcggagcccatgaggatgctgcccgaggtgatgtccgtcatgatccaggtcaaggtgtcgctggaccgcatcgggaagttcctcaccgaggacgagttccaagacgacgccgtggacagggcaccggcgtccgacaggagctgcctggacgtgcaccacggcgtcttcagctgggagcccagcaagggcaccgcaaccctgaaagacatcaacatcaccgccacgcacgggcagaagatcgccgtctgcgggcctgtcggcgccggaaaatcgtcgttgctgtgcgcgacgctcggcgagatcccaagaatgtccggatcagtggccgtgagtggctcggtggcctatgtgtcccagacgtcgtggatccagagcggcacggtgcgcgacaac

SEQ ID NO: 69747 - DNA, 134 bp, Triticum aestivum
  unsure (1)..(134): unsure at all n locations
  Clone ID: PAT_TA_69747
gggttttnagtcttcttncacacgcccatgtaatttcctttgaaaattcatttgtatgttacttgtgctacgagatgcgtaccgcatgtgtacagattgatcgcaattggcagttacaagattcaaaaaaaaaa

SEQ ID NO: 69748 - DNA, 622 bp, Triticum aestivum
  unsure (1)..(622): unsure at all n locations
  Clone ID: PAT_TA_69748
gctcaaacttatnatacaaagtaacatatatcgctacattggtatacttcttgaaggccgtgaacggtttgaagaggaagttttagctgatagaagaaaactctgccaacacgatccttctagctctgggcgtcctgagtcggggttctgtgatgaagaagttactgagtactccattgtcccacgcttgaaagcattttcagattggattctaaaggccatggctttgggtaatcttgaagacattttccctgcagctagtcgtgaatatgcgccgctggttgaggaactatggaaagatcctgctattcaagctacatatagacgaagaaatgaactgccgttccttccgtctgctgccagttacttcctggacagggtggttgatatttctcgaacggaatatgagctctgtgatatcgatatcctctatgctgatggaataacatcctcggatggattagcatctacagatatctctttcccgcagctggctttggatgtgcgggntgctgatgagcttgatccacaagacacgttgctaaggtaccagctgatcagaataaacaataaaggattgcgggagaacagcaaatggctgcagatgttcgatgatgncagc

SEQ ID NO: 69749 - DNA, 170 bp, Triticum aestivum
  unsure (1)..(170): unsure at all n locations
  Clone ID: PAT_TA_69749
tgcttgctctttcaagtcactttggtggnggatgaggagcgggggcgttgcanatacttgaagtctgcagatcgagtncgngcatatcancagnngattccatggnggagcgacggngccctcgantggctgncggnctncgctggntcnctgcttnttctggccgaang

SEQ ID NO: 69750 - DNA, 608 bp, Triticum aestivum
  Clone ID: PAT_TA_69750
attgcagctcttgctgccgttgcaggtgctcaatccaccacctccatcgatatcgatgcaatttctgttgccattcccaccagtgtgttcgttctccccgtcgtctacgtgactgccgagaacgcacctactttgaccgccaccactctcgcaactactgcaactccttcatctgaccccaaggccacagccgtcttcgactcagctgccgatgtcaccgccgccatcgtgtccgcttccgaggctgcagctgcttctgccactgcctccgtcgagaagcgcgatggaacctgtattcagcagcctctgggtatcagccacgcttctctgcctgacaccgctgctgcttttgcatcagacgcttggtacggtgtccaggccgttgctgctggcactcccaccggcttcgttcagaccttcagcaacttgactgcttccaactccgctgatgcttacatgggtttcactctcttgagctcctacgatgttcctacttgcggtgctaagtgctctgccatttctggctgcaacagcttcaacatctacttcgagagagaccctcagtacgacccctctgttgcggcttgcaacaaccctgccagcactgt

SEQ ID NO: 69751 - DNA, 569 bp, Triticum aestivum
  Clone ID: PAT_TA_69751
gtgctccctggccgccccgccctccctcaccgactcaccgtccccctcgctggcctctggcctccctctgctgcttgttattcgagaccaggccagaggcgtcggggcacctcccggcggcggagcttcggggtcgtctcggcggtgggcggagcaagcctcccacctcgggccttgcaagcagcggtgttggacgaaggcggcggccggagctcggacgccgagggggcggtgatttgaggcgactggaagtagcggacgggttgcgccaacaccagcagcagcagcagcagcagcagcagggcctcctccaccactttgatccagacttcctggtcgaggtcctgttgttccaccgtccaagaattggtatcgcaaatggaggaagagcctacagaggcaccactttacatccatatcgagactaatgatttttcatacagaaggcacaagcggcagaaggaggaggacatagctgtatgcgagtgtcagtatgatttgatggatccagatagcgcatgtggagagaggtgctggaatgtctcgactaacacagagtgcacgcctgg

SEQ ID NO: 69752 - DNA, 640 bp, Triticum aestivum
  Clone ID: PAT_TA_69752
gcacgctgctcatcgagggcaccttcgaggagcttaccgacgagttcgcacaatacattgacagcctcaaaaaatcccagggcgatgagagcgccaacctccagggcgagagcgcagacctgctcaaggagaacaagaaggacgatgttctcaagaagctcgtcgtcggtagccaagcgctgaaccaggcgccagagaaggaattcattgcggcatacaacctgcttatccacctcgtaaaccagtcaccgaatgtgtccgtgttcatccccaagatgtgccagaaccttagcacacctatctcttcgtcgcctcagaacggtggtggtctggctctctccatcctcagcaccatcttcaacaccacccagccggaaagcgaaacgcgctaccacgtgctcctcgccattctccgtgtcattcgcgctacatcaaatttcgagacgctacgaccacaactgaagcagctcgacagctggatagctgcatggcagactggggaggagaatgcgcgcaagctttaccttgctgttagcgacgtcgcatcggacgctggcgaggacgagcaggcatacacatatttgctacgcgcgcttaggacgttcccttcagaacaagcatcgtccccagaggctcgtga

SEQ ID NO: 69753 - DNA, 628 bp, Triticum aestivum
  Clone ID: PAT_TA_69753
gggaaaatccggttccaaggttccggtccggtgtgacgacgacaacgacgatgagagtctccacgaagtcgtcatggaatccggcgagaagaagacgaagaaggtcaaaccgccaaaaatcacatcccgtctgagtcgcctcggaatccacacacgtggaatcaagttcaagtcgctcgagcaacccgaagcatgcatgccgaaccacatcttctcgttgtcagaaaaggcagcgctcgcaatccaacggacaatgccaaaagctcttttcacgcacaacaaggacttcctcatgcgaacctacccccacggaatgcgattcgactcttccaacttcgatcccgtcatcttctggcgagcaggcgtgcaggtcgttgcactgaactggcaatcctgggatgcaggcatgatcctcaacgaaggcatgtttgcgggatctgacggttacattctcaaaccaaaaggttaccgtcgcgagaatccgcaagattcaatccctgctcgtgaagcgagcgcaggatcggacattgtcagcaagaggctggacaggctagccatcaccatatatgcagcacagaaccttcctctgtatcaacaaggcgacgacccggcgagctatgccccgtac

SEQ ID NO: 69754 - DNA, 537 bp, Triticum aestivum
  unsure (1)..(537): unsure at all n locations
  Clone ID: PAT_TA_69754
gccatggccggggnaagacgagggccgtagccccacggnactacggccgccgcgcgcacatcttcgaggagagctcccgggtgttccgggccctcaaggagcgccgtgacggggacggcggtgccaagcccggtgctgccgcgacgcgccacggctgaaacgaacacgccccactccctcagaggacacgtcgctcccataacttcctaacatcacgtttttctcatgtattactatgtatctaggccgatcactgtatggaggtttctttcacgccatcgatctggtagaatgaatatcatctctgaaaaagatggacgcgatcaactgtacacgccgaggaagctgctcaatagtacacggtacaccaagcgtgagttagatagcctaccgaactcaaaactctcgctatgcgtgtacagtgttgcataattttgcctccgtctcggaaagaaacgagacactccaatagcatcgcctctttgcctctcaatgctttatgaaaatgaaaaagatcaccgtaatgcanaanaaaaa

SEQ ID NO: 69755 - DNA, 434 bp, Triticum aestivum
  unsure (1)..(434): unsure at all n locations
  Clone ID: PAT_TA_69755
cgtgtccttctcgttccccgtgccgcgggtgtccttcaccaggggccccgtcgcgtcgccgtcgtccaacgccaagctccggnagctgcgacgtgtacattggctaccacaacaacggcaacctcggcaggttctgcaagtggctcaaggcggagctggagctgcagggcatcgcctccttcgtggctgaccgggcgaagtactccgacacccagattcacgagattgctgaccggattatttgctccgtggcgttcggcgttgtggtggtcaccatgtcaagcttcctcaaccccttcagcctcgaggagatcaggttctttgctcagaagaagaacctcatccctattctgttcgacaccgagccgtcggagattgccgggctgtttgatggcaagttggaggacaaggaagggaaggaagcatttgaaggg

SEQ ID NO: 69756 - DNA, 653 bp, Triticum aestivum
  unsure (1)..(653): unsure at all n locations
  Clone ID: PAT_TA_69756
tgaattacgctcgccaaacactgnaaagnagtccccagcttccaagnaaattctgcaaggcaccatgggatccaacaaggaagaaatcaacgtcgacgttctcgtcatcggtgctggtcctaccggtctgggagcagcaaagcgcctcaaccagattgatggcccctcatggatgattgtcgactccaacccgatccccggtggcctggcctccaccgacaccacgcctgagggcttcctctacgatgtcggtggccatgtcatcttctcccactacaagtacttcgacgacgttatcgacgaggcgctccccaaggaggacgactggttcacacaccagcgcatctcctacgtccgctgcaagacccagtgggttccctaccccttccagaacaacttgtccatgctgggaaaggacgaccaggccaagtgcgtggacggcctcatcgacgctgccctcgaggcccgcgttgccaacacgaagcccaaggacttcgacgggtggatcctgcgacagatgggtgtcggtatcgccgacctcttcatgaggccttacaactacaaggtctgggccgtgccaaccaccaagatgcagtgtgcatggctcggtgagcgcgttgcggcacccaacgtcaagggtgtcatcaacaaca

SEQ ID NO: 69757 - DNA, 269 bp, Triticum aestivum
  unsure (1)..(269): unsure at all n locations
  Clone ID: PAT_TA_69757
ctcgcccgcccgcgccgccgccgccgcctccttccgcaggnactccctccccgcagcgcgatggtgtacatcaagnaaccagnaagacaagggcgtactccaagcgtttccaagtcaagttcaagagaaggcgccaggggaagaccgactacagggccaggctgaggctcacaaaccaggacaagaacaaatacaatacccccaagtaccgttttgttgtgcgatttaccaacaaggatgtcactgcacaaattgtgtatgctaccatt

SEQ ID NO: 69758 - DNA, 237 bp, Triticum aestivum
  unsure (1)..(237): unsure at all n locations
  Clone ID: PAT_TA_69758
caccaccggtccaccgncgcggccaggccggcgtggcggcgcgccaccgcgccaacagcaccccccancactagctgctactccaccacttcaccatcgccatccatccgtccatcacccagcgccaccgctgcaccatccaccatcagcgccgccacctgaaccccgaaccaccagcaacccacgccggcgccatccaccacttccactcttccctcttgcttcgcccctgctgct

SEQ ID NO: 69759 - DNA, 173 bp, Triticum aestivum
  unsure (1)..(173): unsure at all n locations
  Clone ID: PAT_TA_69759
tctgcggcgtcgaacagcatggtctccgccgtcgccgtcgccccgtgtancggcaaacgacgacgaccggcgtagtacgtgttcacgtagttgttcgttagcctaagggtatattagtagggcttaatcagtggacactgcactcaataatgccacttcaaacaaaaaaaaaa

SEQ ID NO: 69760 - DNA, 599 bp, Triticum aestivum
  Clone ID: PAT_TA_69760
tgcgcgaacttgctgctggtggccgtaccggtaacatgctctacgactggttcatcggacgtgagctgaacccccgtatcaacctgcccatctttggcgaggtagacatcaaggcttggtgcgagcttcgcccgggtatgcttggttggatcattctcgacctcgcttttatcatgcagcaataccgcaattttggccgcgtcactgacagcattattattgtcaccgtcgcccacactgtttacactttcgatgcgctgtacatggaacccgctatccttaccaccatcgaccttatcgctgacggcttcggtatgatgctttcctttggcgatcttgtttgggtccctttcacatactctatccagactcgctacctatccatctacccagttgatcttggccccatgggagttgttggcgtgctggccgtccagggtattggctactacattttccgctcagtcaacaacgagaagaatcgtttcaggaccaaccccgaggacccgcgtgtcaagcacctcaagtacatcgagactgctgctggttcgagacttcttgtcagtggctggtggggtatggcgcgtcacatcaactac

SEQ ID NO: 69761 - DNA, 590 bp, Triticum aestivum
  unsure (1)..(590): unsure at all n locations
  Clone ID: PAT_TA_69761
ggcacgaggggcacagnanagnagaagcgaggcggggcggcggagtggctcgagtcgtcttccgctcctcctcgtcctcctcccacgcgcaacggatcgggggattcggccgcttctaccggcgttgcctggtagaatggattctccggcgcccaatgccgccaacccgccgccggcggcggctgagccagcaacgcagccgcggcggctgccagacttcctccagtcggtgcggctcaagtacgtgaagctggggtaccaccacctcatctcccacggcacgtacctgctgctgtcgccgctcatggccctggtggccgtgcagctctccaccgtgtccccgggcgacctcgccgacctgtgggagcagctccggttcaacctcgtctccgtgctcgtctgctccaccctcctcgtcttcctctccaccgtctacttcctcacccgcccccgccccgtctacctcgtcgacttcgcctgctacaagccggagccggagcgccggtgcacgcgccagaccttcatgcgctgctccgaggccaccgggtccttcaccgacgccaacctcgacttccagcgcaagatcctcg

SEQ ID NO: 69762 - DNA, 193 bp, Triticum aestivum
  unsure (1)..(193): unsure at all n locations
  Clone ID: PAT_TA_69762
gaggaggagcacangcnagccggccgccnctgagggncgggcgcacgaaggagtaccgcatgggcagggacacgcagctactcgccgccgagggctcgccggagagccncttcgatcnctgnggcgaccggaccgagggctcgcagctgnagcgctccggcgaacngtcggngcacanganccgggncgaggg

SEQ ID NO: 69763 - DNA, 640 bp, Triticum aestivum
  unsure (1)..(640): unsure at all n locations
  Clone ID: PAT_TA_69763
gnaattcggcacgaggaaagatnacacttttggcagaagggactttgattctacttatctctcagattctgatctttcagatactttctctggattgaggctgtctaatagggcatcatttgatgaaaggagtcatgagaaagagctgctggatgaaatgcttatgcatcgcagatatttcaactctaatatggctgatgatagccggcttccttcagctggtaatgcttttcactcacctaggtccaagcacatggattttcgcccgacacgtcgaaattgtttacgtaggcagaacagttcaattgatgcccccaatgtcccaaggatgaatcaccatcacatggataattttgatcaactgtcttttgctggaaggctaactttgatgcagtcaggcaatttgcgtggggaggccaattatctccgtgatgcagctacaacaaatatgataaaccccttgagcagtagaaacaacaccattacagacttggatctggctaggaatcgtagggcataccttgaggatcagtttgcccggcagtgtctgcagaatgaaagtagttatgtaccaaaatctggtctctcttatagtggtaacaggctctatcatgatgagccttgtttcccctcttcaagg

SEQ ID NO: 69764 - DNA, 330 bp, Triticum aestivum
  unsure (1)..(330): unsure at all n locations
  Clone ID: PAT_TA_69764
ccaacanggncnngaggcccangcctntgcangctgnangcattnccggactncttgnaatntttnaaaacnagtggnatgctnttatgctttntaattntgntttgnagcannancttnacacannangacangaacttantnatgcgttataccancatgatgctgnctgncgngttatanncagatnaaagaangaaagagatgantntanagcactttnggntctanctganagacagattncanngnnnatggcngnagntgcacctgcanntgncnnntncaatggaaaaagancntggangatgaaannggccctgatgggaa

SEQ ID NO: 69765 - DNA, 862 bp, Triticum aestivum
  unsure (1)..(862): unsure at all n locations
  Clone ID: PAT_TA_69765
gaaagcagtgctcaatacaaatccaccatgaagacctttctcatccttgccctccttgctattgtagcaaccaccgccacaattgcagttagagttccagtgccacaattgcagccacaaaatccatctcagcaacaaccacaagagcaagttccattggtacaacaacaacaatttccagggcagcaacaaccatttccaccacaacagccatatccgcagccgcaaccatttccatcacaacaaccatatctgcagctgcaaccatttccgcagccgcaactaccatatccgcagccgcaactaccatatccgcagccgcaactaccatatccgcagccgcaaccatttcgaccacaacaaccatatccacaatcgcaaccacagtattcgcaaccacaacaaccaatttcgcagcagcagcagcaacaacaacaacaacaacaaaaacaacaacaacaacaacaacaacaacagatccttcaacaaattttgcaacaacaactgattccatgcagggatgttgtattgcaacaacacagcatagcgtatggaagctcacaagttttgcaacaaagtacttaccagctggtgcaacaattgtgttgtcagcagctgtggcagatccccgagcagtcgcggtgccaagccatccacaatggtggtcatgctattattctgcacaacaacaacaacaacaacaacaacaacaacaaattcttcaacaaattctgcaacaacaacaactgattcatgcagggtgtcatcgtcttgcaacaacacaacatagcgcatgaaagctcacaggtntgnagcaaagtagttaccaggngttgcacaattatgttggcagcagctgngg

SEQ ID NO: 69766 - DNA, 614 bp, Triticum aestivum
  Clone ID: PAT_TA_69766
ggaacctctacatctccggcatgaagctcacctccgccaccttcgcctccgccatgaccaacctcatcccggccatcaccttcgtgctcgccgtgctcttccgctacgagcgcctcgccatccgcactctcgccggcctggccaaggtcactggcacgctgctcggcgtcggcggcgccatgctgctcaccttctacaagggcgcccaggtcaccccctggccacccacccacatcaacctcgcagcccagctcgccgcccggcaccaacacgaggaacatgcctcctcctcccttcacccggacagcggcaaccgcgccatgggctgcctgctctgcaccggcagctgcttcttctacgcgctctggctcatcctgcaggcccggctcagccgggagtaccccttccactactccaccacggcgctcatgtgtggcatgagcgcgctccagtccgccgcctttgcgctctgcttcgaccgggacctcatccagtggcgcctctcctccggtgtccgcctactcgccgtcctctacaccggtgtggtcgcctcgggggtcatgctcgtggtgctctcctggtgcgtcaagcgccggggccccctcttcgcgtcc

SEQ ID NO: 69767 - DNA, 603 bp, Triticum aestivum
  Clone ID: PAT_TA_69767
ggacactctcaacagcatggcccagaagtgcccagactccgttatcgtatcctcgggctacagtcaaggagctgctgtcaaccaccgcgctatcgaggagctcgacgctgctgtcatggatcaaatcgctggtgttgttacctacggtgacacacagaagcttcaggaccgcgaccagatccccaacttccccaaggagaaggtcaagatcatctgtcagcctggtgatgccgtctgcctgggtacgctgagcgtcttgcctgctcacttgacatatggtgttagggcgaacgagggtgttgagttcttggtccagcagatcaagggtgcgcaggcaaagatcaaggctaggaatgcgaagcgcgaggctaaagcggccgccgctgttgaggacgctgtcaagcgtgttgctcaggagatggcggtataagtcgagtttttcggtttggatgcgatatctggatacttgtgtggctggatcactttgttcttatccggtcgcgtaggaatctcatggccttttttctttactctctttcacactctttggttatatgtttcacatcttatgaatttatcaaattgggcccaataaaaaaaaaa

SEQ ID NO: 69768 - DNA, 629 bp, Triticum aestivum
  Clone ID: PAT_TA_69768
tgcggcggttcttgccaggggtttgggcagattcggaggaagaagacggggcccggctctgattcgccgtggtatttatgtgccatgaggaagctcttcttctccgagttgacctcctgcaaggagaccaagctccagtccgccacccactcatggctgcccatggacaaaggcaagctctccaagttcactggccactccagctcctcctcctcctcgatagaatctctgatgaaaatgccggagccgccggtcctcccgcacttcaagcctgctgactacgtcgacatattggctcagattcacgaggagctggagtactgccctcctgatgagaagtcgtgcctgtacctgctccagttccaggttttccgcgggcttggagaggccaagctgtcgcgaaggagcctccaggctgcctgggagaaggcgagcacgatacacgagaagctcatattcggggcatggctcaagtacgagaagagaggggaggagccgatatctgaccttcttggctcgtgcggcaagtgctctcaagagttcaagctgctggatttcgtctcacagatctccgccgagtcgcacgggataagctacgatgacgaatctgatgagttccagggctcccc

SEQ ID NO: 69769 - DNA, 281 bp, Triticum aestivum
  Clone ID: PAT_TA_69769
ttcttggtcttcttctatggcgcgggcgcgggtggccctccgtgcatggtggtccggatggggcccaggcggcggtggttggacgactcggcctcgaaagaggagaacccgccgtagctggagcactcggacgagctggacgcggtggtctgcggccccggagccgtgggcgttggcgcgcgcgcctgtagctccgcgcgagagacggcatgtagttgtccgcagaacctcctgctgctgcttctcgcccacgacagtgccgcggtcgacggcctcgaccg

SEQ ID NO: 69770 - DNA, 667 bp, Triticum aestivum
  Clone ID: PAT_TA_69770
gctggtgccttctcctagctcgatgtagagttgccatcagactacagatacaggatttcctcaagttgcgtttcatggcctgcgacatgcagcattccatgcctttctgcaccgtcggcgttcatgccatcgtcggcggccggggcgacggagcaggcactgtcaggcagcaagttgcatccgacccccagcacgtgatgtggttctcaacgactttatatgcggctgatcggcgaggccttcggatgagctgaagttcagggcatgacgacgacatatggggaggcctccggccagtggggccgaacgcgatggtgctgacagtcatggtgacggccagcgcagggcacacacgactctgaggcggcgagcacgaggcaggtggcttgcaggtctaccatgcgcggtgggcgttggcagggctcagtgtgcttgcacgcggaggccgtgagagcacgcctcagcaagctgaggaaccggttgcaggcggatgcgtagatgtgtaggatagacacgacctgttgcgacgcaaggaactcgccgagctccggcaagatcatgccggagagcaacaccatgtggatggccagcatgtccaggttctcgagtctgtccgagctcgccgcgagggggcagagatgctggtctctgcgaggccgggcatgct

SEQ ID NO: 69771 - DNA, 538 bp, Triticum aestivum
  Clone ID: PAT_TA_69771
gcttaatcgccattcacctctagtttaccgccgaccattgtgccctgcgcctacccctgaaaccgtcactcgttccatactacgccaatcaacccgacactccctacggtacccccacgttcaagccaagacaattctcttgcctgaaagcttgatcactccaacactactccctttcgcgacgcgcgcagagtgtatccaagcctggcgctggaccttagctgcgaccgcctagagccgagccgacctactctgtctgcaacatgaagttcacctctgtcatcggcgctcttggcgcctcgaatctactattcacaagcgtaggcgccgttgaactggacatcaactcgccagactccatcaagcaagccgccagggcaatttctgcaaacctgcggtcgtactataccggtgacaatgtaggcgacacaccaggcaatcttccagacccatactactggtgggaatgtggcgccatgtttaatgccctcattgactattggtattacactggagatgatacgtacaacaagatcag

SEQ ID NO: 69772 - DNA, 456 bp, Triticum aestivum
  unsure (1)..(456): unsure at all n locations
  Clone ID: PAT_TA_69772
agcattttaacaataattaaacaactattgttgcattaggaacaatgggnaaagcgcttggcatatgatcaaggtggaaaacatcgaagaaaaccgacgtcagtacagacacttgttgatgtctaccaagacagatatttcggaatatcttggaggaatcattttgtttcatgaaactttgtaccagaaggatgatagcggcaaactactcaaagatctcatggtagaaaaaggcattgccatcggtatcaaggttgacaagggagttgtgaagcttcttggaacaaaagatgagacaacaactcaaggcctcgatggattgggtgatcgttgcgcccaatacaaagctgatgggtgcgactttgctaagtggagatgcgtgctcaagataacggacagtactccttcacagcttgccatcgatgagaatgcaaacgtgctcgcacgatatgcttc

SEQ ID NO: 69773 - DNA, 595 bp, Triticum aestivum
  Clone ID: PAT_TA_69773
gcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagccgctggagagctttccgcggaggagatggaccgcctgatggcggtggtgcacaacccgcgccagttcaagg

SEQ ID NO: 69774 - DNA, 587 bp, Triticum aestivum
  Clone ID: PAT_TA_69774
tccctgttatccccagttacactcacaaccttcagtaactctgttgcatcattccgtaaagaaagggaatatattgacccatttccagcacaagatgatattcgctcaaacgtgacagaaaccaagtttgtggaatcatagtaggtgcgcgtgtgtacctctagttcaataggtataacaacaatgtccactttatcagttgtgtgattgcgcagtttcatgtagatagcaccaaacaccttgccttctgaaataggttgcaatttcaactctatcacagtgctgctttctgaaggaagcacctcccattgctcactaggcctaatatggatcactggccatccaaattcagtactgcttgctgtatgccagttgctgctcaaagaagttaactccactgcctcatccaaagggcctaactgacaaactacatgagaagattgttttgtgctttcagaagcagacatccaaacggccacttcctcgacatagagagaatcatcaaaagggttgtatatggacaaattcttctccaggtgtccacctattacaacatccatcctggtcaatggaagtatctggtacgg

SEQ ID NO: 69775 - DNA, 682 bp, Triticum aestivum
  unsure (1)..(682): unsure at all n locations
  Clone ID: PAT_TA_69775
gcttncgtnctctcggttcggctcgtcaaggagctggttacgctttgttccaacccatcgctgacaacgcccgatatctcattcgccgggaggcatttgtcagcggctgagttccactcggtgcttcagactgtgggaactggttcggatactgaggcgcctgcggggcagaatgatgtggttgttttggatgcaaggaatctgtatgagacgcggatcggcaagtttcatgtaccaaatgtggagacgctgcatcctgagatcagacaatacagtgacttgccattgtggatagatgagcatactgagaagctacgtggtaaatcaattatgatgtactgcacaggaggtatacggtgtgagatggcctcagcttatatccgctccaaaggtgaaggctttgagaatgtttttcaattatacggtggcattcaaagatatttggagcaatatcccgatggtggctattttgatggaaagaattttgtattcgaccatagaatctctgtgggaagcaataaagataacatacttggaacttgtttgatatgtggatctacctatgatgactattcctctcggtgtcgttgcagcaattgcagaatgttggtcttagtgtgctccacatgtcaggattctaataaggagtatgtatgtgaactatgtctaaagaatggaaaac

SEQ ID NO: 69776 - DNA, 190 bp, Triticum aestivum
  Clone ID: PAT_TA_69776
tgagcagagccgttgtggttgtagtacgtgcacgtggtccacgcccaacaacaattgttgtttttgctgttgtcctcgtcgttatcttttcttcttcttaagaaaaacttgttgttgctccgtgaataagcgcttgtatcagtttatgcgttgctgctcaatcaaataaaacatttgtttaaaaaaaaaa

SEQ ID NO: 69777 - DNA, 672 bp, Triticum aestivum
  unsure (1)..(672): unsure at all n locations
  Clone ID: PAT_TA_69777
cagcagctcggacaaggacaacaagggtactacccaacttctctgcaacagtcgggacaagggcaaccagggtactacccaacttctctgcagcagctaggacaagggcaatcagggtactacccaacttctccgcancaaccaggacaagggcagcagccaggacaattgcaacaaccagcacaagggcatgcaaccagaacaagggcaacaaggtcagcagncaggacaagggcaacaaggtncagcanccaggtacaagggcagcaaccggttacaagggcanccagggtactacccaacttatncgcatcagtcaggacaagggcatccagggtnntacccaacttattcgcaacagccaacncaanngcagcaaccaggtcaagggcancaaggtcancangtaggacaagggcaacaagctcatcaancaggtcaagggcatcaaccgngacaagggcagccagggtactacncaacttatgcgctgcaagcnngacaagggcancnagggtactacctaacttctgcgcancaagcaggacaagggcatcangcaggtacaantgcatcaancagcacaagggcaaaaagganancaaccaggacaaggncaataagccaggacaagggcaaacaaggtcagcangcaggncaagggcancaagg

SEQ ID NO: 69778 - DNA, 369 bp, Triticum aestivum
  Clone ID: PAT_TA_69778
aaagcgagtctttgctggaggtccttctttacgaacttgtctactcaaaaaaacaattcaacaaacctaatccactcaacatgcctagcgtatcaaccatcctcaagggcctagttgccctggcgcctctcgtggctgccgctcccgcaaactacgcccgtcaagagtcggcttccaagtcgagctcaatggtcatgtcgtctgctacccccgcggcggcagccattaccgaaaccgcaggagaggccgcctctcctgctgctgctgcaccggcggcagcagcaacattgagcgatgttgacatcctcaacttcgctttgactgccgagcatctcgaatcggaatactacaagcagggtttcgccaagt

SEQ ID NO: 69779 - DNA, 468 bp, Triticum aestivum
  unsure (1)..(468): unsure at all n locations
  Clone ID: PAT_TA_69779
cgcggccngttcgtctgcgagttgccggcgagttcttgacgacagaagaagcccggaggaggcataggctgtatgacgagcttgcctcggttggtaagctctctcctgcactccttgtcatacgagagcaccttccttctgggagagtatgcatgcgagttaacatcgatgcaacaaaagtgggaaacgtggctcgtttcatcaaccattcatgtgatggaggcaacctgcgccctatcttagtgaggagctccggctcgttgctcccaaggctctgcctttttgctgccagagatatagtggacggggaagagctcgccttcagttacggggatgctaaacccaatcctaagggcttaccgtgcttctgtgaaagctcgtgttgccctggtgtattacctgcagaagaaacctaagttcgtgtcatcggttgtaattccttccgggcaaatttggttatgcgctgnt

SEQ ID NO: 69780 - DNA, 594 bp, Triticum aestivum
  unsure (1)..(594): unsure at all n locations
  Clone ID: PAT_TA_69780
gaggaattcggcacgaggagnaatcgagaagctgaggagatcttcgttgtacccacgcaaaagttgaaagagatcaccgatcacttcgtcaaggagcttgagaagggtttgtcggaggaaggaggatccatccccatgaacccaacatggtgtatggctttccctgacggtcacgagaccggccgatacctcgctcttgatatgggaggtaccaatctgcgtgtctgtgaggtcactctcaccgaggagaaaggcgagttcgagatcatccagtcgaagtaccgtatgccagaggagctgaagactggaactgcggatgagctctggggctatgtggccgactgcctccagcagttcgtcgagtaccaccacgaagatgaagagctcgaggacctgccccttggtttcaccttctcctaccccgcgacacaggagtacattgaccacggtgttctccagaggtggacaaagggtttcgacatcgatggcgtcgagggtcacgacgttgtcccacccttcaacaaggcattggctgagcgaggtgtgcccattaaattggcggctctggttaacgacacaactggtactatgatt

SEQ ID NO: 69781 - DNA, 921 bp, Triticum aestivum
  unsure (1)..(921): unsure at all n locations
  Clone ID: PAT_TA_69781
gcaatctcgtctccgatcgaccccaggctcgtcgaatcctcctcccccgccgcctcaagatgcagatctttgtgaagaccctcaccggcaagaccatcaccctcgaggttgagagctccgacaccatcgacaacgtcaaggccaagatccaggacaaggagggcattcccccggaccagcagcgccttatctttgctggcaagcagctggaggatggccgcacccttgctgactacaacatccagaaggagtccaccctccaccttgtcctgcggctgcgtggtggcatgcagatcttcgtcaagaccctcactggcaagaccatcacccttgaggttgagagctccgacaccattgacaacgtcaaggccaagatccaggacaaggagggcattcctccggaccagcagcgcctcatctttgctggcaagcagctggaggatggtcgcaccctcgctgactacaacatccagaaggagtccaccctccaccttgtatctgcgtctgcgtggtggcatgcagatcttcgtgaagaccctcaccggcaagaccgtcacacttgaggtggagtcgtctgacaccattgacaatgtcaaggccaagatccaggacaaggagggcattcccccgggaccagcagcgccttatctttgctggcaagcagctggaggatggccgtaccctttgctgactacaacatccagaaggagtccacccttcaccttgnccttcgncttccggggaggcatgcagatcttcgtcaagaccctcacccggcaagaccatttacgcctgaggggggagtctttntgacaccatcgacaacgtcnanggccaagnntccanggacaagganggcatntcccccggaccagnagngnccttntttcncaggcanncanntggaggaaggccccnccc

SEQ ID NO: 69782 - DNA, 591 bp, Triticum aestivum
  unsure (1)..(591): unsure at all n locations
  Clone ID: PAT_TA_69782
ttcggcacgagggcttctcctccgctccccgccccgcctcgngcagctcagggnacgcgcacagccatggcgacggagaccgagaccttcgccttccaggccgagatcaaccagctcctctcgctcatcatcaacaccttctactccaacaaggagatcttcctccgcgagctcatctccaactcctccgaggccctcgccgccggcgccgacgtgtccatgattgggcagttcggtgtcggtttctactccgcctacctcgtcgccgagagggttgtcgtcaccaccaagcacaacgacgacgagcagtacgtgtgggagtcccaggccggtggctccttcaccgtcactcgtgatacgtctggggagcagctcggcaggggtaccaagatggtcctctacctcaaggacgaccagatggaataccttgaggagcgccgcatcaaggatctagttaagaagcactctgagtttatcagctaccccatctccctgtggactgagaagaccaccgagaaggaaatttctgatgatgaagatgaggaggagaagaaggatactgaggagggcaaggttgaggatgttgatgag

SEQ ID NO: 69783 - DNA, 636 bp, Triticum aestivum
  unsure (1)..(636): unsure at all n locations
  Clone ID: PAT_TA_69783
ggnctgcaggnaattcggcacgaggcaacaacgnacaattttcacagcaacagcagccaccatattcgcagcaacaacagccaccatattcgcagcaacaacaaccaccattttcgcagcaacagcaaccaccattttcgcagcaacaacaaccaccatttttgcagcaacaacaacaaccaccatttacacagcaacaacaaccatcgttttcacaacagccaccaatttcacagcagcagcagcagcaacaacaacaacaacaaccatttacacagcaacaacaaccaccattttcacaacagccaccaatttcacagcagcaacaaccaccattttcgcagcaacaacaaccaccattttcacagcaacaacaaataccagttattcatccatctgttttgcagcagctaaacccatgcaaggtattcctccagcagcagtgcatccctgtggcaatgcagcgatgtcttgctaggtcacaaatgttgcagcagagcatttgccatgtgatgcagcaacaatgttgccagcagttgcggcaaatccccgagcaatcccgccatgagtcaatccgtgctatcatctactctatcatcctgcagcagcagcagcagcaacaacaacaacaacaac

SEQ ID NO: 69784 - DNA, 127 bp, Triticum aestivum
  Clone ID: PAT_TA_69784
acgaggcctccgacccaccatcgccagggtagtagcgcaaatggaggacaccttcatcacggtctgcctcgccgtagctctcgtttcgctgctcatcatgattgcgggccgccggcgctggggggcg

SEQ ID NO: 69785 - DNA, 568 bp, Triticum aestivum
  Clone ID: PAT_TA_69785
gaggtcctcagcctttatataatctgtcttctgatttgaactgctctgttctaagaacgttaattaaaaaaatcccgattttaatccccatatgatttgattccccatcatggcgtcaattgctcggcgcattggacgttatgctcatcggctacaaaaaaacttgccagcagtttgttcgagggtcgttggccccattactacatcgaaaagaacagcctattggtatcccaactatgaatatctcaaggactttgagaacatggaagttcctacagcatcagatccagcaccaaagactgatctcctgcaagatatttctgatcccgcagagggtgcaagcaaacttgatacactgacgataaatttcggtcctcagcatcctgctgcacacggagtgttaagacttattctggaacttgcaggcgagatggtcatccgagctgatccgcatattggacttctgcacaggggaaccgagaagcttatagaatataagacttacacccaggctctgccatatttcgatcgcttggattatgtatcgatgatgattaacgaacaggca

SEQ ID NO: 69786 - DNA, 503 bp, Triticum aestivum
  unsure (1)..(503): unsure at all n locations
  Clone ID: PAT_TA_69786
caaggactggtatatgagaatttgtgaccncgtactattgaagtgcaaatcaaactggcgacacatggacgatggagtgtaggtacaagtcgttcttcctccggacggtgatgcccatatcctccaccatgtcgacctcacctggcttcagccccgacgggagctcccagtcgaagtggtagagaagtgcggcgagaacaatctccatgctggcctgtgcaaatgtcatgccaggacacatccttctccccgccccaaacggtatgtactcgaagtccgtgcctttaaagtcgatgatgccagactcgaacctctctggcttaaattcctcggggttgtcccagtgcttagggtccctaccgatcgcccacgcattcacaagcacggttgtgcccttttgcacgtcatacccgaggattttacaggattccatggcctcccgtggaataagcagcggagctggtggatgcagcctcaaggtctccttgatgacaagtctgagg

SEQ ID NO: 69787 - DNA, 637 bp, Triticum aestivum
  Clone ID: PAT_TA_69787
aaacactgggagtgcccatggtacaaactctcaactctcagatacacagatactgatctcctccagaggagtaccagcaagccagcaggagagagttcttattcatattcagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcaggcagggtctcaccaagctgtcaacgtggccgcagtcgatggccacggcagcgcgcgggaccgccgcgagcatcagcaccaaggcgacggccatgagcattacctgagcgcgggccatgatcacttcttggtctgtagctaacagtgcaccgtattagctagtgatgattgggtggagagatgagc

SEQ ID NO: 69788 - DNA, 660 bp, Triticum aestivum
  unsure (1)..(660): unsure at all n locations
  Clone ID: PAT_TA_69788
cgagttgtatgtattaaagtcntaaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggccgcagtcgatggccacggcagcgcgcgggaccgccgcgagcatgagcaccaaggcgacggccatgagcattacctgagcgcgggccatgatcacttcttggtctgtagctaacagtgcaccgtattagctagtgatgattgggtggagagatgagc

SEQ ID NO: 69789 - DNA, 653 bp, Triticum aestivum
  unsure (1)..(653): unsure at all n locations
  Clone ID: PAT_TA_69789
acccctttcnttagtttttnatnacgaaaatacagcagtttttgtagccaatatgtctagcagtacaaccaccacacctaacataacgaagcaaaacgcccagagcgcagatgaaaccgaaaggggagagcgagttggcgcatcgtcagaaaacccaccgcaggatgattctggaacgaaccatccgccatgggacgaaaacctgacgacacaaacatccacagctcaactatgaatccaaaaagtcccaggacaattcaagctggaacattactgtaactaaacggagaataactaggagacaaaagacccagcgggcatccacccccagtgggagatgactaagcaaaagacgcagaacttcatcatccaatctggatcccctcattgtctcctaagaggagcctgcctcgaggaaacgatctgtccgccagagcagcagccgcatgcgctagcctcttcactccggcctgaagcttctccctatcttctcccttaagcagaccttccaaattacgtttcctcattctgtttgccgccacattctccaccctctccagcttctgcttctgtctgtgtgaaacttncttttcaccactcatgcagtcatggattggtgatccagaaggagattcaactgtataaacactaca

SEQ ID NO: 69790 - DNA, 199 bp, Triticum aestivum
  Clone ID: PAT_TA_69790
tatttattgctaattgaaatcctcaaatctaataagcgcggggctctggatccgaaagctgcctgcacgagcgggcagcttaatctgtcactaacttttccactggattcgattcagtacagcacgtaagcaagcgagcatgcattgcatggctgcctgtactctcttggattaattaagtaattaagcaggagccggc

SEQ ID NO: 69791 - DNA, 635 bp, Triticum aestivum
  Clone ID: PAT_TA_69791
aaacactgggagtgcccatggtacaaactctcaactctcagatacacagatactgatctcctccagaggagtaccagcaagccagcaggagagagttcttattcatattcagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcaggcagggtctcaccaagctgtcaacgtggccgcagtcgatggccacggcagcgcgcgggaccgccgcgagcatcagcaccaaggcgacggccatgagcattacctgagcgcgggccatgatcacttcttggtctgtagctaacagtgcaccgtattagctagtgatgattgggtggagagatgc

SEQ ID NO: 69792 - DNA, 546 bp, Triticum aestivum
  unsure (1)..(546): unsure at all n locations
  Clone ID: PAT_TA_69792
cggcgtggaaacttttcgtngnaggggcgatatctgaaaacgccgctctataggacaagtactaatgcaaagaaagtgctaatgccggctccgaccggactctgttgctgaagggtatgtttcgatgtgtaaaagccgctcggattagatggggttgttgctgcgggctcagaaaatctccaatatccaatggcgctgtaggtggcccacatcaattatatcgcgtctttcgaaatcatgcttcgtcatgtgcttcgttaatgacaccgggcttaggtgcgaaacttgaggaaccggagatagagcccatagagccaacacgctcctgtggtggcggttcgtctctcatgcatgcgttctcaagcatgttcgtccattttccactggttccggcatgactatgcttcaagtgttgtctgaagtggtctgcgcggaaaaacttcttggcttggttgcattccccaaacttatgcacatgattcagatgctcagatcgtgcttcccaatccgcaggattggagaactcttcaccgcaataaccgcaaa

SEQ ID NO: 69793 - DNA, 677 bp, Triticum aestivum
  unsure (1)..(677): unsure at all n locations
  Clone ID: PAT_TA_69793
aactgacttccgagtctccnaacattttagagtgatgatcctctgcaaagtacattctgatacccagcaaggaaggaaaatacatatgcattgccctggaatttctgacggaaaccgctagctagccttttaattgcacaccataagaggaagcactttactacatcacaacatcgaagcagcatagggagtcagtttttactatacatcacagcaccgtaactacataaagatcgtccgtggtataacattccggccaagcaatcccaagtattcttctcttttcttttcttctcttctctgatcttatcttctccaggagccggagcatacataccttagttagcgttctgtgacgtaaacatagtgcttccgttgaaagaaacatagtgaatgcaacaatgctcttcttcccatatccagagtgttacttcctctggttcgaagcaagcatggcaatgagctcgttcaaaacagagggatatgtcgtgagaatatgcccccagccattactcgtcatgagtgtctgcagacacgagggagattggacttggataaacttcaagcacgccaccttcaatccgtggcagtgatgctgctcggctagagcaagagtggacgccacagagccgacacacatgcgctgagacaactgctttacacagatgaacttgagc

SEQ ID NO: 69794 - DNA, 134 bp, Triticum aestivum
  unsure (1)..(134): unsure at all n locations
  Clone ID: PAT_TA_69794
gctagcaagaaacactacgccatcatattgnccatcctcgngaagnccgtatagatgcccatagctttcgcanagaactccggtnaccgaatgtanaaaatgccgctttccctttttccccgagagttgtttgc

SEQ ID NO: 69795 - DNA, 322 bp, Triticum aestivum
  unsure (1)..(322): unsure at all n locations
  Clone ID: PAT_TA_69795
gtacatatncaactgcctaatccaaaattttacgtgaacaatccatcacaaggaaaccacccaacgctctgcccctgcctgagggaacttggtacagtagacagacaagacatgcgagaatgcggatcaagcgatcctaccaaatattcacaaacaaacgcgaaggtcatctacaagaaatgcacttcagcgcttagtaggtgccgtagccggaaccgtaaccgctgccagagccgtagctgttgtcaggggtaggggtggcggcaggaggagtgtaagcctcggtggaggaagagacggcagcctcaggggtcttggagga

SEQ ID NO: 69796 - DNA, 302 bp, Triticum aestivum
  unsure (1)..(302): unsure at all n locations
  Clone ID: PAT_TA_69796
cttctccttggcccacccacaatgttactttgcccaccatttcgtgacttcaagaaaagcacacagactgcgacgatagccccaacaaagaaaaacttctgacccattgacagtccatcagcggaaccagtggcaacggccataccagggnagcttgggcttggtggtagaggcctgggtgacctcagcaatgttgacgatatcctccttggatggtgttgccgcagtgatatcgagttcgtcgccaggaatggcaggttcagcagctccgtatagatcttgaagaaagggcacaactatca

SEQ ID NO: 69797 - DNA, 622 bp, Triticum aestivum
  unsure (1)..(622): unsure at all n locations
  Clone ID: PAT_TA_69797
attgtgttagccgttgtggttggngcactgcaaacattcgcgtccgtcatcgtaccacgctgtgcgtaagtcgcgcagcgtgggtagctacgtatgatgtgatctgcaacgattggaggctgaactactgctgagtgggatatgcacgtcacgtgggtagtcggcgccgcgcatttaccaattactacgtgtcttgagcttctcgttctgcaccacctcgatccagtagttatcgggatctaggacgaacgcaatgttcttcatgcgaccatcagtgagcctcttcttccagttgaccttcttctcttcgaaacgagcacaggcggcgtccaggtcatcgacagcaatgcagatgtgaccgaatccttgtggctcatcgttaccgttgtggtacttgaattcggcatccttctcagtgccatagttccatgtaagttcaagtaagccttcactgtccgacacagggttgacgccattcgcggtcgtctctggcgcatcgacaccgtatcccaagaagtatagattgaagccagcatttgggctctctgaagtgcgcttgagcttcattcccatgacgtcttgatagaagctgagcgacgcatccttgtccttgacacggatc

SEQ ID NO: 69798 - DNA, 634 bp, Triticum aestivum
  Clone ID: PAT_TA_69798
cactgggagtgcccatggtacaaactctcaactctcagatacacagatactgatctcctccagaggagtaccagcaagccagcaggagagagttcttattcatattcagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcaggcagggtctcaccaagctgtcaacgtggccgcagtcgatggccacggcagcgcgcgggaccgccgcgagcatcagcaccaaggcgacggccatgagcattacctgagcgcgggccatgatcacttcttggtctgtagctaacagtgcaccgtattagctagtgatgattgggtggagagatgagc

SEQ ID NO: 69799 - DNA, 634 bp, Triticum aestivum; identical to SEQ ID NO: 69798
  Clone ID: PAT_TA_69799

SEQ ID NO: 69800 - DNA, 637 bp, Triticum aestivum; identical to SEQ ID NO: 69787
  Clone ID: PAT_TA_69800

SEQ ID NO: 69801 - DNA, 583 bp, Triticum aestivum
  Clone ID: PAT_TA_69801
gcttgcagtttctggtagtattctctctacctaactgatgctatgtatgtacatggaaactactatcctagatttgtgggatgtatttcccttcgtttagtacgtcatgctcgcatatcttcgttatacgggtcagtccaaaccctctacaactcctccttgtcgacaccctcaatagagaccagctcagactcaaagatcaaaacgctgttggcggggatagggccagcacctcgcgagccataggcccactcgggctggattgtgagcttcctcttctcgccagggcacatgtcgagcagaccctggtcccagcccttgatgacctgaccggtaccgacagcgaagttcaagggggaaccgcggttgtatgaggcgtcgaactcgctgccgtctaggagtgtgccgcggtagtggacgttgaccttgtcgccgaccttggtcttgcgcgtgcacttggcttcggtaagaacctcggtcttgaggtgctcgttgttgacgatgtcagcgacggcggccgtagccagagcagcgaggaggacggtaaccttcatcttgacttgtgaataggagtgtagtttga

SEQ ID NO: 69802 - DNA, 660 bp, Triticum aestivum; identical to SEQ ID NO: 69788
  unsure (1)..(660): unsure at all n locations
  Clone ID: PAT_TA_69802

SEQ ID NO: 69803 - DNA, 698 bp, Triticum aestivum
  unsure (1)..(698): unsure at all n locations
  Clone ID: PAT_TA_69803
gatgcattttgtctatgatgatgtgtgaatcattgaccgggcgtgaatattacaccccattaccgcctgagtccttttgcccaagcacgttgcaatgcagtcatctctcgttatcaatcgctacaagaagacctgtatcctcaaaaaaatctataaacccgtgaagaaaatgccgcctcaaccactctagtgctcaagcaatctgagcgaaccctggacgacgacgttctcgaggatggaacccggagggatgtcgatagtggagccctcagtcgcaacgatgatgacggtacccttgagggtaacgccacggccaaggttgaccggaccggtaatggtcagatggtcaagctcgacaatcttgggaatggagggaatacgggactggaagctggacaccttcttgaaatcgctgccgagcttgatcaagggggcgggtccgaagcggttggggtcgatcactagctgaccgtgctggagtgtgtaaagatcagacttgacaagcatgaggtcggagcaggtcttgacgggcaagaaacgctttcggggtacgttgacaccgtgtgcgttcttgaagtgcttgatagcagcaccaacagctgtctcgagctggaggactgagatgtcggcctcgcccttcttgtcggcagggatggacttgccgttggggatgatctncatggcaagctcgttagcct

SEQ ID NO: 69804 - DNA, 332 bp, Triticum aestivum
  unsure (1)..(332): unsure at all n locations
  Clone ID: PAT_TA_69804
tatacacatactcgctttctacagtcgcgcattttgctcctgtgacgctctgctcgctcgccctggttgctcagcccttgtctttggtgaaaaattgaaatggangacantgtgaaatcgtcatgctggtgaaggcatctatgagggctggataacggagggaccggcaaggacctcggcgtcggcaacggactcgctcttggtgatcatcatgtagacttcaccctggaggccctggggaaccatgcagttgccgtcggcgatcttggtaaactggttgccgccaggtccgacgaaagcgcagaaagaggcaccggctggctgagcggngt

SEQ ID NO: 69805 - DNA, 615 bp, Triticum aestivum
  Clone ID: PAT_TA_69805
gcaactattagaggcttatgcgcctcgcggcttctgtcctgccatcttcatcatagcctcgcggtcctggatacctgcaagctggccttccttcacacgcttgatggtaagagcagcaatcagggcagcaccgacaccggaaccatcctcggcgggaaggatctcgatgggatcgttcttgcccttgccgtacttggctggccagtccaagatctccttaagtgcttgtgcgttgcggatcttgaaatgggggtacttggtgaagactgagccgtcagcaccaacgtgggtttggtcccagttcttgtgcttgcagatagccgcaacaccgcaagcggtcagacgagcagcacgggtgccgatgagctcggcaagacggcggatgagttcgagctcgggttttgtgcaggtgatgctgagcttgttctggaagaggtcgccggtctcgagcaagttctcaaatgggtcctcctcgatggccgagagaaaccctgcatcgagagagtagggcttctccagcttgctgacgtcttggccctcaaacattgtgcattcgtggcccttgtgaaggtccaaaagaaccagacggaagatctctcccaagtacagtccagc

SEQ ID NO: 69806 - DNA, 226 bp, Triticum aestivum
  unsure (1)..(226): unsure at all n locations
  Clone ID: PAT_TA_69806
gtcctaaaaactcattnttttaaatttgntngccggggctntttttngtaggactaanggtcaccaccatagccgccgccacnacnaccanggccaccaccgtntccgcngccaccacnaaagccacngccacnatagccgccgccnccncctcnntagccacngccgccacgngngaagccgccgccgccgccaccacccganggtcgttcgttggcaaanttca

SEQ ID NO: 69807 - DNA, 660 bp, Triticum aestivum; identical to SEQ ID NO: 69788
  unsure (1)..(660): unsure at all n locations
  Clone ID: PAT_TA_69807

SEQ ID NO: 69808 - DNA, 653 bp, Triticum aestivum
  unsure (1)..(653): unsure at all n locations
  Clone ID: PAT_TA_69808
cgagttgtatgtattaaagtcntaaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggccgcagtcgatggccacggcagcgcgcgggaccgccgcgagcatgagcaccaaggcgacggccatgagcattacctgagcgcgggccatgatcacttcttggtctgtagctaacagtgcaccgtattagctagtgatgattgggtggagc

SEQ ID NO: 69809 - DNA, 658 bp, Triticum aestivum
  unsure (1)..(658): unsure at all n locations
  Clone ID: PAT_TA_69809
cgagttgtatgtattaaagtcntaaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggccgcagtcgatggccacggcagcgcgcgggaccgccgcgagcatgagcaccaaggcgacggccatgagcattacctgagcgcgggccatgatcacttcttggtctgtagctaacagtgcaccgtattagctagtgatgattgggtggagagatgc

SEQ ID NO: 69810 - DNA, 365 bp, Triticum aestivum
  unsure (1)..(365): unsure at all n locations
  Clone ID: PAT_TA_69810
atgttcaagtttgctcttacaatgacctgcctaaagnaatacaagtcctgcttgctgtacctagctatcttctctcccagacaaaagatcaggcggtcaaccttgattgcacgctgggttgcagaagggctgacatccaaggaagattggcccagttctgtgcgtcaggccaaccgatgttttgacacactcgttggccgttgccttgttgatcctgctgatattgatgccatgggaaaagtaaagagctgcctcgtaagtgattcanttcatggattcatcaccaccatcgncagaaaacaacacattgtggagacacgcctgtnacatcacttgnctcgccacttntccatttncaatgatnt

SEQ ID NO: 69811 - DNA, 518 bp, Triticum aestivum
  unsure (1)..(518): unsure at all n locations
  Clone ID: PAT_TA_69811
ctcctctttgtccgtagcttggttntaaaatgttatgcaatggcgctccatggttccctttgtgccgcaccttgttttgtccgagctacagttacattgcagctttggagacgcttgtcccaagatgttgttcagctccgaccaaagtgtgtgatcaaaccagattgccaatcacttgctcaacaggcagtcctcgtcctcggtctgatcacccactcctgtgtgttctatcttctcatccgcaccggatcgcgagcattgcttgcggcggcgataggagcggttgcgtcggagcagagcggcgcgtgaggaacctttcgccgggcgccaaggggcccaatatcgtgagttcagaaaaactcccttcaagactcttcttccatgaagaagtagtttcctccattcttctgttcctggtcgagctgggagtccagcttgttgatacggggacggtatgagttgggatcgcgtctgaaggtaacgtccaagttcttcaagaacttgttgcaaccggtcag

SEQ ID NO: 69812 - DNA, 416 bp, Triticum aestivum
  unsure (1)..(416): unsure at all n locations
  Clone ID: PAT_TA_69812
atagataactcgatggcagacaccagagcactcatttcttcttgatggcagccttggtaaccttggcgccggtggggtccttcttctcaacgcccttgatgacaccaacagcaaccgtttgtctcatgtcacgcacagcgaagcggccaagaggtgggtaggtggcgaaggtctccacaaccatgggcttggtgggaatcatcttcacaataccagcgtcaccgttcttcaggaacttgggcgcagcctcaatctccttaccagatcgcctgtcaatcttggtcaccagctcagcaaacttgacagcaatgtgggaggtgtggcagtccagcactggggcgtagccgttgccgatctgaccagggtggttcatgatgatgacctgagaggtgaagttggctgcctncttggcaggg

SEQ ID NO: 69813 - DNA, 615 bp, Triticum aestivum
  unsure (1)..(615): unsure at all n locations
  Clone ID: PAT_TA_69813
agtgagaatcgctttggagaaacggaaacgtattcctgggaatacgcttcccttacgtgactaagcagaggcggggtcggctcgcgtgacgctgacgtgcgggtcccacggggcggggcccgtcacttatccatgctggcaggcggggtcaacgcgggccggctcctgtgtgactgactggtggggcctgctcacctctctctctctcctcccttctcttcttccttctccatcccgacggtgcgccgaggcagggcgaggccgactggtccggcgaggctcccgggcggctccggccatctcagacgacggcgagggcatcggaggactctgcaggaggtgccgcgcccgtccaggtgcagtaccagcacaggggaggagcaggatggcggaggctcaaggagacaaaggacccggcggcggggccgatctttgagggcggtggcctgaggcattccggcgagaagaagagaggccggggagggtcgccggagtgagcggcttcgggtggtggtggctacgaggagagggagggctcggctagctccaatttangaggaggaggccggcggccatggcggcgatgtcgagccccagagagcttctcgagctcgg

SEQ ID NO: 69814 - DNA, 548 bp, Triticum aestivum
  unsure (1)..(548): unsure at all n locations
  Clone ID: PAT_TA_69814
gttcctgtgaatggattaattggataccccaacctcaagtgtgcacccagcccccaggtaatagaagcaaacacggacacacgcacccaccacgcagcacgcacacaaacacactcagcgtactgcacactgcaccaagccatgcatcacacactgaacacgatacagcggcagcacgcgagccgtgcacgcacgctatgcagcggcagcccgcgcaagcgggaagcatgcgatgcagcgcacgggctggtaggacgcacgacctagagagcgagggtgaggcagccgccatgcgagctctgtgctgaagttcacatggagggagggtgacagagagctggagcgcctcttgcgtcgttttcgacaaagcgccggcagcctggcgtgcatgaggtcgacatggcgaacgcgagctagagccggttggatgggctccaggcgccgacgggttgggcgagctcgaggtcaagaacaccggcctcggcgtcgataaggcagaatgaggtcgctgatatgatagaagcgggggacgacggcaatggcgtnct

SEQ ID NO: 69815 - DNA, 570 bp, Triticum aestivum
  Clone ID: PAT_TA_69815
tatatacggtagaatttatcccatctcctacaagaaacaaacacctctttcaagcaccaaattgtctgtcttaagctgatagatctaatcggatgccctcgttcccaccctgtgcatttaagcaagagcggagcagagaccgttgtaagactccttggcctggaagctgccgtcgaaaagcagaggagtggcagcagcgccgatccaagagtcagtgtcgctaacaccccagacggtaacaccaacacagttctcaacatccaagcaagcagtgacagcagtcttgtagtcagcggcagcaccacccttgatgtcaagctcagtcatggcgcactcggaagcagactcgcagagaagcttgagagcagcggggtagtcggagatgggccagctgccggacaagtgggactgggaaccaataccgtcaatgggaacaccggcggcaacccacttcttgacattgctagccatggccttggtcttagcgtagcttggggctgtcgaggttgtagtcgttgatgtagagcttggcctctgggtcggcggccttggcagtagcgaaagcggtag

SEQ ID NO: 69816 - DNA, 236 bp, Triticum aestivum
  unsure (1)..(236): unsure at all n locations
  Clone ID: PAT_TA_69816
caactgatccgaacgttcttgtgtatacaaacnagaccaaacttattagatattccgggtacgtgccgcaactattattaatctgtggagtggtttctcccggaggacgggtcgcgtttcagctgctccgcgatgccggtggcgaggcagtaggccacggactgtatggtgatcatggggttgacgcccaccgcgctgggcaggacgctgccgtcgcacacgtacagcctctccgc

SEQ ID NO: 69817 - DNA, 652 bp, Triticum aestivum
  unsure (1)..(652): unsure at all n locations
  Clone ID: PAT_TA_69817
tgtgagacttgactgtagctactccttgacctagactttttatcncgaacgcattccggatttacttgagtgaaatagagctgtgtcgctccattgatcaagatatctcggcaacatgagacaatgaatttcatgttctggccgtgggtactattcatattctgactggggccattgttccagaccctgacgcaactccaatccgaccctgcctgtgcccagttcccagacagacctagaccggacctcaaatgaactcttccataggctcctcgctggtggccttgcccagagctgcagtgaagaatacacctgcgtcctcgaagagctcggccttgaccttgggagtggcaggcttctttggcttggtgactctaccgctcttgactggggtcttgatggggctgtcagccaagtccttggtcttctttgacctggaaggagtcgcggtgggagcagaacgatccttagcttcttccttcagctctgcggcaagcctcttgaccttgcggagctggccctcgacggcatcgtaggtagcacccttgccgaagatacgcgctacctcattcatgttgagtccggacgaggaagcgatgacagcagcaagaaggcgctccttcatttctgcctgcgaccactgaatcggcat

SEQ ID NO: 69818 - DNA, 678 bp, Triticum aestivum
  unsure (1)..(678): unsure at all n locations
  Clone ID: PAT_TA_69818
gagagggtggcgtcctaggagcttagttccgccctgtacatagcngtttgcccgccgcctctcgctcggcaccgcttagaataatactagtaatacaatgatcgaaaccacttcaatgtaatccatcaggtagtctgtgatttcatgtcaaggacgaggctgcgccggtctggttctcagctcgacttcttcggcatgcagcagtccccggacgtagaggcgacatggtccgccagtcccttcagttgacagctctgtctgtcagacgtcgacgatggggccgctgcaggcgcggcctcctccttcacctccccgaagctctgggcgtacccgtcgcagagggcggccagctctgtatccttggccgacaggcccggcgggctgtgcgtcgtccagcggatgaacgtcgtgttgtagacgttcgaccactctggatggtggttcttgatcttgcattgcaatgacacggcggtcataaagtcccatgtcttggcgaacgtcttgaacttgaaagaccgctcgatgcccttcccgtctgccgtgagggcccacttgttgtccaggagcccgtccagctctttcgtcaggcgcggctcgtccgagccctcggagaactttggcgatgctgccatggcggctgacctggagaatggccggctggagacgatgggcttcagc

SEQ ID NO: 69819 - DNA, 135 bp, Triticum aestivum
  unsure (1)..(135): unsure at all n locations
  Clone ID: PAT_TA_69819
aaatttgcggtacnacggtttacaagatctgccgagatgcacgtgtaccccatgacaaaaacaagtatacatcaagggcacaagataagcaagggatgctatattctcctgcgaaatgatggttgcactgcaaga

SEQ ID NO: 69820 - DNA, 660 bp, Triticum aestivum; identical to SEQ ID NO: 69788
  unsure (1)..(660): unsure at all n locations
  Clone ID: PAT_TA_69820

SEQ ID NO: 69821 - DNA, 112 bp, Triticum aestivum
  unsure (1)..(112): unsure at all n locations
  Clone ID: PAT_TA_69821
tatgacaatggccgatcgacagccgttcgtaacgcttncgatcttgtngnntgtgacacagacagtaccaaacggaaatngacccaaggaaaatgnggnatcggtattggta

SEQ ID NO: 69822 - DNA, 676 bp, Triticum aestivum
  unsure (1)..(676): unsure at all n locations
  Clone ID: PAT_TA_69822
agtgacgacaaatattatggaaaacttnttgtctaaattgtctgctaatgcaagacattattctgtagcaaaccataccaaaccatgaatcctgctttatttctatcagggtgggcggcattcaagggtagacttcaattatggatcgaaatcctagcattggagtgatcttatagtccctgaatccggcttcaaagaaaatcttcctccactgctgctcgtctcgctcacccccgtcaacacgcatcatttggacatcaaatagaacctgtgtctccctaagaaggacatcatcctgcgacatcccgaagtctatcacgacatcgacgattatcaccttccctacggcacctctactggttattgcttctttgcatcgtcgtagtaccttgacagcatcttcatcctgccacaagcacaaaacccacttgagtagaacaacgtctactggtggcacatactcaaacaaatcgccagcaacaaactcaacattggcgatggcaggtgcccccgcgattgcatgtgggaggtcaagcacggtgcacttgatgtgagggaaagccttagcgatggcttccgccgtggcaccatgggcaccgccagcgtcaacgagggagctcacgccctcaaagatgttacggtgatccttgatgatggtctccatgaggaggtggct

SEQ ID NO: 69823 - DNA, 659 bp, Triticum aestivum
  unsure (1)..(659): unsure at all n locations
  Clone ID: PAT_TA_69823
gagttgtatgtattaaagtcntaaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggccgcagtcgatggccacggcagcgcgcgggaccgccgcgagcatgagcaccaaggcgacggccatgagcattacctgagcgcgggccatgatcacttcttggtctgtagctaacagtgcaccgtattagctagtgatgattgggtggagagatgagc

SEQ ID NO: 69824 - DNA, 558 bp, Triticum aestivum
  unsure (1)..(558): unsure at all n locations
  Clone ID: PAT_TA_69824
catatctatgcccctagnacatatattaagattgagctaggatacggtgttaccggaatccagcaagtcgcttcctcgcgacttgcaggagctgcgacgacccttctttctgattggtcgtgttcggagtctcaattatctgatgcaaatatctcctggctcgttcgttgttaccgatggagtcatagtaatccgcaagctgcaacattgaaggtttgtggccgatgacagacgcgacttgttgccactctcgcgccaacgcagcagtactgccttgtctccagcttagcacccagttgagcgcttttcgtatgctgtcgctcttcaaaatagtaggttctactgtcgccacttcttggtagaagtcggtaagatttagtattgcttgttcatggccggatgctgctgctttgctggtatattgcaaccacttctgacttgtcctcggctcaaacgctgcaagctcatagtatgacagtggatcatcgccttcaagagcgcccttttgaaagtaaaacttggcttctgcttgtactttggggtctttgtctgctttga

SEQ ID NO: 69825 - DNA, 668 bp, Triticum aestivum
  Clone ID: PAT_TA_69825
gcagcagcaatagccataagtagcaatacaacagttacagaggacaatacaagacattatatacatgcatacaacattatcagttggagattctgctggttcatctgctcccctgctccttgttatttgtcccaggactcatgcgcttgggatatgatgctgctatcttggtgactggtgagtgtctgctgcccctccctttttttcgggtttagtctgcgcccctttcattttcttgcgcattacattgcatgttttattcttctgaaatgaatttgcgcaaattacgcgcaaagtcattgatatgaaactatatatcaaatgatcaaatacttgtttttgccaatttacctcttgttcatctcagaggcttgtggatcagctccctgtcttgtgatggaaacacaaaatgcattatgcatgagatgactaatttcatcatcagttccgaaggactctgtggagctgagctcccagcgccgtcagtgtaaggggtttctggatcaggccgtttatccccgagtggcggcacatctcacggatgttgtcgtcgacggtcacggcgagagcagcaactataaggagccagcgcctgttcttgagccccctgatctggagtgccacctcaaatgcatccatgtcaaggtccaggaggaggagctggaagg

SEQ ID NO: 69826 - DNA, 738 bp, Triticum aestivum
  Clone ID: PAT_TA_69826
gattctgttgatttcgctcgacttctcgcaggagaagccaagttcaacaaggagaccaggcgattcgccgttccccgcgactttatttgattgtggtcattaaaccataaatcgtgcataccatgccatgccatatcccaccactgagcaaaaaacttgcgcacatgctcagagacgacgaccacggcgaccacccttccttctggtggagtcggatggggtgggggtaacgtcctcgatacgtccaatgcgcatgccagcgcgggcaagagcgcgaagagcggactgggcaccggggccgggggtcttggtgccgttaccaccggtggctcggatcttgacgtggagagcggtgataccgagttccttgcagcgagcagcaacatcctgggctgccaacatggcggcgtagggagagctctcgtcacggtcggccttgaccttcatgccaccagtgacacgggagatggtttcgcggcacgcacctttttctttgtttcggagcggggcgcgtactattaccactacgttccacaccattttctggccttcatgccgagtcttcctccgccgccaactcgacgtcgtcgtaaccaatttcaaccaaacctccatgctcactggtactttgacgtcactataggtaggtctccgtgggtcttgggcaagacgacttcggttcacacgtgaaagtgcttcgaaaggcaccggcttccaatggtgaaattcttgctgaaa

SEQ ID NO: 69827 - DNA, 657 bp, Triticum aestivum
  unsure (1)..(657): unsure at all n locations
  Clone ID: PAT_TA_69827
gagttgtatgtattaaagtcntaaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggccgcagtcgatggccacggcagcgcgcgggaccgccgcgagcatgagcaccaaggcgacggccatgagcattacctgagcgcgggccatgatcacttcttggtctgtagctaacagtgcaccgtattagctagtgatgattgggtggagagatgc

SEQ ID NO: 69828 - DNA, 586 bp, Triticum aestivum
  unsure (1)..(586): unsure at all n locations
  Clone ID: PAT_TA_69828
cagngcgcgcaaatcgcatcgctccatgttctagnatatcgtaaaagttcccgtgccatacacataagctacatccaagnagctttcgttcgtaaatcaaacccagatcagacccagcttctctttcccagagaacgccaaatctataatacatctactcgacagtgaccgacttggccaagttacggggcatgtcaacgttgacaccctcggcaacggccatccagtaggacatgagttgcagaggaacgacgttgatgagaccctggagaacgtcgacgttcttgggcacctcaatcttgtccgtcttgtcggtagggaactcggggtcgttctcgttgcagatgatgattggtcgtccgctacgggcaatgacctgttggtaggcgttgagcgacttggcgaagatgtcgtcacgggtaaggatcatgacaataggaaggttctcgtcaaccagagccaagacaccgtgcttgagctcaccggacatgacagcctcgcagtggaggtacgagatttccttgatcttgagagcaccctcgagtgcggtggcgtgctggggagccacgaccaaggagcaacagag

SEQ ID NO: 69829 - DNA, 176 bp, Triticum aestivum
  unsure (1)..(176): unsure at all n locations
  Clone ID: PAT_TA_69829
tgttccaccgnaatgtttaactcgcacagcataacccccgnccactcggnaccaaaacaataaccaccactaacntagtctcagnataacaataggnacaccataataaccagagncagcaggcnttctctcgcctctgccagnagnaacatccgacnccgtttagtcgacctcct

SEQ ID NO: 69830 - DNA, 165 bp, Triticum aestivum
  unsure (1)..(165): unsure at all n locations
  Clone ID: PAT_TA_69830
cacttgctcggntgctcgggggctaaaagtcctcctctgttttattattttctttccagctcatatatatnatcccagnaaaatattttancaggnaaangaaattggngtggnncatttggaagcttggatggaactggtatnttaggtgtcantnaaactntg

SEQ ID NO: 69831 - DNA, 426 bp, Triticum aestivum
  Clone ID: PAT_TA_69831
ctgaattttattgaaatttggcctaaagccgattgttcagcaatacaaacaggggacagagagagtgtgttacagagttacgagcggagctggagaatacagtgcagccatatgcatcgggcgtcggcgcggcgcggtgaagaagggggaggcggcgcttccatagggacgggcggaagactctcgaacacctccgcattgcgctgcttccagaggtgccggcagcagagaagcagcaaggtgtgagcagaggcgcccctggagagccatagggagcgcggcacagtcgagatccgccagctcaagatatgaacacaaatatttcacaatgaaggaaacatcgccagagagggacctcctccgccctgcggccccggcggcggctagttttttttttttgaagcggcacagtcagttccgccaccg

SEQ ID NO: 69832 - DNA, 660 bp, Triticum aestivum; identical to SEQ ID NO: 69788
  unsure (1)..(660): unsure at all n locations
  Clone ID: PAT_TA_69832

SEQ ID NO: 69833 - DNA, 657 bp, Triticum aestivum; identical to SEQ ID NO: 69827
  unsure (1)..(657): unsure at all n locations
  Clone ID: PAT_TA_69833

SEQ ID NO: 69834 - DNA, 637 bp, Triticum aestivum; identical to SEQ ID NO: 69787
  Clone ID: PAT_TA_69834

SEQ ID NO: 69835 - DNA, 657 bp, Triticum aestivum
  unsure (1)..(657): unsure at all n locations
  Clone ID: PAT_TA_69835
cgagttgtatgtattaaagtcntaaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggccgcagtcgatggccacggcagcgcgcgggaccgccgcgagcatgagcaccaaggcgacggccatgagcattacctgagcgcgggccatgatcacttcttggtctgtagctaacagtgcaccgtattagctagtgatgattgggtggagagatc

SEQ ID NO: 69836 - DNA, 506 bp, Triticum aestivum
  Clone ID: PAT_TA_69836
actttattttttaccgctacaacgaccaaaccatggactaagaaaacggtgtatcatatatctactactagagttcttctcttctcagttagtaccgaagatgccaactggagcaatggtgcaatatggagggatatagacattgcacattgcaggtagcgtctctagcgctaggttccttatttcctcaaactggggcagttgttgaggctggacagagccctgggcctgtgggttttgctgagatggctggaaggagccctggcctgatggatattgttgttgaggctgttggaaggagacctggctcaacggttgttgttgttgttgttgttgttgttgttgctgttgatgcagaataatagcatgaacaacattgtggatggcttggcaccgcgactgctcggggatctgccacagctgctgacaacacaattgttgcaccagctggtaagtactttgttgcaaaacttgtgagcttccatacgctatgctgtgttgttgcc

SEQ ID NO: 69837 - DNA, 660 bp, Triticum aestivum; identical to SEQ ID NO: 69788
  unsure (1)..(660): unsure at all n locations
  Clone ID: PAT_TA_69837

SEQ ID NO: 69838 - DNA, 540 bp, Triticum aestivum
  unsure (1)..(540): unsure at all n locations
  Clone ID: PAT_TA_69838
aaacttgagnctagatacagtggctcctccaacacgcaagtgagctaggagnactaggctcacgttgtntggaggaatnntattgtatcgccatcttattattgattctgcaacggtggtcgaccggcacccccactctcagaagtggcgaccgcgggctctgctcagcgctcagtgctggccagggagcttctccttgatcttgtccatgatgcccttcttctcgccggtgtccgtgccgtgttgcccgtacgcgccgccagtgccgtgcgcccctgtgcctgtcatcccggtgtggccctgctgcccgtaggtgccgccggtgccggccatgccagtaccctgctgtccgtaggtgccaccggtgtgctgctggtcaccgtggccaccagggagcttctccttgatcttctccttgatgcccttcttcctcctcccgcccatgccatcgtcctcagacgagctggagctggagctgccggagcggtgcaggatcccacggccagtctggtgctcgtccctcatgggctggaaatgccc

SEQ ID NO: 69839 - DNA, 556 bp, Triticum aestivum
  Clone ID: PAT_TA_69839
cacgctcccacgttccctagtttcagcctccttttttttaactttgcatgcatggtggactgatttaccgctgatttcgaggaaaggctagggaaacctgttagtgctgatttaccgctgattttgaatgtatctgatccatagatcggaataatttgcatgcagctgataagctcgcatgcaggggagcgcagccgccgtggctactccagcgaagccactcgacggcgtgcagaacgcggccgccgcacagctgttgatttcatagctgctcctcgtttccgactgcatgactcccttaaagctcgggttgcccgcgtacatgctctggatcccgacgacgtctccgttggctagccccaccttctgggtgcgcgacgtgattcctggtacatgacggcatcctccacggctccaccgaagatcggcaactgttccaaccacaccatgctcggcctcgcggagaccaacatctctggccccctcccggcgagcttagccgactccagaacctggacacactggccatcaacacggcactgctctccggctcgat

SEQ ID NO: 69840 - DNA, 650 bp, Triticum aestivum
  Clone ID: PAT_TA_69840
atataggtactctattaatggcaacgaggccctctgcgcacctctattgcatcttccgcaatgcagaccaccttaatcgtactacagtatgtgtctcgtaataaaccgagactatgtgccgcccctcaacgcctatgcggaaattcagcactccgtaaacgccagagcgtggccaggacggcccatctttctggtcttgttccaaaaatcatcaccttgtgatacatgcagagcacagatgtcatggctcgtaaacttgctgccccatcttcatccccaagaatacttatctaaagcaccccgagcggaacgaagataaaaagctgcacttaaaattcgtagtaaatggtcgacgaaggcgcaaaacgggggtattaatacaacagtatggccgagtcgttttcggccaggaaaacacaccaattgacgttattggtagtcgagtgagtccaaattccgatatgctgccttgaccctggctgacgttgatagtcaatgctggtcctcgagacgatccgatagatgttgcagcgaataaatatttgcagaccgcatcaaaatctatcatccactgtttagaggatagtcaacaatgcgcggcattcatgatagcatcgggatcagaatgacgcaatatcaagctcgggttg

SEQ ID NO: 69841 - DNA, 257 bp, Triticum aestivum
  unsure (1)..(257): unsure at all n locations
  Clone ID: PAT_TA_69841
aaaaaaaaccgantcgaacgngcacacaccgttttattcggacacaaagtacaaatcctgcaccgcaccgntgcgcgccacctcgggcgtacgctcgctgtacgactctagatggagggaggagagggcgctacgcctacgggcgctcctggttgagccgcgccgccgtggtcaccgcctccgccacgccgcccggngnggtcgtcaggtccagcttgttccgcatntccgccgacacgaccctntcggnacgaggc

SEQ ID NO: 69842 - DNA, 106 bp, Triticum aestivum
  unsure (1)..(106): unsure at all n locations
  Clone ID: PAT_TA_69842
cacaacttacaacgacanctactaccagctagtagnaagctngctgggacactaaagcacacacgatcacggnncacatgatnacctattacatgcgngctcacgt

SEQ ID NO: 69843 - DNA, 276 bp, Triticum aestivum
  unsure (1)..(276): unsure at all n locations
  Clone ID: PAT_TA_69843
anacacacaaatctggatcaancttgnttcacccaacagntatcttgatgcctatgtatgtgtntctgaaacacccaggaagcactacgataccangtntcgcaggtaggcnaccncgcacagntgnttacttgccaccaccgatttccttcacagngcagatctgttacttcacccatggcggacatcacagacaggatcaggtccttgccatcagcaaatccantcttgatctggccaagcagaacatcatcagtgggaagcttcaggtcatcc

SEQ ID NO: 69844 - DNA, 660 bp, Triticum aestivum
  unsure (1)..(660): unsure at all n locations
  Clone ID: PAT_TA_69844
gagttgtatgtattaaagtcntaaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggcccgcagtcgatggccacggcagcgcgcgggaccgccgcgagcatgagcaccaaggcgacggccatgagcattacctgagcgcgggccatgatcacttcttggtctgtagctaacagtgcaccgtattagctagtgatgattgggtggagagatgagc

SEQ ID NO: 69845 - DNA, 208 bp, Triticum aestivum
  Clone ID: PAT_TA_69845
gaacggagtcctggtattggatcatgataacagtgcaatgtgtacgtatacgtacatacatacacatgcactaccttcttattcaccatgtattactacgtgcgtgcaacgagcaagtctatactacccatgcacgctgctgcatccggcacttagttgcggacctccgcccgatacttgggcttggggatctcgtcggggccggcac

SEQ ID NO: 69846 - DNA, 119 bp, Triticum aestivum
  unsure (1)..(119): unsure at all n locations
  Clone ID: PAT_TA_69846
cagaagcnagcngggacactaaagcacacacgancacggnacacangancaccnagnacatgcgngcncacgncaaganccgagnacctgacgacctacatnanncagnaccnnggaca

SEQ ID NO: 69847 - DNA, 329 bp, Triticum aestivum
  unsure (1)..(329): unsure at all n locations
  Clone ID: PAT_TA_69847
ggggagctccttnccggncaaaaanatacaaggaaccanganngngcatcagnnggnncaccggaggcgggacancctacacctaancgaagccangaacacgncngaagcacccacaganganncaaggctnngncgagaccctcacagcatgcgcatcatccacagctngaatnnccgnacatacaganataggacgcacggngcgancagancngnctcaganaggcgctngcagagnnncatgnatgannctaggnngccggannccngnangnnnctctgcagngcagncagnacagccgctctgnccaggnaanccctcgngc

SEQ ID NO: 69848 - DNA, 136 bp, Triticum aestivum
  unsure (1)..(136): unsure at all n locations
  Clone ID: PAT_TA_69848
aaaaagagcagagcaatcgcaagcaacctctaagccttctggttgtagacgtaggtgaggtttttttttgccgcagtagtggcgggngnngnggttggccatnattgtntccgcgccgcagtcggcgttggggcac

SEQ ID NO: 69849 - DNA, 137 bp, Triticum aestivum
  unsure (1)..(137): unsure at all n locations
  Clone ID: PAT_TA_69849
gacgcgaacaaaanactgnncaaatgagcggccacancggacgacnaaggataaacgcagcaggtccaacgccagggcaatgactgnccancacggaggcggagcacaaggngtttnttggactccttctgaatgnt

SEQ ID NO: 69850 - DNA, 555 bp, Triticum aestivum
  unsure (1)..(555): unsure at all n locations
  Clone ID: PAT_TA_69850
aagctctaantctgcaattcaatncgactcgggaaccgagcaacaacgtttcgactcgggaccgaggataacgttgacaggagagaaaaggaagaaagactcccatgtatagttcgatatatgcccacccgcaaaagaaacacaactcaaacgtaaacaaactctaatnttccatatccaaccatctaccacctccccaaccacctcccccacccctcctcaactatccaaacaaacaacccactctcccccacatcaccgcctctccaccaaaaataaatacagcgcaacataccccagcaccgcaaacacagcgctcaccactcccaggccggcgacatctctccaaagagccagcacatcgaacccgaaactgctcaaaatagcactgccgggaacctcaatattaagaccgnacttcttgtcgacgagagacaagnanngcacttnattgacnatcaagccttcgaagccgaagnggaagatggaaagcgattgcaaccacannanccccttanggatcgnctnnnggnngancaananccgcnaananca

SEQ ID NO: 69851 - DNA, 191 bp, Triticum aestivum
  unsure (1)..(191): unsure at all n locations
  Clone ID: PAT_TA_69851
agctgcactacacatctttnctgnaaaagtactacactgaancttnctcaaaaaataacaaggaaaacaatgagctgcagcgctggccgagctgnacgccagagagagagagagagagcaggtgaacagggaaggagcttgtgggaaggaagccaggggatgagcgggcggtntttnnttggccctgaggc

SEQ ID NO: 69852 - DNA, 113 bp, Triticum aestivum
  unsure (1)..(113): unsure at all n locations
  Clone ID: PAT_TA_69852
atgccaccactcgcggacggggctcccaaggcgcagggngatcccgtcacagnccctgangtagccgaccttntgcccccagtncttctgctccggcgcgcncaccggcaccg

SEQ ID NO: 69853 - DNA, 119 bp, Triticum aestivum
  unsure (1)..(119): unsure at all n locations
  Clone ID: PAT_TA_69853
tctcactagntntcatatntnagctctcgactgaggtccgctcggagtccaaaactttcatatctaaaccatgactgcnccactgcctgccgcggcattatctngtctaccgacgcggc

SEQ ID NO: 69854 - DNA, 762 bp, Triticum aestivum
  Clone ID: PAT_TA_69854
gttgagaattttttattttgcaatactgcataaattagcagtatagatagatgttacacaatagtcaggaggagctagcagggcatcaaatgtaaaatgccaaaagaccttgcaatgtacatatgatacggaaatccggtgacagcaaggggtgacaaagatcatcaatttcatcatgtacaccagatgctttctcccgggctttcacgacataatcacatcttcgacaagttatagaacagctctaggaaaaggtctacggcagcctctaattctacagccaaaaatttcctctctctatttcaaatgccagaggcactttcagcaatttcaatcgtcccaggttctacctgcaactacataggtctgcatcatggcctcataggcgtctggatcaaggcattcaaacttcttcaggcactcaaggaaagactccgcaccagcaacatcctttgactcttcatagtgcttcagaaatctgctcacaagctctttcgatggcacccatttgtgtgtcgtcaccatgttatttgcatctcttaagatctccagtgccgtgttaacatcagatttatccagatagaactcagcaaatatgtaaaccatcccctcgtcgcaatgaccctgagccattgtgctctgacggatagcctcagcttcatcaatcatacccttatcaaggtaagccttgatcataacatttgctatccttgtgtcataatggtcatgacttgattgccactcctggaaatatttgctgca

SEQ ID NO: 69855 - DNA, 598 bp, Triticum aestivum
  Clone ID: PAT_TA_69855
ttcttgctttggtttgccttgcccccctgttcagtcacgaaggcaatactatagataaaactcagctatcaccagcaccattatcggcggtgtgttcctgcgagatcccgggttcgtcacctgggggcacgggagtcgtgggaggcctgcaccgcccgggtgactccaccgttgccgctaaggcccgaatctctctgcttgtgatgcacactgaacaggattatgcgaccttctacccttgcattgagctgcccgcccgtgggtataccaccctctgcctgaacaactggaccagcaactcggggtctgatgaacgaagccgcaaggactttcagatgtttatatgtcccaggagaattaagcaagcggtggtgtaacaaccctgatcaactcctgcaagtgggaaacatccccggtcgcatccagccagtcgccggcaggtcctctttgaggtcgtaccagtcctgctcgagatcctttagtttaatcctgtgccgtttcgcgtatcgagtaattccatcgaacatatcagtactgatgcctttgaagccgatgagtaggggctgagccgatttctggtgtccgagcgtgctctgct

SEQ ID NO: 69856 - DNA, 128 bp, Triticum aestivum
  unsure (1)..(128): unsure at all n locations
  Clone ID: PAT_TA_69856
tctcacaatttatccgcaattcgaacaattgcgcnanntgttacnggctatcgncatagccctnttagaaaaacctanacagacggaggtaggataaagatnttaacttcctaaactgggtncacaaa

SEQ ID NO: 69857 - DNA, 105 bp, Triticum aestivum
  Clone ID: PAT_TA_69857
cacgttacattatttatttaacgcttgacgcttccaagtggctacagcgccaaaaaggcccctaccgaacacacaaccgaactactaccaggctgacactcgaga

SEQ ID NO: 69858 - DNA, 727 bp, Triticum aestivum
  unsure (1)..(727): unsure at all n locations
  Clone ID: PAT_TA_69858
gtatatatttgataaaagaacttatctgtacnacaccataccgtaagcatacatacacggtttaaccagaaggaaatttacaaaattatacagtgtaaacagacgagtaactcaaaacaaacaacactgtttgttcacgtaaacttgagcctagatacagtggctcctccaacacgcaagtgagctaggtgaactaggctcacgttgtatggtggaattttattgtatcgccatcttattattgattctgcaacggtggtcgaccggcacccccactctcagaagtggcgaccgcgggctctgctcagcgctcagtgctggccagggagcttctccttgatcttgtccatgatgcccttcttctcgccggtgtccgtgccgtgttgcccgtacgcgccgccagtgccgtgcgcccctgtgcctgtcatcccggtgtggccctgctgcccgtaggtgccaccggtgccggccatcccagtgtgaccctgctgcccgtaggtgccgccggtgccggccatgccagtaccctgctgtccgtaggtgccaccggtgtgctgctggtcaccgtggccaccagggagcttctccttgatcttctccttgatgcccttcttcctcctcccgcccatgccatcgtcctcagacgagctggagctggagctgccggagcggtgcaggatcccacggccagtctggtgctcgtccctcatgggctgggaaatgccca

SEQ ID NO: 69859 - DNA, 654 bp, Triticum aestivum
  Clone ID: PAT_TA_69859
gtctcgagcaaagtcttaggaatatcttcaggcacgcaggctcaatacctgatcagtcggaacttgagcaatctttccttgtaatcctcccaaacgccatgccgaattcaaaacatgtttcctcgctgaagtcgatgcaattccctcacttgttttccttctccttctcgaagctgccagtagaagttatcttctgtgcctcctcatcggccttcatctcacgaactttggccaggacgacttcacggaagatggcacccttggcaatcttgctcagactgcgcttgtgcgtcactcccttgtcctccggtaccttgaggccggcttccaaaggcttctcttcttgatgtgcgagtgcgtctcctgcggcctgctttgcgccggcgggaacgtctccagcctgtggtacatcctcctcttcgtcttcttgcatcttgagtgcttcgatacgattggcgagcttgaccaattcgataccgcgcttcaggcgagccttggtcatgtatgccttgatttcgggcagcaagttgtggtctgttgcacccttgccagcaatccaagcattcttgagcgcttcagcacttgtagctctcttctccggcttgggaacgagcaaggtcatgatgaaatccttggcttccttgctgacatcct

SEQ ID NO: 69860 - DNA, 166 bp, Triticum aestivum
  unsure (1)..(166): unsure at all n locations
  Clone ID: PAT_TA_69860
tttcnaagaccntcctnaangaccttgntgttggtcanaggaatcctttgcttgttgagcttgccataacctnttttgtaaatnaantccntnacacttttcaggttngggtacccatatgcaacatatggctcnaccntgcggagcatgtngatggnggccttgt

SEQ ID NO: 69861 - DNA, 659 bp, Triticum aestivum
  Clone ID: PAT_TA_69861
actaaaaaaacaacactgtttgttacgtaaacttgagcctagatacagtggctcctccaacacgcaagtgagctaggtgaactaggctcacgttgtatggtggaattttattgtatcgccatcttattattgattctgcaacggtggtcgaccggcacccccactctcagaagtggcgaccgcgggctctgctcagcgctcagtgctggccagggagcttctccttgatcttgtccatgatgcccttcttctcgccggtgtccgtgccgtgttgcccgtacgcgccgccagtgccgtgcgcccctgtgcctgtcatcccggtgtggccctgctgcccgtaggtgccgccggtgccggccatcccagtgtggccttgctgtccgtaggtgccgccggtgccggtcatcccagtgtgaccctgctgcccgtaggtgccgccggtgccggccatgccagtaccctgctgtccgtaggtgccaccggtgtgctgctggtcaccgtggccaccagggagcttctccttgatcttctccttgatgcccttcttcctcctcccgcccatgccatcgtcctcagacgagctggagctggagctgccggagcggtgcaggatcccacggccagtctggtgctcgtccctcatgggctggaaatgccca

SEQ ID NO: 69862 - DNA, 548 bp, Triticum aestivum
  unsure (1)..(548): unsure at all n locations
  Clone ID: PAT_TA_69862
acttttcttttttatatacnaattncaaactttatagtggcagtgtgtgaacctcatggctttaataatttgaaatttaaaacaaacaccattacaatatgaactctcacatagcacaaatcacaaatacataaacacgaaggctttctttactgttaaagaactttctttggaggtttggactttctcagttctgatttttggaactctccatgtagctatacatgaacttttttttcgtggacgatcagtgtgtaggagtgcttgttgacgaccacacacgctgagtcctttttcttatgctctgatttttggaactctccttgtagctacacatgaactgcgcaacacatgaattctctttgtgggcgaccgtgtaggagtagagctcgtcgacgaactagtctgcactttgaacttctctcaagccttcttgctgagcgaccgaccgtcgagcaagcagttggattgccgagttgaatagtgcactgtggttgagtggaggacagcgcggccacgaggtccagccgagagtactggcctgacgc

SEQ ID NO: 69863 - DNA, 150 bp, Triticum aestivum
  unsure (1)..(150): unsure at all n locations
  Clone ID: PAT_TA_69863
aaaagccaggcatgacatcccccatccaacaagcgtatcgtctgtgcgcgctngtatagccnaccgacaacacacgcatgnctctcgatgccnaanagacactgncaacacttaaccagagttttttttgtcctgctgatngcanaancc

SEQ ID NO: 69864 - DNA, 265 bp, Triticum aestivum
  unsure (1)..(265): unsure at all n locations
  Clone ID: PAT_TA_69864
aaaccctcctaaacnacctcggagatctcatcggacggaccaggggaagacacgacacgacacacgactctnttatttagatcgacgacacgacacgggacacacggggcggcgacgacgacggcgaaaggcgacccgcgcgcgggcggatctagagctggccgnaggcggcgatgaccacctgcttggagcaggtgccgctgcgggagcccaccttctcgatgttcttgacgacgtccatgccctcgacgacctcgccgaagac

SEQ ID NO: 69865 - DNA, 137 bp, Triticum aestivum
  unsure (1)..(137): unsure at all n locations
  Clone ID: PAT_TA_69865
gaaacacatccatatgatgacttcgcgcaaacaggagananncgcccatcacactncgtccggatcttggaggagaaacagtggncagagggtgggccacacgccaacaggagctgngctatctctttttccgatcg

SEQ ID NO: 69866 - DNA, 108 bp, Triticum aestivum
  unsure (1)..(108): unsure at all n locations
  Clone ID: PAT_TA_69866
taacaaaacaaagnaagnaacattctaaagtaaagggaaataaggcaggacacctatttcttccgagcaaatgtacacgctatgacacaacatgatcatgcttatcaa

SEQ ID NO: 69867 - DNA, 123 bp, Triticum aestivum
  Clone ID: PAT_TA_69867
acaatacacaccgacaaaccgcctcaaaaaccaccaaatcaagggatgagcacatggcgccgagaaacaaactagcctagccaacaagtggatacgagacccagattattcaaagtaaacacc

SEQ ID NO: 69868 - DNA, 628 bp, Triticum aestivum
  unsure (1)..(628): unsure at all n locations
  Clone ID: PAT_TA_69868
atgagggttantntngattagatatacaggtaacagtctagctatggacgctggtaagatcgcgtggcatggtcgtcattgttgcttagaggccggtagagccgacaccagaggtgacgccatccttgaggttgttgacaacagggagagcaccgtcggtgacgttcttgacggcaggctcaacggcacccttagcgccgttaacaacggggtcaacagcgccctgaacgttactgacaacaggggcgacggcaccctcgacacccttaacggcaccagtagcagcgtccttgacgggcttgacgatagggtcaacagcaccggtgacgccgttgacaatgggagtgacagcagaggtgacaccgtccttgacatcgttgacgataggggagacaacaccggtaacaccaccaacgacgttgtccttgacatcgttgacaataggggtagcggcatcctcgacagccttgacgccaggaacggcaccctcaacaccgccaacgagaccgttgacgtcagggagctggcgcctggtcagagcagcgtcgacggacttgtccagagcatcagcgtgggcatcgatgttcttgacgtcgttgacagtagaggtgacaccatccttgacgtt

SEQ ID NO: 69869 - DNA, 678 bp, Triticum aestivum
  unsure (1)..(678): unsure at all n locations
  Clone ID: PAT_TA_69869
atgctcctttttgtgacatgcaattgtggggtcgggatccaccttgntgggctgagatnacaatcgcatatatttatcccccagcaccaccaaagtgttgcagcgagaacttgtcgcaatccagagtagtgtttggagatagagtatgctacatgaagcggggaataaaatcataataggttataatggtgcgttccatatacaactgcaaaatcacagaaattcaaagataccaacaaggccatcaatcacagtgggaaagacaagatccaaacgccttctaccgttatttgcattaccatccaagcgagtccaggtcccttagatagtagtggactggcggtaaagaccgacccagccgcagttaccggggatagtaggaccaaagtacaaagacgagtagccatcggccgagcaagcgtaagcctgctggaactgaccaccagcagagcacacaagataaccagcattctcgtcaatggagcacttgatgtagttgttggaaacagtaccggtggggttccacaagagcttctgctggacctggacaccctggggcatgctggcagcgtagcccgacgttgttgccactggcttcgatcaggtatccagttgtggtgtcaagctggaacttggtggcaagtgattgggatgagtaggtggctgcggcgttggagc

SEQ ID NO: 69870 - DNA, 149 bp, Triticum aestivum
  unsure (1)..(149): unsure at all n locations
  Clone ID: PAT_TA_69870
cacactaaacaggagtncttctttcatgggcnataccaanacaggncatnttaagngcagcaacagnnaccgataacaagcaactaaaaangtaaagggtncgggtagtngtaacggcnganacaaccctgcgcgaccggtcaaacgga

SEQ ID NO: 69871 - DNA, 578 bp, Triticum aestivum
  unsure (1)..(578): unsure at all n locations
  Clone ID: PAT_TA_69871
ctgaattgcattctctatnntgcagctcgagggctgctgttcatgaacctgaaaagcctcataatgcatccgtcccaagcttaccccttttgaaagaagcaaacgcgaatcaagtcgctgcagccacttagtccatatcttcatcgatggccctgtgctgcttcctctgtccaccccgtccgccgaacctcgaggacatatcagccttctggtctgccttgtttgcctcgtcctccttctcctgcaagaacctctgcttctcttgcttaatgacgtccagaacaccttgtagactgtttcgccataggtttaacctggagtccacctctctccactggttttcgccaaagacgcggtatgttgagcggtggatcaggaaggtctggttgagctggctgagcttgccctcgacaagacccgcgcggattacgtcgataacccacatctcgacgtcttcagatggtacttgtagtttgtttgcgatcttctcgtagggaagcgacctggtctgaccggcggatgcagccatggatgcgagagtgagaaggcgcatncttgcggttcaaggcagcgccgtc

SEQ ID NO: 69872 - DNA, 147 bp, Triticum aestivum
  unsure (1)..(147): unsure at all n locations
  Clone ID: PAT_TA_69872
aaagaagagaattagggagagagantantttctgaaanatcaattnctagctagagaatcggaggggcggnagagagaccatacacatcagccacaccgncctcgacattgcctgctccgnancgtccaaccttctctgtcggngtg

SEQ ID NO: 69873 - DNA, 543 bp, Triticum aestivum
  Clone ID: PAT_TA_69873
ccctttgcttttctgcttcttacggtacagactcacgactttgggcccctctcgtgtatcctcctcgggaggtgtaagatcactcctccaaacaagtttgggagctgcacagcaaacactgcaactctttgcagctttgtagatacaaagcctcttgggtacactccctttccgtgtctgtggtggaagcaacgctaattgaaagtgctacacagagagctttctgccctttgatctcgagtcgacatggtcagctgcagttttgacagtggtagcgaacgttgtagacccgtccatgtccgatggctgccacaatgccctacagattgcatatagtctcctgggcgaaatgctgatgagaggtaatcatgtggctggattgtacagggatgagctcacgttgttgcaaatatttctaggcaagtttgagactgactcaacccacccagcgagtgttacagatccagcagccgctagtctgcacgattccatgaatcttaccacaacaaatggagatgccaacgactggtggtccgatgatat

SEQ ID NO: 69874 - DNA, 151 bp, Triticum aestivum
  unsure (1)..(151): unsure at all n locations
  Clone ID: PAT_TA_69874
aatgctaccacagaacgtgaaactaccagngagatcgccattttacaagatggggatacggacacactactctacatcatctgctagcataaggcaaagctaataggtctagcgaaaagcatcagcgatttttacaaggtcagngagctga

SEQ ID NO: 69875 - DNA, 591 bp, Triticum aestivum
  unsure (1)..(591): unsure at all n locations
  Clone ID: PAT_TA_69875
ttggagatgaagaagaagaggaaggcngttttaggttctatttagaccgaatcttgttagttacaactcccagctgaacagccacttgctcacgcagccagtctcgcatcgccacacgggttagatagaggcgtcgaccaatctgcgcgtaaaacaactaaatggccaggatctagtcgcgtcgagcaacagcccaggcgtcttccttcccgggtggaagttcatctactagtgccagtttctacactgcaaagcaaagggccagacaaggtggaaatccctccctagatcggctcaccgcttcttcctctgcggcctctttgccgcaaccacagtctcttccttgccagccgagtcttcatcgtctgaagaacaaccttctttcttcgatgggccctttgctggtcgcttcctccccctcttggcgggcttcgactcttcatcttcatcttctccctcctcgtgatcatcagcacgagtattaaccactttcttcggtagggcctttgcccccttggctcttcgctttgctggtttatcatcctcttcctcttcatcaacatctgtcttctgtgccgccttccccccttc

SEQ ID NO: 69876 - DNA, 140 bp, Triticum aestivum
  unsure (1)..(140): unsure at all n locations
  Clone ID: PAT_TA_69876
atgacagcttctctctctctctctcttttatctctctctctgnctgattgggcagatatcactgcttgaggngagggaagcactggacgagctcgctcttnggatgctttgcctcggcatgctccttgcactttgcttca

SEQ ID NO: 69877 - DNA, 306 bp, Triticum aestivum
  unsure (1)..(306): unsure at all n locations
  Clone ID: PAT_TA_69877
agggaggaacannacaaagnggcaaactgcggacctaacaatctatancaccccgnnctccggtnaaccttgnacgcccgttacttcctaagcantntccaccttcccgtggccgtncagcagntggttncatanacagccaggcctagnaggtcnggtccttccaagcgcgggtncctctcgaagntgctgagaggaatgngctcaaacggnccagtcgcgggaattgcnccacacagatnattaccagaaacancaacaacnnngaggctggatantccggccagctcccctggaantggncca

SEQ ID NO: 69878 - DNA, 177 bp, Triticum aestivum
  unsure (1)..(177): unsure at all n locations
  Clone ID: PAT_TA_69878
cccatggngacaaacngcncaacnncttcaggtacacaggacactgganctcctccagnagggagtaccagcaagccagcngggagagagtncttattcatattcagnanaaactcgcataactagggaccatactacataggganagaggctgcgccctngagccgaatgccngca

SEQ ID NO: 69879 - DNA, 512 bp, Triticum aestivum
  unsure (1)..(512): unsure at all n locations
  Clone ID: PAT_TA_69879
atgtacagnctatatatnccacctgtaaacttttacatggccgaaaagatatacagcggcaaaccctaatactcaactagttactcggaagtttcccgaagactctccagattctatacaagacaggaaagggaacaccttgctcctctttaccaaggcatgacattacatgcacgctgtaccgacagaaaaaacctccacagtccatccatgctccaccagaagtgacggcaaatgctttaagaagaatcagcgtcggcgtcagcgcacttcgccgcctgttggcatcggcagggcttcgacgccatccgcacccggttctctcctgtgataattagcttctcaacccgtgcaacgatatgcttcccatatgtgtagttcttcagctcgttcaagtgcaccttgatgcttgacaggatcatctcaaggtgtttgtcatcacaggtctgaaggactttctgtacgacgtanntgccaaactgatccttcatcantgtctgaaatgttngacc

SEQ ID NO: 69880 - DNA, 636 bp, Triticum aestivum
  Clone ID: PAT_TA_69880
cactgggagtgcccatggtacaaactctcaactctcagatacacagatactgatctcctccagaggagtaccagcaagccagcaggagagagttcttattcatattcagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcaggcagggtctcaccaagctgtcaacgtggcccgcagtcgatggccacggcagcgcgcgggaccgccgcgagcatcagcaccaaggcgacggccatgagcattacctgagcgcgggccatgatcacttcttggtctgtagctaacagtgcaccgtattagctagtgatgattgggtggagagatgagcc

SEQ ID NO: 69881 - DNA, 381 bp, Triticum aestivum
  unsure (1)..(381): unsure at all n locations
  Clone ID: PAT_TA_69881
gatatctcgaacagcagcaggaccccgccatgtaagactagccataatgagtactactctatgttactacctctatagtggggagtaacatatgtgtggtaacatgcaacacttcatttgttaggttatagactcattttgccttgatatgtgtgatgttactcatactagtagtaactagctattttaccacatgcctctttttcttcatttattgcttgccacatcatctattttatctagatatgtgtgatgttactacctatattacttncattgtggctagtctaagtgaacaaatacaaagtataggcacatgtaagtgtagtttgtgtagatgtgcaacctggcagtgctactgcttggcaacaactcctacct

SEQ ID NO: 69882 - DNA, 422 bp, Triticum aestivum
  unsure (1)..(422): unsure at all n locations
  Clone ID: PAT_TA_69882
tcacctgacggnaaaccttgttacgacttctccttgcctctaaatgataaggttcaatggacttctcgcgacgtcgggggcggcgaaccgcccccgtcgccgcgatccgaacacttnaccggaccattcaatcggtaggagcgacgggcggtgtgtacaaagggcagggacgtagtcaacgcgagctgatgactcgcgcttactaggcattcctcgttgaagaccaacaattgcaatgatctatccccatcacgatgaaatttcccaagattacccgggcctgtcggccaaggctatatactcgntgaatacatcantgtagcgcgcgtgcggcccanaacatctaagggcatcacagacctgttattgcctcaaacttccgttgcctaaacggcgatagaccctctaagaagctagctgcg

SEQ ID NO: 69883 - DNA, 744 bp, Triticum aestivum
  unsure (1)..(744): unsure at all n locations
  Clone ID: PAT_TA_69883
tcgtatgttgtattcntttaaaatgtctaaaaagacttatatttaggaacggagggagtagcagtgagtatggataggaggttagacatgggcgcgtacgtgcggaatgtgtcaacaacgatgatggcgtactttttttaggggaatgatggcgtacttgagtctcttcttagagcggccaacacggcgaccccgggaagtaggagtagaggttcgttcagtggaccgccgtctttggccatcttctccatgacggaagtgtcgttgatgatatcctcgacgctgcaacatgggaccatcatcttggtgacggtggttgcggtcagctaaccggtgacctccaggccgaagttctgctggtggattctagtggccagctccatgcctgagctagcccttgagcttttcatgaaaaggagctgccgctcctccccaaactggcagccagagacctcttgcactttgctgcgtgtttttgtctgcgcagacaaaaacacaaccaacaccacaagtgcatgattcggtctatgcatacatgtaaaagatcacgtatctagtttacaacagaaaccctatatagcaaagtaaatgctcaaaagtaaaagaaagacagaaaaaaggggctgtccataaactatcaggagaacgctggcgccggctgcgccaaaaatctgctccatggtatggagcgcgcgcccgcggtgcctatgtggatttccttgatgctcgtcagcagcgtcatga

SEQ ID NO: 69884 - DNA, 616 bp, Triticum aestivum
  Clone ID: PAT_TA_69884
aaaccctgccgtcttgtcactgcaatgcagatcacacagacacacacacacacacacatgcgcaaccacgggcactcacacagataacagaacccatcaaagccactctacttgccattggagagaccggccttgctgaggatggtggtctcggcgatcatggaggtgacgacgtagggatccatgttggatgccggcctccggtcctcgaagtagcccttgccttccttctcggtgtcgccttcttgatcacctcgtacccaccctcgctcctcatcgacttggtgctgtagtttgtgtgggcaccagcaccattccactctcccgggatcggtttggggtcgaaggagacgacgacaccggcaatctcagtgatcctctccaggatgtagcgagccgcccagagctcgtcgccggccgagatgccgacggaagggccgacttggaactcccactgtcctggcatgacttctgcattgatgccgccgatgttgatgcccggcgtagaggcaggccttgtagtgcgcgtcgacgatgtcgcgcccgtaagatttctccgcacccgcggcgcagtagtaaggtccctgaggaccagggtaaccccctagtggccagc

SEQ ID NO: 69885 - DNA, 349 bp, Triticum aestivum
  unsure (1)..(349): unsure at all n locations
  Clone ID: PAT_TA_69885
ataatgtgaactttgcaccaaaagctgngtaactaattaacggtaaatattactgcattaatgttgtttaatattggtggtttgcaacgtgaagagaacctgcatctgctgctgatgtttccatgctggcctcgtatttaccaactgcagcgagagagttcatcttagctcggtgcataagagcgtccttggcagcggcaacattctctggcttgcctttccatgccttcaatacagatgcctgcaaagcccttccataagagaaagacagggcccatggtttgagagccttcacttggttaatagcattcaaatgggcggtggcagatgnctcagattgcccaccaga

SEQ ID NO: 69886 - DNA, 186 bp, Triticum aestivum
  unsure (1)..(186): unsure at all n locations
  Clone ID: PAT_TA_69886
tgatcccaaatgacatgcagcaactcgcataccgcattcattagcataccacactaaatttgaaccgtctgaaccacatactggcttgntgtgtcttggacaaggtatgaaacattttggcagngcatccactgacgaagcagcaagaagtacaactaaaactaacgcgaatgtaactttcatctt

SEQ ID NO: 69887 - DNA, 578 bp, Triticum aestivum
  Clone ID: PAT_TA_69887
atgttgctcttacaaaacaagtagaggaaactgtatgacggctcatgtatactcttacctgcaaacaggcaagaaccactacctataagcttctacctttgtatagctgatattggggcttcagacaacacatactcatgaactccagagcctacttgcaggtcacattgttgtggatggcattgccagtctgctatatccactgtcagtttgttctgctctacatcaccagaaatcaccacaagagcaggcaccagatttgaagtggtggaacctgctgcagtctcgcatgatgatctccctgtcctcaaccgccgacaccatcttcatcaccacatggcagtccccacagacccgcaggtttttgacaatctgaaggggcgtccctggtggcgtagctatcagaccgaaggcaagagccagccgctcactgtgcgtgaccagcatggcttccttctgctcttgttccatgtcatggagcacaaagctcgtgttcgggcagtaaccctcctgcttcaacctggctgtcatcgccttcagctttgtgtatatctggtcggacagacggtgcgatttat

SEQ ID NO: 69888 - DNA, 713 bp, Triticum aestivum
  Clone ID: PAT_TA_69888
tatatgtaaaattctgaaaaacccgacacgatatacaaatgaaaaaacaccttcataatgtaattaaaacataagacaacattgataaaatctaaacaagcgaccgtgacactctactaggcacgagtgaggcactctactagatataaaagaataaattccacgaataaataaattccacgaatgaagaatggcggggcgaagtggcctctagtataaaagataataaacaagaaattatttgctccgcttaatagacaagtgggctagatttgtttagtcaatcaacgacggcaacatagcgatgataattcgagacacttgcatgaaggcttccctcgacaagtttaggccagcgtcgcgtcagtgtctcgttctagcgacagcaacagtgcgtttgattcgatggtctatttattattattattttagaggagaatggcgttttggtggccgagcttcatggaggtctttaatttaaaaaaaattcaaattgaaactatatattccaaaaaattctgaaaaatatgcgtgtatgtaagaatgaaacccacatgtgtgtaaattttcataatgaaatacattgaaatgtgacctgtaaaaaaataaaaataaattcatggcctgagaggatgaatattatcatgtgttaaacaaccctagatttggtctgttttacacagccctcatttcaacatgttttgccctgaaat

SEQ ID NO: 69889 - DNA, 138 bp, Triticum aestivum
  unsure (1)..(138): unsure at all n locations
  Clone ID: PAT_TA_69889
agttactgacaccaacattggaagnagtcgactgtacaaccatagnataagagcaanaaatactgaagnacagcatagattntagcatacagtgcgattagcacttgacctctttcagcccatgtgcnaagtacagga

SEQ ID NO: 69890 - DNA, 162 bp, Triticum aestivum
  unsure (1)..(162): unsure at all n locations
  Clone ID: PAT_TA_69890
tctcccaaacntcactacataaanccatcatgcaaaacttaaactcaaaancatcacatccaaactaggggggagtncactccattgggctagcgccnaagccaccgccaccgccgccaccacggccaaagccaccgaccggcaccacggccaaagccgccg

SEQ ID NO: 69891 - DNA, 677 bp, Triticum aestivum
  Clone ID: PAT_TA_69891
gagttgttcgtttacgcaaaaaaatgtgtgcagcagctggacgaagcactaccactaaccagccaaaccaaaatacccctgaagcaaaatactcttcaccatcatgttacagaccacaggcacaaagcatatactagaaccccccctaccctcccttgtccaagatctctgttgccaacacaataatgttgcgtccaatagccaacttcgatcaacctgaagcgcagtttgcttcgcaggttaatttctctccttgagaacttgtggatactgcatcagcaaatgcttggaaggacccaaaccggagatccataatcctcagttcgccctgggtggtcgataacgaattcatgataagacccatcagccaaagaatactcgctccacttcccagagcacccagtgaagtacaagcagtcccttcgaactgccggatgatctggaccaaggcaaccggcaaactcatgcaaattaaagaacaagctgcaaccaccaaggctagtagtcctctcccacttcttcttcccagagtgcagatagaaaacatggtacacacatggatcgaactccacctcgacaatgagcaataactcacgacgacgctctgctagccagaaccttggacagttaacttccggcacactcaatttatctccaagaaacgacaataccgcaga

SEQ ID NO: 69892 - DNA, 676 bp, Triticum aestivum
  unsure (1)..(676): unsure at all n locations
  Clone ID: PAT_TA_69892
aggccttttnttataaataaattaagatnatgaaccttcccactggttaagcaaaagaatttgtttccacaaaaaaactttctctactgaaaatatgaagactgatgtgcatcgacaacaacaaaaataggtcagtaatcagcacacatgatgcagtgggaaagaaagcctggacatgaaacaacaagtaggagcaaaaactgaggacagtgaaggacaagcacggaatgtaagagggaaactttcaaagagcaaatcaagaggcccctgaggcggggtgaagcagagcacggtacgccatggcagtgagctggtgatgcagaaagacacgctgggcagctgctccttgagcggatgcggctgcagctcgtcggccttgggcggcggggcggctgccatcttcctcctccctttccggcttcaacctcccaagaaaatgtcccaggcgctgctccatcatgaggagcacagctaccttggccgtgtttccggcaacagtgtcatcaagtaataagcggacctcttcaggagaagacatgttacatatcatgattccatcgcataaatcttcaaaaatctaaaactaacggaggatgtgaacagacgaaaggggcaacctcaattcctcggtcctccagagccgccatcaaaaaggggcagagatggtggggtcgac

SEQ ID NO: 69893 - DNA, 742 bp, Triticum aestivum
  Clone ID: PAT_TA_69893
tgctagcttgcgagttaacatacttgaatacgtgggcactaagctttatacatatacaccagtttaatgctccgctccacttttctgaaaccaataatagtgaccttagttacaccacatgacaatctgcacacaattgttgcttatatttcacgaaagggttccattcaagttggcagtgggctatttgagctatttctctggtcataaatttcttcaccctctcatccaccatactgtggggccatctccgccacgatccccgtatatggaaaatgtgatgctcggcgaaagcccaatttgctccaaaggtaaactatgtacattacctccgttaactgtacatcagcatgtgtgattgcagaatgtccttgaactgcgtctcttaaaatgaaactagtcaggaagactcaaccgcctaaagaattcaaaaagatggagatttgatgtccagtagaagaaagctatcacaggaccatctctgatgaactttccatctagtatcaaaagctcgccgtcaacccatcgaggatttttgaagccagcatctgcaattctcctttgccccttatacctagcaaccactccaagttctctagggatgacccccttatgaggaagctgatagtgtttgccaactttcgcacggaagacaacctgacccgctggcacaagattgtccccagtcaattttgcagcttcgacatactcataaaacttaagatccaagtgctcctcagat

SEQ ID NO: 69894 - DNA, 564 bp, Triticum aestivum
  unsure (1)..(564): unsure at all n locations
  Clone ID: PAT_TA_69894
caaaccagagcatatgtgatcggtcgcagcccagtgggcaaatccaggtgcctttattttacatttgtaaggtttactcgagccatcanaaacaagataaactccgaattcaccctttggagcttccactgcagtgtaagtggctcctggaggaacttgatatccttcactgaataatttaaaatggtggatcacagcttccatagaattcttcatctcagctcgactcggaggaacgatcttattgtcatcgattttgatctccccaggaggcatgttgtttaaacattggttgatgatgcgcaaagactgcctcatttcttcaactcgacaaagatacctgtcaaaggtatcaccattggagccaataggaatgtcgaaatcaaaatcctcataactatcatatggctgagtttttctcaggtcccatttgatgccggaaccacgcaacatcacaccgctgcaacctangtttaaagcatcatcagtagagagaattccgatatccacgcatctaagtctccaaatacgattgcctgtcaacatctcttccatctcgtcaat

SEQ ID NO: 69895 - DNA, 269 bp, Triticum aestivum
  Clone ID: PAT_TA_69895
ttcggcacgagggcgtcctctcccttgcacctctctcgcccgcgccgcctctccccgagctcctcgctcgcccgcgtcgtcggcatccctccctctctcacgctctccaacaccagctccattgttaaaaatgcgatttccccccctccggccctccgatctgcagtggcggtcctcgatctgctgcggcgactatcaagacggcacgacggagctgttactgcctgtcgcctgcccagagcttctgttgccggttgcctacccggagc

SEQ ID NO: 69896 - DNA, 597 bp, Triticum aestivum
  Clone ID: PAT_TA_69896
gctgaggctctgacctaaagtagggcagatgggaagcagcatttcagagcgtaacgacatggtcctgactgcggtaggatagatgggaagcagcattttccatcctcccgcgccagaccaacttcgtcattttctgattggtgtgaagtgagcacacatttgttgatcgttagtctaccgcttgcttcctgttctcttcattacttccttcctgccgtaccactggtgagatgttgtctcctcatgcttttatccgttcatatgagtgattcaatgttgttgttggactggtttattgtgtggatggggtggcgctcgtcaggtgtttgtgcttatgctccacacatgacctgctttaaaaattgtcttgtcaggatttgtattcattgcacaccccgctgcagatccgagcaggcaccttgcatccttccttttgcactgtgaatcttattacttaaccagatctgcgtatatctcgtgtgttaaccagatctggatatatctcgtgtgatgatctgcgtcatggatggctgatgagtattcagtgatgtctgctatgttgtgcgctaaacgtttcaccttttttatggtgttttt

SEQ ID NO: 69897 - DNA, 606 bp, Triticum aestivum
  Clone ID: PAT_TA_69897
gattgattttgctggaagtgatgtcgaggaaaaactcattgagagtttatgcaagaggctgtcaaaattaagggtgctggccattgccttgagtaatcgagaccatggtgtaatcaactacaccaagaagttcttgttcccagaatctattagacagttgaagcacctacgctatcttgccttcagaacactgcacatggggatggtcgttttaccgagtgcactaactaagctagaccatatccaactgctagattttggtgacaatgtaattgaatttccttctactggtgttatcaagttgcggcacataatctgcaggtatgacgcgaaagttcctaacataggcaggttcaaatcactccaaacattgcaaaacttccaagtgaggaatgaagaaggttatgaggtaaagcagctgatggacctagacaagctttgcggtagtttggcgatccatggccttgaaaatgtaaaaagcaaaagggaagctcttgaagccaatctagctaccaagaaatggctcaaggaacttgaaactattttggactggtggttgtacgaggcgcagtccagaagttgaagaagaggtacttgagggcttgt

SEQ ID NO: 69898 - DNA, 710 bp, Triticum aestivum
  unsure (1)..(710): unsure at all n locations
  Clone ID: PAT_TA_69898
tcggcacgaggcgcagccggngnatcccgatctcgacgagctcgagcgcgcgtttccgattgtggagccagattatggccacactaagctccgtctgtcagaacaaggtcttgaggccattcggaggatcgaaaatcctatcgctattgttggtgtcattggtccatatcgatctggaaagtcttttcttctgaaccaacttctctccttatcatgtgataaaggttttggagttggtcatatgcgggatactaaaactaaaggtatatggatttggggtaaacctgttgagatggatgttgatggcaccaaagtatctgtcctttatcttgacacagaaggatttgagagtgttgggaagtccaatgtatacgatgataggatatttgctttggcgacagtcttaagttctgtgcttatctataaccttcctgagacggtgcgtgaagctgatatatctaggctctcatttgctgttgaaatagctgaagaattctatggaagagtgaagggagaagagattgcttttgagccagcaaagcttctctggcttatccagagggatttcctgcaaggaaaatcagttcagcaaatggtcaatgaagccctccaacgggtgcctaatgataatgggaacaaatatattgacgaggtcaatcaaatcagggattcgttggcagttatgggaaacaacagcactgcttttagct

SEQ ID NO: 69899 - DNA, 668 bp, Triticum aestivum
  Clone ID: PAT_TA_69899
gggctaacatcgatgtggccgcatcggctaaatgttatactaggggatcaaatgggagctgggggtgtaatcccaacacttgtgtttcttgaccgtctcaaagagaatggccagcatggtccatacctgatagtttcttctctggacaaggacaacggcattggagactggttgagacagataaggctttttccatctatgaaggaactgctttactttggaaaccaacagggtcgcgcaacaatgaggaaacagtttgcgcgcaaagctgttggccctgatttcccgatcatactgaccacatataatatggtcatggtagaaaagcaatggcttgctcagtatgactggaaatatgttgttgtcgacgagggctatcaactcaagaaaagagaacacgaagtattggaggcggtaaagcgccagccaatggatcataagctccttttgataagggagcctttccaaaataacctagcagagctgtggtcgctattgaactttgctctgcttaatgcattctcatctcgtgaggaatttgattcgtggtttgataaatctgggaaagaaggtgaggaacaacaaattgaagaggaaagaagggcccttctttcgaagcttcatgccattttgcgcccattccttctaagggacatgaagggggctgt

SEQ ID NO: 69900 - DNA, 626 bp, Triticum aestivum
  Clone ID: PAT_TA_69900
gctggcacaggcaatggagtagtgaagaaacaagaaccttggcctttcacattggtacaaggtcctccaggaacagggaaaactcatactgtttggggaatgctaaatgttattcatcttgttcagtatcaacattactatgctgctctgctaaaaaaacttgctcctgaaagttatgagcaagttggtggtagtgctagcagcacctcagaagctgttgctgcgggctcaatggatgaagttttgcagagcatgaatcaaaacctgtttcgcactcttcccaagctttgccccaaaccgcggatgcttgtttgtgccccatcaaatgctgcaacagatgagctgcttgctcgtgttctagatcgtggtttcatagatggtgagatgagggtctaccgccctgacgttgcccgtgttggagttgattcacagtcccgtgctgcacaagctgtttcagttgagcgacggacggaacagcttttaatgaagggacgtgaggaagtaattgggtggctgcatcaactaaaagtccgtgaacaacaattatcacaagagatagcacttctgcagagggaacttaatatggttgcagaggctggtagatctcagggttcgtttggagtaga

SEQ ID NO: 69901 - DNA, 594 bp, Triticum aestivum
  Clone ID: PAT_TA_69901
gcggctggtccttgcggcggcgctcgttcttagccggcgccaacggggggatggaggatgctagtatggagttcctgcttgacgccgttgacaggtttcccctgagagaggaattcgctgacaaccttgagcacccagatccgattaccctcgtcttcctggaggacgacggagccggtcatatgtggttcccgcggaatctattgctatgggtctggttgtgcggaaaaggtcggagacgatggaataggtagagcgcgtgaaggagctcgccgtggccgtaatgcatctccgacaaggtcggcgcagtcgactgacagagtcaatccacaagcgtctggctggatacaaaggctgcggctaggcaatgcgtgactagaccgggcacaatgtccttctcggatgagcgctctggaggagccttccgcaagtatgcagaggagcctcataagagtgcggatgcgagtgtccagcgctgattaggctcttgtgtgtggtagacaacagttggtacatcacagagcaccatgagggccacaacaattcaatgtctttaatgatgggtgttggacaaagacattgatgtatacacaa

SEQ ID NO: 69902 - DNA, 665 bp, Triticum aestivum
  Clone ID: PAT_TA_69902
ggccttgcttgggctgctctcacgcccgcaggcttccccctccccaagatccaaaagcttcatcactgtgcgccgcctcgatctgctcggctcctgccggcgctagtcgctgctcggcgcgatgggctccgccggtcttccccatccttcctcgacctccatccgactgggccgggagcgcagctttgatctgctctgccgcggacggtcctcgccgccgctcgccgtgctagcatccaacgggctccctcgacctccctccagctcgcctgccgcgctccgccttcaccgcagctcccccgcgcctcgactccaagcctctgctccacgaccccgagcaccgagctgtgtgcctcggctctagatctgcatccgctgctctgggattcaaccttcccctcttgcgcatggcctgcaccagcgcggcttggctccatgccgggtcttgctcctccatgccccgaccagctcttgcctcgctccatctcgcaccgccgcgcggagtccacttccatcatgcccatcggcgtcctccaccgttcagatcaggccggggctcgccgctctcgacctgcgccaccatcctccgcgtcgaccctcctatgctcccccaccctctgtccacctccgacgacgcaccacctcgtctccaccctccccaccgg

SEQ ID NO: 69903 - DNA, 385 bp, Triticum aestivum
  unsure (1)..(385): unsure at all n locations
  Clone ID: PAT_TA_69903
gaaccaccgccaacaccacacctcgagngccctcatcgccggagaagcagcaagcaagcaagatggccggaaggaagggcggcgacaggaagaaggcggtgacccgctccgtgaaggccgggctccagttccccgtcggccgcatcggccgctacctcaagaagaagacggccaccaagtcccccaagaagaaggtcgccgccaaggagtagccgcccccatagcctagcctgcgccgaggaaccgtgtcgtgttgcctggtctcgagttgcaagctgtagtgtagtggccctttcatcagatctcgatgaggaaggccgatattgtatctgtgatttctgtgggaatggcgaaagatgcaaacctttcaatcttaaaaaaaaaa

SEQ ID NO: 69904 - DNA, 721 bp, Triticum aestivum
  unsure (1)..(721): unsure at all n locations
  Clone ID: PAT_TA_69904
tcggcacgaggcaacgtctggcacgtctcactggnagnagcgtggaggggtacggcagctacggcttccgctgcgggctgttcggcatgggccacccactgctggatccgtatgccaaggtgatcggtgacctggttgctgccaatccccttcatgtgaaggggatcactgcgccgtctatgagctgcctcggatcgttggcgactccaccgagctacaattggggcagggacaagtggccacgcttgccactggagaagctggtggtttaccgggcaaatgtggccttgttcaccaaggacaagtcgagcgggctgccggacaatgttgccggtactttctccggggtggcttcaaagatacagcgctttaggagccttggtgtcaatgcggttttgctggaaccagtgttccagttcgatcaggtgaagggcccttacttcccgtaccatttcttttcaccaatggactcgtatggcggtgaaggctgcagtgcttcagctatcacggctatgaaggatatggtcaaggcaatgcacaggaatggaatagaggtcctcttagaggttgtttttacacatactgctgaaggagaagcagatggtcagatgatatcgatcagtggcgttgacaattcctcgtattacattgctgatgagattgctggatgcaaatcgggtatactgaattgcaattctccagtgactcagaatctgatttt

SEQ ID NO: 69905 - DNA, 638 bp, Triticum aestivum
  unsure (1)..(638): unsure at all n locations
  Clone ID: PAT_TA_69905
gttcttccccaaataccatccccagnagccggcgtgcacccgccacctcctcccatggatctgcacgcatcccggtcgatgagggcaactagttcaatggtgaagctcgaccttccagatccatggcagcagctatgagggctggcctcacggagcagagctgagctgcgcccttcccatgctcttcatcgatctgccccgccgccgcgccggacggcgccgccttgctttctctccttattttccctccttaccctcactcaatctctctcgtgctgtacgtgaagccatggccatctcgaaaatcttttccacccgccgctgctctagattcggccgtcaccatggtttctcgtgtcggatccagccaccgtcagccagatccggcgcctagctagctgcccggttaatttccgccacctcgccgtgtcccgcagcaccgggagacaccgtcgtgctcccatcttccacccctgcacccgcagctgctcagggcgtcgtcccccaaatgcagctcggttgccgctcccatgcagctcgggtgctgccttctctcctttccgctcgccatgctgcttggggaggaatggagcagcgacggaggagcgcgctcatggcgggggcagaagggaacaggt

SEQ ID NO: 69906 - DNA, 176 bp, Triticum aestivum
  Clone ID: PAT_TA_69906
ggagaactagtctcgatttttgctctgctctatgtatggttgtcagtcgactctccaatgttggtgtcagtaactatcagatgttaagtgtctcgaaaactttctgataattgtggtatttgctttgtaatggtaatcgtgaaattggtgtggttgtgttttggtcaaaaaaaaaa

SEQ ID NO: 69907 - DNA, 672 bp, Triticum aestivum
  Clone ID: PAT_TA_69907
ggaaggatctcctcgtatctctgatgctctcgaagaagtgtttgttcaagctaggcaattgggcgagctgcgtcaaaggtatgaacaagagacgcgggattccgacgctggtgctagtgttgaccctcgcgtgatggccctatacacagatgttacaaagcttgtcggcgttgaagaaccacgagacaagttgatcgacatgttgattgaaggtgatgattggtcgaagcatccattgaagacggtttctattgttggatttggtgggatgggcaagacaactcttgccaaagcagtgtatgacaagctcaaagtgcaatttgattgtggtgcctttgtttcagtttctcaaaatcccgacatcaagaaggttttcaagaatattttgtatgaatttgacaagtgcaagtatgcacacattcataatacagaatggcaagaaagacatctgatcgatgaaatcattgaatttcttaatgacaagaggtatctcatcgtaattgatgatatatggaatgaaaaatcatgggagctaatcaagtgtgctttctccaagaagagtcatggcagtaaattaatcacgacaacccgtatcgtaagtgtctctgaagcatgttgctcttctagtgatgatatttacagaatgaaacctctctcgaatgatctctcgag

SEQ ID NO: 69908 - DNA, 406 bp, Triticum aestivum
  unsure (1)..(406): unsure at all n locations
  Clone ID: PAT_TA_69908
ttcggcacgaggtnnaggtgctcaagcaggtgcaccccgacatcggcatctcctccaaggccatgtccatcatgaactccttcatcaacgacatctttgagaagctcgccggcgagtccgccaagctcgcgcggtacaacaagaagcccaccatcacgtcccgggagatccagacctccgtccgcctcgtcctccccggcgagctcgccaagcatgctgtctccgagggcaccaaggccgtcaccaagttcacctcatcctaggctcctcttgtgttgattcttgtgtttctttcctcttcctcgtctgatgaattctgtagctagctgtgtgtgttctgacagtgtcatcttgtaacaatggtgctgcctgaataaatagtcgtgttgctgcttgaaaaaaaaaa

SEQ ID NO: 69909 - DNA, 626 bp, Triticum aestivum
  Clone ID: PAT_TA_69909
gtacataaggaagcggctgttctcagatcttgataaaacaagtgttcagcatgttcttcgtcagttacgcaagttaccttgggctgagtgcgaggagtacctggtgaaatgttttctcaaggttcacaagggaaaatatagccaagttcatctgattgctcttctaactgctggtcttagtcactatcatgatgattttcatgtggctgtggtagatgaggttctagaagagattagagttggacttgagctgaatgactatgcaatgcaacagcgacaacttgcccacatgcgattccttggggagctatataactacgagcatattgattcatcagttatatttgacacattgtaccttattactgtatttggtcatggaacactggaacaagatctgcttgaccccccagaagatttcttcaggataaggatgattgttacacttctccagacatgtggtcactattttgatagaggctcttcaaaaagaaagcttgacagatttttgctacattttcaaagatatattctgaacaaagggccattgccacttgatgttgagtttgatgtgcaggacatgtttgctgagctacggcctaacatgactaggtattcatctccag

SEQ ID NO: 69910 - DNA, 692 bp, Triticum aestivum
  unsure (1)..(692): unsure at all n locations
  Clone ID: PAT_TA_69910
gcaggnaattcggcacgaggcttaacatgactcagaacttccgactatctggataaggattttttagcctatgctaaacgttaacaagtcctgaacaaagacactgattaaatactcgcttactccatttcgcctatcttttcttttagtcctgaacaaagctaccaacaaaaatatactcatttgcttcctcacgctctatcctttctgccttactggcaatctgctgtccgagttgcagaagagctcgctgcactactaagaagagcataaatgtgtgttgaaaagaaactgggaatgaaaaggtgacgatgcagaatgataacatggtttctgctgaacggttgtgaatgagtaaatggtagccatggaaatgtagaacatgatcgtgtaaaaaaaaatgggatcttaatgccatcggtacaccatgtagcagttgctgattgataccaccaattttgttcaaacattgcactgattaagtaataaatgagtgtagttcacatcaagggcagaagttttttagttgagccagcctcagcaatgcggcagcagagtagaatacaaacgacaaaaatggccaggacgtacactggtgcagcttgcgtggcatccactcttgtttctagttaactccatgattttatatataatagcctgttaactctatgcattagtgtctttttttctat

SEQ ID NO: 69911 - DNA, 615 bp, Triticum aestivum
  Clone ID: PAT_TA_69911
gtgcaatatggggggaggaagatataccttgtatctcactgtctatgctgagcgcctctgtgatgcataaactgcgacctcagccagcatgggatcgtacctgcaccgcggcagccgcagctggtcttctctcagaactgcacatgcggcctgagctcagtgcgtttaaactagaagagcaagctgaggcagtagagtgctcgctggatatcttgctagacgctctcatcgcgagacgggttcgcctgggccgatcaattactcgaaagcagagacatagaagagactgcatatagtgaaagatgccagcagcgtcggcggagatcataatatttccttgaaggctgtttgatctttttgcagaatcggaagagaattgctcatataattctttaggtcactaactcatcaccctggtggtgttcattttgttagtggttgtgtgttgatgttactgcttaccttacctttaagagcagaattttggtaaccaactggtatggaaattaaacgtgtaagttacacgctttgtagctacgatattaggaacagtccgaaatgaaaaagaaaattatatttgattaatgttaatttttcccttgtccataaaaaaaa

SEQ ID NO: 69912 - DNA, 446 bp, Triticum aestivum
  unsure (1)..(446): unsure at all n locations
  Clone ID: PAT_TA_69912
gaaaaaaaatgttctcgttgagtacgcatgtcccttgatgcccgctgcctcttgatggngtttcttacattgacccaatctcacacatgcatcatctctcggngcttactgctcgtccgcattcgatgttgttcccttcggcgtctttcgcaggctgngctggtctnatggttttcgtcagnggngatgatcgctctacacctacttctataggccacacttnagcgactcctnttgcgacctctgcacatggngatcattgctctacatcgtctctcgngcttttcatggactacgcctcgtacacatgccttcccttagcgcttggngcttgtctgcatgttacctcgtctcctccgtctgcctctgcagatgatacttgttatgctacaccgccttatctatcggcttccactcttgcatccatgatggcttgcactttctca

SEQ ID NO: 69913 - DNA, 697 bp, Triticum aestivum
  unsure (1)..(697): unsure at all n locations
  Clone ID: PAT_TA_69913
gnatattgaaaaagtcgctgaacggataaaggacactggagtaagtgttcgcaaacgtgcgatcaaaattatccgtgatctttgtgcttcaaatccgaatgcggatacaagtcatgcctttgtggagattatttcgcgtgttaatgacgaggaatcaagtgtacaggatcttgtatgcaaaacattttatgagctgtggttcgatgaaccatctgggagtcataaacacttggttgctgatggtagttcagttcctatggagatcgcaacaaagacagagcaaattgttgacatgttgagaaagatgcccaatcatcaaccccttattaccattataaaacgcagtttgactctcgagttcctcccgcagtcaagtaaggctgcaggcattaactcatccatgatgacatcgctccggaaacgatgtgaattgatatgcaggcgcttattggaaaggatattgcaggttgaggagggagctgataatgagaccaaaatccacacgcttccttatgttcttgtcttgcaagcattttgtatcgtggatcccaccctctgcactccagttaccgatccctctcagtttgttgtgacacttcaaccgtatcttaagaataaggtcgacagtaaatcaactgcccagttacttgaaagtataatttttgtgattgatgctgttatcccactcatacggaag

SEQ ID NO: 69914 - DNA, 619 bp, Triticum aestivum
  Clone ID: PAT_TA_69914
ggttggggagtggaggtagtgcgccaagcagcaatgccgccggtggcagtgcaccgtcagccgtgaacccagcgggaggtggcacggccgccgccaagagcgattctccgacgaataatcctgccacaagtggcagtgcgccggttagttcggcagatcggaataaaggtaactctactggaggcggttctagtagccaggcagggggtggtggtggatccccaaccagtgattcagccggagaaagaaccgtggcgaaggccgacgaggagagtgatggatcaaataagcagtcgggaagcgtagctccgacgaataatggcgccgctggaaatgtcagcgcggtgaaggctgacaccaaggattcagttgtagtctctgccggagatggcagcaccgcgaagtctgattccaaaattgggtctgatagtcaggcagtgactgcaggcggtgctccgagcagtggttctgctgctggaaatagcaccacagcgaaggctggtggaaaggattcagttggtgcggcgagcagtggctcggccgcaactgacacagttgtgaaggctgatccaaataatgagtctgatggtgcatcagggagtggaaatgtagatgaaac

SEQ ID NO: 69915 - DNA, 660 bp, Triticum aestivum
  Clone ID: PAT_TA_69915
ggcctgttcctgactcggcaaaaatgtccactcacgttcaaattactgatcaaaagttacgcctgtgtgacatatgtggagcattcttgagcgtgtatgacagtgaccggcgtttagcagatcatttcggagggaaactccatatgggttatatgctaatacgtgagaagttgtctgaactgcaggaagagaaaaacaaaaggcgcaaggtggaccgaactgaacatgacagaagatccaaggaaaggagcacagaacgtgatagagcatcgagcagggaccgtcatagagtagatcgaagcagcagtcgtgacaggcacagggattatgaccgtagaagtagccatgatcgctaccatgacagagaaagtagatatgaccatgataaagaatcagggagatctcgtagctatgattcgaggagccgccgaaggtcacgttccccaagggatagttctagggactatgaccgacacgggcgtcgtgaccgttgagatgggcactagatacaggcaagcttgcattagattttctgagggttctgcctaggatgacaagaatggccggcttgcaactggaggaaggcacatgtttctattagtatatgtacatatatgtgcatcttccttcaccccataacccatgaacgtgatatgttga

SEQ ID NO: 69916 - DNA, 657 bp, Triticum aestivum
  Clone ID: PAT_TA_69916
ggccttcctctgctgcgagtcgcactttggcctatggctgaagatcttcgggatcaagccgaagttcagcggctccgaccacacggagtgcggaggggccatgatcagcaagaaccagggggccgaatggttcaagggcaccttcatcaaaacggtgaaggagtggcagcgagagtggttctacatcatcgaaccgctcgcccctggtcaggccgaggttcctgccttttcggccgggcctccgaagaagatcaggtcctggaaggagaagggcgttgcctgtgggaacccagccgaggtggaagccatgatcaagaggatcaagtggtggtccactacaaagacccttcagctcgccgacgtcatcaacgtcatgctcaaccgccgtatgctcccgctccagcttcgggctaccctgatgtgggtgtaaaagcccgaggacatgggccccctcaccgcttttcttccgctccaccttggcagtcatgtggacgcggctcctatagctggccaaggacaagatccctgaggaggggaaggacctcggcttcgaggattgctacgaagccccccgaagtggttggcttgggtgcagaaagtgcagtgcatggccccactaccagaggagcaaagaacccctcggctcacgacgctcct

SEQ ID NO: 69917 - DNA, 627 bp, Triticum aestivum
  unsure (1)..(627): unsure at all n locations
  Clone ID: PAT_TA_69917
ggcgacgcaggggcgaagnaactcggngtcggagaggcagtacccccggcgaccttcctggccctcctcagtagaaccagaacccaaaccgtgcaccagtaacaaagctgaaggggccaacgaccaccactgatggcgttgtggtgtgagaacatggcgttgccgccccgtgtccttgtcgctccccgcccttctggtgccaatggtcaagggaatattctattacttcgccatccaaaactagaagaagaaacacagtatctgttcactgacggccaacttcatgaattcaattggtttaaggagcgttatggttcttggttcctgggagattatgtctgtgaagatggtagcatttactattgcacacttgttgaccccatctttgttcttctaccacttttcgaagctgcacgtatgtcgaacggtaaggatctgggaaaattcagacagttggatgaaattttatacatcgaaggttatcctggatatcagcacctcatgagtatagcaggaaagcatatggaactggtttgtgaagttaaagaagttgctaatatgaagttcttcaggctagatgattccaaggtcttaacttggatgtgctgtaaggtacacagtataaaa

SEQ ID NO: 69918 - DNA, 678 bp, Triticum aestivum
  unsure (1)..(678): unsure at all n locations
  Clone ID: PAT_TA_69918
ggaacaaagactgggatccagtgcttcaagtacaagctgctgcgggagccaggacaacccgagggaatgtcaatctggaagatgtcccggaaatgggtagagaatccagcaactagaggcagagttctacaccctgatctatcatctggtactgaaaatcttccagtgtgtcttgtcaatgatattgacagtgagaaaggaccaggccttttcacctatattactcaggtcaagtacccaaagccactaagttccatgaaaccattacagggttgttcatgcctcaatgcttgtctgcccagtgataccgattgtggttgtgcagagtttaatggaggtaatttaccttacagttcaacaggattgcttgtatgccgcaagaataggctatatgaatgtggtgaatcttgccagtgttcagttaactgccnnaacagggtgacacagaaggggattagggttcactttgagatctttaggacaggaaatcgaggctggggtcttcgttcatgggaccctatacgggctggctcatttatctgtgagtatgttggcgaggttattgatgagagtaaactgaatttgaatggtgaagatgattacctttttcagactgtgtccccttgtgagaagacattaaaatggaaatatgtacctgaactgatgggggagcaaatc

SEQ ID NO: 69919 - DNA, 602 bp, Triticum aestivum
  Clone ID: PAT_TA_69919
tctatacattccgtcatttgttccccttcacaacatccgaatcggagggagaacgaacatccgccagggatgggatcgatggccgtgcgcccccgtgggcgtgcgtgcatgggcgtgtgcgctctcccaatcatttggacataaatgacaagcggcttacgaggtagttggatacctgtacttagtagttttgaggcccggattcgatgggtcaatcattcgcatcatttaatggccaaagcggctgaacacttgagacggattgagcttcattaatcgcctccacttttggccccctcttttgttctcttgttattggactcttgcataatctgctcctagccggcaactcttttctcttgcaaaatttccttttgattatttgatccgtctccttgtgatttctttccagcttcagaaaggttcgaccctttccgctggattccaacttgttctcccccattgctatgctgctgttttctcttcttgaaatactactaatatccaagtgcgccatcagatctgcgtttgtcttgtaaatcctgacatatctgtgtggatccattcctttttgctctgtctccctctctttgtaaagctag

SEQ ID NO: 69920 - DNA, 613 bp, Triticum aestivum
  unsure (1)..(613): unsure at all n locations
  Clone ID: PAT_TA_69920
ggnctgcaggnaattcggcacgaggaaaagaggagatgcaaaatggcctgcagaatttaagcactgcagaggaacagtgccttatgcttgagagggctaatcaggatttgcatgtggagctagataagctgaagtatgcttcaaaagagaagcatgaagagcttaatgagaaacagattgagctggaaaagctcagcatctctatacaagaggagcagctcaagagcatgcaagcagaaatggcacggctgtctttagagaagcaattggcacaagtacaggagaagctgcggcttttgtctcttgaaaagcacggtgaaacaagtaagtttaaggatgttgaagcaagcaagcttatgcttcagaaagaattggagatgattcgagaagagaaccgtaaactggatgatcaaaaccactcctcgacatccgtgataatacgtctgcaggatgagataatttccttgaagaatgcacaacggaaactcgaggaggaggtgtctcggcatgtggaggaaaagaaggtacttcaaaatgagctttcacacataaagaatgacagaggtgatgttgagaggaagcacttctcaatcaaggagcaaatacaagtggt

SEQ ID NO: 69921 - DNA, 642 bp, Triticum aestivum
  unsure (1)..(642): unsure at all n locations
  Clone ID: PAT_TA_69921
gggatggccgagctcctggnacagnatggcttctcgggatgatttttcaaagtggtttggtccatcatcaatgcagacattctcaaggtccttgcacctcatcaacaaggcgctcatcactctcgtgccaaagaaggtggatgctcaagaagttaagggcttctagtctattatccttttcaggtcgccaagttctctaaacttgtcttcgtggttcatgtgaaacaaagcacattcatcaaggtgcattgtgtccaggacaaattcttctatatacaatccgttgctaaggcattacacgcgatgaagctgccaacgttgctacttaaggtggcaagctttgatacagtgttgtggccctttctcttcaccttgctcctatttggggtttcggcaacattggaggaaactggatcgctagtctctgggctcttgcgcatcatcctcaacggtgtctcggggcaaaaaatacggcatggtcgaggcttgaggcaaggagatctgctctctctaattcttttatcctcatggtgaaggctcaacaacctcttctgcaagatggatgacctcgagctgttaattggtcatgtcaacattcaatattgatgatgtggtgatgttttcgtccccccataagaagga

SEQ ID NO: 69922 - DNA, 292 bp, Triticum aestivum
  unsure (1)..(292): unsure at all n locations
  Clone ID: PAT_TA_69922
gcccactcctccttcctcctccagccctagccgccaggggacacacctttcccctccaaaatggcaatgtgagcagaggaagccgccagggcacacacccacccacttctcctccttcctcctccagccccagccgccagcccccatccacgaaaatcacaaaccctcatcgcagcacgcaaaaacatggatgcaggaagagatcangagggcacaaagcactcaccaggctgttcttgatgcttatggagcttctctgtttggttctcagaaacacaggggggggggggca

SEQ ID NO: 69923 - DNA, 637 bp, Triticum aestivum
  Clone ID: PAT_TA_69923
gggaatggtgatatgtcctggaaagattttctctctcgtgctgctgagagtacatggatgacctctccagtttatcaatctggcctacaaatctgggttgggtcatgggacctattcaactgttctcatgctttttaaatggtgcgacattggctttatatcatggttctcctcttggacgtggtttctgcaaatttgtgcaggatgcccgtgtgagtgtattaggatctgtgcctagcttggtgaagtcttggaaggcagggaatcttactaaagggctagactggactaaaatcagggtacttgctacaacaggggaggcttctgatattgatgataatctgtggctatcttcgcgtacctgttacaagccaattgttgagtgctgtgggggcacagagctggcatcctcatacattcaagggagtcttttgcagccacaagcttttggagctttcagtggtgcatcaatgtccactgggtttgtcatactcgatgaacaaggaaatccatatcctgataatctaccttgttctggagaagttggtctcttccctttatattttggtgctaccaatcggcttctcaatgctgaccacgataaggtttacttcgatggaatgcctatttacagagg

SEQ ID NO: 69924 - DNA, 609 bp, Triticum aestivum
  Clone ID: PAT_TA_69924
gctcccctgcctccagcaaactcacagcccccaccaccgaagctcccaaccccacccgaagcggcagccatggcccccaaggcagacaagaagccggccgcggagaacaaggtcgagaaggcgacggagaagacccccgcgggcaagaagcccaaggccgagaagcggctgccggcgggcaagacggcgtccaaggaggccggcggcgagggcaagacccggggccgcaagaagggcagcaaggcgaagaagggcgtggagacgtacaagatctacatcttcaaggtgctgaagcaggtgcaccctgacatcggcatctcctccaaggccatgtccatcatgaactccttcatcaacgacatcttcgagaagctcgccggggagtccgccaagctggcccgctacaacaagaagcccaccatcacctcccgggagatccagacctccgtccgcctcgtcctccccggggagctcgccaagcacgccgtctccgagggcaccaaggccgtcaccaagttcacctcctcctagactgacgatgcgtcgcttgttgtgacagatgtggctgtctgatgtatctgcaagtagaagtagtagttcgtgtggtag

SEQ ID NO: 69925 - DNA, 633 bp, Triticum aestivum
  Clone ID: PAT_TA_69925
gctcgtcttggagcttgattggttatcaacccgaacaaggaaggatgaaccacttgtattatgcatcgctggagctgatagtagctttcgtctggttgaagttaacactgataccaagatcaattctgcttctaggctgctgactacaaaagagagatttaggccaatgccattatgcctaccaatactattccccacagcacatgctttggctctgcgtatgattctgcagctcggtgtgaagccttcttggtttgaatgcaataatagtgataaattagcctctaacagctttaaggaaggaccgtcaacctttggggatcttcgttcatacatgattgagacaacacttcctcctattggtgattctgtagtggctgaattgctgcttaaagtgttggagccatacagaaaggatggttgcatccttgatgatggaagagccagcttatattcagctatagtaaataaaggaacttgtgcaaggtttgcatttgctgctgctatttttggtgatttccaagaagcacttttctggttacagcttccgcaagcccttcagcattccctggataaatcgacaagtagatcaagtgagggcttcgaatcaagtgtacgcgctgattctgaaca

SEQ ID NO: 69926 - DNA, 727 bp, Triticum aestivum
  unsure (1)..(727): unsure at all n locations
  Clone ID: PAT_TA_69926
attcggcacgaggggtaatcccaatccccacagnaaatccccatctcaaaaccctagccctcatccccgatcccggcgagcgagatggccaacccgagggtgttcttcgacatgaccgtcggcggcgcgccggccgggcgcatcgtgatggagctgtacaaggacgcggtgccgcggacggtggagaacttccgcgcgctgtgcaccggcgagaagggcgtcggcaagagcggcaagccgctgcactacaagggcagcgccttccaccgcgtgatccccgacttcatgtgccagggcggcgacttcacccggggcaacggcaccggcggcgagtccatctacggcgagaagttcgccgacgagaagttcgtccacaagcacaccaagcccgggatcctctccatggccaacgcggggcccaacaccaacggctcccagttcttcatctgcaccgtcccctgcaattggctcgacggcaagcacgtggtcttcggcgaggtcgtcgagggcatggacgtcgtcaagaacatcgagaaggtgggctcccgcagcggcacctgctccaagcaggtggtcatcgccgactgcggccagctctagatccgcccgcgcgcgggtcgcctttcgccgtcgtcgtcgccgccccgtgtgtcccgtgtcgtgtcgtcgatctaaataagagagtcgtgtgtcgtgtcgtgtcttcccctggtccgtccgatgagat

SEQ ID NO: 69927 - DNA, 770 bp, Triticum aestivum
  unsure (1)..(770): unsure at all n locations
  Clone ID: PAT_TA_69927
ggnctgcaggnaattcggcacgaggatagttgtctaatatttacatagtttttcatccgtacatatctttattactgatttataatgtttttcggatggaagcaaaactaaattacggataaatagagaatgtgcaaattagttcaagatcaataaatttatgtaacttatgttgctagtacggacaccctagtagtcacttatttgctactattttcttagccatatcatcctgattctaccctttgtcccatcatagaaattgacacatcacccatggctgcaacagtctcaacgtgatgaagagccaaatcagtttcctcctccgtcttacacatgaccttgcttcctgtcatgtcacaaaagaagaaaacagtccctttctctgtaagattgaacagagtcaagccataaaagaaaatggacaagctgattttttcatcatgaaattttgtgttttgaaatagttactaaatatgtaatgtttagtccagcagccaaatggttataccccagagttgtttacatcattgcttcactcatggttcagtgccatgatggcataaaagatatcttagaaaaagccggatacatagtaatgcctaattaacagatggtcaaagcaattatcaaaaaacatgaagagcaggttaaccattgttacatcccaaatctatgagaacatctgtaaataattatctgtaatggggtgtttagagtacacctgctttggttgtctggggtgtggtcgagagtggatgttcgcatcc

SEQ ID NO: 69928 - DNA, 670 bp, Triticum aestivum
  Clone ID: PAT_TA_69928
ggtatgaaccatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagccgcggtaattccagctccaatagcgtatatttaagttgttgcagttaaaaagcccgtgttgggatccaccaaagggtgaccaaggaagacgccatgaagtggttccaggtcaagtatgagggtgtcatcctgaacaagtcccacgctagctagtaa

SEQ ID NO: 69929 - DNA, 566 bp, Triticum aestivum
  Clone ID: PAT_TA_69929
agccggcggcgaagaagcccgcggaggaggagcccgcggcggagaaggccgagaagactcccgccgggaagaagcccaaggccgagaagcggctgccggcggggaagtcggccgccaaggagggcggcgacaagaagggcaagaagaaggccaagaagagcgtggagacgtacaagatctacatcttcaaggtgctgaagcaggtgcaccccgacatcggcatctcctccaaggccatgtccatcatgaactccttcatcaacgacatcttcgagaagctcgccggcgaggccgccaagctggcgcggtacaacaagaagccaaccatcacgtcccgggagatccagacctccgtccgcctcgtcctccccggcgagctcgccaagcacgccgtctccgagggcaccaaggctgtcaccaagttcacctcctcttaggctgttcgtcttcctgtgtctcgtagttagctgttcgggtgtgtttgtggccgtgttatcctgtaagaatcgcaccgcgatgtttctgtatctcgagaaatggtaatggtgcctgcctcaatgttcagt

SEQ ID NO: 69930 - DNA, 609 bp, Triticum aestivum
  Clone ID: PAT_TA_69930
ggggttgcagtcgccggtgacaacaaaacgccgggtggctcctgctccagccattacccctgaaagcagggggaagtcgacgccgaggcgtgccaggagcgatggctcgtctctggtcatcgatatgaaggccgcgaggaggcgatcagtggcttcctggtggtggggaggcttctatcgcccttccaagtgaacccgtggatcatcactaacgaactccgtgctacttcagcttggaagctgcaaggagcagtcactgctcaagatctggccagcggggatgggaggttcgtccttaatttctctgccgaggaagaccggaggttcattctcaaggcccagccatggcactataagcgtgatggtgtcatcttcgctgagtttgatggcaagggaaaccctgtggaggtcgatcttgcgttatggcaatttgggttcaggttcgtgacctcccatttgaacttaaaactgagtatgggctggtcttttggggaccaacttggcgatgtgattgccgtttcccatagaaaccacatgatcgtagagaagtttttgcgtttaagggtggaaatcccactacatgaacctcttaagacatcagtagagttc

SEQ ID NO: 69931 - DNA, 593 bp, Triticum aestivum
  unsure (1)..(593): unsure at all n locations
  Clone ID: PAT_TA_69931
ggttatgttctttgctctcgtggtttgatagctgttagcttaatagctagtagaggatcgcggcatgaatgtttacgtgtgctggagcagtaactgtcaattcttgtgcaggttccgttatgaaatgtctatctttaatgctatctaggaattaggagtataaactagcaagaaggctaattgtcttaaattacaccttgatatatatatatatatatatgtnacttccttacatgtngggntgcanactttcagctatttcagtatgtagngatgatntattccaatggtatagttncctctctagaagtcaagtgtatagaattatatagnaatataacttgnacctccttattatgcactncctccatctgcagatgtaagtcgtaattttgttttctgcggnccacaagaccacantgcaagatctatactatgtgntctgttatattataatataggtaatagtntgtgttagtattttgcaagagaaagccagngctaaaattttcatgtntgtattcacatatactganggtcaaacttttgaaggntgatcatggatcccatggcacctgtatatttagagacgg

SEQ ID NO: 69932 - DNA, 236 bp, Triticum aestivum
  Clone ID: PAT_TA_69932
gggagagccctcccttctccattactgctcctcactcaagcttcttgagcttctcttgctcatccaagatgtgcgagagaaggaatggggagtggagagcagcatcccccactgacgcgcgggaccccttccttcctttcttcaccgcgatggggagagcagccgccgctgccttgcaggccacggcagcgaggaggcgagggatccggaggcgagacggcccgctacaccagctt

SEQ ID NO: 69933 - DNA, 599 bp, Triticum aestivum
  unsure (1)..(599): unsure at all n locations
  Clone ID: PAT_TA_69933
tcagggnatagggttctgcccgccgccgccgccgccgcccacctctcctccttccgacgagcatccacggccgccggccctccgatggaggcgccgccggactggccgtccgcccgggtccgggaggagttcatcggcttcttcgagtccaaggcgcacacgccatggccgtcgagccccgtggtgcccgtggacgaccccacgctcctcttcgccaacgccgggatgaaccagttcaagccggtcttcctgggcacggccgccccggactcgccgctcggccgcctgcgccgcgcctgcaacacccagaagtgcatccgcgccggcggcaagcacaacgacctcgacgacgtcggcaaggacacctaccaccacaccttcttcgagatgctcggcaactggtccttcggggactacttcaaggacggggccatcgcatacgcatggcaattactcacacaggtctacaaattgcccactgacaggatttatgcaacatactttggtggcgatgacaaggctggtctcgctcctgataccgagtcgaaagacatatggctcaagtatctaccgaatgaaagagttctgcctttcggttg

SEQ ID NO: 69934 - DNA, 624 bp, Triticum aestivum
  unsure (1)..(624): unsure at all n locations
  Clone ID: PAT_TA_69934
ggccggcctcgctcctacagnaagtttgggcccccatccttcgcaggaaacatcctgctctgcggctactctgcttcttcggcgccctgcccggtatcgccgtcccccgcgccggcatcaccaggacaagagcccaccggaccccgcggcggccgtacaaagaaggagctcatactgatcataggggggatcgtgctcggcatcctcatcttgctgtccctctgctgtcttctgctctgttgtttaataaggaagaagaggtcgagcggcagcactggagcacggagcgggaagcagacgtcgagcaaggaagccggtgccggtgccgccgcagcggcggccggcagaggcgagaagccgggaacgtcggaggcagaatccggcggcgacgtgggcggcaagctggtgcatttcgacgggccgctggcgttcaccgccgacgatctgctgtgcgcgacggcggagattatggggaagagcacgtacgggacggtgtacaaggcgacgctggaggacggcagcctggtagccgtgaagcggctgagggagaagatcaccaagggccacaaggagttcgaggccgaggcggcggcgctcggcaagatccggcatcccaacctgctg

SEQ ID NO: 69935 - DNA, 654 bp, Triticum aestivum
  Clone ID: PAT_TA_69935
gcaacgcacaaacgcagcaaccagcagtgcatggtcgctttgttgagaagaccgagcttggtgagaagaacccgacaagtaggtcgaaattctgattggcggcgttcgaaagtgacgatgggtcaagtgaatctgcatctttagctgaaattagcctcttattttgttttctttctcatcatcgtctcaattttcaccggaccggaactatattaatacaacacatgtaggcaagttggacttggacacagcggagactgcattgggtttggtggtaggctgatggacacatgcaagtcgcttagccagctccatggagttctagccgctcatatggactgagcaagctggacaaattcatgcgtgaacgaacattgctgcttcagatcttggccggtaattaagagactgtttggagtccctctgctccatgctgccgctcccggagctgacggagttttagttcaaaactgtggagtgagtgaatcggtgctccccagattcctaaaatccagggagctggtggactgccgaacaggccctaatactgaacttgacccttcatcgatattaaaatacttaacctgacagcccctacacctcatgttgattgatcacttttgatttgtttatttcatttcccttttgatatgg

SEQ ID NO: 69936 - DNA, 499 bp, Triticum aestivum
  unsure (1)..(499): unsure at all n locations
  Clone ID: PAT_TA_69936
ttcggcacgaggcgcaaccgccgccaacaccacacctcgngngccctcatcgccggnagaagcagcaagcaagcaagatggccggaaggaagggcggcgacaggaagaaggcggtgacccgctccgtgaaggccgggctccagttccccgtcggccgcatcggccgctacctcaagaagggccgctacgcccagcgcgtcggctccggcgcccccgtctacctcgccgccgtcctcgagtacctcgccgccgagaaggaggccaagtcgcccaagaagaagacggccaccaagtcccccaagaagaaggtcgccgccaaggagtagccgcccccatagcctagcctgcgccgaggaaccgtgtcgtgttgcctggtctcgagttgcaagctgtagtgtagtggccctttcatcagatctcgatgaggaaggccgatattgtatctgtgatttctgtgggaatggcgaaagatgcaaacctttcaatcttaaaaaaaaaa

SEQ ID NO: 69937 - DNA, 648 bp, Triticum aestivum
  Clone ID: PAT_TA_69937
ggtgactggctcacgtttcatgttcatcggcgcggacgtgaaccacccgcctccaggagacacggtgagtctgtcgatagcagctgttgtggcgtccatggattgccctagcgccagccagtacgtgccgagaatccgtgcccagaagcgcggcacggaggagatcgataacctcggtaccatgtgtaaggagctcatccaagtctacatggaaaggaacggcggcttcaagccagacaagatcatttacttccgcgatggcgtgagcgacgagcagttcaagatggtccttgacaaggagctagtgtctatggagaagggacgatcacagttgtcgtggccaagaagcggcacaacacgcggctgttccccaaggacgaaaacgagctgcagacaacgaatggcaatgtgctccctggcacggtcgtcgacacagtcgtggtcgacgggtcgcacgatgacttcttcctctgcagccacgacgggctgcacgggacgagccggccgacgcactactacatgctgaagaacgggcacgccttcaagcccgtggacctgcagaagctggtgtacagcatgtgcttcatgttcgctcgctgcaccaagccagtgtcgctgacggcgcccatcaagtacgccgacaccgcg

SEQ ID NO: 69938 - DNA, 691 bp, Triticum aestivum
  Clone ID: PAT_TA_69938
gcaaaaaaacacgcggcctcctctttccccgggcggcggcgatgactacccgcagagccaaaaagcgaaaatggcaggaggccgagttggtcgccggcgtctcaccaccggcgaacgacaagcgcgaagtcggggaaggtcccgagctgatcagcgacctccacgtcgacgttctccggcgcatcatctcgctcctccccaccaaggatggcgcccgcacccagatcctctccaccaggtggcgccccctcttccgctccgccccgctcaacctcggcgtcgttctccgccgcgaagacgagcccgtcccctccagcctcgtctcccgcattctcgccgaccaccaggcgccctgccgccggctctcccttacctggtacggctacaaatctgactatgtctccccattactgaacggctggctccagtcaccagccttcaaaggcctctctgagttcgatctgtggcaaaaccgcaaggaaatcggcaaggaactttggctagtgccaagggaggaggttccatatgcactgccgccgtccgtgctccagtttttacccgccctccacatcctcagcatcaagtgcaccggctacatgatccatttcccctctgcggccacattggccggcgatctacatttccccaaactcaagcagctcacacttaaaggtgtcgtcgtctcggaggt

SEQ ID NO: 69939 - DNA, 222 bp, Triticum aestivum
  Clone ID: PAT_TA_69939
tcggcacgagggcacacttcccgccgccaccaccgccgcgaaccggagagcgaggccgacaccgccgccgcgatgagggccaagtggaagaagaagaggatgaggaggctcaagaggaagcgccgaaagatgaggcagcgatccaagtaggccgtaagcatcatcttgcatccaggcagcggaactctgaggggtgatggcattgtctagtgattcttgatt

SEQ ID NO: 69940 - DNA, 660 bp, Triticum aestivum
  unsure (1)..(660): unsure at all n locations
  Clone ID: PAT_TA_69940
ctgcaggnaattcggnacgaggccctcactcccacttccacttcctcctgccaccggccgccccacaacccaacccgcctcactcccacttcctcctcccgtcggccgccccccaccacataccgccggctatctgagccgccacccccgcctccccaactccggcctcacgccaccccggccaacccaacctcccactgcccagcctcctccccaacgacctcctgcagtgctgctacgaccagatccacccaccaccgccgggatatggccactcaccacgtcggcccaacccggcggcgctctgcatctccttcgccaccgcgccgtgccacccgccgccccgaccatgcccagctggatctggcccgaccatactcagcgtcttcctctccctcacacccgccccgccgaaccaccttcttctctccgtcgggtgcctcctcacccaccccccgtagtactacgcccactacccccgatccaattcaccttcttccacctcccgcaccgcccacaagcccccaatccatcaacctcctacgcatctgcccgcccaccaaccggagtcaagcccacctcccctaccaaccacggcacggtgcctcccaaatccgccgccaaaaagctccaccccatccccctacccagcctctcgac

SEQ ID NO: 69941 - DNA, 470 bp, Triticum aestivum
  Clone ID: PAT_TA_69941
tcggcacgaggcaacaaaccgcgtccttttctcccgctccggtgctcgcgactgaggcttgacattgtgctcttccacgccccctccatccatccatagcctcccccgccgaccactccggcgcatcctccgacgacccaaggccaacctcgacgccgccctgcggtgcgctccgacggctgcctacggcaagctccgccccgaccagctctgctcgtctctcccggctccgaccaccagcgccggctctgcagcgctgtagcgcacgctgcccctgactcatctacagggtgcacatcacgaagcagggtcgagctgcagatcgacatcgatatggccggaggagcagcatggaaagaatcgggtatcgcagcatggaaagaatcgggtatccaggcgttggtgttgctgagcttgacgctccaggtggcgctgctcatgctggcggaattccggcggcgcgtggactc

SEQ ID NO: 69942 - DNA, 323 bp, Triticum aestivum
  unsure (1)..(323): unsure at all n locations
  Clone ID: PAT_TA_69942
gnctctcctcgtcgaagcagcagcagcagcagcatcctaacttggttctgatggagctcgagcaggcaaagtcgaacctgaacagaaccacgggtgatctcgctgccatcagagcctccatcgagtcgctgcgtcatgacatagcgacggagaaagtcttggtggagaggagccgggcgaaggtgtcctcggatgccaccttggtttcttctctgaaggaggagctggatcagaccacgaagaagctgcagacgctgaaggatctgcagagaaggcgcgaggatccctcggacatcttcttcgagatcaagaggatgacttca

SEQ ID NO: 69943 - DNA, 498 bp, Triticum aestivum
  Clone ID: PAT_TA_69943
tctttgccccaataatgcaaatggttttgctagcattacggttccatcatcaattcccaaagcagtacggatctctccggaatctttgcacatggacgttgatactcatgaatctatgtgtgctagctcaggcgagaaaaatgtcgttgggtctccacataattccgtgttggagttcacgagaactaacagaaatacggaactcaatctaaagggcgagaaagttgatgatagttcagtctcactggttctacggattgctgatttgtgtggtcaagcaagaaatatccatttcctcttctacctcgaatctgacacagctatgtctgttgctgcggaaatggttgaacagttggagctagcagactgcgatgttactttcattgctgattttattgaccttctgatagtcaatcttgttcctggtcggaaactggcaaatgatgcagcgatgagtccatatgtggaatctaaaacgtgtggaagtgagcaagtaac

SEQ ID NO: 69944 - DNA, 560 bp, Triticum aestivum
  Clone ID: PAT_TA_69944
tgcaagaacggtgttgagcaaattacttgagatgggcattgtttgtacaatgaatattctccagtatagaaggccaggacctaagaacgtgttgaaagatgggaacataaccgagcatggcataaggtgccggtgttgtgacaccatatttacaatgtccaactttaggtgccatgcaggtctcaaacaagaaactctgaccctgaatcttttcttgggttctggtaaatcttacagcctatgtcagcttcaagcgtggtttatagagcagaagaagaggaaagaaagtgcaaaagatactatgtcagtacaagcagatgaaaatgatgacacttgtggattatgtggtgatgtcggtgaactaatatgctgtgacaactgccctgctagttaccatcaggcctgcttgccttgtcaggaagttccagatggcagctggtattgctctagttgcctgtgcaatgtttgtggggaagtggtcaattcaaaggcgccaggaggtctcctacatgctttagaatgctcacagtgtgaatatcgatatcacgtaaaatgcatat

SEQ ID NO: 69945 - DNA, 208 bp, Triticum aestivum
  unsure (1)..(208): unsure at all n locations
  Clone ID: PAT_TA_69945
tcggcacgaggcaccctcctgcgctctcttccttcactgtgtgcttgcggtcgcctggatctcccgcaagcagaggagcacacagcccgacagcttccggatgatcctcctcatggaaacctctcgctccatccttctcactcctccggggtgctggtggatagagagatcgcccccccccccccnnccttcccccnnntttttnttt

SEQ ID NO: 69946 - DNA, 296 bp, Triticum aestivum
  unsure (1)..(296): unsure at all n locations
  Clone ID: PAT_TA_69946
ggnctgcaggnaattcggcacgagggaggatagcagttgcaaatgggatctataagggacattagccgttcccatataacggtctctttgtcacgtcgtctgagacttccaggcagtagctccttgctagagcaaggagacctccaacgcgaactttggcggatagacaaggatgagtttagctcttcatttgcaaccatgcgattcaaccttgtccaactgttttctcagaagccgcaaaacactaaactacggaagttggtagttgatcttgaggtttgatagtggaggattgt

SEQ ID NO: 69947 - DNA, 469 bp, Triticum aestivum
  Clone ID: PAT_TA_69947
gaggctccgcatggcgcgcctcgacgacccgctctgggccaccacggtggaccaggcgctcgcgctggacgaggaggagtatgccaggatgttcatcgacccacgcggcggccttgggccgaagcagtatggcctcgtctctgaggcatcgcgcgacgccgccgtcgtcatcatgacccccgccagcctcgtcgagatcctcatggacgtcaaccagtacgcggcggtgttctcgagcatcgtgtcgagggcggcgaccctggaggtgctgtccaccggcgtggccgggtgctacgacggcgcgctgcaggtcatgtcggtggagttccaggtgccgtcgccgctggtgccgacgagggagagctacttcgtgcgctactgcaagcgcaacgctgatggggcctgggccgtcgtggacgtgtcgctggacggcctgcagggggtcaagtgccggcgcaggccctccggc

SEQ ID NO: 69948 - DNA, 525 bp, Triticum aestivum
  Clone ID: PAT_TA_69948
attttaagagaggtgatcaccatgccagggcaacatgaaaaatgctttctgtgtggtcaagttgggcatttggctgctgagtgccaaggccctggtcctgctgataatgtcgtggagctccctccaattcataaaaagaagtaccagtttcttaacatctgggtgctgcgggaatacctggagaaggatctggagattgtagatccccccttcaagataaaccttgaacgcatcttggatgattttgtgtttctctgcttctttgttgggaatgactttctgcctcacatgccgactttggaaattcgcgagggtgccattaatcttctgatgaatatttatagagcagagttcaaaccaatgggcggttacctcactgatgggggtgaggttttactggaacgagtggagcatttcattcaggctgttgctatccatgaagaacaaattttccggaagcgtgcacgtattcagaaggcgtacgagaacaacgaggatagacgtagagcgcagggagagaactcc

SEQ ID NO: 69949 - DNA, 439 bp, Triticum aestivum
  unsure (1)..(439): unsure at all n locations
  Clone ID: PAT_TA_69949
attcggcacgaggcaccagcaagccacacagnngcagccaagcgaagctcgccggagagagaagcgaagatgtcgggccgcggcaagggagggaaggggctgggcaagggcggagccaagcgccaccggaaggtgctccgggacaacatccagggcatcaccaagccggccatccgtcgtctggctcgcaggggcggcgtgaagcgcatctcggggctcatctacgaggagacccgcggcgtgctcaagatcttcctggagaacgtcatccgcgacgccgtcacctacaccgagcacgcccgccgcaagaccgtcaccgccatggacgtcgtctacgccctcaagcgccagggccgcaccctctacggcttcggcggctaggccgcgcccgtccggtcgaatccgcctcgcgccgccagattcgtagctagccatcggt

SEQ ID NO: 69950 - DNA, 484 bp, Triticum aestivum
  Clone ID: PAT_TA_69950
acctggccgtccatgcacgctcaccgtccctccctctctgcctctcccctgtctcccaccacgccgcacgccacctccgccctcccctcgcccccgcgttgatcccaccgtcgagcccagtcaccccccccactctggacgagcgccgccggtggaggcaggtcaccatggccgccgctgacctccgttgtctcccccaaccccggcctccactccatcgtcgttgcccctccccgtcttgccgtggacgcagatccgttggagcttctcagcccgcggtcagacccgccctccctcgacccctgcccgtgccggaaaccctagcctccggccaaggcagctgacagctgggcgcaggcacagggctcggcttgacgacaatgcttcgttcgaatccctactcccctccttctcctcctcttcttctctccctctctgaccccgtctcgtcttgtctctgtaggcaggcgacatggagtggagc

SEQ ID NO: 69951 - DNA, 543 bp, Triticum aestivum
  Clone ID: PAT_TA_69951
ggcgctcgggcaccacttggaggggtgcttccagggcacatttccctcaggaaggtacaagggaaaggaagaccaaacccacaagagttcatcgcaaggaacacccaggagctataggagtcgagagtcatgcgcggcagccgccgcttgaccaccatggccccacatccaggcgaggatggtgggctgcgtctgcatcgacgtgccagggctcaaccgagctgcgtctcaggagcgcctctggccttcgcgcgtggggcgttgtgagggtccaccccacagctatgttcgcatgcctttcggcctgccgaacgcggtcgccgctcatcagcacctgctgaggagcattctggaggaccaggaggtcgggcattgtgcggtcctggcggagatggagatggccctcggagacccacctgcacccccggagcctcttgaggctcgtgggcctgggggctcgtgaggatcgatgtcttcatcatgcatcgcctgcttcttcaacatcacttcatgttcaacggcaccaggtgacatctttctaag

SEQ ID NO: 69952 - DNA, 631 bp, Triticum aestivum
  unsure (1)..(631): unsure at all n locations
  Clone ID: PAT_TA_69952
gcaggnaattcggcacgaggcncctccgcgacctcgtctcggaatccggcgaggagccccatagaaaaatcctgggcgtggggagggggacgcaggaaagaggcgagcatccgaagctgccctgccctcccttccctcccttgtcgcgtccaccctccacctcctcctcctcgtcctcccctcgccctgctcccgtccccttctctgttcatcagtagctgctcagctcggtttccagggagggaggccaaggtcgcggctctgtccggggtgccgcgggtgcatcggaaggtattctgacagtccccactgtttcttcgccggacaccggtccgccgcgttccagcagcgggatgggaggtagtgtgacattgtagtaaaattctgccaccgttgcatggttggtgttcagagttatctttgtcttgagtaaagatgaaagaggagatcatgttcgacaaccaatcaaagccatgcagatcgagggttgactccaagagtaaccaaaatcctctcaagcccaagtttgggtcatcatggggatcccaaattgtcaaggggttcacagccgacaagaaaaccaagaagacagcagctattgcaagcaagaagccgcctcttgcaagcgtgg

SEQ ID NO: 69953 - DNA, 314 bp, Triticum aestivum
  Clone ID: PAT_TA_69953
ggcatcccatatacctttgctcctgcattgcagtttgcagagatccaagatggggtcgatgctatgagagctacagtgaagaccataagattgttcagcagatgacagatattatccttggtctgcaaggagagatcccagtgaatcataccaaaggagttccttatgttgccaagaataaagttgctgcttgtgctaaacacttcgttggtgatggtggaacgcataatggaatcaatgagaataacacgatcattgacgagcacggactgctaggcattcacatgccaccatattatgactccattatcaag

SEQ ID NO: 69954 - DNA, 190 bp, Triticum aestivum
  unsure (1)..(190): unsure at all n locations
  Clone ID: PAT_TA_69954
ccggcggcaaggcagcgctcctcctcctcctgtgcgcggcggggctgntgaccccggcctccgcggcggacgacggcctgaccaagttcaagctgtactggcacgacgtgctggcggggacgagccccaccgcgatccggatcgcgcaggcggcgtccagcaacagctcctccaccttcttcggcgcggt

SEQ ID NO: 69955 - DNA, 694 bp, Triticum aestivum
  Clone ID: PAT_TA_69955
gctccggcgagctcggcgactccctcgccgcggaatccgacgctcctcccgcttccgcacgcccgcaggtgcagagatacctcatcatgtcagctgctgccgtggactctgctgctgtggcggtgcggaacacgtgtggctgcaaaaacaccggatgcaaaaccagaaagtgcgcttgtttcagggatggtttgccttgcattcgtgggcgatgcaagtgcgagggctgcgcgaacaattcgagggggctggctatagatgtgttgccgacgaagtgcagctgcaaaagcaccagatgcaaaaccagggtgtgtgcatgtttcagggaggattcgcgttgcactggtctatgcaagtgtgtcggctgtgagaacaatccgcgtgggctggtcaatgaggcagatagcaggccgaagaagtgcaaatgcaaaagaaccaaatgcaaaaccaacatgtgcacatgtttctgtgcggattcgcattgcactggtctatgcaagtgtgagggctgcgaaaacactccgcaggggctggtcaatgagggagatagcgggccgaagaagtgcaaatgcaaaagaaccaaatgcaaaaccaacatgtgcacatgtttcagtgcggatttcgcgttgcactgggctatgcaagtgtgagggctgcgagaacactccggagggcctggccaatgagggtgata

SEQ ID NO: 69956 - DNA, 701 bp, Triticum aestivum
  unsure (1)..(701): unsure at all n locations
  Clone ID: PAT_TA_69956
ggnctgcaggnaattcggcacgagggacttgtggacatgtacacaaaattgcaaatggaacagtccatggaatgtgcaaggaaagtcttcaaacgaatgcccacacataatgtcatgtcatggacagcactgatatcaggatacgtgcaatgtggagcacaggaaaacagtgcaatagaactcctctgcgaaatgttaaatgagagcatcgaaccaaaccacatcacatattctagtcttcttaaagcctgtgcaaacctttctgatcaagattcaggcagacagattcatgcccgtgtcatgaaaaccagcatagggaatgtaaacgttgttgggaatgctctggtcagcatgtatgctgaatctggttgcatggaggaggctagaaaggtgttcgaccagctttatgaaagcaacatactttccaccagttctgatattggtggaactgagagcagcaatgcctcttggagttctcagattgagagcatgggcgtcggagtcagcaccttcacatttgctagtctgcttagtgctgctaccactgtagggttgccaaccaagggtcagcaactgcatgcgctttcaatcaaagcaggctttgagtctgataaaggtataagcaattcccttgtttccatgtattctaggtgtggatatttgggatgatgcttgtcgagcatttgatgaaatggacgacc

SEQ ID NO: 69957 - DNA, 757 bp, Triticum aestivum
  unsure (1)..(757): unsure at all n locations
  Clone ID: PAT_TA_69957
acaaatccccacccaatctcgtctccgatcgactccacgctcgtcgaatactcctcccccaccgcctcaagatgcagatctttgtgaagaccctcactggcaagaccatcaccctagaggttgagagctccgacaccatagacaacgtcaaggccaagatccaggacaaggagggcattcccccggaccagcagcgtctnatcttcgctggcaagcagctggaggatggccgtacccttgctgactacaacatccagaaggagtccaccctccaccttgtnctgcgtctgcgtggtggcatgcagatcttcgngaagaccctcaccggcaagaccatcactcttgaggtggagagctccgacaccatcgacaacgtcaaggccaagatccaggacaaggagggcattcctccggaccagcagcgnctgatcttcgctggcaagcagcttgaggatggncgnaccctcgntgactacaacatncagaaggagtccacccttcacctggtgctncgnctncgnggnggatgcanatntttgngaagaccntnaccggnnngaccatnaccctngaggntgagagctctgncncnatngncancgnnnnggncnngatcaggaangggnnnggcntnnncnnggnccagnnnngcntgatntttgntggnnagcngntggngganggncnnnccntnnnngnntncaanatncanaaggagnncnccctncnncttgnnctgnncnngnnnggnggnnng

SEQ ID NO: 69958 - DNA, 643 bp, Triticum aestivum
  Clone ID: PAT_TA_69958
gctctccctccgccttcccctgctttggttctcccagttccaggacgtcgtgttttcaggatttgcgctccacggaacacctcccttccggccggcattgcggcagtccctttagctgtgcttcaacaagattctaccgctgcttagataaacgaaactttcagggctttctacagtgagaagctacaggtttttcactcgttaagtcaggacatcaataaccggcgagatgaggaattcctgcgagtgctgcaagtactcatttgcatggaaaggtcaagtgtttcgtcacgcagatggatagacactctaggcatagcatggccataccagagagattcgtgaactatttcgcgtggaagctgtcaggaaccatcaagctagaagcccacaatggtaatctttacgatgttggaattactgagcgtaggaacaaaacactactccgatctgggtgggaggcgtttgtcgacgccaattatatagaagaaagcgactcgctgatgttccgctaccgtggaagctctcgcttcaaggttgtggtctttgattctagtggttgtgagaaagtggtgtcctctgctcgcagtcgcagacagagtaacatcaatgatcaagaaccaagcacaaattctgcagacat

SEQ ID NO: 69959 - DNA, 583 bp, Triticum aestivum
  unsure (1)..(583): unsure at all n locations
  Clone ID: PAT_TA_69959
gcgcatccatggcgcccaaggccgagnaagaagccggcggcgaagaagcccgcggaggaggagcccgcggcggagaaggccgagaagactcccgccgggaagaagcccaaggccgagaagcggctgccggcggggaagtcggccgccaaggagggcggcgacaagaagggcaagaagaaggccaagaagagcgtggagacgtacaagatctacatcttcaaggtgctgaagcaggtgcaccccgacatcggcatctcctccaaggccatgtccatcatgaactccttcatcaacgacatcttcgagaagctcgccggcgaggccgccaagctggcgcggtacaacaagaagccaaccatcacgtcccgggagatccagacctccgtccgcctcgtcctccccggcgagctcgccaagcacgccgtctccgagggcaccaaggctgtcaccaagttcacctcctcttaggctgttcgtcttcctgtgtctcgtagttagctgttcgggtgtgtttgtggcccgtgttatcctgtaagaatcgcaccgcgatgtttctgtatctcgagaaatggtaatggtgcct

SEQ ID NO: 69960 - DNA, 495 bp, Triticum aestivum
  Clone ID: PAT_TA_69960
gaggcacaggtcttcatactattgttcacttgccgcagcaagggtcctgcatttgaccttctctcaagaatgctcgagtatgaccctcgaaagcgtattacagctgcacaagctttggagcatgagtaaataattaataccttcacctattcttttttcccctttcgcgtgtttggatgcttctgtttccatatctgtataactagttcttagctgatgcatgctctagacttgtagtaagctacctgaatctagatgagcaaacatgaaaaagatgctgccctgcaatagctatctggtgcatattttaactacctgtcagaccattatgcatccttattggtgctaccagatatgagatctttggaatatgcttaggtttcctttgtactaataggaagactctagccgctcccgttataccactgtctaaactgccttactctactctattagggcatctccaacgctatcccctattaactttaaaaaata

SEQ ID NO: 69961 - DNA, 279 bp, Triticum aestivum
  unsure (1)..(279): unsure at all n locations
  Clone ID: PAT_TA_69961
ttggagatccctgggccgtctgcccccggatctatcgacccggacattgttgtnctggagacgccgggctacaccccggtgcgccgggtcggggcctccctggggctcgtcccgtgctcgctcagcccccgctccggcggcgatggtccccgcacgcctgattccgttctccggcgcaatatcgacttngaagatgccgctgatctggagatncccgggtcggcttcccccggctctgccgaccccgacgttcttgtcctgganaccccgggcttcacc

SEQ ID NO: 69962 - DNA, 630 bp, Triticum aestivum
  unsure (1)..(630): unsure at all n locations
  Clone ID: PAT_TA_69962
ggnctgcaggnaattcggcacgagggtgagggcgagnagnagactgaggcgccgccgtctcctcggacgccggcgccgccgagccacttcgcacatactagtagccggctgtttgatgaaatgtcgacctgcagttccaagagggcgcgaggcgccagcgatggtgtcgacaggctcagcagccttcccaacgagctgctccaccgcgtgatgtccttcctgccgatgccggaggtcgtgcgcacaagtctgctctcgccgaggtggcgctatctctgggtctctactccatacatccgcattgaccaccaggacttcatggatgacagcaagttcaagaattttgggaaccgcctgctgatcttacgtgacggcgctacttccttggatgaagcccggatctctgcccacaatgttgttcgtggtacatcgtggtgtgagtggattcgtcatgccatcatgcacaaagttcgtctacttcatgtttctgcatatgccccattggatagcacagccatgtttccttcacagcacctcaaaatagtcaggctccaatttaatttgttggaacatgggttctttaggcagctgaactgtgtctgctcagtgcttgaacatttagagctggag

SEQ ID NO: 69963 - DNA, 278 bp, Triticum aestivum
  unsure (1)..(278): unsure at all n locations
  Clone ID: PAT_TA_69963
tctctacaccatctattctagctctctcattaagtccctatcacacacacgatgactcgcttcccttgcgtctccgttcataggccaatttcagacaacatcaacattgtctccctatctatacgccatttatggacacaaacgacccctctcaccccctctcttcctctctctctctctctctctctctctctctctctctctctctctntgncgcnngctctctctntctctcnctcncacaccnctctcacacacacacacacnctnngtgtctc

SEQ ID NO: 69964 - DNA, 487 bp, Triticum aestivum
  Clone ID: PAT_TA_69964
gctcaccgaggagaagagaagaaaagagaagcgagaagatgtcgggccgtggcaagggaggcaaggggctcggcaagggcggcgccaagcgccaccggaaggtcctccgcgacaacatccagggcatcaccaagccggcgatccggaggctggcgcgtcggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccagggacgcaccctctacggattcggaggctaggccgccaccaccaccagattaggagctagcccatgtgtagggttcgtggtcctcgttgtaatcgcagtatctcgctgttgttcgctgtgttctgtaggatcgaatggaatggaattgaaattaaactaaaaaaaaaa

SEQ ID NO: 69965 - DNA, 597 bp, Triticum aestivum
  Clone ID: PAT_TA_69965
gaggttcttcaaaagaaacagatcctctttctgctgctccgaaggctcatccggtcagctctgaacctcaacgaattcaaactgacatagaacgaaccctaggtcttgtccgtaggctggacaccgagaagggtattcagggaaatgtcttgtcaagtggtgatcatgagaagtcggatgtagacaaatcacatatgggatctatgggccctatagttatagtccgaggcttaacaactgtcaagggccttgaaggtgttgagctccttgacacccttcttacatatttatggcgtattcatggagttgattactatggcatgtccgagacgaacgaggcaaaaggccttcgtcatgtgagaactgataataagactcctagtacaactaatatcaatgctgctgattgggagaagaagctggatacttactggcaggaaaggttgacgggtcaagatcccatggttatattaacggccaaggataaaattgatgcagcagctgctgaagtccttgaacctcatgtcaggaaaataagggatgagaagtatggatggaaatatggctgtggagccaagggctgtacaaaacttttcc

SEQ ID NO: 69966 - DNA, 617 bp, Triticum aestivum
  Clone ID: PAT_TA_69966
ggagaattcttaattaagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagggttccgttactaacatgtttacttccattgtaggtaacgtatttggtttcaaagccctacgtgctctacgtttggaggatctacgaattccccctacttattcaaaaactttccaaggcccgcctcatggtatccaagttgaaagagataagttgaacaagtatggtcgtcctttattgggatgtactattaaaccaaaattgggattatccgcaaaaaattatggtagagcgtgttatgagtgtctacg

SEQ ID NO: 69967 - DNA, 722 bp, Triticum aestivum
  Clone ID: PAT_TA_69967
ggtttttttaaatgatttttctcccaacatggtcagtcactagaatcatacctatcatcaaatggagatgaagagaccaaggagaccatgaagagtttgaatgaaaaacttgctgctgcccttttggctattagtgataaagaggatctggttaagcagcatactaaagtcacagaagaggctgttgcaggttgggaacaagctgaagttgaagctactgccatcaagaagctgcttgaagctgcttcccatagaaatgactatctcgagggtcaagtcagccacctagacaaggccctcaaggaatgcgtgaggcagctgcgcctggtaagggaagaacaagaggagataatacgtgatgcacttaccaagaagtcccaggagttggagtctgagaactccaagctgcaaaaccatattgctgagctgaagaagcagctggcagcaaccaaatcagaagcatccaccgtgtctgcacagcctgatctacaagagaagcttcagacaatcgagaaagagaacttggatctcaaggccaagctccttgtacagtccaaggatctgaagatactctcactggaaaaagacttgagcaatcaagcagcagagacagccagcaagcagcacctggaaagtataaaaaagattgctagggttgaggcagaatgccgcaggttacattatctagctcagaaaacagcattggtcaatgattctagacc

SEQ ID NO: 69968 - DNA, 678 bp, Triticum aestivum
  unsure (1)..(678): unsure at all n locations
  Clone ID: PAT_TA_69968
gcaggnaattcggcacgaggtgtcgatctcccttcttcctcgttgatccccatcgatccccacctcccttgctgattcccacctcccacaacgcttcctctccctctctcatcgatcttctccgcctcacgacaggagccatccaatagatcgtggtcgagagctttggtggaggcggcggtcttcatggccggcggagttgagggagaggtgagggggaaggtgctgactctgttgaaggaggcaaaggcagcaataaagcaaatcaagttgttgctaggccagacgcccaaggtggacggaccagatggtcaacgattctgcaagcggcagtgggaattcgaagaaacagaggaggaagaagaggaggaggtccccggcgagggctgcggtggagactggttggatgccctcagtaaggaggacctgctcgagtacgtcaacggatttgatgtcggcgacactaaccaaggttcgcttgtgacccaggatgccgatgtctgcgttcgtgtagaagatgtctcgcccatgctgctcaattttgttcaagacgacgtccatgtccttggcggttgcccaagatcaggaacatgatgcatgtgcggcaacaagctcaactgcttcccaagcaatggtgtgcatgtccttagtacagggagcttgcccatcttggccggt

SEQ ID NO: 69969 - DNA, 675 bp, Triticum aestivum
  unsure (1)..(675): unsure at all n locations
  Clone ID: PAT_TA_69969
tgcaggnaattcggcacgaggattgtatccccattgaggtgtggagagactcatagacagcgatggtatggctaactaagcttttcaccctcatgtttcgggcaaacaagatgccggaagaatgaaggcagagtatattagtaacaatcttcaagaacaagcaggatgttgtactaattatcgtggaattaagctgacgagccatacaatgaagctatgtgagagtcattgagcaccacttgagaagaattacaagcgtgaccaaaaattagtttggtttcatgcctgggaggtcaaccatggaacccattttcttggtatgacaacttatggagagatacatggagcaaaagaaagacctgcatacgataagataccgcagaatgtcatgtggtgggccttggagaaacaacaagtccaaacaaagtacattgcctcatcaaggacatgtacgatgatgttgtgacaagtgttcggacaagtgatggagacactgatgactttttgattaaaataggactgcaccaagggttagctttgagcccttatcttttgctttggtgatggatgaggtcacaaggagatatcccatggtgtatgctcttcgtggatgatgtggtgctagcggcgatagtcagactttggaatcaaaaggtttttggcttagtagaacta

SEQ ID NO: 69970 - DNA, 515 bp, Triticum aestivum
  unsure (1)..(515): unsure at all n locations
  Clone ID: PAT_TA_69970
agccgagtaagaagccggtggagaagacccccgnggggaagaagcccaaggcggagaagaaggtgccggcgtccaaggagggcggggacaagaaggggaagaagaaggccaagaagagcgtggagacgtacaagatctacatcttcaaggtgctcaagcaggtgcaccccgacatcggcatctcctccaaggccatgtccatcatgaactccttcatcaacgacatctttgagaagctcgccggcgagtccgccaagctcgcgcggtacaacaagaagcccaccatcacgtcccgggagatccagacctccgtccgcctcgtcctccccggcgagctcgccaagcatgctgtctccgagggcaccaaggccgtcaccaagttcacctcatcctaggctcctcttgtgttgattcttgtgtttctttcctcttcctcgtctgatgaattctgtagctagctgtgtgtgttctgacagtgtcatcttgtaacaatggtgctgcctgaataaatagtc

SEQ ID NO: 69971 - DNA, 683 bp, Triticum aestivum
  Clone ID: PAT_TA_69971
gcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagcccgcggtaattccagctccaatagcgtatatttaagttgttgcagttaaaagctcgtagttggttatgtgaagattcctgtaggcaagcgttgtggatttgtccaatttaccagcagggcgtgcgctgagcaggccatcagtgcactgaatgggtctca

SEQ ID NO: 69972 - DNA, 159 bp, Triticum aestivum
  unsure (1)..(159): unsure at all n locations
  Clone ID: PAT_TA_69972
ccgctccacccccaccggnccagcccccgccagatncccnccgctgacaagccaaagcccgnccttggnnacactnccaagcgcatcnacttgaccattgtntgtatactcttgttttcttctgtgtgcntgtncgggaccgtgtncntgagancctnc

SEQ ID NO: 69973 - DNA, 458 bp, Triticum aestivum
  Clone ID: PAT_TA_69973
gaggcttctcttcgcggcgagggagccggcggcggaggaggaagcagggagggctccggaggggaccagcgggataccagggagcgagcaaccgagatcgaaatcactaccactcttccgcccggtccggttactcgccgatttgtttgcgtccgggcacccccgaatactggcccagccccatccgtccatggtccgatggttcttccttttcagcgcgcaagatcgatctgagttcataccaagcttggatccagagtctgcaagaagcccctagtagatcataaataatgtcgccgaggagaccagaggccgtggcgacgctgttcatgctcatgcttttcaacgcttcaggagcatttgttggtatcaacattggcactggggtgtcagacctgccatcagcatcagacatagtctccacccttaaagccatgaagatccaacatgttcgcttg

SEQ ID NO: 69974 - DNA, 722 bp, Triticum aestivum
  unsure (1)..(722): unsure at all n locations
  Clone ID: PAT_TA_69974
ggagaccctctcnccggcggcctccccttcctcaacctcctctcttctcccagcccccgcacacatgggaaactactgctcggcgtctccagcaatcaagcagcggccaaggccgggctcccgggctccgtgcggcatcgtctcttccttccccgccgtcatctgtcagcgtcatcgtcgtggtctggcccttcgcgccacaacggtagaagatagcgacagagtgggaaggtttgtgcaaatatcttctcctccatccccgtccgcgtcaaagctgctgggtgcatccatccaacatcttcagatctgagtgaagaggacatccgtccatctcaaaaggcgatggctccaaggcatctacaatcagtatttgcatgttcttagcagacaaatctgggagaatgtactagctgcatatattggttcttgggtttattattagagctttttatctgcatatatacataggagtgagaatgcccaggtatgcgaccctaaatttagtttcactgctttcttactcatgggatttatccaattaataactagaatggattaatgagaaaaatacaagggaaattagctttataaaaatgaaactattcatggtaaacatttggcagaagagaatcacaaaatgaacaacagcctccctcacgggaaacatgaggtgtggtaaaatgctcacttaaaaaataaaaactagagattacttcctggtt

SEQ ID NO: 69975 - DNA, 680 bp, Triticum aestivum
  Clone ID: PAT_TA_69975
aaaggggactaaaacctgacaatgcaattaacaaacacattactccctataattgtgtcatcaataccaaaatatcattaggggcctagatgcactttcaagtcatcttggtcctatccaaataggaaaaacccattggtcatctcacttatcgaaacacatacaagaatacctgaccgtgtcagttcagtccgttgcaacaaataattactccctctgtaaacaaatgtaggacgttaattaaactgcgtaaacgtcccacatttgtttacagagggagtaggtattaagtattatttgttctgactttctaggaaaagttcccgtttttctcatttcaatccttcaaacttgactgaaaaaaataaattgcgaatgatattgttatttcaccttcagaaactggcagtttgatgtacatttctcttcactgttgtatgtgatttgtgttcttacaattctgaagtgaaaacttttacctggacaggatattggctttcatgtggagtacataagcccgtcacgggagaaaacggtaggtttttaaattttgggataatgtgactatgttttttctgttcacgaaaggaaatgaaatatcctgaagatatctacagtttgtcatttgtggatattgatgatattaattcaattagtagtagtatgactgcagtagttat

SEQ ID NO: 69976 - DNA, 663 bp, Triticum aestivum
  unsure (1)..(663): unsure at all n locations
  Clone ID: PAT_TA_69976
ggagaagatnatntgaatttgacgatgacttgtcatgcatattcaatgatgataatgcagataagctcatccttcgtgtccgcattacaaatgacgaagctccaaaaggagaaatacaggatgaatctgctgaggatgacgtcttcctcaagaagattgagggtaatatgttgactgagatggcccttcgaggcattccagatattaacaaggtcttcatcaaatacgggaaggtcaataaatttgatgaaagtgagggtttcaaaccagataacgagtggatgcttgatacagaaggtgtaaacctcttggccgtgatgtgccatgaggatgttgattctacaaggacaactagtaaccatttgattgaagtgattgaggttcttgggattgaggctgtccgcaggtctctcttggatgagctgagggtggttatatcttttgatgggtcttatgtgaactacaggcatctggccattctctgtgatacgatgacatacagaggtcacctgatggctattactaggcatggtataaatcgtaatgacacagggcccctcatgagatgttcttttgaagaaacagtggatatcttgcttgatgctgctgtatatgcggaatctgattacctgagaggtgtgactgagaacattatgcttggcc

SEQ ID NO: 69977 - DNA, 603 bp, Triticum aestivum
  Clone ID: PAT_TA_69977
gcacttttctccccctcccgagcagcgatggcccccaaggcggagaagaagccggcggcgaagaagcccgcagaggaggagcccgcggcggagaaggccgagaaggccccggcggcgaagaagcccaaggccgagaagcggctgccggcgggcaagaccgcctccaaggaaggcggcgagaagaagggcaagaagaagagcaagaagagcgtcgagacctacaagatctacatcttcaaggtgctcaagcaggtgcaccccgacatcggcatctcctccaaggccatgtccatcatgaactccttcatcaacgacatcttcgagaagctcgccggggaggccgccaagctcgcccgctacaacaagaagcccaccatcacctcccgggagatccagacctccgtccgcctcgtcctccccggggaactcgccaagcacgccgtctctgagggcaccaaggccgtcaccaagttcacctcctcttagactgcgtcgcctgtatctagtagcaaatgtagttctatactgttggcttagtgcttgtccgtggactctggttatctgcaagtaatagtagtcctacttttggatgaaaattgccga

SEQ ID NO: 69978 - DNA, 586 bp, Triticum aestivum
  Clone ID: PAT_TA_69978
gagcgccctccctccctccccacccagggaaacccaccagccatgaagggggccaaatccaagggcacccaaggccgacaccaagttggcggtgaagagcaagggggcggagaagccggcggccaaggggaagaagggcaaggccggcaaggaccccaacaagcccaagagggcgccctccgccttcttcgtcttcatgggcgagttccgcgaggagttcaagcagaagaaccccaagaacaagtccgtcgccgccgtcggcaaagcggccggtgagaggtggaagagcttgagcgaatcggagaaggccccctacgtggccaaggccaacaagctcaagggcgagtacaacaaggccatcgccgcctacaacaagggcgagagtgctgctgctgccgccccaaagaaggcggccgccaaggaggtggaggaggaagatgaggaggaatccgacaagtccaagtcggagatcaatgacgacgatgacgatgagggtagcgatgaggacgaggacaaaggcgggagcggctgctgcgcgagaacccgacgtgagctgtgtgcggtggtgtcataaggagcctgtcca

SEQ ID NO: 69979 - DNA, 694 bp, Triticum aestivum
  unsure (1)..(694): unsure at all n locations
  Clone ID: PAT_TA_69979
gaggaattcggcacgagggtntactggaaaatggaggttgcagttctatgagcataccaaattcccagaataagacgccattgcatttatgtatcgagacgtggaatgccagtttggtgaaaagatgggtcgaagttgcatcgaaagagcagatagttgaagcagttgatgtacctagccctgttggaacagctttgtgcatggcagctgctcttaaaaaggagcatgagaaagagggccgagagttggtaagaatattgctggctgtcggtgctgatcctacagcacaagatgacccacattgccgaactgcgttgcatactgcagcaatgatcaacgatgcagaattggtaaagattatcctcgatgctggagttgatgtaaatataagaaatgctcaaaacacaacaccacttcatgttgcactgaacagaggtgcaaactcatgtgttggcttgcttttagctgctggggcagactgtaatctacaggatgacgacggtgataattcttttcacatagctgctgatgcatccaaaatgattcgggaaaacctgacttgggttgttcaaatgctggaacatccatcacctgctgttgatgtgaggaaccacagaggttggacactgcgagattttcttgagaggctcccacgagaatggatttctgaagaactgatggagaaacttgaaga

SEQ ID NO: 69980 - DNA, 681 bp, Triticum aestivum
  unsure (1)..(681): unsure at all n locations
  Clone ID: PAT_TA_69980
gaggaattcggcacgagggtcctctgtaagagatgatagtngtcgctggcaaagacaaagatgctcataattcacataaacatagcacaagcttgagaggccggcctgctgaaagcaaggatggaaaccatggtgaaatcagagcaagaaatggtgatgcgacaagatctgactctctaaagggaccggggaagagatggaatggcgaacctgttcacaatgatagaatcatggagaggagcgacaagctccggaatgaagcaaaaaggaaaatccatagttttgatgaggaaaagccttcatatgttgatcgaccggtgctgaagaaacatgattccgcgcgattccaagtttccaaacactatgacataaatgatgcaaggagagagtacggaaaaccataccgtgaagagcccaggtcaaaaaggagaaggtcaagaagcagggatcatgatcaaggaagacgtgacagatctctctcactatccccaagggaacaaaggcgtagctaccatggaaatgatcatgacaattatcctcctggaaggaagtatgctgaaaacgacaggtacagaacatctgataatgttggacaaggtggtgggtcttaccagagatatgaaagtcggcttggtggctactcaccaaggaaaaggaaaacagtgccacaagacgaacaat

SEQ ID NO: 69981 - DNA, 445 bp, Triticum aestivum
  Clone ID: PAT_TA_69981
aatcttattcgttcttctcgcgtttatcgcggcggttcagtgcatacggttacggaggctacggctacggttacaacaagtgctatacccgctacaccaattgctacagctacagaaagttctacgtttaccccaaacctcaagtgttctgctacaacattccctacaagaagtcctggtgctcctacaaatattacgaaccagttcttcatgtttaccccggttccgaatgcggaaaggagggatggaccgaaaagaccattgctgaactcgaaattgaaatgacaaacctcttgaaggaatctcttcttaagatcactacggagatgaataaggccaaagctacttttgttgagcaacttaacaaatgtatcgaacaatacaagttgaacgtcaagaataagttgttcaactactacgcttattacatcgaatgtgccaagac

SEQ ID NO: 69982 - DNA, 244 bp, Triticum aestivum
  unsure (1)..(244): unsure at all n locations
  Clone ID: PAT_TA_69982
tgtccggcaccccgataagaagatcttgtggacaaaccnaacccgagantgaaccaccagtgtttggaccttgtaggttaatggatttcgaacttgaaatgggattctttgttggaagtggtaacaagcttggtgatcgngttgatgtgaaaaatgcacaagatcatatatttggaatggtgctggttaatgactggtcagctcgtgacatacagaaatgggaatacgtnccacttggtccctt

SEQ ID NO: 69983 - DNA, 903 bp, Triticum aestivum
  unsure (1)..(903): unsure at all n locations
  Clone ID: PAT_TA_69983
cacccaatctcgtctccgatcgactcgagagctcgtcgaatcctcctcccccatcgtctcaagatgcagatcttcgtgaagaccctcactggcaagaccatcactctggaggttgagagctctgacaccattgacaatgttaaggctaagatccaggacaaggagggcattcccccggaccagcagcgcctgatctttgctggcaagcagctggaggacggccgcaccctggccgactacaacatccagaaagagtccacccttcacctggtgctccgcctccgtggtggtatgcagatttttgtgaagaccctcaccggcaagaccatcactctggaggttgagagctctgacaccattgacaatgttaaggctaagatccaggacaaggagggcattcccccggaccagcagcgcctgatctttgctggcaagcagctggaggacggccgcaccctggccgactacaacatccagaaagagtccacccttcacctggtgctccgcctccgtggtggtatgcagatnttngtgaagaccctcaccggcaagaccatcactctggaggttgagagctccgacaccatngacaatgctaaggccaagatccangacaaggagggcattcccccngaccagcancgcctgatctttgctggcaagcagctggangacggccgcaccctggccgactacaacattcagaaggagtncancctttcacctggngctncgnctncgnggggggatgcaaatttttcgngaagaccctcaccggnaagaaccttacccttgaggttgagagntccgacaccatcgacaacgttaaggccagannnccnggananggggggcntttccccggnacaaaaannncctgatnttntttgcaagcanttggag

SEQ ID NO: 69984 - DNA, 703 bp, Triticum aestivum
  unsure (1)..(703): unsure at all n locations
  Clone ID: PAT_TA_69984
gnaattcggcacgagggccgctttgtcttaaagagttcggcctaacgatcactgttttgagcccagccgagattgagaacgcctttgctcgtaagccacagttcatcgtgccacttcagagaagtttcatggaaaagatgcctattcctcccgagtttctgcaacgaggatacatctcggaagaagacctgaacagaccgagaccgatagccacttttttaacatcctggcatatcgagctcaagaaggatggcccgaatgtcttcttcactggttccgaatggccaaagtttctggcctactttgaaattgctgaaaccgatgtcctgctgatcaagtatcaggggtgcatgaacttctcattcgagaccttccaaaatgggaataatgagaacatcgaggaaaaaataagctcgtctcagcaaagcgagcaatcacaatgccaagaggacgaacatgtttccactcgaagaaggacacaaagcaatggcataacacctggagcacaaagccaagaggaagaacatgtttccactcagacaaggaaacaaagcaatggcaaaacacctggagcacaaagcgaagaagaagaacctgtctccactcagaaaaggaaacaaagcaatggcaaaacacctggagcacaaagccaagaggaagaacatgtttgcacccgggaaaaggaaacaaagcgaagtcaaaa

SEQ ID NO: 69985 - DNA, 601 bp, Triticum aestivum
  Clone ID: PAT_TA_69985
tcggcacgaggcgcaccgccgcccacgcatctcgagtagtttccagctcgccggagacgcagcaagcaagaagatggccggaaggaagggcggcgacaggaagaaggcggtgacccgctccgtgaaggccgggctccagttccccgtcggccgcatcgggcgctacctcaagaagggccgctacgcccagcgcgtcggctccggcgcccccgtctacctcgccgccgtcctcgagtacctcgccgccgaggtgctggagcttgccggcaacgcggccaaggacaacaagaagacccgcatcatcccgcgccacctgctgctcgctgtccgcaacgaccaggagctcggcaggctgctcgctggcgtcaccatcgcccacggtggcgtgatccccaacatcaactccgtgctgctccccaagaagtcccccgccgccgccgagaaggaggccaagtcgcccaagaagaagacctccaccaagtcccccaagaagaaggtcgccgccaaggagtagcccgcccatagactactgtcgtgacattgcttaggtccatatcagggagaggatgatgagttttggttggttggatcctgtgtgtaa

SEQ ID NO: 69986 - DNA, 638 bp, Triticum aestivum
  Clone ID: PAT_TA_69986
attcggcacgaggggcactcttcgcttattcgccgtctcgaaaatagcagatctaatctcccgattgtgctcgccgcttcctcaccctcaccaggcgcatccgactagatcctccgctggtaaagcagcgtaagaccagtcggagagattcgatcagttggactttggagaggatgaatactcggtttgtgaatttgatagtgcaggacttgagccgtcgcatgtattcgctgcatcgtctggatcccttgaagtacctcttctatccgtcaacagaagcacgaaaagcagcactagcaaaaacggagaagaacaaaccacctatgctagagcgcttgtcggttctgcctaagccggaaatcaattttcatcccatgtctagtttaacacatagtagtatgaacagggattcgttctctctacttggaaaagacagtattgttttcagtgactcctttagtaagacaatactctacaacattgagctgggaactgttgcaagcatccctcgtatcaattcatgcatggttccttttggcatgagcctccccatgatccaagacaatcttgttgaccggacagaagatcaatctctctatgttatggacctgtcacgtgacgccaacatcagcagctgc

SEQ ID NO: 69987 - DNA, 575 bp, Triticum aestivum
  Clone ID: PAT_TA_69987
cgagggcgaggcaaaggcggcgtaggggacacggcgtggcgcaggtgggtcggcgcggccgcggcttctcttcttatctcccgggagtgggccgcagccatggagagcggccagaggagcaaggacggccaacccctgccacctatccagcacgtgttggggattgcgggcaacgattgaatctgcagactggttcgctcaaggatgacgaggagatggccggcttcagggtgcagcagaaggaggaggggcacgcagtgccggccgggctgatgcggagggggctgcaagctcgacgtgagagcagcggcagggacaagctcagcaggctcttctactgcgcctgctagacctcgaggtccatctgcccctccccccctctccctccctagcgatttggtttggtgttcatggtgttccgcccaacaaatcaccaaaagaaattatatacatatacaacacatttttagtagcgacagattattcctaggatcatgtaaaaaaatttattgctagttcagcggtgggttcggcggccgcggtcggtgctgccgtcctctccagtgagctccttt

SEQ ID NO: 69988 - DNA, 599 bp, Triticum aestivum
  Clone ID: PAT_TA_69988
tatgcttgtctcaaagattaagcctgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggaagtgtatggagcctgtggagaagtgtttgagggacgcaaagatggacaagagcaccgtgcacgatgttgtccttgttggtggttccactaggattcccagagtgcagcagcttctccaggacttcttcaacggcaaagagctctgcaagagcatcaaccctgatgaggctgttgcctatggagctgctgtc

SEQ ID NO: 69989 - DNA, 537 bp, Triticum aestivum
  unsure (1)..(537): unsure at all n locations
  Clone ID: PAT_TA_69989
ggccattactgccgtacacggnagctgcgaggcatagagaagagatctctatcggttgagctctatttttctctctcttcttacaagctagggtttgttaatttgctcatggatcagagcagctttgggaatctcggagctggagaagggggcagcagcagctccaaggcttcttcatccttcctgcagctgcagccactgtcgacaacgacggtggcttccgggccaggcccgatgggcggaacgtactacggcacaccgctcgcgttgcaccaggccgccgcagcagccgggtcgtcgcagtaccagttccaccaccacaagagcagaggcgaggagatctcgcaagcggaggctgaggccattaaggccaagatcatggcgcacccccagtacaccgccctcctcgtcgcctacctcgactgccagaaagtcggtgcgccgccggacgtgctggagcggctgacggccatggcagcgaagattgacgcccacccgccgggccggctgcacgaggctcgcgacccagagctcgac

SEQ ID NO: 69990 - DNA, 565 bp, Triticum aestivum
  unsure (1)..(565): unsure at all n locations
  Clone ID: PAT_TA_69990
tgcaggnaattcggcacgaggcctgatttgagtaagatgattgaagctgttcgagccttagttgcacagtgtgacgatctgaaaatgaagtaccatgaggagatggccaagagaaagaaacttcataatattgtccaggagacaaaaggaaacattagagttttctgtagatgccgccccttgagcaaagatgagacatcgtcagggtacaaatgtgtagtggattttgatggagcaaatgatggagacattgggattatgaatggaggaacagcaaaaaagacattcaagtttgacagagtctacacaccaaaagatgaccaagctgaggtttacgccgatgcatctccactagtcacgtcagtgctagatggatacaatgtatgcatctttgcatacggtcaaacgggaaccgggaagaccttcaccatggaagggactgaaaggaacagaggagtaaactatagaactctggaggagttgttcaagattgctgaggagagaaaagacactgtcacgtacaacatatcagttagtgtgcttgaggtgtacaatgaacaaatca

SEQ ID NO: 69991 - DNA, 739 bp, Triticum aestivum
  unsure (1)..(739): unsure at all n locations
  Clone ID: PAT_TA_69991
aggaattcggcacgaggttntttctaggagaggtgcactgaagcttctccgtgtatgttgtcaacgtctaaatcttcaggatcagatgatgagctattgcgtagtactgtaaaaccttgcaaacgcacttctagtggacctatttgctcaatatgtaagagtggagctggcagctgtcttctaatccagtgccagaattcaagctgttctcgtagcttccacacattctgtcttagtcctccgatgcaagatagtagaggcactttggaatgtcctctctgcaaaatcaatcaagcatcgttggctaacgggacggaagtgtatgccccaaaaaaggtccaaaggcttgtaggttgcagacgggtgattcttcaggagtcagatttctcgtatcaaatgctcgtgaaatggcaatcactttctcatcatcacgactgctgggttccacttgattggcttcttgttgttgagcgtcaacgagcacgatcctacataagcaagaataccttacctaaagaagcatactcggaggatcaaaggaaacctgaatggcttgaagtagatcgtgccattgcatgccgccggaagtttggtcgtgatggtttatgtgacgtcctggctagttttcacaataatgaagattttgaggggtacgagttcctcgtcaaatggaaagggcttgactattgtgatgttacatgggagtcttactgcactgaangcgtggcgtcagctgttt

SEQ ID NO: 69992 - DNA, 618 bp, Triticum aestivum
  Clone ID: PAT_TA_69992
tatgttttactggagtagttgtcatattcagatattttctttcattctctttatttataccatgactttgttcaggtgttgaaaatcaggtttagtcacggaagccatccaacagaatgcatatttctcccctcaaaaacaaaaggaaaaaagaatgtatattccctattgttttttgtgtggctagggttgtttttgtgtccacaaaataaaacaaatgctattaccagccagccaaaaatggtcaagatggttaccactggtaaacaatcacacactcaagcttagttgggttgaatccatggatttttttaagtgccagctagttattagcattgttgcaaactgttctgtgtaaaggaggtgtccagtaattcacaccgaatttgtactcccatgatcagtgttactgtacagtaattcacaccgaatttgtaagtgcaaatagtgcttgttttcaggagtaggatgctgatcaatggtgcttgtttggagtaattgtttgctctgtagtgcatttttgctgcaacctaatctgtggagtatcaagctaattggaagaaagccaattgcttgctctgtaggaacttttatgtgctggagtataggatttgctat

SEQ ID NO: 69993 - DNA, 701 bp, Triticum aestivum
  unsure (1)..(701): unsure at all n locations
  Clone ID: PAT_TA_69993
ccgcacacaaggnactatgatggactccatgtatggatatgtcttgaaggatggtggcccagttggagtgaaggtgatgtgggactgccctaagatatttctttattgggacgaaccaaagacatgtatgataaagatcattcatggaccgggcaacaaacttttggaggatgccccaagtgctagcactagtgctttattattgcctggtttcatatgcaagcagagtacatctgtgcatgtctatgataacttgtccatcaccaatatccctccacctcccgacggatcagggtggcagagtcaaagatggtgccgagtcgagaggtgccccaagctacacacggtcttcaatattcggcagggcagtggtgcgtccagctttaggcgtctggagacattatggttgtcccagcttctgacggcacagacatttactacgtcaactctcaccttttgtagcctggagttcttgcacctggactgctgtcccaggctcttacatgtgttcaccttggccagcagaaattcagggaggttcttctgtagttatttgcagaccctcgagatagtgtactgtgacgatctaagggaggtcttccctttggcccctgggccccagaaacaggatacagttatagaatttccctatctgaggagcatccacctgcatgaggtccccaagctgcagcacatctatg

SEQ ID NO: 69994 - DNA, 471 bp, Triticum aestivum
  Clone ID: PAT_TA_69994
acaccgtaccctctacgctggctccgcagcccctcctacgaccgcgcctagagcacgacggcgccgctgttttgcgaactaatcccctcaccctccgccatcgttgccctctcgccctccaacaccgtcccctccaattccctcaccctccgccggcgacatccaccctccccctcgccttctttccctacataggcccacgatggagccggtcagacggctctccgagatccgcgatagccacagcgcatacgcgcccctccacctcatcgtcacgagattcgagcttggccgcgacggaggtgttggaggttttctccttccccacaatcgtgcgccgcgggaggtgcccccgtgcgtttcttctcgggcgacgacacagccatgcggtgggtgggatttgacgccgctcttccgctccgcgcgaggagggagccggcgaaggctcggctgctccgactccatggagcc

SEQ ID NO: 69995 - DNA, 602 bp, Triticum aestivum
  unsure (1)..(602): unsure at all n locations
  Clone ID: PAT_TA_69995
ggtntatgcttgtctcaaagattaagcctgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggaagtgtatggagcctgtggagaagtgtttgagggacgcaaagatggacaagagcaccgtgcacgatgttgtccttgttggtggttccactaggattcccagagtgcagcagcttctccaggacttcttcaacggcaaagagctctgcaagagcatcaaccctgatgaggctgttgcctatggagctgctgt

SEQ ID NO: 69996 - DNA, 614 bp, Triticum aestivum
  unsure (1)..(614): unsure at all n locations
  Clone ID: PAT_TA_69996
gggaaggtnagaaggtggccaagcacgacgacgacgacgccgggccccggctcaacaacgacatcaccgctcccttcctccggctcgtcaccgaccaagggcatgatgttgtccccaggcacgaggcccttcagatggctgccaggatggggctggacctggttgaggttgaccggaaatcggaccctccggtttgcaagatcatcgacttccacaaggagaagtacatcaaggatgtcaaggacaaagagcgcctaaaagccaagtctgctattactttgcgttgtggagatatcaaagaagtgcggtttaaggcgaaaacagaaattaaagacttgaaggtgaaagcagatgcaattaccaggctgatggaccgtggttacagggtgaagtgcatggcgatgcccgcaggtaacgaagccgaagatttaggcggaccgctatctcgcttattaggactgattcaagatgtctgtaccgtggaaagcgggccgcatttggactccaagcatgcatatgttattgtcaggcacgtgaagtttgcaaccaagaaaggtggaaagaaagcaagcaaggccatggaagacgcaagcaaaggcagcccccgcaccgct

SEQ ID NO: 69997 - DNA, 585 bp, Triticum aestivum
  Clone ID: PAT_TA_69997
cagtcctctccccgctgcttccacccaccgtcgacctcaccgacctcctcacccaccgccgccgacctcgtccctccctcccctcaccatctctccctaccctattccccagatcgagtcgaccaggcgctagggttccgtccctccgcccctctcctactcccctcccatctccgccccctccctgctccctcccatggctaaccccttcgcctcccctctcctcctcgcttccccgctccccctccgggccccgatcttcccgccccacccgtcggcgctggtggaggaggccgccaccacggccgtggaggagtacgaggcacctctgctgaggcttctccgaccatataggcgagctagtgcttcccccctctcgctgtcgtcttcttccctcgtcgtccactgccttcgggatctgcctacggaatgaaggcggcagaccacaccagttctctgtaggcggcgattcgatgaatgcttcagaccatccttccaagcctcggcaagctagacaggtggattcgccaagcagggccctccggcgaggtggagggctgagggacgagatcgagcaagtcgacg

SEQ ID NO: 69998 - DNA, 131 bp, Triticum aestivum
  unsure (1)..(131): unsure at all n locations
  Clone ID: PAT_TA_69998
tcgagatcgatgacgaccagaagctgcggaacctttatgataagaggatctcccaggaggtagttggtgatcttcttggtgaggaatncaagggttatatcttcangatcatgggtggatgtgataagcag

SEQ ID NO: 69999 - DNA, 692 bp, Triticum aestivum
  unsure (1)..(692): unsure at all n locations
  Clone ID: PAT_TA_69999
aggaattcggcacgaggctttcngagntgttgtgaatctggtacagcaggacttccagttgaagaggccaattactaatgctgtattgaagaaccagcaagtcctgttggactttatgcacatggtctgcattgattcttcgatgaccacaaacaagccaatagcatggattgatgttcatggtaaccgcttctttccagagttatgtgctggactggtaacatctaaaccatctcagcatgggaaaagtgaccccagtggtaaatctaaagctggtgagtgtgctgggactttgattttgacagctgaagctgaaagctcgagttcagattctgttgatgcagtactccctcatgctaagaaggttaataacatactggaggaaggacaggaggtacataattatgctgctgttgaaaataaagctggtcctgcaatctgtttgaatgaacctgctagtggaaacatacatgctgctacttataagcagaaaattggccaacctgttgattcagctgtgcgcaagttattgcttgaaggggcaggccaaccttttagtgaagaaaatattattggcatctacagaactccactggtagatcagcaagggcgggctcgcttcaatcttttccagaaggaacttgaggccaccaaaatgcatcgtggcaacgcaaatgtgcgctacgcgtggc

SEQ ID NO: 70000 - DNA, 354 bp, Triticum aestivum
  unsure (1)..(354): unsure at all n locations
  Clone ID: PAT_TA_70000
gccccggcnccgnngccctccgcgagatccgcaagtaccagaagagnaccgagctgctcatccgnaagctcccnttccagcgcctcgtccgcgagatngcccaggacttcaagaccgacctcngcttncagtcctccgncgtctccgccctgcaggaggccgccgaggcctacctggtgggcctcttcgaggacaccaacctctgcgccatccacgccaagcgcgtcaccatcatgcccaaggacatccagctcgcccgccgcatccgtggagagagggcctaagctctgttcgtcgtcgtctgttagtcgtcctcttagcctgatgtgttcatcggtggaaatgtgcgtgcta

SEQ ID NO: 70001 - DNA, 681 bp, Triticum aestivum
  Clone ID: PAT_TA_70001
gaggaattcggcacgagggaattccccgccgcggtccgtgcgcagcgccttgagctgccggccggactcgagctccgccatggcctggaaccgtttcagtgctggctgtgcctcgtccttggtcgcgagcaggtacaaccacatgtgcctgctcttgtcatctaccagcaacaggaagtatcgcttccctcctggcgttggaggggagatcggcccacagaggtccgcatgcaccagctcaaggacctcgccggctctacggagagctgcctgagggaagggtgcccgtcgctgcttgccggcgaggcacgcctcacagacacgatccgcctcgtcgaatagcgggaggccgcgcaccagatcattccgggcaagttggcgtagagcccggaaattcacgtggccgtagcgcgcatgccagcgccacgcatcctctccggcgtgtgccacgaagcatactggccgggccggagtgagctgcagcacgtacagcctcccctcgttccgatgcacccgcgcgaggagacgcccacccggatcacgtagttggagcacgccgaagcttatgtgggtctcgtaagcgagctcgtccaactgtccgatgctgacgatgttgctgcagagctttgggatgtaatacacatctgacagtaccaagtgctcaccgttgcggcattggaa

SEQ ID NO: 70002 - DNA, 701 bp, Triticum aestivum
  Clone ID: PAT_TA_70002
aggaattcggcacgagggttgcctgggacggaaagcctggcaaggtgtgaattcagcttccgctaccttaaggaacacctggcagttactgctgaggaaatggcagtttatctcactggtcactatggcgagcaggttactcccgctgaggcgtggagggcaagacagatggctcttgagaaggaattcggtaccttttatgattcatacaactttgccccgaggttacttaaggaaatagcacgtaaaaaccctggtggttttgtagagatcaaagattcactggtttcagggtgtaaggattttcgagtccttcagcgtatatgttgggcgtttggacaatccttacaggccttcagtgcctgtcgccctgtgctgtgcattaaaggcacacccctatgcgggaaatatcaaggggtgctgttgacggctgtggcattagatgctaataatttctccattccagtggcatatgccatcgtcgagtgcgagacaaaggaaagctggctgtggtttcttaggaatttggagcgagcagtggttcatcaagctgatgtctgcattatacacgactacaaaaaggagttgatcgacgccgtagaggatcttctgaattcccgtcgacgacaagggctgaaagcagaaagccggtggtgcatggaacaccttgctgaaaacttctatgcatattttggcgacaa

SEQ ID NO: 70003 - DNA, 155 bp, Triticum aestivum
  unsure (1)..(155): unsure at all n locations
  Clone ID: PAT_TA_70003
gagcggcagcgtgctgcctgcgcctgcatgtgcggacgaacgagatctcagcaaagtcgaggaacgggctctgtncatgctggagttggccaagcgccggcgcatcggcgtgagcgaggggaagctgcgctacgccgaggngactccggacggnc

SEQ ID NO: 70004 - DNA, 599 bp, Triticum aestivum
  Clone ID: PAT_TA_70004
gagacactacatacaggatctcatcgtagtcctgagaaatggatctaagcaacaatggctaggctatggggacgacggctactccttggtggcggcggtcttcttcttgggggacttggcggccgtcttcttcttgggcgacttggcctccttctcggcggcggcgggggacttcttggggagcagcacggagttgatgttggggatcacgccaccgtgggcgatggtgatggtgaggatgaagaagtggaacctttaaacgaggaggagcaagaagagaaggagcagctactggaagagggcttttcaacatggacgaggagggacttcaacacattcattcgagcttgtgagaaatatggtcgtgacgacataaagagtatagcctctgaaatggaggggaaaacggaagaggaagttcagcggtatgctgaagttttcaaggaaagatatacagaattgaatgattatgacagaattattaagaacattgagaaaggagaatcaaagatctctcggaaggatgagattatgaaagccattgcgaaaaagatggaccgttataagaacccatggttggagttgaaaattcagtatgg

SEQ ID NO: 70005 - DNA, 612 bp, Triticum aestivum
  unsure (1)..(612): unsure at all n locations
  Clone ID: PAT_TA_70005
gatnccattgcggagcggcggcagcacgacaccggagggacgaccaggaggagatggctacctctattgcgcgtggagtatttacctttccctgtctcacgcggcagcgatctggaggcgatgtgggcgctgcaaaggtccggcgcaagctcggcggcgacaacgaacttctccggcgcccctccacaattggcggtccccccggcggtaagaaatatttcctcctattattcctgtctcatcctccatgaatttctgaattgttagttcagggttatttgttattgggaggggggcaagcacgggaagaggaagagaggccaagggatgaaatgaaagaaatatggggagcttgtgtggtacctgcagggaaggtggttatggtgtagacgggcgtctgaagatcaattcaaggagggcttgttcggttaatcccttctccgaggggattggaggggtttgaagggaattggggaaggattttgacttacaggagatttaatccctcacaaaccccttcaaatcaaatgcaaccgaacaaggcccgatgtgaattcagtatcaaactgtggagaaggatgaacaacactacagcatcaaacttcgatccag

SEQ ID NO: 70006 - DNA, 622 bp, Triticum aestivum
  Clone ID: PAT_TA_70006
agaaattaaagagttattacgctattcgtgggtctggtttgatgttttccaacagcttcatagtgtcatgtttgtctatagctgcactgaccagacgtttaggcctgcctgatgtatttttatctcttaaagcacaaatgagcagaaatcagaattcagaagccaaaccagaaatagtcctactcgttgttaatggccgttgtgccatggtgaagtgagaaacaagcattctaacttcaaatcttgactggcttaagttaatgtatatggtacttttacatttgctcacttgattgctgtttattatcagttttagtcactgttctacattgtgtcagtttcctcattcacacattgattattgtgatcatgaccatggtatttattgcggattagttgctggttctgtgtacttctctccatggatgtggagatcaagatttggatgtactcacatttgcctttggttttgcattatgtgatggtgaattctaatgcactctttctgtttgagtatttatttcatttaatgagattgaaacctatcactaggttctatgctcttattctaactgataaagataagatgaataagtctcattgatgtaaacattttctcttt

SEQ ID NO: 70007 - DNA, 590 bp, Triticum aestivum
  unsure (1)..(590): unsure at all n locations
  Clone ID: PAT_TA_70007
gtgctctctctctctctctctctctctccgcccatccctctctctcgtgcctcctgctaccaccaccgtncaccaccaccgtccaccatcaccaccttttcctttcccttccctcgggcggcccccaaaaaacaacactagctgaggctgcggcggcgacccacttctttctttcttgtctggttgcggagcggccggcggcgaggatggtggttcgcctcctcttcctccttttcctcctcgcttgctccctcctcttcctcgagctcccctcggtctcaggtacttcctcttcttctttctcaaattgctctgtcgccataaaaccctgccaccactatcattcttgtttagatccccgccctggaggctcatctgcacaagtatcgcggacatttttagattcccaaatgtactcttgcgcttctacctgcggctgcagcacacgatttccttttcttgaggtgatatatgcgacggacgaacgattaattctgaacttaacgtccccttcaatctgtacgcaaatcctgtactgcttcagcatttgtgtctcgatctgggattgggggagattaattatgctgatt

SEQ ID NO: 70008 - DNA, 563 bp, Triticum aestivum
  unsure (1)..(563): unsure at all n locations
  Clone ID: PAT_TA_70008
cccgcgcacctcctgcgcgcctccctcgccagcaagctctggctcggcctcctctcgtcccctcgcttccgcggtcgctaccacgagcaccatggnagctccccccatgctgggtttccttcatacctggcactacggctcccaccccaccaaggtagaagaccccatcccatacttcaaatccaccgccaaattcggcgcgcgcattcccgacgacgaatggggggacatttactacactgcgtgggactgccgccatggccgcgtcctcctagactgctttgatgcatatcagttacgtacggctctcgtcgtttgggaccccatgaccggctgccggagggagctaccccgcccctggatctgggaccgccgccgcgccgccgccgtgctctgtgccgtgagcggctgtgaccaccgcacttgtcactcggctcccttccagctggtctttgtcggcctggatgaggatgatcatgatgattgtgttgcacgcgcctgtgtgtccttgccagagaccggtgattggagcaagcccgtccctcaattcgatgcgtgggtca

SEQ ID NO: 70009 - DNA, 639 bp, Triticum aestivum
  Clone ID: PAT_TA_70009
cccgtctccacctcctgcctcgcgcgccgccgtgcgccgccaccgcccaccacgccggcacgtttacccctgcacgaccggctacacgccgacgacgctcgagcttgcaggggctgggggcagatccggaggcgagggtcggaggtgacgacgaggaaggcctgagcacaggcggatccatggcatccgcggctcctaggcacaaaggggacggtgaggcgggggagagaagaaggaaaaaaggaggggttgtgcggcgacctagcgaggagctcgccggagctgggcgaaggcggactggcgcgggagacggaggggtccggcgcggcggcgcgaagtccttgcaggtggaggcaggcgtcgaagcagaggacgagaggatccccggcctaattctggcgtgcactcagcttccccgatccatcccctcctacccatccggcccttcctcgatggcccgcatgcgacgaacccctacgcggggtaagaagggggatcacgcgaggtggagcactccagccccctcctagccctaccacggtgaggcctcctttccctctctccctgcctgagccataagctggcggcgctgaggtcgatctgctcatgcacacacggttgctgtgacatggtgacagc

SEQ ID NO: 70010 - DNA, 499 bp, Triticum aestivum
  unsure (1)..(499): unsure at all n locations
  Clone ID: PAT_TA_70010
agtctcggnacccggtcacgggcgaccggcacgtcctccccgcgccgggcatcgtctggctcatctgcactgccgcggtcttctgcgccgccgatggctgccaacatctcgactgccaaggcggccccttccgcgtcgccttcctggccaccgacgacgacgaccgccaggttaaggcgagcgtgtactcgtcggtgacaggtgcgtggagtgcgccagtatctcttgacgatggttgcgaatgctattcccagcacatccgagatgacattgcagaaaacctctaccacctgccctatgtcatgccccgggcgagtagctgtcattggagatgaggtctacttcacacttcgctctgctcacaaaatcgtcaagtacaacttgccaaacaactgcttatccatgatcgacccgccgccacacactaggagcccaattgctctcatggtgatggaggacagttcgctggggtttgcctgcactgagagttctagtcttt

SEQ ID NO: 70011 - DNA, 527 bp, Triticum aestivum
  unsure (1)..(527): unsure at all n locations
  Clone ID: PAT_TA_70011
tccggtgggtggctgcgcggcatcaggcacctggccggcaccgtcgcctacggnnggccgccgcggcagcaccgaggtgagggacagggagaaggagaagaaggagagggaggcgcgccgcctcagctccgccaccgacgacagcctcgacggcagcagcacgcgcagtgcgggcagggtcaaggtgcggcagtacgggaagacgtgcaaggagctcaccggcatgttcatgacacaggagttggctgcgcactctggctctgtgtggtgcatcaacttcagcctggatggacggtaccttgcaagcgccggcgaggaccgtgtcatccatgtctgggaggtctccgagggtgagagaaagggggagttgctcggggaaggtgcggtttcgaaggagagcggtggcggaggcagcccatttgtcgcggttgctggaaatgggtcgccggaggtggcaatgctgccgctcaacagtgcagataagggctatggggagaagaagaggaggccaagggtgcagagcagcc

SEQ ID NO: 70012 - DNA, 118 bp, Triticum aestivum
  unsure (1)..(118): unsure at all n locations
  Clone ID: PAT_TA_70012
agcagaacgagnctagttgtggagcagggccaggnaagacgaaggtgatgtccttgacatggaaactgctgtgcctggaccggcaacctcagacgagggaagtgatggatgacgctga

SEQ ID NO: 70013 - DNA, 573 bp, Triticum aestivum
  unsure (1)..(573): unsure at all n locations
  Clone ID: PAT_TA_70013
aacacgcacttcgaccccctctataagnaggaggtacccttattgtgtgtcccatggcattattgggtcaatggaaggatgaactggaagcacattcaacaccgggagcaatttctgtgtttgtatactatggcggtgatagaactggtgacctcaaattgatggctgaacatactgttgtcttgacgacctatggtgtccttcagtcagctcataaagctgatggcagcagtgcctttcacaggatagattggtatagaattgtgcttgatgaagcacacacaatcaagtctcccagaactaaagctgcccaagcagcttacatgttaagctcgcaatgcagatggtgcctaactggtacaccgttgcagaataatttggaggacctttacagtcttctttgcttcttatgtgtagagccatggtgtaattcaaattggtggcagaagctgattcagagaccttatgagaatggtgatgagaggggattgaagcttgtcaaagctattcttaggccgntcatgctgaggagaaccaaggaaacaaaagacaagatgggaaagcccatattgg

SEQ ID NO: 70014 - DNA, 544 bp, Triticum aestivum
  unsure (1)..(544): unsure at all n locations
  Clone ID: PAT_TA_70014
tgtcatggngtatgtcccggngnacgctctaccgcgggcttaagnaactacagtaataccaaacaggggatgtcacttatctacgtcaagctttacacctatcaggtgggcagggcctttggatgggaatcatcttcggtattttggtccaggtcttgttgttcgtggccatcacactgcacaccatctggcaaaataagcaaccatgttgacagcctggcatctctttgttccattctattgacttcatgtggcattatgtatgaagccctttgagcacaaatctttctatggaaggaccttcatgggatttggagtgctcaatggcatctcaatttggcttctcaatcagagtctatgtttcaactctgttggtttctatcagggcaagtcgagtgcattggttggatctagattcctgatattgcataggacttgtcaaaaggttagcatctattctataatgtgggtcacataaaaatcaaaattttaatttctaaaataagattgaaccatgtttgaaccatgtatatatttccggata

SEQ ID NO: 70015 - DNA, 107 bp, Triticum aestivum
  unsure (1)..(107): unsure at all n locations
  Clone ID: PAT_TA_70015
cctctccatctccctttccgcggctggngtgncgacctcggngctagccatggccgcgctgaggagaggntcggccgnggccttggcggctgcggcgatgnntgccg

SEQ ID NO: 70016 - DNA, 604 bp, Triticum aestivum
  unsure (1)..(604): unsure at all n locations
  Clone ID: PAT_TA_70016
cacctctaccagcccgcccttcctccacccttctccgccccccggnaccagccggtcgcctctcctgctccgtccgccgcccggcacgcggcggccagggtcgccggagggggttctgcgcttctctctgctctcgttcggtctgtttctttgtctgtgcaacggcacgagccagctgcttcttggtgtctgtctgtcggggactctcggtctcgccgttaatgcggcggcgcctgtgaccgggacgccgaagagggaggaggaaggagctgtttcttggacgacgagggctgtcaggaatggaaggcgacgaggcgggggcggcggccgcggcggcggcgaggataagggtggtgcgctgccccaagtgcgacaagttcctgccggagctgcccgcctactccgtctacgtctgcggcggctgcggcgccaccctccaagcaaagaggaaaaactctgctcaagctttggatacctctgataatggaaatatgaaatacttggaagtactggagactgtgccagagacatctgaagcaatggctggagctagcattgatcataaatcagtacccaatagaatgccacctttgcacagtagatc

SEQ ID NO: 70017 - DNA, 608 bp, Triticum aestivum
  unsure (1)..(608): unsure at all n locations
  Clone ID: PAT_TA_70017
aggggctccannccgtggcgatgtgctgcaagnaagctccaggttctccgcgtgctcccattggacgcgcacgaggatgccgacgagctggtgtcggaggtcgggctcaccgccatctccgagggctgccgtgaccttcggtccattctctacttctgccagaggatgaccaacgccgccgtcatctccatgtcgcacaactgccctgagctgaaggtgttccggctgtgcataatggggaggcaccggccagaccacgtgacgggggagccgatggacgaagggttcggcgccattgtccgcaactgcagcaagctcaccaggctctccacgtccgggcacctgacggatcgagcattcgagtacatcggcaactacggcagctccctgcggacgctctccgtggcgttcgccggagacagtgatctggcgctgcagcacatcctccagggctgctccaagctggagaagctcgagataagggactgcccgttcggcgacgccggcctgctctccggcatgcaccatttctacaacatgcggttcgtctggatgtcgggctgcagcctgacgctgcagggctgccaggaggtggcgcggcagctccc

SEQ ID NO: 70018 - DNA, 588 bp, Triticum aestivum
  unsure (1)..(588): unsure at all n locations
  Clone ID: PAT_TA_70018
tacttaagnaagnaggtgcgtacctgtgttcctgagtgaggagttaagggaccagtactacagcgggtactgcaataacattctatggccgctcttccattacttggggcttccacaggggtacaaggtcaataagacaaaagactttaagtcacagcttaaggcatatactgaggcaaacaagatgttcgcggatactctgtgcgaaatctctaaggaaggggatatcatatggtgccatgactaccatttgatgttacttcccaagttattgaagcagtccaacctgaacatgaaggtgggctggttcctgcacacaccgtttccctcatatgaggtttaccaggcattgccgaaccgcaaagagctgttgcaggctgtgcttgaagctgacttagtggggtttcatacgtacgagtatgcaaggcactttgtgagtgcttgcaccagtctgctgggtcttgagggtcgccttggaggcattaagtttaaaggaaggattgttaaagtggatgcttttccgatcgggatagacgctcagcattttaaagaatctttggatcttaacgcagtcaaaggggaaataac

SEQ ID NO: 70019 - DNA, 502 bp, Triticum aestivum
  unsure (1)..(502): unsure at all n locations
  Clone ID: PAT_TA_70019
ttatattgtatatgtttgttttttctatttcagcaagcattgtatgtactctttttccttttagtattatctaatagagaaaatcttagaggttaagtaagtgaactcttcatccctttccttgagatgtgatttagctttacagtttattttttttgtgattggtggacaaaagcttgcacttggcgctttgtattctactaacagtgcaagacccatactaattttcttttagaggtaacactcttagtttattcatagtgagcagtgtgactttacatagcatttacataattgataattgattatataaaatacattcttgaataggttattcatatttttgtttttttgcccacacttccgtttagggaagcatgatcaatcgtatttgttacagacatcattttgaaatgttttgtcctctcaagtttagtattattcacgagtcataagtgnttctctttggnttgttaacccgtagtggtgatggtcagccggt

SEQ ID NO: 70020 - DNA, 476 bp, Triticum aestivum
  unsure (1)..(476): unsure at all n locations
  Clone ID: PAT_TA_70020
cggttcctcgncgggnatggcgaccaanagnagcgtgggcaccctcggggnaggcggnatctcaaggggaagaaggtgttcgtgcgcgccgacctcaacgtgccgctcgacgacgcccagaagatcaccgacgacacccgcatccgcgcctccatccccaccatcaagtacctcctcgagaagggcgccaaggtcatcctggccagccatctgggccgcccaaaaggtgtcacccccaagttcagcttgaagcctcttgttgcacgcttgtctgagctcctagagaatgttagattctacaaggaggaagagaagaacgatcctgagtttgctaagaagcttgcgtcagttgctgacctttatgtaaatgacgctttcggcactgcacatagggctcatgcttcaactgagggtgtaaccaagtttttgaggccttctgttgctggcttcctcatgcagaaggaacttgactatct

SEQ ID NO: 70021 - DNA, 601 bp, Triticum aestivum
  unsure (1)..(601): unsure at all n locations
  Clone ID: PAT_TA_70021
caccgcctaactctcagtggtataagtttgggtggacagctagggnaatacacttgcgaatttcacatcgataatcaccttagaacttagcaacaacaatattggtggaaccatacctgataatctaccggtcacacttcagcgctttttcctctcaggaaaccagctaagngggagccttccaagtacattgtcgacgcttacacttttgacagacatgtccctcagcagcaatcgtttgtctggggacataccagatgtattttcagcactcactggacttataaatttagatttttcttccaacaacttgactggcccattaccgccttcgatgggaaacttaaaagcattgactaccctgcatattcaagacaatcaaatatctgggaccctgaatgtcctgcaagatctccctctgaaagatttgaatatacagaataatcttttctctggtcctgtgccaacgaagttattcaatgtcccaaactttcagagggatggcaacccatttaatactagcatagctccatctccactgcctgctgcaccagcaccatctccatcactatcaccttcaacagggcatgtcccctcaaaa

SEQ ID NO: 70022 - DNA, 600 bp, Triticum aestivum
  unsure (1)..(600): unsure at all n locations
  Clone ID: PAT_TA_70022
ccggttgngncctgctcctcctcctgctgtcactgaggnaggtgcccccggcagcagctcctccgccgcaagctgcagctggaaaccccacaccaatacttcctgggtcacctgcattgctaccttcagttcaggctcctactccatctgtggctgtgaagcctaatctgccactaccaccgcctgcttcgctaccttcagttcaggctccgactccatctgtggctgtgaagcctaatgtgccactggcacctcctccttcactaccttcaactcaggctcctactccatctgtggctgtgaagcctaatgtgccactagtgcctcctgcttcactaccttcagttcaggctccaactccatctgtggctgtgaagcctaatgtgccactagtgcctcctccttcactatcttcagttcaagctcctgctccatctgtggctgtgaagcctaatgtgccactagcgcctccgccttctgtgaacaatcaaccaggtacaccaattggatcaggtaatgatgtccctccgtatccaccacctgaaggcattttcccggcagttcctccttccgcttcagttcctccgcaacatgtgaaac

SEQ ID NO: 70023 - DNA, 129 bp, Triticum aestivum
  unsure (1)..(129): unsure at all n locations
  Clone ID: PAT_TA_70023
cttgtgccaggaaagaaaacgttntgtgaaagtaagcacttgatgggagatgtgcatttgcagccgctcactttgcatatattcagatcgctgnggcacacaggcatttgctctgagaaaatttgtaga

SEQ ID NO: 70024 - DNA, 259 bp, Triticum aestivum
  Clone ID: PAT_TA_70024
gcaacttcgtgtggaatgtggcgggccgtgcgctgtgccatttctacgctcttgagaccgagggcgacaaggtgcttgtcccgttgacggtcgctcggaatcttgccaagaagcgccgaaggtagcagcgattcaacgggctgtgaatttgactccatgttgtataaagtatgtatctattgcggcgggtaatatcaggtgtggacgtttcaaacctatatatgggttcagtgtaggctgtatatatttttacccgctt

SEQ ID NO: 70025 - DNA, 455 bp, Triticum aestivum
  unsure (1)..(455): unsure at all n locations
  Clone ID: PAT_TA_70025
ggnctgcaggnaattcggcacgaggcgccgttcctccggttccacatccgctcgcagctcgagatcggcagccatgtccgggcgtggcaagggaggcaaggggctcggcaagggcggcgccaagcgccacaggaaggttctgcgcgacaacatccagggcatcaccaagccggcgatccggcggctggcgcggaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccaggggcgcaccctctacggcttcggcggctaggcccggccgacggtcgcatgtctctctcgccgcctgcagattcgaaaagcttgatggaaccccgacctgt

SEQ ID NO: 70026 - DNA, 471 bp, Triticum aestivum
  Clone ID: PAT_TA_70026
gccgcatccagtttggtcgccttccgattcgaacctccccgaaatccgcagcagtcgacaggaggccaaaggcgccgccatggcccgtacgaagcagaccgcccgcaagtccaccggcggcaaggcgccccgcaagcagctcgccaccaaggcggcgaggaagtctgcgccgacgaccggcggagtgaagaagccccaccgctacaggcccgggaccgtggcgctccgggagatccgcaagtaccagaagagcacggagctgctgatccgcaagctgcctttccagcgcctggtccgcgagatcgcgcaggacttcaagacggacctcaggttccagagccacgccgtgctggccctccaggaggcggccgaggcgtacctggtggggctgttcgaggacaccaacctgtgcgccatccacgccaagcgcgtcaccatcatgcccaaggacatccagctcgcccgccgcat

SEQ ID NO: 70027 - DNA, 356 bp, Triticum aestivum
  unsure (1)..(356): unsure at all n locations
  Clone ID: PAT_TA_70027
ccgccaagatgcagatcttcgtgaagaccctgacgggcaagaccatcacgctggaggtggagtcctctgacaccatcgacaacgtcaaggccaagatccaggacaaggagggcatcccgccggaccagcagcgcctcatcttcgccggtaagcagctcgaggacggccgcacccttgccgactacaacatccagaaggagtccaccctccacctggtgctccgcctccgcggcggcgccaagaagcgcaagaagaactggcctggacaaaggaagatgaacttgtgagctccgagttaaatgctaaaaggtggctgtctcctcctccgcttggaaatacggnagttgttttgggac

SEQ ID NO: 70028 - DNA, 439 bp, Triticum aestivum
  unsure (1)..(439): unsure at all n locations
  Clone ID: PAT_TA_70028
gctgcgtcgtcgaattgtgctcggggttgggcggtgctctactttcttgggtgtgcttgaggtgaaattgggcgcacagatttggggattcatcttcagattggttgttttatccgcgctcgtagttgattcgttggcagaacatggatttcgttttgctggttcttgcaagtgaagtgaagctcgcaccatgaagctgccaattctgttgctctgaactctgtagcaagtgttactggacagaggatatctctggactttcctccgtctgctgtgaggaaatcagaaatgttctctgaacttccgcttctgaattcagatgccttttcctcttttggaagttcgggagacaggggattcttctgtcatgtggtggcgacacttcagatctctctctctctctctctctctctctctctctctctctctctctctctnc

SEQ ID NO: 70029 - DNA, 462 bp, Triticum aestivum
  Clone ID: PAT_TA_70029
tcggcacgagggcggccactccctcccggcgcccccgagatcccgcactccatgtgaccccctcctcctctgccaggtgattctgctcactccccgtgctcccctccgagctgaaatccggagggctgtccgttctttctcgattgccgcgcgccgggagcgaaatccgtggttaatccccgacctcctccttgcaaattccgcggttttgttcggcgcacgggcaagcggtgcgcggcttgcgattcttttgcctactctgaatttcgggctgccggaatttgttgccttggccgaatgctcctacttttctagatctgccaggccgagtttccgcggaatcgacagttgatttgtggcttctctctggggctttcggcgattcgttgcgcggttggaggaaagcttccgtctaattcttgtgatttttgtcctgcagattcggcggcgggtgattcttgg

SEQ ID NO: 70030 - DNA, 454 bp, Triticum aestivum
  unsure (1)..(454): unsure at all n locations
  Clone ID: PAT_TA_70030
gnaattcggcacgaggcccactctcccctctccgccttccagctatcactcccgcggtctcttctctccttctcctctccaccttccaactatctctcctacggtctcttctctccttccggccacctgagtttgaccctgaggcactcataccgccagcttgtttagaatgctagccgcatgagtgcctcatgcagcggtatcgccggtatgagtgtttcagggtcaagcttcggttgctagaaaaacaacggcaacaaagggacaggaacaagcgaggaaaagattgagaaaaatgaaggatgaagacgcgtggtagtcaacatcatcgacatcaagcgaccacccccacctcaacatctcgacaagtatccaccctgcccgacgcacgagtgccacccgcagtgatcatgaagataacttgtcatgcatggatccacactaggagatgaag

SEQ ID NO: 70031 - DNA, 511 bp, Triticum aestivum
  Clone ID: PAT_TA_70031
tcggcacgaggaagctagtgcaagagaaaaaatggggcttcagaagcttatcgaggatcatgaggtgaagcttgaagcaagaagacgagattttgaattagagctggagagtgagaggaaatcctttgatgaaaagatgaaacatagggaagctgatttggtaaagaaggaaaaagatctcagttctcgggagaacaaaatatctaaaagggagcaagcgttaaatgaaagcaagaaaaagctggaagaattgcagaatgaccttgataccaagtcgaaagctttgaagaagtgggatgagtcactgaaacttgagaaggataagttatctgaagaaaagctgcaagtagatcatgaacgaaaacaggctgagatgtacagatcggatgttgaaaggctgaaagccacaattgaagctgaaaagaagcaaattttagaagaacagaacaatttgaaagttacagaggaagagaggcaagagcacagcatgctgacagcacaactgaagaag

SEQ ID NO: 70032 - DNA, 440 bp, Triticum aestivum
  Clone ID: PAT_TA_70032
ggccacctcctcctccccttcctctccccctcccgtgcctccgcacccgactagcacggccagaccacgtgacgtggacgaggagatgacagctcgggaggcaggctccttccatggcggcaccccaacctgccggattttcctcctcgtcagctcagcggagaggagcggtggatccgcctcctcttggacctagcgcccgatccgaggtgtgcgggcgcggacgagcttcccctgccggcccgcggcagcggcgacctacaagcaaagggcaagggccaggcgacggcagagagagagaagatgagagggagaagaaggaaggagaggagggagaaagagagagaggaaagaggagaaggaggcgcggcgtcggatgggagagggtcaccaccggccgaggcctgcgcgtggcggttcgatgtgatcctcgcgccttc

SEQ ID NO: 70033 - DNA, 662 bp, Triticum aestivum
  unsure (1)..(662): unsure at all n locations
  Clone ID: PAT_TA_70033
tgcaggnaattcggcacgaggtaaacattgtctgaattgcctgagcttaagggatctgaggtagctgctggatatgatgttttcaaaactcacattgcgcgggcagctttggtatctgctaacacagcatcggtactggtatctacagcgattggttttgatgaaagaatgttgctccacagtgagatggaaattaaaccaaatccacatccagaaagacccaaccgtcttcgtgcaattgctgccagtctggctgctgcaggaatatttccctcaaagtgcgccttggtacctcctcgagaaatcactaaggaggaactcgtaatggtccatacttcagatcacgtcgaaagtgtagagcagacaaagaacatgctttacagttacttcacttcggatacttacgcgaatggacactcggcatgtgctgccaaacttgcagcaggcctatgcgctgatcttgctagtttgatagtgtctgagcatgtccagaacggctttgcactggtgagacctcctgggcatcatgctggggtaaagcaagccatgggattttgtcttcacaacaatgcagcagtggctgcattagctgcacaaaaagcaggcgctaagaaagtcttgatagttgactgggatgtgcaccatggcaatggcacacagga

SEQ ID NO: 70034 - DNA, 475 bp, Triticum aestivum
  unsure (1)..(475): unsure at all n locations
  Clone ID: PAT_TA_70034
ggnctgcaggnaattcggcacgaggcgcgaacgcacctcctcccctcctgcccccgngcaccgcagccgccgccgccgccgccgccgccgccgactgcagccatgtcgctgatcgcgggtgaggagttccagcacatccttcgtgtgctcaacaccaacgtcgacggtaagcagaagatcatgttcgcgctgacctccatcaagggtgtgggccgccgcttctccaacatcgtctgcaagaaggccgacatcgacatgaacaagagggctggagagctttccgcggaggagatggaccgcctgatggcggtggtgcacaacccgcgccagttcaaggtgccggactggttcctcaacaggaagaaggattataaggacggcaggttctcccaggtcgtctccaacgccgtggacatgaagctcagggatgaccttgagaggctcaagaagatcaggaaccatcgtggtcttcgtc

SEQ ID NO: 70035 - DNA, 403 bp, Triticum aestivum
  Clone ID: PAT_TA_70035
gcactcacgatggcagatctcggcgagtcacccaccccaccgcctccgctctcgcccccacagccggcgacctcgtctcgcaccgccaccccatctcatcccctccccaactcccctccactcatccgacggcggctagagacgcacacaaccggcgaccaacatcacacaaaggtcgccaccgccggcggtggaaggacagtcttctcccgccgctagccgcaacctctgcctcgccctgatcctcggcctcctcgaccgccgctcgctctcctgggaagcacctcgccacctcccttcccatgctgtcttcgccgactgccctgctcgcgccgacctcgcgaatctcgcggccgcgcttggcagtgctcgacttgtcctcgccgccgccagcggcgacggg

SEQ ID NO: 70036 - DNA, 608 bp, Triticum aestivum
  Clone ID: PAT_TA_70036
tcggcacgaggggggaatttgtgttgcaggttccattttatccgcctcagcagatgtttgaggattttagtgcaaaggtgtgcgagcaaattattgtcaaattggttggatgggagccagcagatattcaggttttagacataaaaccatgggcaatgcatgctgaagttgcagagaagtatgttggctgcgacaatcgtgtaatcctagttggtgatgctgctcaccgctttcctcctgctggtggttttggaatgaacactggtgttcaggatgcacataatttggcttggaaattgtgtttacttctgaatggcatcgctgacccatcaattatacaaacttatgagtcagagcgtaaacctgttgccacttttaacacagaacttagtttggaaaacttcaaggcagcaatgtctattcctgctacccttggccttgatccaacaattgcaaactcagtgcacagagtaatcaacagcagcctaggatcaatcattccaagaaatttacagaaggtggttctggaaggattattttccattggtcggacacaagtctcggactacattttgagtgagaacaatccccttggatccttgagactg

SEQ ID NO: 70037 - DNA, 336 bp, Triticum aestivum
  unsure (1)..(336): unsure at all n locations
  Clone ID: PAT_TA_70037
acctccccgccgctctccatgggaaggtcttctacctactccggcccgtgctcttccgccgctccagccggcagagaggttctgcccggtcgtccgcgacatccgtcttctccgactgaaatccacatcaaccgctcgctctttcttctatcctcaagatccggaggggaagaagatggaagatccgatggaacaggagagngaagatctgaaggcgggggaaaagaagacgaaagatccggtggagaaggagatcgaagatctgaaggcaaagaaggtgcgcctgacaccgcaactggttcactccatgtntaactactgttggatgttgggcgg

SEQ ID NO: 70038 - DNA, 608 bp, Triticum aestivum
  unsure (1)..(608): unsure at all n locations
  Clone ID: PAT_TA_70038
gnaattcggcacgaggnagccttattcgtattttgttgtttagatgaattgtatacttctcatatgaattctaatgtccgcgttactcatccatgtgcagaggggaatagcaggttatgcgtctcggtgagagactactactgttacatgctccaaacatgacttgggatattcaatcccatactctgnggagcacgattgctccagcaatggggcgtggacatgtacatcaagattgagagttgcaggttgaaatggtncaaaaagaatcagacaaagatccgtgccgacctgtataaaggagttgttgatgcaattacatccggggagacccgggcaagcgctgttggagtaaggatagtgctccctggaacgtacccaggtggcgactgcgacatgaagcggaggcatatggatgccatggcaattgtccatacctacgggaagcctgacatcttcttgaccatgacctgcaaccctaactgggaagagataacgaatgagttgtttcctggtcagacagcgcaagaccgacctgatcttgtggctcgtgtgttccatggcaagatagaggctatgaaagagatgttgttcaagaagaatatctt

SEQ ID NO: 70039 - DNA, 705 bp, Triticum aestivum
  unsure (1)..(705): unsure at all n locations
  Clone ID: PAT_TA_70039
ctctctcgtcctcctcctcaagatgcagatctttgtgaagaccctcaccggcaagaccatcacccttgaggtcgagtcctctgacaccattgacaatgtcaaggcaaagatccaggacaaggagggcatccccccggaccagcagcgtctcatctttgctggcaagcagctcgaggatggccgcacccttgcggactacaacatccagaaggagtccactctccacttggtgctcaggctccgtggtggtatgcagatctttgtcaagaccctcaccggcaagaccatcaccctggaggttgagtcctcagacaccattgacaatgtgaaggccaagatccaggacaaggagggcatccccccggaccagcagcgcctgatctttgccggcaagcagctcgaggatggccgcacccttgcggattacaacatccagaaggagtccaccctccacttggtgctcaggctccgtggtggcatgcagatatttgngaagaccctnaccggcaagaccatnaccctggaggtggagtnatntgacaccatngacaacgtgaaggcgaaganncangacaagganggnattnccccngnccagnngnnnctnatntttgntggnaagnannttgnngatggncgnnccttgnnnnnntacannattnannnggngnnannncntnncttggngctnnnnnnnnnnngngg

SEQ ID NO: 70040 - DNA, 161 bp, Triticum aestivum
  unsure (1)..(161): unsure at all n locations
  Clone ID: PAT_TA_70040
acgcctgcgatgcacctcaaggtcgagcaaccagcagnatccaaagcactcctgcgatacacctcaagtttgagcaagcagcanattatccgactagttcattcaagactcgtagcaccgggataaagaaatccatagtccaggagtgcttgngttttctc

SEQ ID NO: 70041 - DNA, 290 bp, Triticum aestivum
  unsure (1)..(290): unsure at all n locations
  Clone ID: PAT_TA_70041
gaacggcagcaccggnacatgagggatgaggcatatgtatgcgacacaagagaaacacaagagagcataggactagccacccaacggcagcaccggagagaaggagcatcccaagccttggccagcttccttcctcctccatacagctccaggagcaacattgtactatcaatcatccaactaaactcggcaggactaggggtattatctctccggagagccctgaacttgggtatgtccggcgtcccgcgcccgcgcatgccaaccttgcctctggagcccaccagtgc

SEQ ID NO: 70042 - DNA, 471 bp, Triticum aestivum
  unsure (1)..(471): unsure at all n locations
  Clone ID: PAT_TA_70042
cggggacgaatctacccggcttctcgtcctatccgccgccggtagaggcatccatgtccgatggtgtgaattttggctggttccatgagcacttcgttccctgccgtgtagtcttcgttgattcgggaagatggtggttgtctgtttagccatttcaatctgctattgatcatgctcattcttgttatattcanttatattggaaacaccatctgattcagttatattcttgatcatgctcatgctcatccttattcaaataagaatacttctgtttggagagctcgggcgtcagctgtgtggaagcaccagctgatttgtaactggtcggaaggtgagcttctcatactcgctgccgtcgaagcacgacacctcgctgccacttatgtttcgtgttgntgtgctataggtccttggggttgggtgcgacaactcncgactcgaagacatttcntgcatgtgctcccctgc

SEQ ID NO: 70043 - DNA, 152 bp, Triticum aestivum
  unsure (1)..(152): unsure at all n locations
  Clone ID: PAT_TA_70043
atgagagtgatgaagagcctccccagaaaaagctgaaggatgctgcgaaggntactcctaagnctgccaaaaaggacagcaccagtgatgatgacagttctgatgaaagctctgatgatgagcctaaaaagaaagttacaactgcctcaaaa

SEQ ID NO: 70044 - DNA, 232 bp, Triticum aestivum
  unsure (1)..(232): unsure at all n locations
  Clone ID: PAT_TA_70044
acatcggggtcagcctaggcacgtacctaaccttcctctccttttccttcctctcgtttctgctccttgggcaatttgattatctgatccaatgcggttgatgcctggtgatcggggagcgtggccgcgtgaaatctcagtcgcattttggccggggcttcgcgggaattctagatcagcgggggcgtcncannntncgccggaaatgtttattttccatgcttacaatggg

SEQ ID NO: 70045 - DNA, 650 bp, Triticum aestivum
  Clone ID: PAT_TA_70045
gggagaagaaggccatgtggcggcgggagatggactggctgctctgcatcagcgaccacatcgtcgagctcgtccccacctggcagtcgttccccgacggaaccaggctcgagatcatgacaagcaggccacgatcagatttgtacatcaatctgcccgcacttcggaagctagaccatatgctcctcgaaatcctggacagcttcagggacactgaattttggtacgtcgaccaagggatttgcgcggcggactgcgacggctctgcctcgttccgggcggccttccaccaccgggacgacaaatggtggctgccggtgcctcgagtgccacccgggggcctccgtgacaagacgaggaagcaattgcagcacaaacgcgactgtgcgaaccagatcctcaaggctgctatggccatcaacagcaatgccttggctgagatggatgtccctgtatcatacctcgactctctgccaaagaacgggagggcgactttgggcgacgtgatataccgctacataacgtcggatcacttctcccccgagtgccttctcgacagcctagacctgtcgacggagtaccaagccctggagattgccagccgtgtcgaggcgtcggtccacgtgtggcgccgcagggttcctgcgaaa

SEQ ID NO: 70046 - DNA, 418 bp, Triticum aestivum
  Clone ID: PAT_TA_70046
gccaagcgccacaggaaggttctgcgcgacaacatccagggcatcaccaagccggcgatccggcgcctggcgcggaggggcggcgtgaagcgcatctccggcctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgtcagggccgcaccctctacggcttcggcggttagggccggccggccgacggtcgtcactctttgtcgccgcctgcagattccagaagcctgatgaaaccccgacttgtttagttcgccattttctctgtagctcgaactgaatcgtggaacaaagttattcgcatgtgttgttggaaaaaaaaaa

SEQ ID NO: 70047 - DNA, 609 bp, Triticum aestivum
  unsure (1)..(609): unsure at all n locations
  Clone ID: PAT_TA_70047
atcgccctcccaattacgaagttttttcctttctttgattttcctgtgtgctttttaggcggctatctatattagccaaaaagcacttacatttgagaccggggcaggatttgccattgcttgctcattgcgacaactataattaccatgatttgccatggttaaaaacctgacaatctgacatccgattttaatattaccgaaagaaaatctgggccaacttgtttaaatttaacttttttgtgaaaaggttatgaaagcagtggatataaatagtgatggaaatagttttgaaatggaaatgtagatgaaagcagtggatataaatagtgatgaaaatagttttgaaatgtaaatgtagatgaagttgcctgtattttcaattttaagtttcaaatgtggccccaacccctaaaactttagctatatgtatatctgtagtttctgccttagttaataatgttgntgcattgaatatttgttgntngacaacggatgttacaaattanacggnnnngnatagntnaaaaactactgntagcttcctgactatttcgntggngatgcatgtgcaattnatcaaggncaattnttctatgaaaacaaacc

SEQ ID NO: 70048 - DNA, 237 bp, Triticum aestivum
  unsure (1)..(237): unsure at all n locations
  Clone ID: PAT_TA_70048
cacccgctctgccccgtcgccgcacaccaaccctggcaaacctctcgccctccgtcgatgccccgcgatgccgtcggncgccacccgttcgtcatccatgggtgccggcgacattgagttcgccctcgacctcgaggacatcgccgcccgcgcagccaaagcggactgcatcggcgcgctcgcctgcggccgcacaagcttctcctaccaccgcctccccgagccgcccctccgnct

SEQ ID NO: 70049 - DNA, 415 bp, Triticum aestivum
  Clone ID: PAT_TA_70049
tctcggtcaacttccttttcagattacttcttgaacggcaagtatatttctaaacctttggtcagcacacctcttaaggaaggacagggacagctttcaccttcgaatcagatagacaggtccacctctacaaatgacagtgttcattctaggagtcgttctgataacccacaagagaatgatgtgaaaaaagtagcaaggagcaacgaggctaatgcagcacggaaggcttttggagcttttcttggtatgctgacaagaacaaaagaaaacatagcatgtgcaacacgtcttgctattgattgcgctaaacatggcattgcttgggaggcgattgatattattgttgaatgcatggaaaaggaaaatttatataagagggtggaccttttctttcttattgattcaataactc

SEQ ID NO: 70050 - DNA, 535 bp, Triticum aestivum
  unsure (1)..(535): unsure at all n locations
  Clone ID: PAT_TA_70050
caccaccaccagcacccatggcacccaaggcagcggagaagaagccggtggccacggccgagaagaccaccgcggggaagaagcccaaggcggagaagcgggcgccggcgaccaaggaggccggcggcgaggggaagacgaggggcaggaagaagggcagcaaggccaagaagggcgtggagacgtacaagatctacatcttcaaggtgctcaaacaggtgcacccggacatcggcatctcctccaaggccatgtccatcatgaactccttcatcaacgacatcttcgagaagctcgccggcgagtccgccaagctggcccgctacaacaagaagcccaccatcacgtcccgggagatccagacctccgtccgcctcgtcctccccggcgagctcgccaagcacgccgtctccgagggcaccaaggccgtcaccaagttcacctcatcctangctggcttcgttgttgtttcatgagttgatggcggcaggcgtcgtgtacgtagtcggcagtagtacgatgttacaatctctgt

SEQ ID NO: 70051 - DNA, 118 bp, Triticum aestivum
  unsure (1)..(118): unsure at all n locations
  Clone ID: PAT_TA_70051
tgataaaaatgagctatcttctgttgtttcttcgctgggtgggtttgaacatggcttgtatgttgagaggtggacaacatttgcaaaggagctttctgtaattgtggcaaggagcana

SEQ ID NO: 70052 - DNA, 318 bp, Triticum aestivum
  Clone ID: PAT_TA_70052
gcggtgtgagtgccccaatgtagattcaagacgcttgaggagagcatctctctctctctgatcgtgaagcagccccaatcctagcccttctttggccatggcgactgagcaggcaggaggtacgaacccctcctcgcctcccaaaaccaactcctggatttcctgttgatgacagaggaacaaggatgacagtcattcagtacttgaaggacatatacaactgcaatctgcgtattttattcaactacatgattgaccaacactcgtttctatggcatggcagcagcttttggttctggcgctctattctccattgtt

SEQ ID NO: 70053 - DNA, 601 bp, Triticum aestivum
  Clone ID: PAT_TA_70053
ggcgcgacggatgtcgacgaccggcaccggcaccggggcagggatcaccggcggaggcagcgggaccggaggggcggccaactccggcggagccaggtctttctcttctcctttcctctcctcgctcctttttatctcggggcaaaagatttgaacttgaccaacattacgtcgcaggacgaccggatccggcggcgcgtcaaactccggtgggaggtaaccttggctctccacttttacgcatataagatgccgccgtctgggtgccaaagggccgatctcccgtgggggtcttccggttcggaggatcggaagaatccatcaatccttccttgtccatctatctcgttctgctctcgtgtactgcaaaaggccattttttttctgttcttgacgtgcacaatggcattgcaggatggcgggcggcggctccgcgggcaactcaggcggcagcggaggggcgacgggggttgatcgtctaaggaaggacatctttaaagaaactagacgcctgtgggagggctacaacgtgctgtcggaggtggacaggaacttatttggggagatcgcgcgtcttgaaatggacaatgccatgaatatg

SEQ ID NO: 70054 - DNA, 580 bp, Triticum aestivum
  unsure (1)..(580): unsure at all n locations
  Clone ID: PAT_TA_70054
gatttaactgaaacctttttattaacagaagcttcttctcctctcttcataaacagtaatttgaatcatttgaaaaggaaacatgttgtatgaatttgaacctactgttaatttttcttactgttgaaattgcagtgctgaatcagattaggtactccatctattgttttcttttttttttgcaggaagacaaaacgttcaaattgcagcaacacttgctgaatcactacaaaatgttcaactagagagacttgttgttttctgctgtttgtaggaagacaaaatttctgtagcatgttttctgtagcttgaattagtaaaattaacttgngcttgngcgtgcagtaattaaaaattgattcaatttcctctctgattgngngcttgcagnggactagtttagnggagcaaaattaaaattagtaggagtaggagtaggagtaggagtagctcttctctcttcttctcacttctctcctcttctgnattctctcttcttcttctcacttctcttttcttctcactnggctcttcttctcttcttcacaatttcctttaattaaaattaaactaaaacctt

SEQ ID NO: 70055 - DNA, 556 bp, Triticum aestivum
  Clone ID: PAT_TA_70055
gcatcctggcccccaaggctgctgagaagaagccagtggagaagacccccgcgggcaagaagcccaaggcggagaagaaggtgccggcgtccaaggagggcggcgacaagaaggggaagaagaaggccaagaaaagcgtggagacgtacaagatcttcatcttcaaggtgctcaagcaggtgcaccccgacatcggcatctcctccaaggccatgtccatcatgaactccttcatcaacgacatctttgagaagctcgccggtgagtccgccaagctcgcgcgctacaacaagaagcccaccatcacgtcccgcgagatccagacctccgtccgcctcgtcctccctggcgagctcgccaagcacgccgtctccgagggcaccaaggccgtcaccaagttcacctcgtcctaggctcctcgtgcattagttcttgtgtttctttcctgttccctgtctgatgagttctgtagctagctgtgtgtgttctgacagtgtcatcctgtaacaatggtgctgcctgaataaatagttatcttgctgcttgaaaaaaaaaa

SEQ ID NO: 70056 - DNA, 653 bp, Triticum aestivum
  Clone ID: PAT_TA_70056
aggaattcggcacgagggtgcattttggtccgggctttgcctcgtatgtcctggagtagcaagagcgcatgatggttaaataaataatattctaacaccgtaaatgagttgaacatagcagcaaattaaaaagctgtgattttgagatttctatgacagacagaattacatgcgactgatcatcatcttatagcataattatgtgatgtaaactaacccacagtgtggataacacaacagtatgcgtcttgcaataacttaatactacctccgtatcaaaacaagtgttgtacttattttgggtcggagggagtactaaattgtgctccagaagtgaagatgcccattcatagcagtgcaagtaaaagatgtcttgttcactactactttcttttacgggcattcacttccatagcaaaagtcaactcacactttaaatattattcactttacaattggcagctcatggtaaaaagacaagaaataggcagctcatggtaaaaagacaagaaataggcagctcatggtaaaaagacaagaaatagccagccacagttgtaaaaggacagatgaaccgcattgaaaatgcttgggggacataacagctacaatagaggaaaatatctctaatgttttgaactgtttgatgtcac

SEQ ID NO: 70057 - DNA, 577 bp, Triticum aestivum
  unsure (1)..(577): unsure at all n locations
  Clone ID: PAT_TA_70057
cttcgtgaagacccttaccggcaagaccatcacccttgaggtcgagtcctctgacaccatcgacaacgtcaaggcaaagatccaggacaaggagggcatccccccggaccagcagctgtctcatctttgctggcaagcagctcgaggatggccgcacccttgcggactacnttntccagaaggagtccaccctccacctggttctcagggngngnggtggtatgcacccccnnngtcaagaccctcactggcaaaaccatcaccctcgaggntgagtcctnaaacaanattgataatgtgaaggccaagatccaggacaaggagggtatnccaccggaccagcancgtctcatntttgctggcaagcagcttgaggatggccggacccttgcagactacaacatncagaaggagtncactctncacttggtgctnangctccgtggtggnatgcannatntttngnnaanaccctnaccggcnanaccatcacccctgnaggntgantnctnngacactattgacaattgttaangccangatccaggacaangganggcattnccccgnaccanna

SEQ ID NO: 70058 - DNA, 468 bp, Triticum aestivum
  unsure (1)..(468): unsure at all n locations
  Clone ID: PAT_TA_70058
ctccctctcccggagcacctcggggcaccagatccggtgaggattcttcactaccctccactcgccggcgaccaatagcccacgtgtgggttgggtgctatcctgcnnntggaggaggcatcgaccttcagctgcaggaggccacgacctgcagctggccacgcgccttccccgaaatcctccttcctacccaccgccgtcgatctccttccccgccatggtgacaaccgacatggatccttccctcttgccgccgcttctccctctcctcttccccgattccactgattccctgccgccactggcccggtccgtcctcctcgcctcttcccaccccctcctctgcatcgtaccggtggcttcaccgtttgtcattcgatctctaccgcttggccttatcctctctactaccggtgctcaggtcccctggcattgtgccactgtccgtccctgcgccctcgcctccgt

SEQ ID NO: 70059 - DNA, 337 bp, Triticum aestivum
  Clone ID: PAT_TA_70059
aaggtggtgctgatcggcgactccggggtggggaaatccaacctgctctcccgcttcacccgcaacgagttctgcctcgagtccaagtccaccatcggcgtcgagttcgccacccgcaccctccacgtgagtccttccatccatcgatttcattccttgctttgcttgcttgccgctagatccgacgggatcaatcggatccgcggcttatttccttcctccctgcgctccagatccatatcgttgctgccaaatagtagcaaatccatcgccgcggggacggattcagaggcgaggattgatttctcagctttcatgatttccactgtgcctaggc

SEQ ID NO: 70060 - DNA, 347 bp, Triticum aestivum
  unsure (1)..(347): unsure at all n locations
  Clone ID: PAT_TA_70060
cacctgcgacctcctcgcagccgctgcgactgtcgccaccacctgcaacctccccgcaaccgccaccaccgcccacaccctccccaacggccgactctaccaccccttttctcctccccttagcttctcctcaccatcggcgacctcccctccccctcgcaccagatcgaccagcaggccaggcatagcagagtggagcggacgggcgtgccagaaccagcataacacggtcgcgggcggagagggcgaggctgagtcgctggcggcggcgggcccgatctgggcgggcatgacggacggcctacgcgagcagcgtangggcgcaggcagccgacgcctcttcatgg

SEQ ID NO: 70061 - DNA, 486 bp, Triticum aestivum
  Clone ID: PAT_TA_70061
ctcaccgaggagaagagaagaaaagagaagcgagaagatgtcgggccgtggcaagggaggcaaggggctcggcaagggcggcgccaagcgccaccggaaggtcctccgcgacaacatccagggcatcaccaagccggcgatccggaggctggcgcgtcggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccagggacgcaccctctacggattcggaggctaggccgccaccaccaccagattaggagctagcccatgtgtagggttcgtggtcctcgttgtaatcgcagtatctcgctgttgttcgctgtgttctgtaggatcgaatggaatggaattgaaattaaactaaaaaaaaaa

SEQ ID NO: 70062 - DNA, 615 bp, Triticum aestivum
  unsure (1)..(615): unsure at all n locations
  Clone ID: PAT_TA_70062
cgggctgaggaattcggacgaggcccccgccaccctagctccctcgctgcccctcgccacctcgctccagtccggcnaatcctcccccgctacccaaccttcctcaggacgaccggcacgcccaaccacggccggcccgccacgccacccgcacctacctggcgacggattggttctggcctcgccgcgccgctagagaagcactaaaccacagccgcgccccgatcaccccctatccaccttctggaaacgcagccgcccgagcaccaatcccaggccgctgtcgctctgcccctccccgcacggccagggtgcccctgagccaccttcttctccatgcgcgaccaaggctccccatggtagtgcgccgccgtgccctccccaccgaatccacttcggtcccagcctgaccaccaacgtatccctgttggatccaccccgcccgatggccttcgaccgtggtagcaacgtcgaggtcccgggccaccctctacctctcccctccgctagatccaccactgttcgagaacaactacaacgacgttggcttggggcagcagggttaggggcaccaccgaggcagcagcttcgggcctagatcccgctctagctccg

SEQ ID NO: 70063 - DNA, 634 bp, Triticum aestivum
  unsure (1)..(634): unsure at all n locations
  Clone ID: PAT_TA_70063
gattgtcggctaaaagagttttttgtcttccagcaatgagctttcattttnattgtggaggtttgttcggttcatctcctctcatcattttttttnagtttatctcttcagaagtttgggtgcctctgttttgctactttttagttctcatcattaaggtttgtatctttcctcccctcttggattgttgcatccttattgtgtctcatcgttaaggtggcacatataagtattaatttgttgagttctgctaaagtaccgctgaaaattcaaattctatatactttacttttggctatacacgagaagaatacagtacacacatttgagtagtgattaaatgtgaagaccattgtgcatgtttttctgaatgtggattaattaagttttattgctttatggtgagatgaatatgttgattacaatgatataatattaagagattttcaagtgtaagcttgtagcaaattatcttctaatccggactccatatcattatttatattgtaacacaaatgtgatctattatactcccagccctcggtacatgaaggcatgatattacccctctccccctgccccttctatgtattttttgatttgtttgtgtgactgtactgaatggtgcttgcag

SEQ ID NO: 70064 - DNA, 281 bp, Triticum aestivum
  unsure (1)..(281): unsure at all n locations
  Clone ID: PAT_TA_70064
tntntntnnnananacanncccccccccgngagngtgtgtntntntntntntcnnntctnnnacgcgcgcgcgcgncntnnccccctctntntatatntnntctctnnnnnanatatcnctctcncnngngnntctctttttntnanananatannnnnctttttnttttntctgtganntntctcncncanncncacacaccccncncgcnctctctttttntctctctctctctctctctccnctctctctctctctctctctcncnctctctctctct

SEQ ID NO: 70065 - DNA, 505 bp, Triticum aestivum
  Clone ID: PAT_TA_70065
aattcggacgaggctactcctggtctcccacgccgcctttgctgcggctccccgcctccgcctcaacctccacctccaccagtaccacaacatcaccacgccgatgtctctcatccacctccacctccaccgccgcctcttctcctccaccgcgcggccctcgcgaccctcgcgtgcctggtctccccacgccgcccacaatcttcacgtacggcattctcatgaactgctgctgtcgtgcgcattgcccggacctagggctagccttcttcgggcgcctcctcaggacgggcctgaaggctgacctgatagtcgccaacaccctccttaagtgtctctgccacgcgaaacggacggatgaggctgtgaacgtgctgcttcataggatgtccaagctcggctgtgtgcctgataccttctcatacaacattgttctcaagagcttatgcgacaatggcatgagccagcaggcgctcgacctgctccatatgatggcgaaagaagg

SEQ ID NO: 70066 - DNA, 399 bp, Triticum aestivum
  unsure (1)..(399): unsure at all n locations
  Clone ID: PAT_TA_70066
cggagtgtgatatcgaaaataaacgcgagtgtggatataacgggataacttctgagcaatgcgaagattcaggttgctgttgggttgaaagcgacacagaaggcgatccctggtgtttcgtcaaaagaaatgngctagaacaatgtcaagtcnacagtagtgaacgggttgattgcggacactacggtatcacaaaagancaatgcgaaactagacaatgctgctgggacgagagcgtcgncagagttccctggtgtttcgtcaaaagaaatatgctanaacaatgtcaagttgacagtagtgaacgggttaattgcggacacaacggtatcacacaagagcaatgcgaaactagacantgctgctgggacaagagcgtagccgggagntcccctggtg

SEQ ID NO: 70067 - DNA, 651 bp, Triticum aestivum
  unsure (1)..(651): unsure at all n locations
  Clone ID: PAT_TA_70067
attcggncgaggaagaggctggacaggggatggccgccgggatgtcgctgttccccagaatcctggtttcgatcgggaggagcatggaagcaagggtgtgggcggtgctgcagagtgggtcgatagaggaggtgatgggctcattgggttatcactaggacggcaacgcagctttgctgatatgtttcaggataaccttggccgcagaacacctacttcagaacatccctctcgtgcagccagtcgcaattcagttgatccttctgagaaccaatactctttacataatgatactatggatgcacagcgctctgttggaaatgcacaaagtgtcggcagtctttccagtattaatgcatctgcatctcaaacttttgcttctgttctgggttcatcagcttcaaggaatgcgacaccagattcccattatatccctagggttcctagccctggccttccacctgttggcgctaggattagttctaatgagaagagactaaattgttcatcgtcatcattcaacacagtatcatcaaaagcacttgagcctgatgatatattaactgcactatctagcatgaacttgtcaaaaggtggcactttgaacaacaacagcaacattagtcaatcaaagtttcagagagagataag

SEQ ID NO: 70068 - DNA, 590 bp, Triticum aestivum
  Clone ID: PAT_TA_70068
aattcggcacgaggccaccccgacaatccccgtcgccgaagaagtagcaagcaagatggccggaaggaagggcggcgacaggaagaaggcggtgacacgctccgtcaaggccgggctccagttccccgtcggccgcatcgggcggtacctcaagaagggccgatacgcccagcgcgtcggatccggcgcccccgtctacctcgccgctgtcctcgagtacctcgccgccgaggtcctggagctcgccggcaacgcggccaaggacaacaagaagacccgcatcatcccgcgccacctgctgctcgccgtccgcaacgaccaggagctcggcaagctgctcgccggcgtcaccatcgcccacggcggcgtcatccccaacatcaacgccgtgctgctccccaagaagtcccccgccgccgccgagaaggaggccaagtcgcccaagaagaagacctccaccaagtcccccaagaagaagaccgccgccaccaaggagtaaccgcccccatagcctggccagtgttgcttagatccatttctcatggactaagatgagaccctgtatgtaatgcctgctagtctgtagtgcc

SEQ ID NO: 70069 - DNA, 613 bp, Triticum aestivum
  unsure (1)..(613): unsure at all n locations
  Clone ID: PAT_TA_70069
ttcggcacgaggcccgcaccacctctcctcgnnctcctccctcgctcgcattgccggcgccctctccccgcgcgcgtcactggcgctctcttcctctcacatctccgtctgcatatttaaaaatgggattttttccctctggctctccgatcttgaccggtggtgctcgatctgcggagctgctgctgatggtcacctgcccggagctgctgctgcccggatctggtagctgcaccggcagatgttcttcttgagctgggaccgcttgttggtttcggctagaagagggaggaggtgatgccggccaagtacctgcaggcgttcgagaggagaggcgaccggagttgcaccggcgtcgactgcgcgtgccgcatcctcaccggaaacgtgcccttcggcctccccatcagccgcaccctcgtcatttccctccccaaggtctgcaagtccctctccgtccagctcatgtgcagagatacagcgacgcaaatcccagctccccccctctacggcctattgcattttgctccggggaagctaattaacactgcacgaaaaccctttgcttaagcatctaacgacattctgctcgtgccttaactgtatcaaagtt

SEQ ID NO: 70070 - DNA, 462 bp, Triticum aestivum
  unsure (1)..(462): unsure at all n locations
  Clone ID: PAT_TA_70070
ggtacagagataagnctgttagaaaaagagacaacttagagagagagagagatgatggaggtgggcatggcgatggcgatgaaggtgctgctaagcctatgctgcgtgggggcgtgctccctcgcgctctacctctaccacaccgtctgggtggtgccgcagaggcttcttgctgggttcaggaggcagggcatcggcggcccgcgcccgtctttcccttacggcaacatcgccgacatgagggaggcggtcgccgccggaaagtcggctccccgagccggcggccgcatcgtccacgactaccgcccagccgtgctgcccttctacgagaaatggaggaaagagcatggtccagtgttcacttactccatggggaacgcggtgttccttcacgtgagccgggcagacgtggtccgggacatcaacctctgcgtctcgctggatctcggcaagagctcctac

SEQ ID NO: 70071 - DNA, 469 bp, Triticum aestivum
  Clone ID: PAT_TA_70071
ggaaaactacttgcatacttgttcacttataacaaaaaaaacttgtaacacataccacacgattgcgccgaacaaaatcatggacccaatgtattgaccgatttatcgtgcatgaggatcaggatgacatgtaattaagtagaagtaggtgactcacacacagtagcgtagttgtaggatggcaagggtggtccatggaccatcctggaattgagtccattagtgtagtatatactactccataaaaaatataatcggactcaagtcagcttctcagtccatatacaagcaaatagattaagttgtttggttaagtctgctctgtactattgtatgctagtcagccgatgctcgtttttcggtcgagtctagtccaaaagatgttccttgttttcagacttcctctcctctcgaaccctagcgtttagcgagccccatcagccaacaacacgaggctgataggggaccc

SEQ ID NO: 70072 - DNA, 493 bp, Triticum aestivum
  unsure (1)..(493): unsure at all n locations
  Clone ID: PAT_TA_70072
gaaaggtncagcttgcgacgcaacctccgacggcgacggccgccatttgtttactcgctcctccgctccgctcccccctttccccttccctccctatccaccaccctccctccagccaccgccgcaccaactcctctctctctctctctcctgtccccctcgattggttgcgccaccaaaccgaccgcaccaagccgagccaagcacgcccgagcaaagcggggggagagagagaggaccgggaggagcatcccgacagccgcgcgccgccggccggcccgtccggcgtncagatcccgcccagttcggaggtacaatttttccctgcgtgtccgcatgagcagaagagacagcaggagaagtgattttggactgaacttctgagaaatttaggaaggcatacatgcataatgatgttgggatggtgtccagcagaaggaattccacaggggcgttccaccgcgacggcccgcccaaggactggtcccagttc

SEQ ID NO: 70073 - DNA, 632 bp, Triticum aestivum
  unsure (1)..(632): unsure at all n locations
  Clone ID: PAT_TA_70073
cggcacgaggnatctcctcagncctcccgcgcatctcctccgacatggncccgcaccaagcagacggcgaggaagtccaccggcggcaaggcgccgaggaagcagctggccaccaaggccgcccgcaagtccgccccggccacaggcggcgtcaagaagccccaccgcttccgccccggcaccgtcgccctccgcgagatccgcaagtaccagaagagcaccgagctgctcatccgcaagctccccttccagcgcctcgtccgcgagatcgcccaggacttcaagaccgacctccgcttccagtcctccgccgtctccgccctgcaggaggccgccgaggcctacctggtgggcctcttcgaggacaccaacctctgcgccatccacgccaagcgcgtcaccatcatgcccaaggacatccagctcgcccgccgcatccgtggagagagggcctaagctctgttcgtcgtcgtctgttagtcgtcctcttagcctgatgtgttcatcggtggaaatgtgcgtgctagtgtttgttcgtgtcgtggtcgatgtagtgtgtctgttctgatgtcaccatcttgctgtcatcagtaactgaaatgaaaatgttgctatctgttctaaaaaaaaaa

SEQ ID NO: 70074 - DNA, 555 bp, Triticum aestivum
  Clone ID: PAT_TA_70074
agcacgcccccaaccgcatccacagcccacgccaccgcggctcccaatccctcccacgcagccgccgcggctcccaatccctcccacgcagccgccgccaatgcctcctggacatccacctcgaagggacaacgacggcgactaggatgtcttcctcccccagcgacggcgacgttctttgccaccgccgtggtcgggatgcggcgaccagcagaggaactcctccggcagagggggaatcctcccttgcttccttgtccaccacgaaccacacacaggcaggggaggagccgcagcgtccaacctccaccgccgcccgaagccggcaaatcatctgacgcaggcagttgaaggggctaggccatcgagaggctgcagggccatggacatgtcagagaggaggacattcttggccgatgtagaagctgcgggagaggagggctctgaccttgacggatgccatgcaatggaaggtcggcaaggaagccagtgggacggaggcgacgaactctgctgcagccacggccggctgtgcttctgccttcgtggtggcct

SEQ ID NO: 70075 - DNA, 664 bp, Triticum aestivum
  Clone ID: PAT_TA_70075
gcacctcaagctgcaccaatgcggcctgccgtctctcccagtgggattcactggattccccatgctcaaggttctaaaactcggccttgtcgatttcccggagaacggggagagccaactggaggcgattcttgtcgggtcacccttgcttgaaaccctgaatcttcactttgtggatgtccgtgggaatgacgcgtactcaaacgcgtgggtgattcgcggggccaacctccggagcctaacgataagttctgactttgattatgactggcaagttaaggagctgccatgcatcgatgaagtcgccatcgatgttggaaactatgtgagtaatatcaagttcagaggatttcttgccagctttgcgcaagttaggaagctctctctctgtgcgtgctacacatcgtttactggaggtggtctcctggaaacacttccatgtacctttgacaacttaaagagtttgaccctctggacacatttctacgaaatgcctgccatagtgttaaccttttgcttactaaggaatgctcctaatctagaagaacttgaaattacgagttctaaatacacaatggactgatgccttctgtgccaaccttcaggttgtgaaaatgaaaaatattggctggttgcaaaatgaaatgtatttcatagagctcgt

SEQ ID NO: 70076 - DNA, 409 bp, Triticum aestivum
  unsure (1)..(409): unsure at all n locations
  Clone ID: PAT_TA_70076
tattttttaatacagtacaacaagtgtttatatacatacgcatacattcatccctatctctatgagcatcttcgaaagactgagccagcatatcatcttaaaatttacgaagtcaccgtaggcacctcgtcatcgacgggaacgtctccctccgttcacttttgtaaggcgcggaaggagatttccgacagccccaaaaatcgctaatggacaacaatacccttcgatcaatttgaaattcaaaaaccatcgggatcgcttcgccaagtgcgtcgcctcccagcgcgtcgccggctcaccgnacacctcgccgcccagcttctcccttnccacctcgcccagattctcctcgccaggatctcctcccttcccacctcgcccagattctcctccgcccaggatctcctcc

SEQ ID NO: 70077 - DNA, 624 bp, Triticum aestivum
  unsure (1)..(624): unsure at all n locations
  Clone ID: PAT_TA_70077
ttaaggatatntatgaataactgcatatatacagcattgctcctgggccatggcaggcatcacatggttccaacactaagtgagacttaactaatcagggagggagcatcaggagcatgaattccatcagataacatctaaacatgcaggcgcattcatactgctggagcgacagagcaagcactagttgtttccaatctccatgagcagccaatcctttctcatgtccatcgggagtgccatgagagactcaaatcggcgatcatcacgggtaagagcactgtaggctctcagaatatcgctacgggctaagtcaggtatgtttttgagtgcctcgaagattatttcaggggaacttgaatttggcacttgcacatgcacagctggattgctttcgcctactggtgagataggtgcatcgtttgttctcggcctcttaatgaccttattaacttccacttccaggcccaattgaccgatttgcgtgttaggactaccttcaccatcagtttcaccaacaacctctgctcatacttcttgacaactctcaccatcagtctttgcgccttcttttgtcgcgttgtcaccggagcatgtgatgctaattgcatccgagttctgaac

SEQ ID NO: 70078 - DNA, 580 bp, Triticum aestivum
  unsure (1)..(580): unsure at all n locations
  Clone ID: PAT_TA_70078
cacctgaatatattgctcaaagtggccaaaatgccaagtgtttgatccagtttataagaaaaaccggatcgaaaaccttaacaggttgacccggtttataagggaaaccgtgccgaaaaaccacacaggggggaaagattacatagggtgagagcatatggacgccccgaagaaagcactacctagccagcaagccaagagaccaccaccataaaagtcgagaggaagtggtgtgtcatcgaggaaacacaataccaacactaaacaactatcctaacgcaccacacctgcatgcataccaaccccttggcacaacagaggagcaacaccaatcaacgagtgacccatcacgaaccttgactggaaactccgccacagcaagccgacacgattagcaaggtggggaggcatcgttgcgtcgttgttgagcaaagatgaaccgagatagcacgaagagcacgaagctcaccaaaacggacgacaggcatgagagggtcttgagctagcagagcagaggatgaccaatccccaanggcaacgaaggatgaatggcggcaaggagctccctagtgacgccttc

SEQ ID NO: 70079 - DNA, 478 bp, Triticum aestivum
  Clone ID: PAT_TA_70079
aagataatgaaaacttacaagacgacatggtccgaacacatgactattacagagtaccatcgatcgaccaagaaaccggaacagactatctaagcggaggtgaacttggtgacggccttggtgccctcggagacggcgtgcttggcgagctcgccggggaggacgaggcggacggaggtctggatctcccgggacgtgatggtgggcttcttgttgtagcgggcgagcttggcggactcgccggcgagcttctcgaagatgtcgttgatgaaggagttcatgatggacatggccttggaggagatgccgatgtccgggtgcacctgcttcagcaccttgaagatgtagatcttgtacgtctccacgctcttcttcgacttcttcttgcccttcttctcgccgccctccttggacgccggcggccgcttctcggccttggtcttcttcgccgcagtggtcttctcggccttctccgccc

SEQ ID NO: 70080 - DNA, 549 bp, Triticum aestivum
  Clone ID: PAT_TA_70080
cgacatggtccgaacacctgactattacagagtaccatcgatcgacaaagaagacaggaacagactatctaagcggaggtgaacttggtgacggccttggtgccctcggagacggcgtgcttggcgagctcgccggggaggacgaggcggacggaggtctggatctcccgggaggtgatggacatggccttggaggagatgccgatgtcggggtgcacctgcttcagcaccttgaagatgtagatcttgtacgtctccacgctcttcttcgacttcttcttccccttcttctcgccgccctcctggatggacgtcgagttgccgatgaaggtggacgccatggacaggcccctgggcgcgatgtcgcacacgctcgacttgacgttgttggggatccactccacgaagtagctcgagttcttgttctgcacgttgatcatctgctcgtcttctcggccttctccgccaccggcttcttctccgccttgggggccatggatgccgcggctgctgctgctgcttcgacgaggagaggtgtggtgtttcgcc

SEQ ID NO: 70081 - DNA, 108 bp, Triticum aestivum
  unsure (1)..(108): unsure at all n locations
  Clone ID: PAT_TA_70081
atgtcatacaacatccacgcatttacaatntnacacattataaacaaaggcaatgcnggtnaaaccgctgcacccttctttttctgtatcaacncagcgtacacagaa

SEQ ID NO: 70082 - DNA, 174 bp, Triticum aestivum
  unsure (1)..(174): unsure at all n locations
  Clone ID: PAT_TA_70082
cttctttctgcgtacaagggagggagatgtacataagtatccgctaacaaatgttgcattgtatgtagagatcttcaagcgtaaaccttgccttgtccactttatcttagggacangaacaattttacctaacatctgcataactgggcacagacaatttggtaaaaactgctt

SEQ ID NO: 70083 - DNA, 468 bp, Triticum aestivum
  Clone ID: PAT_TA_70083
ttcgatcctacagaagatagcgaacaacagcgagatgctgcgattacagcaacgaccacgaaccctaggcactctaatctggtggtggtggcggcctagcccccgaaaccgtagagggtgcgtccctggcgcttgagggcgtagacgacgtccatggcggtgacggtcttgcggcgggcgtgctcggtgtaggtgacggcgtcgcggatgacgttctcgaggaagatcttgagcacgccgcgggtctcctcgtagatgagccccgagatgcgcttcacgccgccccgacgcgccagcctccggatcgccggcttggtgatgccctggatgttgtcgcggaggaccttccggtggcgcttggcgccgcccttgccgagccccttgcctcccttgccgcgccccgacatcttctcgcttctctctcttcttctcctgggtgaggttgacctgtctttctttgtgaggtac

SEQ ID NO: 70084 - DNA, 654 bp, Triticum aestivum
  unsure (1)..(654): unsure at all n locations
  Clone ID: PAT_TA_70084
cttcctttccnttntaagttnataggtcgcaaagagtcttacacaacctgtatgtcgtaatggattaacatcctaatccaggttgaaatnaacccccaacaattaccttctaaaaaattaatagttggaaacatttgtatcctgcagccttcaggttgccacacaacattctcgtaacgaatacaatagcctgtgaatcccacaaataagggaaaactcctaaaaagggcaatacatgtctaggagaatagcctgatctgtagcagcaagtttgattccaagaaaaaaaatcataaaagggtgaatgattacttgatttatgtagccacacaaacacataaaaaaagttgtcagagcttttgcttatggcattggccattttgttttttttgcctaaatcgccacccattaaaacctagagtttccacccattatcatttgtgagctaaattttggtacttctacactgaacattgaataatacttacacggatcggcgtgctacttgttttccttggtgtactataactatctccaccacaagaagccaaatcctttgcgtcctttgaaagaataaataaataaatgatatatgatacatcaatgcttagacaggtactcagcctgcttgatactatttaatagatgtgatac

SEQ ID NO: 70085 - DNA, 633 bp, Triticum aestivum
  unsure (1)..(633): unsure at all n locations
  Clone ID: PAT_TA_70085
tgaagcactgctatgttngttacagcctcagcaggcagctcaatgagataacaatttgggtacaaataaattccaggttcacagtccatacaattgaatcaacgccctacatacctgatttactaaggctaaagttagtgcagctcaacagggttcgtcaaaaaggaactaatgcagcttacatataatgggtttcggggtcaagaaccaacaatggtcgatggcatctcagcacatccaaattggagataaccccgcaactccaagaatatcaatcaagcctttcgggattatgtcccactccttgtcacccttcggaacatgtcttttatgttctttgatcctacctcaggcttcagtttctttgcaggcctccctttgcttgacttggcactgctatttcctacacccccctctgagggacgagctggagcaggtaccggagaactatcagcacaaaatgacgtgtcattggttttggccatatcatttatctcactgatgtctaactgcaatttcttgcagagtaccattagccacggttcatccttcaggttttcacgaattatttggacagcctcctttaacagttctctttctccttgagcagcataatttttacctaacttggag

SEQ ID NO: 70086 - DNA, 176 bp, Triticum aestivum
  unsure (1)..(176): unsure at all n locations
  Clone ID: PAT_TA_70086
cttattaacaataatgacatnttgaaataagcccagccgattggacancactcacctgatgcagaatatcaggacaatcatgtggcagagatagnaaccacaggctgatgaaacgaatccgnacttntgaaatatcagttngccaaaagaagcacaaatacagntgttacacccaa

SEQ ID NO: 70087 - DNA, 130 bp, Triticum aestivum
  unsure (1)..(130): unsure at all n locations
  Clone ID: PAT_TA_70087
tcaatgtgaccaactgacancactggaatacctgccggcaacccagcagcgctcagggcattagaaaatatgatcaacangcttcggcatgactgctccacttccatgcgctctgtcgcagtgtgctgca

SEQ ID NO: 70088 - DNA, 604 bp, Triticum aestivum
  Clone ID: PAT_TA_70088
ccaagcttgggactccctacccaagatataccggttttagcacccactgctgggccgcacgagttgattgaggcacatggccaatcccaaaggcatgctgctggtctggcgacgtcgacatggggtcctccatgtgagggaaggagacggcagccacaggggttcagcaggcaagctgctctcctcgtcgctgcctagactgcccctctccggcgatagcccccggttgctgaccacgcggcagaagcaccttggcagcggcgactggggtagcacggcggcggcgactacctgcttcttgccagggcatgggtgtgggtctgatatatttttgttttatatctagggctgtgtttgtcaattcttggccaagttagcaccttacaatcagaccacacttgtcagaaacacgattaaatgggtaaagtgagcgataagtgctttctgcaaaaagtttagtgggaatgcggtgattttcgcaaaagactaacgacttggtggttttttacaaacctagccataaatgtggttatttttttgcaatcaactccatattaatataaaaacgacaccatataggcttttcctattgtttttgctaaaa

SEQ ID NO: 70089 - DNA, 675 bp, Triticum aestivum
  Clone ID: PAT_TA_70089
atttcctaacagagaggagcggtgagcttacaaaaaactaagagcgacaagccattgtgtctaatactgattttctacaaaatttgcaagcaagcatttgcatatattttcaagcaacacaagcacaagagttctgggaaacaacataagcccaaatgtcctaactgttcatacaacagacctagcaaccacagaacaagctgaaataaacccaggcctcaaagctgctcacacaactaatggtggaaggtgcggcgccaatgttgagcctctgccttgatactgtccacacaacaatcagatcattgctcatcacctggaagattagtttgttgctctcacaccaaaaagaccatactgcgaaagcaaccatcgagtttaagtcctttctcttctcttgcgatacacttgtgcttcgttgtccaacagtccctcaggaggcattcgccataggcgtcctagaagcatgcccagtcaaatggagaggccccaaagctttttggaccacatgtacctcatgaagaggtgctttactgtctcctgctcaagggaacaaaaagggcaggttgtgtgactagggagatggtggctttccaatttatctgtcgtctagcaacagtgtggtaggtcaaaccacagaaaagccgacacttcaatggtgccttggcttaccaa

SEQ ID NO: 70090 - DNA, 514 bp, Triticum aestivum
  unsure (1)..(514): unsure at all n locations
  Clone ID: PAT_TA_70090
ggcaggacaaacagcagcgagatgctgcgactcacccgactatcaggctactgatctggtggtggcctagccgccgaatccgtagagggtgcggccctggcgcttgagcgcgtagacgacgtccatggcggtgacggtcttgcgtcgggcgtgctcggtgtaggtgacggcatcgcggatgacgttctcgaggattgggtaatttgcgcgcctgctgccttccttggatgtggtagccgtttctcaggctccctctccggaatcgaaccctaattctccgtcacccgtcaccaccatggtaggcccctatcctaccatcgaaagttgatagggcagaaatttgaatgatgcgtcgccggcacgaaggccgtgcgatccgtcgagttatcatgaatcatcggatcagcgagcagagcccgcgtcagccttttatctaataaatgcgcccctnccagaagtcggggttttgttgcacgtattagcctctagaattactacngntattccgagtagc

SEQ ID NO: 70091 - DNA, 617 bp, Triticum aestivum
  Clone ID: PAT_TA_70091
ggagcacaatttgatgtatactaatatccttctcccctcctaatccttggttacaacacaaccaaaggataagggggcaacagataagatagtaccataagataagagtaattcataatcctcatagtgaggaagtcacctttataaagatcaacgagaaaggggacactaaagtagaaatataaggagaaatgcctcacctaggcaaagctggcaattttgatgcagttgattaggctccatttcctccatttgcttcacctgtggccaagctcgaaatgctaaaaatctcctcaccttctacaccaaacaaccccaaaagaatgtggcaccagtacttgctagcatgatgtcctgaggctggtaacttagcagcagcaggcagtagcagccggttgaagcacagccaaaaaaatttcacctctcttgattcatctgtgtgtttggttgttctaaactaccatctcatcgagctggagctgttcgagccacccaccgatgacaccagtggcggcgtcctcctcaccgtcgatgatgccctcacggtggttcgctgttcgacccaagatggcactgtcatcaccggcaatgctctcgtggtggcttgctgatcggcc

SEQ ID NO: 70092 - DNA, 405 bp, Triticum aestivum
  unsure (1)..(405): unsure at all n locations
  Clone ID: PAT_TA_70092
taacacattgtgcaacaacagccggatggtactttgcccacacacacacacacacacacacacacacanagaaanagacgggtgcgattattccaacacaagtccattgacgttnatntggggaactgtcgggggcgattctcanggattgctggtcttatgcatctcacggggggaggcatacaacacaaganggganagcgngcaaattcgntctttccactanatagatgctaattctgctacggntgctgcttacggacagtagtagcgtggcgcggcgtggatcgnacacatggcgttgatcatccnctntatctncgcagtcctnctcgggtcagggtccgcantggcccnctccgtcagcacgtgcttgatccgncacatcnatctcttcaccttgna

SEQ ID NO: 70093 - DNA, 725 bp, Triticum aestivum
  unsure (1)..(725): unsure at all n locations
  Clone ID: PAT_TA_70093
aatggcgctcccttcctgcaccgcgcagctaaacaaaccccggagccgacgcggtgcatctccaaagcgtgacggacgccggcacacacgcccacgccaacaaaagaagaggttcgtttctcgtgtgggcggaatctggaaaagagcaaaggcgaggttctcgaacgggcgggcgtcgccggagtcgctttcgagattcggacgagcaacggggcgccatgacagcaacacaacatgctggtaggcatcggcgcagcaaaagatggaattggaattggaatcgggtgtggtgcaggccgccttcggtgacggctttgctcgtggctgccaccggccgccgccagggccgttgctgtcagtctcgtgatgcccacgcttcacatttcttggcgttgaaaagagttcaggccagcaggggttacaataatagcctcatccgcttgttcatgattaaggccccgttgacggggatggactcttgagctaccggtccttgctgacgaactccgtcttcagcgtctcctccagctgggagaacagcgatgtgaaggtacctgacagtgacttgttcaataatgaacctttgattaacagtgtgccaggcatctgttcaaacaccgaaatacggaaggatgctcctgtaacaatgctatgcacctttgtagagttgtcttcaacagaaccaggaaggtcatcacaatccaatgntgcagcctgagtctgct

SEQ ID NO: 70094 - DNA, 264 bp, Triticum aestivum
  Clone ID: PAT_TA_70094
gttacataggagcgacgcacacatggaacacgacgggaacagggagcctaaaacacctagcagtgcggcgagcgaggcgcctaggcgcgctccccgcggatgcggcgggcgagctggatgtccttgggcatgatggtgacgcgcttggcgtggatggcgcagaggttggtgtcctcgaagaggccgacgaggtaggcctcggcggcctcctgcagggcggagacggcggaggtcggtgttttgaagtggagcgggggagattgc

SEQ ID NO: 70095 - DNA, 712 bp, Triticum aestivum
  Clone ID: PAT_TA_70095
tctttttcttttccttttttctggaagcacaaaaacgtaactcgaattcaagtagagcaaacataaactgaatgcaacctctgcagttatgaatatctgtttggttacggtacacaaatatggcacccttcagacgatggaaaaagatatccatcccaggaaccttacacaatcaacacatcagtctatcacactgtgattggtagaaaccacacatatttttctctccttggaatgatattcacactaccatgtttttctcttcttctgtgaggaaacaatcatacacattgccatcagcgtagcagtgcagtttctctcctgcatgcaaattttaacccacagccgatggccggtcttgaataaagccggacaggcactcataacccctctgtcttccagactacagaaggacccctcttctcaagttcacaagggcggagcttgttcattacacgccccatcatagccatcgctgcgatgcttggaaactgaccttcaagacaatcaggtggtgtgttagacttttgcgattgctttcctggactcgaagctccatgaaaactaggggtgccaccttggcaccacctccccatccagtgattaagactttttgttgacataggagacgcatcttggttttgttggtccatcaatgtttcatgcaccacttggtcctcaacctgtttgatcatgcaagcactgtccctct

SEQ ID NO: 70096 - DNA, 713 bp, Triticum aestivum
  unsure (1)..(713): unsure at all n locations
  Clone ID: PAT_TA_70096
actcgtctnacctacaacatgcgttcataactatccatctctctctcaaaagaaaattttaaatcactccctgttggtggggcaccaaaaggattacccctctttttccctatgatttctttatgagctttctctgttttttcattccctgccctctttttatctttcctctcctttctcatagacttgccctgcgtaggattcttttcagcagaaaatttaaaaatcgcagactcattggtcgtgccttgaacagcaagccttgccgcaacagcgcctgacaaagcctccagcacaccagggttaaagaggagctagttctggaaagcagcagcagcagcaagtaaagtgctgccctcacccaatggatggatcccctggccctcctggccagcgggacaccccatgtgtccagcagcagaacgcagctcctgagtggaactggacgacccttggtgcatcagctcaagaccctcctggccgagttttgcacagctccaggcccccgtcccctggccctccaggccagagtcggcaggtgctgtcggaggcgccgaccggtcctcctgaccggtgccagcacctggtgcagttggcgggggagccacaagtaccccgccctcctggccgagtgggaggccctccgatggccgcaacacccgtcgtcatggtagccgtagcgatcttgtccgtcaccgtgagttcacccacgg

SEQ ID NO: 70097 - DNA, 360 bp, Triticum aestivum
  unsure (1)..(360): unsure at all n locations
  Clone ID: PAT_TA_70097
aaaaaaaaaangccagggtncagaattacagngccacacaccagngaaaaacacagggttncccctngaaacataacatttcagaatttttattgtncaaaaaatagtcccagaaaangngagtccatacttgctnttagctncaaatncaacagtncaggctatggtaacctccaggactagnggcnccagctgnccagcacatacatatccaagcnctagctagatctnatctnatgagangagcattngactgcatacctatatggctaanaaataaangcaaatngctccaanggaccttccanaatntaaggccgtcgtcgnatgcttaaaaccttgacnacggtanatagggct

SEQ ID NO: 70098 - DNA, 103 bp, Triticum aestivum
  unsure (1)..(103): unsure at all n locations
  Clone ID: PAT_TA_70098
accaaacatcatatcaacactacagtgaaacccggcncacatccttacaaccagatcgcangacacgaactgctacggncaaacctaggcgcgctccccacgg

SEQ ID NO: 70099 - DNA, 593 bp, Triticum aestivum
  unsure (1)..(593): unsure at all n locations
  Clone ID: PAT_TA_70099
caacttttacnccttgattagttattaaatgtaatataaaacattattttgtatactggttagtttaattagtatatgtaattaaagaaaattgtgttgcattgttctcttatatactgttgaaatatccattgttcaaaaatagtataataattttcgacgtgcttcaaacattatacaaaaatatgatgtgtatctctcttttgtatttgtgcataacttaatattcttaaatacttcaacagggatctatgaaacatgcaataacatagggtgattcttcgtggtaattaatcttttcaatgatgtgagggcgagagtggaagtattgatggacctgagggtcaactacccagaagaacaccatgccgacagctatcaggaagaccacataatttgattagggccgaggctcaagacgtagaaatacacctcatttatattaaacttgtgtacttatttaaatagttgtataatagtatagttttaattgacagaaaattctattacttacctagcatagttataaattaacaatgttgctaaatatcgcatataactttctttgtttatcaagcagttttaatgtgtac

SEQ ID NO: 70100 - DNA, 663 bp, Triticum aestivum
  Clone ID: PAT_TA_70100
aagcaacaaaacaacctttatagctactggtagctttagcctaagctcacattactcatcaatctcatagaaacctcaagcttactaacaaaactagtggcctcctcgcccttgcaggggaggttacatacgtatattcaggagatcagaacagcacgagaacgatgacactagccatggcaataagcagcgcaatacttgccttcaacccagcagccccattcaagccccagacacggacgtcgtctatcaccggcccgcagagcgagctgtggtcgtcgcttctcgtgttgtagtggaagttctgggcctggtcgccggcgaatgccatgacagccattggcggctggcacgagtcgcctgccgagcccagcgtgaacgtcagggtgtacgccttctgaggggtcgtctccaccatctgcgagatgatgccctccttgccggagagaagctcgatggcgcgcttcccctggggcacggtgtactggtcggagtcgacgaagcggactgcgcggttcgactcgatcatccaccctggcaaggccgatgtctgctcgtcaaggttcgtcgggagcaggacaccgaagcttgtgtttggaaacatccatggcccctcctcaaagtctccattgatcaccatgttctcctttgctttgtcggggg

SEQ ID NO: 70101 - DNA, 715 bp, Triticum aestivum
  Clone ID: PAT_TA_70101
tgtgatgtagcaacctacatgggcaatgaaatacagatgttccaacaaaagcaaacatcaaatattacaaatattatccaaggatttcccaaactgtgaaatgagaacgcaagagctgagagtatctcaaaggaaatcaacgtcatggcatcgacacgatgatctatcaaagggatcgctaatagtcagatcatggatgtgcccaatatgtatctcgtctccgtagtaagagtcacaactaaaattaaactgagcaccttgagaaaccctgttatccagttgtagttttctgtgctggccagctctccattcagaaatgtatttctttcgatttattgcagtgcgtgatgcaaactccatatgttctaacacttttgcattcaaaagaaagtaccttgcaaaatcaacatctctaggtgttccttgatagtttatcagcactacttttttgagatggagctccaaacattcaatatagccaagtggaaaactgtgtcgtgctctttttgatgccccagtccgatataacaagacatataacttctccaagcaaggaaagaatgtcacaaagtcaatggcatcatcgacacttggaggggaaatgcgcagaaccaacactttaacggctcgcaccacattcatcaaattgacagcgagaaatccctgaagaacatttgtttcaagcttgcctttggtgaacccttctggcagagaa

SEQ ID NO: 70102 - DNA, 713 bp, Triticum aestivum
  Clone ID: PAT_TA_70102
gagctgcacatctagcccatatcattcgtcctcgagctgcaaaattatatacaatgagctgcacatctaaaacaaagtatgtgagcatcacatctagccacgcgtcgcagcctgcacacacactcacgccgtactgcatggctgggatccgctacaattgaacggtaggcgagcaatagtcgatctgcacagcacatggagtcacagtgcactgcaccgccacacccgtgctgctccggcgatgaagggggaaaggaggaaaaggggaacagaggatggctggctagggagtagccctggcaccttgctcggcgaggagaaataggggcacgggagctggatccattgtgtggcggcggatctggcctttaggcagaggaacaaggcggaggttgaggttaggggcgccgatggggaggtagatggagggtgcaggaggtgtcttcaacgagggagctcaccacgccatcacactcgcagccgaacctttcattgctcggaggtcgtgctcaatggagatggcgcctgtgttgattcaccgcagcggcaaccttcacgaagccgcagcaatgttcaattccctcgtggtagctcatgcaccacgcacgcggtcgccggcgatccaatcactccgcaccggcaagccaatcggcggcgatgcctccatctcccagccacttgtgacagcccaaaatgagggcggctcgcgcagc

SEQ ID NO: 70103 - DNA, 336 bp, Triticum aestivum
  unsure (1)..(336): unsure at all n locations
  Clone ID: PAT_TA_70103
aggcacgcgaaggtcgaccaaggctcagatcacaagtccactaccttgcctacctacaaagcgcacagcacatacgctaccattttacagaggacggctcaaggctagggtcatgactacaccatggcgaggcttcaggctgttttaccatctcttcctcctgtgcacaatggcctttgccatgtcgctgntcttccactgtacgaaacttatttgctcttctgggcctgaatgccgcccacaggtagggtcgtccttggaaagctcgataagatgaacgcactggccgatgagaacccaaactcgcagtcgccgaagtaggcccgaactcgtnct

SEQ ID NO: 70104 - DNA, 500 bp, Triticum aestivum
  unsure (1)..(500): unsure at all n locations
  Clone ID: PAT_TA_70104
atggtgatatattgttttaaaaaatnttggtagtctcgtttgttcattagacaactatttaatgacacacacacacacacacacacacacacctttctttctatattaatggtagaccttaacttcaactctacacagttcaacattcctcaatgattcatcgccggcattgacagcagtaagagaaatcggtcaattcgctacaaccaacgaatacaacctanggataagctatacaaaatagacatgttctccgttttcctgattcactcttcttgctccacttcaccatatggcttgagcatcgataacttnctctccaatccacctttgcaagtagagtttctttcatggctgtggtaaccacttcagctttgtatacaacggtgcaggaggccatttatagcaaaacaggttgaattttgaacctgcaggttgcgacagctgtagcatggcggtggctgtccgcatggataggttcacagcagcggtgcagggca

SEQ ID NO: 70105 - DNA, 474 bp, Triticum aestivum
  Clone ID: PAT_TA_70105
tgtataccatatgaagtgttacttctggttcaaagcaaacatggcaaagagctcgttcaaaacaaagggataggttgtaattaagtgctcccagccatcggtcgccattactatttgcaaacacgacggagattgggcttggataaacttcaagcatgccgccttcaatgggcggcagtggtgctgctcagctagagcaagagtagacgccaccgagctcacacctatgcgcaaggacaactgcctttcacagataaacctgagccgttggagatcatatctgtctgcggctacaagcaagccttgcagccattgcacagtctctggtggtttctctctttgtccttgttccgcaacttctgacatttcatcctctgttgcttcctcttcttgtccttcttccacagcagctgcttcgtcttcctccatcttgtcatcctccatcttagggagtgagtctgtgtagatgaagct

SEQ ID NO: 70106 - DNA, 360 bp, Triticum aestivum
  Clone ID: PAT_TA_70106
tgcctacgtgaagaggaaccaaaacaagtctggccaatgacctggctgctcgtgcatctagactgggcagactttttaagttggcggatgtgccaaatgagcttagagagactctgagtaaagattgtacccagcctgtttgatcaggtttgtgtgattctcaaaaaaaatgacatatgttccttcgacctttgtcatccagctttggcctacaaaaagttcacttggggttcttgtggaagaatgagcatcacgtggatccaatgcacatagtttgctcagcaaaaacttttgttctgtcttctaggctaaccagaggttccatccaaatccctgtcctaccaaaaaaaaaaaaaataa

SEQ ID NO: 70107 - DNA, 545 bp, Triticum aestivum
  Clone ID: PAT_TA_70107
caaagcgttggcaatcacccagcacaggtactgctaccgctacttgcagatagatagataagcagagtacagatacagaaaccaactacacgccgtcagtctaggaggaggtgaacttggtgacggccttggtgccctcggagacggcgtgcttggcgagctcgccggggaggacgaggcggacggaggtctggatctcccgggaggtgatggtgggcttcttgttgtacctcgcgagcttggcggactcgccggcgagcttctcgaagatgtcgttgatgaaggagttcatgatggacatggccttggaggagatgccgatgtcggggtggacctgcttcagcaccttgaagatgtagatcttgtacgtctcgacgctcttcttggccttgctgcccttcttccggcccctcgtcttggcctcgccgccggcctccttggacgccgtcttgcccgccggcagccgcttctcggccttgggcttcttgccggcgggggttttctccgccgccttctccaccttgttctcggcgacggtcttcttc

SEQ ID NO: 70108 - DNA, 170 bp, Triticum aestivum
  unsure (1)..(170): unsure at all n locations
  Clone ID: PAT_TA_70108
accaggcncacacnaggtatcacacgacangaacagctngcaagcattaccgnngaccaggncgaacctaggcgcgctcncnacggatgcggngggcgagctggttgtccttgngcatgatggtgacgcgcttggcgtggatggngcacaggttggtgtnntcgaacagc

SEQ ID NO: 70109 - DNA, 635 bp, Triticum aestivum
  unsure (1)..(635): unsure at all n locations
  Clone ID: PAT_TA_70109
gtctctgcatagttaaaatatacacagtncatatnatgcacatacaaaaatcacatgggcaactagcaaagccatacaagatcgaagatggggtaataagaaaagaaaagaaaaaactgaagcgatcaaaacattgatcaacgagctacaaagacgatcatatacgcatcaaccatctcttgacctcacaagtacaacgaaaaggtccccaatatcaacgcctacgtgaaaaaaaaaaacgcacaagcgacaccctcgcangatccaatcattgaaagttagaccttcggttttcaccctggagctntagaccggtacttgngaagcaccatcaaatcaaagtcatcatatgttgtcgccaccactttcgatgatcccaccagttgtgtacctagcacggtcttgatgtgagatgtcacgcactcacacaagcactcagtccagttgcgacaagagtctgtcgccaccaaaagctatgaacaacgaaggtcgtcgacacacatttgtaacgaaaattgagcganaaaggtcaccggcaccaccaaaatcccaactcatgctccgtcgttctagatctgaagatccaagatccaanatcgggcagcaatacatatttcgtcgttggcaccacatct

SEQ ID NO: 70110 - DNA, 288 bp, Triticum aestivum
  unsure (1)..(288): unsure at all n locations
  Clone ID: PAT_TA_70110
caagttgatgagagcatgcatatcatcagagtatgtaacgcaatgcagaaataatgccaccagggcctctttgtccatgcatactagtactagtgggtttcaattttcaaacaccatcagaaaattcctaaagtttataagagagaaatcatttgcagcaagtatgtatgcataagaacgagtatggacggcaaccgatgagggcaactattcttacaggagtatatatgtactccctcggtgacatgatataagacgttttttgacactgccatggnactcaaaacg

SEQ ID NO: 70111 - DNA, 639 bp, Triticum aestivum
  unsure (1)..(639): unsure at all n locations
  Clone ID: PAT_TA_70111
ttacactaaacactacccacgatacataaacttgccagcagaaccgaaacctaaacaagggaggatgaggcatccttttgtacagacccttggaacatcaagcactcctaagaccagctatcggaccggatcagatcagatcaggcggcggcgaccttgcgggccttcttggcggccggggagcggacggtcttcggcttcgccttggccttggcagcgggcgacttcttggccttggtgaccagcttcttcttctcgggcgccttgcgcttggtgccctccaatggatcctcgttaagggatttagattgtactcattccaattaccagacactaatgcgcccggtattgttatttattgtcactacctccccgtgtcaggattgggtaatttgcgcgcctgctgccttccttggatgtggtagccgtttctcaggctccctctccggaatcgaaccctaattctccgtcacccgtcaccaccatggtaggcccctatcctaccatnnaaagttgatagggcanaaattngaatgatgcntnnccggcacgaangccgngcgatccgncnagttatcatgaatcatnnnatcancnagcanagnccnnntnanncttttatntaataaatgcncccct

SEQ ID NO: 70112 - DNA, 654 bp, Triticum aestivum
  Clone ID: PAT_TA_70112
atcctaattcctgaacaatgttgatttgctagcactatgtgatccagtaagttacctgaacatggatgctattctccaggtgggcataattcagcatcttgtctggatccagtacccctgcggtaggaaacaagcggcggtaacatcgttaccgctgaaagagacgagtgggtgggtgctcgctgcacaatgtgcgcagtcaaaacctcggggaattttatgtcactgccccggtctggatctactaccagttgtcggcgacgaagatttttcttattgctgcgtctaggggctagcctggcattgctggacgtttcctgatcaagaagtaatgtgcagttgcagcaaagtgtagttccgccatgtgcaccaatgccgcatcataccgacaacccgctttcgccattcctctgcgcaactgggagctgctcgtctctcggcgtcgccaatttccattatcaagggagatggatgagacagggagctttcatactaggtgatcactccactaacaactcaccatcctgctttcctctggattggatcggacgggacagaaccgccttttctgcacaactgaatagctctgcacccttaccatgatgagaatagggtcaaggtttgtagcccaaacagggagcttgccaaactcac

SEQ ID NO: 70113 - DNA, 115 bp, Triticum aestivum
  unsure (1)..(115): unsure at all n locations
  Clone ID: PAT_TA_70113
cactagtaaacaactattacacagctcaccaccagaatgtacagctcgtncgggatacatactctctcccncttntaaggtgtgcttctagngcacttgcgcggtcctaaatgcc

SEQ ID NO: 70114 - DNA, 723 bp, Triticum aestivum
  unsure (1)..(723): unsure at all n locations
  Clone ID: PAT_TA_70114
acgtagatattaaaatattntaatagttccagnaaaacagtaaaatatccatagttaagtagtagggtgttacgcctgcgtggctgctataaatggccactcgaacacaaacagagtacaaagtttactaaatagctagctagctccataagtccagtacatgagtgcagtcaagcaccaaccgctttatcacaacttcatgaagctctgcccaaatcacttgcttccctgcttgtaccattaatgtaactctagtaccatcagaaagattgacaattgtgaggctccaatacacaaggcatttagtgcccgtctgctaatgactccgagaacaaaggaacataggaaagataaggcaacctggaattccttggaaggtcacatatgaaatgcagttccccagaatccatttcatatgaatataattttctcagtgatcggcatctcgatataaattctttgattatgaatatcacattgtgttctgggtgggctgagataacaccgtaaaatcgcccagagcttgaatagtctattccaaacagtcgcaagtagctgatattgagcttcagggtccaacaattttcactaatagaatcttcaagaacccagaaagacagttcagaagcaccttgaattgtgagatacaattgtccccgtgatacataggcatcaggacaaccaggagcatcatggtgaagtgggaataggaatgctcctaca

SEQ ID NO: 70115 - DNA, 647 bp, Triticum aestivum
  unsure (1)..(647): unsure at all n locations
  Clone ID: PAT_TA_70115
tggtgcacaggcttcgcctcaaaactgtactgatnaaatntacatgtagtagtccaaaggagacggccatttttagcagcttgttcaacacctgaggtgctacttaatgttgaagaagggcatcccaccgagggactgtcctgtgcgtcacaaacgagaacaaagggattgagaatctacattggtgataaacacaagttgcaagataacagcatgcagctaactgaggtacatagatttcttattttgagaagggctgttcaagaacatagaattcaaaatcaccagtcttgcgaaattacaccccttggctgcaataggcacttatcgggttcccgtactatgtagatctgatctcccacactgtgttctccgtatgtatcctggttccggtgccatgtccacaaggcatatgtcgaattcacaacctctagaataccgtggccgaaactgctttccctgaatgcgctccattccggctgtcgttcccagcaaaacttncccttgncaggaccagaagtgaagttcaaatggcanactccaccaaattcangttggttgtcacctgntgaggggcactttccanggtcatctgcatgatcaatgncnattttctnaatgttaccgncatccccnatcgnnatgta

SEQ ID NO: 70116 - DNA, 507 bp, Triticum aestivum
  unsure (1)..(507): unsure at all n locations
  Clone ID: PAT_TA_70116
gtattnattgctatggtcgtgggtgcacaaaatngcaacacatcccacaaaagataaacagccagtcctagttgaaatttgcatggagcacaggttcttcaaggtccattctgcgccagcccccggccaaagacgacaactgatccaccttatcatacaacccaaggagaccaccggtgtgcacaaagaggacccttcgcccttcccacctgcctggattatctgacatgttcttcaccatacagtatgccaccttcccggtgtagaccggatcgagcacgatgcctgttgccgcagcgacatccttcacaaatctaagttcatcacccgtgctcttggcataacccaagcccttggcatcttcaatgctgactatatcatgtgagtttagaccagactgaagctcatcgatcagaccctgaacacagtcatagaagtatttagggccatagcagacagagaaggcgtggactttggccttcaggccactcagctgcgaccccaaag

SEQ ID NO: 70117 - DNA, 685 bp, Triticum aestivum
  Clone ID: PAT_TA_70117
tctgaaccttttccttattgttggctcgacgcaggggaggtggtctcacatcgcacacattgacacatatatagcgaattccaatcgcaacaagtacacacacatcatctaaaacctggtggtggttctggaaccagaagacatgatgcccactcatttggcaaccactttctgtcaccagcagctctttaacttagcacccatcaaagatgccaggtcttaaaaataaaacaagctcttgattaacagagatcagagaccgacaaccggtagcaatgccacgcactgaccgttggatctttcttcctggcagtagattttgatcctgtcaatgcaaggatagctgcctgagtccgacactgcccttgaagatggcggtacattccatttcgagcttaaaacttagctccttcggcttgggcgagcgatgtagaatgcgacgcagcgggtagaagtcagcagccatgcaccaatcacccaataccagacttgtcaggctgctgaacaccgggcatgtccgcaggcctctctcgagtgtgagctcaggtaatggtgcatgcaactgcaaggttgtggcatgtgagaggccatcaagtagaccatgacccagtattgtgttttccttataatgaaaattgtcagatctcagactaaccaaagctgttactagagaaggcagatccct

SEQ ID NO: 70118 - DNA, 698 bp, Triticum aestivum
  unsure (1)..(698): unsure at all n locations
  Clone ID: PAT_TA_70118
acatatacttcntataagttggttnaacataataccaaagacagacgccatcatggtgaccaaagacacaataaaatacaaggagatatgttgctcaaacatatcaagcgagttgaccacaaatcacaggagatcatgtcttatatctaacataataaaataccaataaatggacatgtcaagcaagacccagagacaattgccgacagcaccagggcaagttttctcaagtcaaccttgagaaaaacatcttcatgctgaatttaatcctgctgtagatagccaatggtctccggttacaccggataactcaagtattggaggaagacctgccagtgcaatacatgacagaatctcttgggtcttctacgatgccaaacagatcagcgctttgaagcgtcttggtattcatgtcaagagcaaggatccatgactttgggtgatataatttctccctggcaattaagtaaacaaaaccatcaccgtccaagctcggagaggggtcagagaccacaaggtgccgtaagtagtcagcatcttcttctgagtcatcagaactctcatctgatggccgcagcagcattccagtagagtgcgaaatcatatcggttttgattgtgacctcagcagctcggaccgtgcattcaggctcgccccaagcttcgtaagaattctccatcgtgggattgatccatgag

SEQ ID NO: 70119 - DNA, 744 bp, Triticum aestivum
  unsure (1)..(744): unsure at all n locations
  Clone ID: PAT_TA_70119
tttgcgatgctaatnatctgtactgatatacaaatgctgctgagcaaatgcgcaatgcaaaaagttagcttagtcatttcctggtctgctgagcaaacggccggtcatggtttccatgccgctatgctgctcactttgtgctaacaggcttgcgaggaaacttctgatctcagatcgccatcggccgtcgcctggacctgtgcagcgtactgcaggttccacagaacctcttcgatggagggccgggtcgaggattcaacggataggcatttgatcgtgatggagaccaccatcgatagtgagtcctgcgatgaggtcccgagcacgaccgggtccagaacatgctcgcgctcttcctggcatgatagagacataaccagttcacttaaaataaaaggatctccttttctatgtaattttgagcccataagtgcttcaagtagaatgcaaccaaaagagcatacatcatcctgcaaagtttccaattcttcagcattattttgtatgtatctctggccttctcctattgcctcatgtttgtatatctcctctgtgattatggacaaaccatagtcgctcagttttccaatatggtgttcatcaagcaaaatattagaagttttcaaccgattatacaaggaaccaggaattattcctgtatgtaagaaatgaacagcccttgcaatgccgatcagcacatgcagtctatcacaccatttcagtgttttctcaggagtagagcca

SEQ ID NO: 70120 - DNA, 652 bp, Triticum aestivum
  Clone ID: PAT_TA_70120
gacttccaaataaaatacacatcacatctgatcaccatgtccatgcatgcaagttcattttgatgaataaactcacatcagataaccaggaattaataagttcggcataatatcccttacctccatcgtcgattcatcgagcgagtcgccatcgtgagcgggcatagagtcaggcacgaaagatacatcactgtcagcatcctcgggcagtgccgcttcaccgtcttcgggcagcaactctacgccgtcatcggtctgggcgtcctggagcagcaactcgacaccgtcatcggtctgggcgtcctggagcagcaactcgacaccgtcgtcggtctgggcgtcctcgggtagcaactctatgccatcgtcggtatgggcgtcctcgagcagcacgtctacgctgtcgccggtctcggcgtcctcaggcaacatgtgtccgccgtcggtatcggcgccctcgggcagcacctctccgccatcggtctcggcgtcgtcgggcagcacctcattgccgtcttgggtctcagcgtcctcgggcagtacctcttcaccggccaagatgggcaagctccctgtactaaggacatgcacaccattgcttgggaagcagttgagcttgttgccgcacatgcatcatgttcctgatcttggg

SEQ ID NO: 70121 - DNA, 674 bp, Triticum aestivum
  Clone ID: PAT_TA_70121
ttactgatgacagcaagatggtgacatcagaacagacacaactacatccaccatggcaagaacgaacactagcacgcacatttccaccgatgagcacatctggctaagacgacgactaacagagcttaggccctctcgccacggatgcggcgggcgagctggatgtccttgggttctaggttagcgcgcagttgggcaccgtaacccggcttccggttcatcccgcatcgccagttctgcttaccaaaaatggcccacttggagcacccgattccatggcacggctcaccgaagcagccgcgccatcctacctatttaaagtttgagaataggtcgaggacgttgcgtccccaatgcctctaatcattggctttacctgatagaactcgtaatgggctccagctatcctgagggaaacttcggagggaaccagctactagatggttcgattagtctttcgcccctatacccaagtcagacgaacgatttgcacgtcagtatcgcttcgagcctccaccagagtttcctctggcttcgccccgctcaggcatagttcaccatctttcgggtcccgacaggcgtgctccaactcgaacccttcacaaaagatcagggtcggccagcggtgcgggcccgtgagggcctccccgctcgtcagcttccttgcgcatccc

SEQ ID NO: 70122 - DNA, 656 bp, Triticum aestivum
  Clone ID: PAT_TA_70122
tactacattatataggctttgatctacacttatctgctgaagttacaaaatacggaatactggttatgatcataggttgggttcctgcattgctgctcctctagacaatagctaagatgcagattccaagctgagacattcagtatcatggctactgacggctactacgacgatgacgacgaggtctcttcctcggagctgctggactgcgctgctgcactgaactgtggaggaaccgccgcggcctccacccggcgcgaggtgctgaagcccactggcgccttccgttcgttcatcctgctgacgtccttgcagacgcggtcgagaacggcgaggaagtcgcgcaccaccatgaagatcctcagtgggtggccttcctccttggcagagttgccgtggaagaactcggtcgtctccctgacgagggagagggcgagtccctcctgagcctgcaccgccgtgatctcggcttcggccttctgcaggaactccccgatggaggcgcggaacctcttgcagcgctcatccgaaccgagctgctggttcagctgcaggacgtcgctgatcttgctcacaccggctgagagcttcgagacgcagctggccagcgagtcggagtccattcctgccgccttcttgacgttgctgagctcacc

SEQ ID NO: 70123 - DNA, 717 bp, Triticum aestivum
  unsure (1)..(717): unsure at all n locations
  Clone ID: PAT_TA_70123
gactgctaaaataatttntttaagttttctacatacaattctaactgattagtattttttttctcccgttgcaacgcacgggcatatgtgctagtactatataagtatatataaacaaaagctatatcatacaataattaacatgcttgtatttcaccttacatgaagcccacatatcctgatgcttgtggcgatagctatttttttctccttggccatttgttccgctgagcccctcctctttaatacatgcagattgtttatcttcagaatattcatcatgaaaatgtcaagttttgataattgatgatcaaaaggagcaaactcactgaccatcctctgtctggctccttgtcccaatccattttctctgcttccaacttcctgtagtttatgagcttgaggactttataagtcttcgtcctttggatcaattcttgtcaaggactgcaggtgactaatatatcatcgagatttttggtatcctgtgacacttcagaagcaaaaaagttacaaccatttagaaagtacagtgaacccaagaagtcattcttgttgcatctgaggaacaacatgcggttcacagtgatggcagcggccgagccatgttcatagagccaatggcaaccagccgaccactccatgcgccgcacatgatgaaccaggccatcttgcttgcacccctgcgcaaggcgtgatggtgcatcgggtggcggc

SEQ ID NO: 70124 - DNA, 685 bp, Triticum aestivum
  Clone ID: PAT_TA_70124
gttctgcatatagtcatctacatatttgatatagacaattaatgcgcatatatatacaatatacgccacgcgtataggtcgtcagcgtcggtgcctccacaagcccgtgttgatgtcgtcggcatcgctgccactgcagcaccgtgaccatgttgtcgtcatcgttgttggcgccgcagcaccgtgatgatgttgtcgtcatcgttgtcggcgccacagcaccgtcacaatgtcgtcgtggtcgctgcagcagccctgtgtcgatgtcgtcgtcgccgccgctccagccccgtgtcgatgtcgatgtcgacgcacttaattgatgtgaaatggataggaagcatagagcagatcaatggttcaaactttcaaaggcttgaggttggattttctttggtatgcttacgaaaaagagcagaaaaaacaaagtcatgctgcactctagactacatcattttgttctatgttagtgatgtcttgtagacagttagcttatttatataactcaaattcactttatgtatacttagtagattggtgccaaccagctgaacaccatgaggaagagggttacctaaacagacagcaccagtagcaacgaggaataaggaaaccaggaagtaatctctagtttttattttttaagtgagcattttaccacacctcatgtttcccgtgagggagg

SEQ ID NO: 70125 - DNA, 262 bp, Triticum aestivum
  unsure (1)..(262): unsure at all n locations
  Clone ID: PAT_TA_70125
accactcctcccatccaaangcgcnangtntccgtccaccgatataacaagcttccnttcctntgcnactttgacatcaccgaaaagcgacnccatgagagcatatactaccttntgcgccaccttntccgtttcctnttntgtctttgctgctgcttcnatcgnaacagcctttgggccttcacggcctatgttnaanatcgnggccaccacanaatcggacaccatgtcgnttatggaatcanaggaccactgcagngta

SEQ ID NO: 70126 - DNA, 141 bp, Triticum aestivum
  unsure (1)..(141): unsure at all n locations
  Clone ID: PAT_TA_70126
cacaacnatancaggggnatgantgaagaatacaacgcacaacaactacccgnnatngcattanattcactccttggcaggtcttgntgatgagggacttgnggatgtnagggatgacaccaccaccagcgatggtgccnt

SEQ ID NO: 70127 - DNA, 807 bp, Triticum aestivum
  unsure (1)..(807): unsure at all n locations
  Clone ID: PAT_TA_70127
tttgtnttaggcttttacgtggatggaagcagattcctttttctttagaagcaattttgtgttcgtttgaaaacaatctagttgctaccgtggaaaccattttatgtttgagtggaagcatatttaattgttgaccattgatgcaaatttcctttcagtggaagcaaattttctggttgccagaaacaaattcttgcttcattggagatacagagtaaacatttataatgagcacatatttcctaatgaatttgtgttagaccaaaactactttggctactgtttgttgaagcaaaattatattgagtttatggaagcacatatgtgggaaacaaatcatatgaagaaaacaaaagtatcaatcctggaaggtctcatagatggacgcactagatcggaagcaaattggaatcaaactttgattccgtgcagtctgagggcttcacgtttcaggattaacataatcagagtttagcgagagtgtgtgtgtgctaaccagaagcagttataagcagttattaggaagcaatcaaagagccaaccagaagcagttattaggaagcaatcaaagagccaaccagaagcagttattaggaagcaatcaaagaaccatgcacggcctagtactggatccaacggccgtcttacatctcatcctacggcttagcactagtctgataggaagcaaggatcggtagtctgattcctagtgcttccttttaagtaatttgaggtataggtgtgccagttacaaagtagtttttttaactactaaaaagacaacaatcagcactatttaatcattag

SEQ ID NO: 70128 - DNA, 698 bp, Triticum aestivum
  unsure (1)..(698): unsure at all n locations
  Clone ID: PAT_TA_70128
tagaaacctgagtgattccgcagcaacagcctaccaagncatttcccaaggttcaactagaatggtcctagcttggcatgccaacacacattgtagctacacactagatacacgacgactatacgaaactttttcgataatctctgctgcagcagacagtctttagcatgcaacagcggcacaggatacgtgccattgcttcatttcacgatgtcaaagcattcagttatgaggactgaaggccagtttctgcttttgcatccaagacctcactcttggaagcagaccggactagtgaagctgatggcaagggagataacaacttggctgctggaactctcataagatagatgcggttgttctcattcactgccttctccaagttctggttcatatcttgttctagcctggaaactgaatcataaagggaagcgggagctcccctggcagttctcttggcatcaacaactgcattaactccaaactgtagtcgagctatctcctcgccaatttccatcttctcatgcaattcaatagcataccgatagcaagcttctgcattgaattgagcagccttcaactggatgtgagacaaccatgatctttcaaagtggttctgcagtggagggataaccagtgcagcatacgcttcttcatagtacaaggcagcctgcctggccaccttggagcacgccgcc

SEQ ID NO: 70129 - DNA, 740 bp, Triticum aestivum
  unsure (1)..(740): unsure at all n locations
  Clone ID: PAT_TA_70129
gatttgtgacactactgaacagttgcattacatcatatcttatctgatcctaacagaagtacaaacctgtgcaaatttcaaatgaacatactctaagaatatatttgacatccccactgccctgtgacaccgtcatatagaagattaaagaattacagtgtcttagataagcactaagcagtggaaggaagtcaaactaattaataattggatggtttagcagctacctgccatgggaaataaacaaccaacgaaattgcttagtgataggaagatgcggatatctactggcatattccagcgatgattttatctgtttcttcatcagcctcaaaaccatcttttttcatgcgatcaagtaaatctgacactggttgtcctgcatgaacatatgtctgcagtaaaatgtggtaaacatcccttgtcaaaggtactaaattccgtagcaggcttgccatctcctcggctgcttcaacattcttttgctccatgaaatgttccaggctcattagcacatttgttaggtcaggttcccatcgagaagacgcacaagcaagagctttccttgtcatatccaccgccttcgacacctggccgtcctggaaaaatccactagccaaactataccaagtactacggtgaggtgtcctccctttggcgatggcttcatccaggagagcttctgccttctncataagacctttggcacagtaagcatttagcagtaagtttgntaagtg

SEQ ID NO: 70130 - DNA, 380 bp, Triticum aestivum
  unsure (1)..(380): unsure at all n locations
  Clone ID: PAT_TA_70130
cactttaattggttgaacttagtctacaaagctgctggaagtattttgccctcacatgtcccaaaaccaactctgaaaccactgccctggcaataacctgacattacaacattatctccatctttaaggaactttcttttattcccgctaccaagatcaacttctttagttcctttcnagcacaactccagcatgctgccgnaactcgtttcatcctcaccactgatggtgcctgaaccatacaagtccncagtntgtgagttgcaaccgttcactgtgnggtgagccaattgntgcttcatggtccaatacatgttcttgaaatttgaattacacacaacagctggttnattcattccttctccctggattgaaacaga

SEQ ID NO: 70131 - DNA, 554 bp, Triticum aestivum
  unsure (1)..(554): unsure at all n locations
  Clone ID: PAT_TA_70131
aattggagtgatctactttttccatctctaaaaacaaaacaaattgcattcaataaagaagtgaacctcccgtggggatttttttttctctttttctacaaggtgaaccactaaggggctgcactttttttagaactcccaatagggtccagcgagctgcacaattatgtacagtcagctgcgcatcttgttcattcccgagctgcaaaattatgtatagtgagctgcacatctagcagagtatgtgagcatcacatctaaggatgcaccaaccgaccaaaaaaatgcgaacagagttgcaagaatcactgcccgtagttctcctctcaagcaaaaaatcctgccgacgagatgcacggctggaggcacatgggcgtggatccctgatgcggaactgagctgcacgctcctcgaatcaaaaccgcacgctgccgctggcgatgagctgcacagaacctttcaagaacaatgtgaacttctcttcttgagtaaaactgcagccgatgcaaaaaaattcaaacaaaacacatgtgggttgcaccgcggtcatcnat

SEQ ID NO: 70132 - DNA, 508 bp, Triticum aestivum
  unsure (1)..(508): unsure at all n locations
  Clone ID: PAT_TA_70132
tgcttattntatatatatatatatatatatatacaacagtnacacgagaaaaatagctgaccgacagtcagaaccacataaattgacaacctgaaccacgtaaattaactccaatgctcgtgcctaacacaactgctagcaaaggcagcgtcgcgaacgctgcaaatttgatatatatatttatctcctggacangggcaattcctacgaaattcctgcgtttcaaacaggtttaaaacattttttatatggacggtacctgggactaatgacaattgaaccaaggaatggcgaagctgaatagcggncacaatcatcaggttggcggcgtggattttagctcctncagtgccgacttcacctcgtnctgcancaggtcnatccgccgcaggtacacctncagctncagaatnctctgctgnctncacttctccccatncatgggtatcccgagaattgcanacggttgctccggcaccttctctcccaggcccagcggngacggnca

SEQ ID NO: 70133 - DNA, 715 bp, Triticum aestivum
  unsure (1)..(715): unsure at all n locations
  Clone ID: PAT_TA_70133
ttccttaaaanaacaagcgtacagataaattaggcaagcctttgaagcagtaaccaataaaataataagaccacaaaatgatctatagcacgctacaatactaaggtccatcggagttattccaaggacttgccatggcaagagtgaatgtgggagaagcgtgccaaggagcagcatccatgtgacccaaaaacttgcttagagcacggactttatggtacggtgtttcaagtcataatatatagacttgtgcttgatcatcttgaaaggagcctgaccttcgttgcagcatctctccacttccacaccagttaagaaaataaactccccatccatcatatccatcataatttcctcacctgaagagcatggggagtctgggctaaatgtgtgcagaatagtcctaaggagcgtggcaatgcaaaacatgccagagcccaagttaaccagatggtgttcagatatcaccgtcttcttatcctcaaacagatcaagataatcccaagtattctgcagtgttggtggctgctcagcgtccatggcagagaggtccagggcgcataacctgggagagccattgcattctgagaggccaaaccagagtttgagctcagggacatactcagctttgccatagaaggggtagtacccatttgccaacctgtctccatacacgactcgctgtgtcgaangtgtacgtgcctatgccctgatc

SEQ ID NO: 70134 - DNA, 734 bp, Triticum aestivum
  unsure (1)..(734): unsure at all n locations
  Clone ID: PAT_TA_70134
ctttaatnccggtgtgtacaaaactgtctcagacaacaagtttaatgagtctacaaggcaaattctcgagttcagccagtaacacacctctggttgaacccctcggaaactgctgtagagaattcaagattttattgtgcgagggggttgcaatgttatcattcacttcagttttgttactgcggcatgtatggcatctgcaagatgtcatgtaaatgtgatattcttgcctcatgaaggctacttgatcactgttgagcccagtgaaagtaaacatcccaatctgcttaatgatgtgggaccaatctccaggtgtttccctgattttcagcgcattaaaaagctgctccctcatgctaattatcctatcagccatggccttcagctccagagtccattcgtcgaacatagcactgtccttaagtatggtagccacgatagaagcaccatgaagaggagggttcgaatacataggcctaattacaagcttaagttgactttcaaccttaacagctatatcagcactcccacaaacgatgcttaaagcaccaacacgctctccatacaatcccatgttcttggcgtagctttgagccatgagcaattcaccaccatcagcgacgaacatgcgcactgattgggcatctttgtcaaggcttccgcttgcaaatccttgataagcactgtcaaagaatggcagcaatgcttttgatctcataagctgcctgatctgt

SEQ ID NO: 70135 - DNA, 638 bp, Triticum aestivum
  Clone ID: PAT_TA_70135
aaaactagtattacacatccaaaggttcagggccgaataggtacatatcccaaggaccaaaattggagcaagtttgggggtacatatccgttccgttcacataaaacatgccctccaatggatcctcgttaagggatttagattgtactcattccaattaccagacactaatgcgcccggtattgttatttattgtcactacctccccgtgtcaggattgggtaatttgcgcgcctgctgccttccttggatgtggtagccgtttctcaggctccctctccggaatcgaaccctaattctccgtcacccgtcaccaccatggtaggcccctatcctaccatcgaaagttgatagggcagaaatttgaatgatgcgtcgccggcacgaaggccgtgcgatccgtcgagttatcatgaatcatcggatcagcgagcagagcccgcgtcagccttttatctaataaatgcgcccctcccagaagtcggggtttgttgcacgtattagctctagaattactacggttatccgagtagcacgtaccatcaaacaaactataactgatttaatgagccattcgcagtttcacagttcaaattggttcatacttgcacatgcatggcttaatctttgagacaggc

SEQ ID NO: 70136 - DNA, 263 bp, Triticum aestivum
  unsure (1)..(263): unsure at all n locations
  Clone ID: PAT_TA_70136
cacaccgatcgacgccgcataaaactgtgtgccagtgtaagtgattcacggccctttctcttcgaggcaccatgagttctgtggtgtttcaccatcatctcgggtgtcttctaatgggaatttgcgaagctgttagcgctatctatcattgatcatgcagaggtaaccacccccggcgctccgttccaggggatacctggtggcacctttcatgtaccgaangtgattcatggcagcatctcggaggccgaatctgtttggcg

SEQ ID NO: 70137 - DNA, 728 bp, Triticum aestivum
  Clone ID: PAT_TA_70137
ctcttgcgcaaatgtactgtcctgtaaatatcaggcaaaaggggagctacaagcctcattcatacacacttggaaaaccagcgaaaaggagcatgcatcgcgatgtgcggctgttctgggtggagacgagagtttctaaagagcggaaggtttcatttattcaaaacatccagaggagcagctgcccttcgaatgtggatttacgccaggcatgagtaggccaacgccttctcctctgacagctcctgggcggtcgcatccatcttcttcctcgagaactcatcgatcgggagcccttgaacaattgtccattcaccaccactgcacgttactgggaaggagtagataagaccagcaggcacaccgtatgaaccatcagagtacacacccatggaaacaaatgttccctgtgatccacaaactcagcgtgttaaaaggctgcatgtaaataagccaaataccaaaaaggtccaagggcttaaacagacctcagcggttcccagaacccagtcacggatgtgatcacaagctgagctggcagcagagagagcactggagagcttcctcgctttgatgattgcagcaccacgctgctggacagtggcaatgaactccccatttagccattcatcatcttgaacaagttcacgaacaggcttctctccctggggagtcttcacagtggcatggttaacatcaggatactgactggacgagtgattacccca

SEQ ID NO: 70138 - DNA, 440 bp, Triticum aestivum
  unsure (1)..(440): unsure at all n locations
  Clone ID: PAT_TA_70138
tagctttatagattaccttgcttgggcaattacccgaagtagaagcagccgcatgaggctgtacatgattcattgacttgtgcttaagtctgaaatcttgcgtgcaataaaccaattttgtacggaaaccaacgaccactaaaattacagtggatcatagtaatctgcattggcaatccatagggaattccatctagcactatcatgtgtgagcgaccatgaatcaatttttgactggaatcaaatagaggagatggtaaggcaatggggggatatgcacctgctcgtagaaatgcagggtaaaggggaaaatgtgcatagatactactatatttggtatatggataagagtcgcggatgctgctactggatgaggaacctccgctcaacaacacgggcgtccgaagatattgcagcttcagcggacacngcgtagcaca

SEQ ID NO: 70139 - DNA, 604 bp, Triticum aestivum
  Clone ID: PAT_TA_70139
actacgaactaaacaatactccaccaatttccattgagcaatgctaattctaggtaaacagcacccaactacagctgccagagactgaatctaagaggaggtgaacttggtgacggccttggtgccctcggagacggcgtgcttggcgagctccccggggaggacgaggcggacggaggtctggatctcccgggaggtgatggtgggcttcttgttgtagcgggcgagcttggcggcctccccggcgagcttctcgaagatgtcgttgatgaaggagttcatgatggacatggccttggaggagatggttgagactaggacggtatctgatcgtcttcgagcccccaactttcgttcttgattaatgaaaacatccttggcaaatgctttcgcagttgttcgtctttcataaatccaagaatttcacctctgactatgaaatacgaatgcccccgactgtccctattaatcattactccgatcccgaaggccaacacaataggaccggaatcctatgatgttatcccatgctaatgtatccagagcgatggcttgctttgagcactctaatttcttcaaagtaacgatgccggaaacacgaccc

SEQ ID NO: 70140 - DNA, 642 bp, Triticum aestivum
  Clone ID: PAT_TA_70140
aataggagatccaatacatctaaactgcaacccatcgaatcgaaatttacaacattacgggagaactatatgccatcactgaaactagagcgagcctgtgaatccgggaacgacccaaaaattcaataacaatgtccatgtatttttaaccagtcctgaatacaaatatcttttccaatgtgacaatcacctttcgccagatcgattgttcaaagtaggtttacgaaccaaggcggtacatgccgtcagccatgaattgaccgtccatgtagagggcagcggcattctgtgggtggaatccttccatcatgacaaacggcatgtcctcagacggtttccaatgccgtttcctctggttaatgaaccagttgttgatctgtttctggtctagccctgtcgattccgcaagcgcaatcttttctgtctccgaggggtaaggccacttgtagtgcagctcccaccagtgaagtagcttctgcctggcctcctttgggagcttccccttcttcttcttcttggagaactcttgccggaggctgctcaaatagccactgtacttcttcagaagctggtacttgagctccttgtcctcagcgcgtgggtctatctctggcggctcattttcacgcccgctagcgtcca

SEQ ID NO: 70141 - DNA, 184 bp, Triticum aestivum
  unsure (1)..(184): unsure at all n locations
  Clone ID: PAT_TA_70141
tcatctcatctactacaacacagacacacacctaaacgcagagcagcctacctcacctcacccaccccttggtcttgttgctgctccccaccgncgcctgctgctgccgtcgccgtcgaaggccgcgccgggatcgacgccctnttcgacctcacctcgccgccctgcaggctcctcttcctcg

SEQ ID NO: 70142 - DNA, 204 bp, Triticum aestivum
  unsure (1)..(204): unsure at all n locations
  Clone ID: PAT_TA_70142
ttactgctaataaaacaagttacaacaaaatagcatccaatggtttacatctccaagtttctctcccctcgcgcccaagaatttaagccgctctaataaaatcattattgagttacaaaaagcacagnactcgcctaaaggacgcctcatctgaaaactgcctgtccttggccaagacttgggctgctgaggagatcagctgag

SEQ ID NO: 70143 - DNA, 587 bp, Triticum aestivum
  Clone ID: PAT_TA_70143
agttctcaccatacatggacagacgccccaaaagtcggcatataaatcagctacataattctacttaagcagttatatagataatcctatacaaaaggaatggacgactagcctgagtttctgcatcaactgtcaggtgctacaacagacttaacctcttcggtttcatcatcctaggaagagctgccggagtctgactctgaggacgagctaccggactctgaggaagagctgccggagtctgactctgaggaagagctgccggacgcttgaggcttcacgcctgctacaataggcttaacctcttccatttcatcatccgaggaagagctgccggactctgactctgaggaagtcaaggggctgccaggaacgggagctacttctggcttcacaacgctcactgtttcagctttcatgtctacttcagttctagcgcgtgctacttcaggaatttcttcatctgtttcatcatcagaggaagagctactggactcggaggaagcctctggagcgtacatgtcatcgctgtcttcattgtccgtctcctcgaaatacttcacggcgttcctctgccttctcccgcg

SEQ ID NO: 70144 - DNA, 654 bp, Triticum aestivum
  unsure (1)..(654): unsure at all n locations
  Clone ID: PAT_TA_70144
tgttctttcttttctatttgtattgaggttntgctcactcaaatatactcccttcgttccgaaataattgtcgttggaggggttttccgaccaggtgaaaacgagtgaaattaccaaactgcccctcccccacccaccaacttgaaatcgcacgggccgtcgtcttcctccgttgctccttccctccgccaggactccgtcgctcctccccttcgccaggctcctccgtcgtccacatctccggcgcccttccccgccggttgcctgcgccgctccaatcgagagctcgatcccctctggtcgcccttccccgccgcgatcgaaagctccctcgccgcggtccggagctccctcaccggcggccgcctttccccaccggttgcctgctccgccgcagctccgaatccttccccgctggccgcgtatccctcgctggccgtctccctccactccaaccgagagctcgaggtcagccgccgctgctgctcgctgctcctttctgctcctgaatcattgtaaactggaatatctcttcttcctcagggcgagctcctcggactcggactctctgcttaaactggttctgccggcacaatgagatcgagggcataaccttcattaaaatttggacagaagagactagtactcgtgaat

SEQ ID NO: 70145 - DNA, 607 bp, Triticum aestivum
  Clone ID: PAT_TA_70145
tgctgcaaattgaatttacaaacggttgattttaaacccgacaaacaactccacatacacaaataatcaccatcatcattcaagcttacatattacagtcagtcgacggctgactacaccacaccaaacactcacacccacgcaaagacggagctcatgctgcatcagctgaatgcccgctctgacttattttctcatttgctcggaagcaaccagatgaacagtgctttgatggaccgagcaaggatggccaaatcaaatcaaaccaaaaccaaatgagatgaaactgcaaaggggcgtcaccgcaccaaggcaatgccgatgtagagaacaccatagaccaatcaagcaacacagcagaaaagcttcagttacgtaggtccgcatgatgacgtacatgcgttcaggttggacgagcccgaagatcaattcacaggaggggtgaattacctgagtatggtgcctctgggcagatcggttttgtagtacagcgagtggcttggctcgtagagggacgggtgatggtacttattcagcccgtcccactcaaggttatcccaccagtccttctcgcagtccaccttgggcggcttggtgtcgcggccga

SEQ ID NO: 70146 - DNA, 655 bp, Triticum aestivum
  Clone ID: PAT_TA_70146
taggagctgcagtccaaacatagtaaactgtacacgtgaatacttcatcgacgactgagtgcaagactgatctattaaaagaagaaaatcacagctcctccaataaagtaacatgctcttttgtcactgcattcctcatgtgatacacagtccccctccgatgattgaacctgaagccccaaatgcttacagaaatatggtaccttggaatgacagcaatgcatgagcaacaatagttagcaaacaaaggaagaagctggtaacaataggcagcacagaacactcgacaccataaggaaaccttgctctttattacagatagtgttctgtgtgacctatgcaccttatcctctcatgagcattttgtcagacataatatctcatgatcatttcagcaaaaatctttctgctcgcctccatccatacttgagtagaggaatgggcaagccagcaagagagacgagcgtagaagatgacgcccctcgacaatccactatcagcaaccaatccatgaataaatacaccgggcgatccagaagacgccgacgagggaaacgacgccccatagcaggccgcaggcgagccccaccgcctgccggatccggtgcactgcatccagcagaatcgcatgacggcgaatcggaatcccatggag

SEQ ID NO: 70147 - DNA, 680 bp, Triticum aestivum
  Clone ID: PAT_TA_70147
aacttctacttttatttcttgaggtattgcgtggtatatacactcgagcagtcgacctatcaaaacgacttgtatttatttcttgatgtatatatatacggtacccgggagcaagtgactagaggttggacgagcggtcggcatactcctggaccatcgccacgaagagggattccggttgttcgagcaacctcgatggcgcatcgaattccttcaccagacctgcgtccagcaccaaaactctatcacagtccatgactgtcggtatcctgtgtgcgatgctgataattgtacatgatgagaattgttctcgcgtgatcttctgaatcgtggcgtcggtttgagaatcgaccgaagcagttgcctcgtccataaacaatatttggttctgcttcaggatcacccggccaaggcatagaagctgtctttggcctacactccagttctccccgctatcggccactagggcatcgagcttttcagcttttgaagctaccacatctttcagttggcaacgctccagagccagccatatttcagcgtctgaatactgcccaactggatcaatgttacttcgaatcgtcccttcaaagagaactggctcctggggaattatgccgaaacgggacctaagatcatgcagacccaatgcgcataggtcgactccatcaatgatcatc

SEQ ID NO: 70148 - DNA, 116 bp, Triticum aestivum
  unsure (1)..(116): unsure at all n locations
  Clone ID: PAT_TA_70148
acccacaagtcagcacaattcttacaggagcatctgtaaacatgngcactgctaactacacacagnaacaccgncntnaactcatganncanggatgaagcctaagaagaggtgaa

SEQ ID NO: 70149 - DNA, 615 bp, Triticum aestivum
  unsure (1)..(615): unsure at all n locations
  Clone ID: PAT_TA_70149
cctactaacttcnacatacatttgggtaactgtgtcatacatctccatccctatctcgtgccaaacaattttcagtttcaaaattttcacttggcagaagaagtgttgtagcctacagccgacaaaattattttttttcgaaacggatcagccgacaaaattattgatttttccgcattcacttatagttggaccagtactcggagacgagcttaaagaatgacgagtcctcattttccatcagcctcgatggcctgtcgtactctataagcttaccgtaggaaagaaccatgaccatatcactgtctgtgacggtgggaaccctgtgtgctatggtgatcaccgtgcaccctgagaactcctgcttgatgaccctctgcaggatggcgtcagtggccgagtcgatcgacgccgtcgcctcgtcgaggaccaggatcctgttcctgctgaggaggacgcgcgcgaggcagaagagctgccgttgccccgcgctccagttctctccgtcatcgctcactggtgcctcaagaagttcaggaaggacactgatcgtcttcttcaactggcacttatccaatgcctcccagatatcctgatctgtatacaggcccagag

SEQ ID NO: 70150 - DNA, 664 bp, Triticum aestivum
  unsure (1)..(664): unsure at all n locations
  Clone ID: PAT_TA_70150
gccttcggcgccgtgggttgttttaccccgancccccacccgctccgaggaggggaggtggtcgaggcattggccgagcgacggacggtgccgtcgccgacggattggatgacgcgtgcgcagtctgttttggtcagggtcacgacaatgatccttccgcaggttcacctacggaaaccttgttacgacttctccttcctctaaatgataaggttcaatggacttctcgcgacgtcgggggcggcgaaccgcccccgtcgccgcgatccgaacacttcaccggaccattcaatcggtaggagcgacgggcggtgtgtacaaagggcagggacgtagtcaacgcgagctgatgactcgcgcttactaggcattcctcgttgaagaccaacaattgcaatgatctatccccatcacgatgaaatttcccaagattacccgggcctgtcggccaaggctatatactcgttgaatacatcagtgtagcgcgcgtgcggcccagaacatctaagggcatcacagacctgttattgcctcaaacttccgtcgcctaaacggcgatagtccctctaagaagctagctgcggagggatggctccgcatagctagttagcaggctgagggtctcgttcgttaacggaattaaccagacaaatcgctccaccaa

SEQ ID NO: 70151 - DNA, 179 bp, Triticum aestivum
  unsure (1)..(179): unsure at all n locations
  Clone ID: PAT_TA_70151
ccgacattnanaacggaaaaaaatagcatctagctatcatcacctancagcnccnngngcactcnancgacntanngagcgatntanggcatatcccnggnaanaangggggaagcccgnttaggcggcctcntaatcntcctgctcatcctcntagncctcttcctcntcnaccgnng

SEQ ID NO: 70152 - DNA, 742 bp, Triticum aestivum
  Clone ID: PAT_TA_70152
acttattgcgatatttataagttaaccgacttcttatgtactataaatacagaccttttttagcaaaaatacagaccgtatgctagcaatgaaagagcaacagcttcagaaagaacactcctgtgttcagcctcccttctctatctccagactctccacccttggtctgattctaataaaacagacttacttttcttttacagctgtaatgtaaagcaaacaactgctcacagaaaagcgaaagcagcacccaggaaacttcatttgtaccagattatacgcttgccatatagcagatcattacagtattatctactccctccgtcccaaattaagtgtcgccgatttagtaccggtgggagtagatcccaaaaaatgcatcacaagcatgtcagcgtgaacataggatacagcatgcctcagcacacagatgttgtgtatgtcccatagaatccctgggtggttaagctagtgtcctagaactggctaagcaacaaacctcgtgaaactgatcctacctagggtcaacatgctgctatctcgaggaaaaatctggcgtcactgtcttagccagatgaacggttgtgcctcacacaaacaaggtcatctaacttgtttccgtccatcttgtatagagatacgccacccatttgggcatggtgttcctgagcctcgcttctcaggctctcaagtgggagcaactcccacctgctgtagtttgaattccttccgcgtttcgctc

SEQ ID NO: 70153 - DNA, 626 bp, Triticum aestivum
  Clone ID: PAT_TA_70153
tcatactctgggtcaaactcgtgtctctttgcattgtacccactcaattcagttaaagaaggcccctcatctgcagaatatctgggttttttcacgccaatacttctatccatatgaccatcttcgactttagatagattagcactatctttaaaatgcccaacagttgaagctttcttatttgcaccaccaggtatgtgcgaaggtgatcgactggctggaccttctccaagtgcatcttccatcttgatcctggagggagaaaatggtgactctgccttaggtgtcaaatcccctgataacagtggaattccttttttactctcaccctgtactttagccatggcaagaagttccttcctattcttgccattaacatgagacatgtccggaaggggataacaaggtgagttcatatatgcagtagtataatgctcgatgcactgtgccttgctcttggtaccaacatgctccgcaacttcagcccagtttcccagaccatacatttcaattccctctagaagaaggatttcctcatccgcattccaatctggacaaatgagtggaaaagataggttgtccatgaccctgtaggggtggttgctccggtgcggagtgacctcggc

SEQ ID NO: 70154 - DNA, 635 bp, Triticum aestivum
  unsure (1)..(635): unsure at all n locations
  Clone ID: PAT_TA_70154
gataacaaaggataatatgatncagcccgatgaccagggtttaaaatcttttgacaacatacattcctaaatttttgtgaatatccaacaatggcaaatattgacaaaagattgctaataacctaatggtgtttgaaaactctcagcatcatcctgcaacttgctggatcagatatacaccctctctatctatttttcagaaaattctcctataatctagtcgtagcaaagataagaggtctaaagacttgtagaaccaaaattcagaggcagtactgaacgaatatgaatgaaccaacagcaactccactacaaacttcagatctaaagagtaccttaaattgaacccgctgggcactggaattataaaacacaggtgccaaacattttacagaaaagaaaattgtgggcggaatccttccgggttagggccggctattaggctgtgtggcgagcggtctcgaggggaggggaggcaggatagcgtgcaacttatgagttgattagtctcaggtttatgttttgtgaaatttgatctatggactgaacaagtgcaataggttttgaaattttcttgaatcactagttcaaaactatttcaaaagagagtttaaagaaatgaggttaaaagagta

SEQ ID NO: 70155 - DNA, 105 bp, Triticum aestivum
  unsure (1)..(105): unsure at all n locations
  Clone ID: PAT_TA_70155
attacatgttgcccagntgctttccctnaataacaagttaccgaaagctagccccatcacaaattcagacancctattcnggttgtgataatngcaacacatnac

SEQ ID NO: 70156 - DNA, 107 bp, Triticum aestivum
  unsure (1)..(107): unsure at all n locations
  Clone ID: PAT_TA_70156
gcatgcgtgcgtgtntccatnatggtcngcctaggaccgctccaccacagccttgagtgcatctccggctgtcaccctcacnncctnntgccgaattnctgcagccc

SEQ ID NO: 70157 - DNA, 556 bp, Triticum aestivum
  Clone ID: PAT_TA_70157
ggtttgcatctttcgccttccacagaaatacagatacaatatcggccttcctcatcgagatctgatgaaagggccactacactacagcttgcaactcgagaccaggcaacacgacacggttcctcggcgcaggctaggctatgggggcggctactccttggcggcgaccttcttcttgggggacttggtggccgtcttcttcttgggcgacttggcctccttctcggcggcggcgggggacttcttggggagcagcacagagttgatgttggggatcacgccgccgtgggcgatggtcacgccggcgagcagcctgccgagctcctggtcgttgcggacggcgaggagaaggtggcgcgggatgatgcgggtcttcttgttgtccttgaggtagcggccgatgcggccgacggggaactggagcccggccttcacggagcgggtcaccgccttcttcctgtcgccgcccttccttccggccatcttgcttgcttgctgcttctccggcgatgagggctctcgaggtgtggtgttggcggcggttgcgctagatcgc

SEQ ID NO: 70158 - DNA, 180 bp, Triticum aestivum
  unsure (1)..(180): unsure at all n locations
  Clone ID: PAT_TA_70158
ttcatactaactgtcacangncagcgaaacngntacactggaagggaaattcaacgaccaatacccatangcacacaacncccaagaacaggcaagaacggaatggccanttcncccccaaaaccaccatgaccagcaggggcnggcancaacaaaccaacaacgctcnanngaacacaa

SEQ ID NO: 70159 - DNA, 562 bp, Triticum aestivum
  Clone ID: PAT_TA_70159
aagataatgaaaagttacaagacgacatggtccgaacacctgactattacagagtaccatcgatcgacaaagaagacaggaacagactatctaagcggaggtgaacttggtgacggccttggtgccctcggagacggcgtgcttggcgagctcgccggggaggacgaggcggacggaggtctggatctcccgggaggtgatggtgggcttcttgttgtagcgggcgagcttggcggactcgccggcgagcttctcgaagatgtcgttgatgaaggagttcatgatggacatggccttggaggagatgccgatgtcggggtgcacctgcttcagcaccttgaagatgtagatcttgtacgtctccacgctcttcttcgacttcttcttccccttcttctcgccgccctccttggacgccggcggccgcttctcggccttggtcttcttcgccgccgtcgtcttctcggccttctccgccaccggcttcttctccgccttgggggccatggatgccgcggctgctgctgctgcttcgacgaggagaggtgtggtgtttcgctgc

SEQ ID NO: 70160 - DNA, 661 bp, Triticum aestivum
  Clone ID: PAT_TA_70160
gaggtcctggtcctgtagaaacttaaacacaggggcagtcaggcaagcacaagatgcagaaccagcccccaacaacgatgtatgcacggagcaaggacaaaacgagcttgatccgacacaacaacgtgagaacacatgagaaacaggatgagcagcacggttaggaagatcttccggcagaggaatcggtcgcatcggctccacatcgacgaaccacttgagaccgggacctgtgcggtacggcgctagggtgcccgcaagtcggcatgcgacggcgagtcgccgccagatcgcgtcggggaaggaagcaggcatgccagcatcttcttcatcattggccctgatggggtggccgtgtgagaaggcaagctggcatcctccctgacaacgcctggcaagccagagccatcttcagtttgcggtaccgcgtcccctgatggagatgatgatgttgctgctgctgttccagcgaccttcgtactgaattcctgaaccaccttcctctgggaacgggtcagcagcactctagcccttttagatctcacatgctcaaatgctgtggtaggtgtcatattcttgtacttcacctgataaaaatcaagcataaaagattccactgaagcacaatacaaaattaattccaaataagtggtatgcaata

SEQ ID NO: 70161 - DNA, 686 bp, Triticum aestivum
  unsure (1)..(686): unsure at all n locations
  Clone ID: PAT_TA_70161
agtttcgcagcgcccttcgngatacagatgaggcagtgcaaagttgatgctactagtttgtcattacaaacatgtagaacaaaaaacaataatataactctcagtaaaaaaatgcaagtaaaacgtacatacagccagatcatggatacgttcctcctcaggtcttttctgcaataaaactctctcaaacagaactgctgatggttgatagctggccgaaggatactgattcattgaagttgcagttggactatatggaacaatttgactgttttgatctctagcatgcattgtctcatttacttcatcaatttcttcggttacctctcatgagagaaccagcctgttctgatggtatcagctgtttatttttctcaggtgtgagctgtttgtttttctcaggcgtcagttatttgtgtgctcctgtgctttcatcatcatcatccgaatgaagaattattatgtcactctttttctgttctctttgctcgatagaattggccatattagttttaacactcggcccataactcagagcgggctcgggcagagtagaaagcaaagttaacaattggaccttctgaggatacaagctgtcccactcctcggtaacactgccacatccccaactgcgaatcgtatttgcattttgcagtaagtgaaagattattgatggggtcggaagg

SEQ ID NO: 70162 - DNA, 594 bp, Triticum aestivum
  Clone ID: PAT_TA_70162
caaattaaacaacatagcacatggttcatactgcagcagcaagaattggaggttcattacaagatactccattcacccaattacacgcgccaacgacatggggaaactatcaagctgactgacaaaagcgaaaaacaatatgagaaatcaagcaagcaccactgaaccaaaagagctactaaatagtgacataattcatcacaagacccctttcgcctccaagcttgtcatctttcttgttgatgagagtggcgtcctaacctgagcatattcaaccataccttgtcaatgtgctgcgtcacagggagtgggcgtcaccctttcttgtggattgtagaaactcatgtatggaatcaaagcacggaaaatttctctcttccatatcttcttccatcgctgcgacttgacattaatctcgtagatgcccagatctgtggtcacgaaaacggtatcactgccctccactgatccaaccagtataaggtaaatttcctcgggattttggatgggtagaaggctgctgagattggtaattctacattgactccatgacgcaactctgttggaatccatcagtcttgaccatatgtagag

SEQ ID NO: 70163 - DNA, 641 bp, Triticum aestivum
  unsure (1)..(641): unsure at all n locations
  Clone ID: PAT_TA_70163
anggggtgagaaccttgtttgcaaacgatcctttgttgccacagttatcaactaaatactgattcagagatcacgaggaatgaggacagcgaacaactttaaaagagagccttgttacataaagaggaaactcacctaagtcatacatcagataatcatatttctatacgccagtaaatccatggaagcagataacataataaccaggtgatgcgaggcttggcatagaggaggtcataggcgttgaggccaccaagcccaatcttgactgctgctcctctctttcttcctctactatttttttctggaggggctttcttcctgtactgattcgctcaacgccatgctttcctgatcatcctcttcctcttatcaccagctaggcatttaactaatcagggtaaatgctgaaaggtacattcgacaaaccatgtcaatgtgatctacatggatcgattgatcaaatagtcaaaaactaagaaatctaaatctgaactaaccaaaaaaagcaaacaatcttcaggctacgtaactgtacccacatgtctgctccaaggaattggttatggaaagaaaagggagtacaatggagttgggttgatgcctaatgacggaccagttgttcctgctacgccagcttc

SEQ ID NO: 70164 - DNA, 674 bp, Triticum aestivum
  unsure (1)..(674): unsure at all n locations
  Clone ID: PAT_TA_70164
tattataatgtaacagaaagaatncatctgtagtgtacaaaataatacaaacaacagttaccacttgccttggggctggttcagttgctctacatgctacgatttccagtacatgagattacatatgtgctcaaaattacatttggaagcacatgtataacaaattaacaacagatcaaggctcatttgctctacatgctactgatttcccagagcataattctactcatttgctctacatgctactgaatctcgtcagaatcgatgaaatttcgggctggtccttgggtaaaaaaacagccaatcagcattatctagttagctctgcatctgctgctaagtacaaacaacagcataaacatgtcaccagaacatttgagcttgtgcaatgacatgcctatcatggcacttccctcggtgcgatgcggtttgcatcagtggctcaaagcccagaactacagcatgcagtcctcgatgatctcccattagaacactgcatgtccattacttcttcctgatgatagtaggcacaccataacaaacaggagatgcaccgatcataagaggaagcctgcaagcacgcctagcttcacttatatgtgaagctattcgcctgtgcccgcagttacagcagctactactgccgcccatctctactgtctgttgttgcttcc

SEQ ID NO: 70165 - DNA, 703 bp, Triticum aestivum
  Clone ID: PAT_TA_70165
gaagtacaccttatatgctaaacagaaatacagttcgctcgctcgacatgatcagggcgaattcgacacgagaaccactggtcaaacatggtagctcgcacgattcacacttaaactgcataacagataagaaaccaacttatgaacctgaagtgcaaattctctagccacattatcatgatgaactgaacgagggcaaccgcaactgatcacgattgacttgcaccacttcacgcttaaaactcctcaacagagacaaaatacaacctggtattagtagcttggaagaagccaacggcagcagactagagatgacgggtttgcccattttgcaattcatcaccattgagccgcacatcagagatcagtgggtcttcgctagcgccaacaatatgccacgatctggagtgtagaagctcatgtagggtaggacgcctaaagtactgtgcgggctcatcaacctttctgactcgccctgacttgagctctagagtgaataagccagcatctgtgtttatgaagatgacacccacaccctctgcggaaccaaccacaaatggttggtaatctggatccacgacgggcacaattgtctccagcttcgatgttcctgcattttacccattcagcagctgcttctgaattcaccttccttgaccacagataaagactagaacttctcagtgcaggcaaaccccagcga

SEQ ID NO: 70166 - DNA, 663 bp, Triticum aestivum
  Clone ID: PAT_TA_70166
tctcgaactaggctttcgccccgctttataaataaagccaacctcctacaaccaagtcccaggaccaatagtagaaacagacggctggggccgcagcacaagcacgcccaagaaacgaagaagaaataaaagaggccacctagtggcaaactccgaagcaagcccaaggagcagaaagatgttgcgccgctgccactagcgcatccaacatcattccaagcaggtcgcagacccgatgtctagcaagcaggtgccagtactgtaaaaaagtaagaaatttgaaaaacgagtcagaagtccgtcgtggaaagatctgctcaattaccattttgttgagagttgtccaaagagtccacatcaatgccacaaagatacaccaaaaaaggcggcgcttgtgacccagctgggtcaccctgccttgtaggaactcggccaggtctccggcctcccaatcgggcccgagtgcctcccgaataaagctccatagagctcgtgccgcggaacaagaaaacaagatgtgagtgcccgtctctagaacactacagagggggcacatgccatcgcccggactgctgcgcttaaggacctcagtccttgagggcaagcggttccggagcagctgctagacgaatatatttattttaagcggcacaggggccttcc

SEQ ID NO: 70167 - DNA, 700 bp, Triticum aestivum
  Clone ID: PAT_TA_70167
gttggggaagaacacaaaataacagatgaaacaagatacaataggcataacttaactcagtaaaagcccagtattatccgataatacagcgaaagcaagatgcttatcacgacaaatgactacacaatcaaagcatacggacagtacatattttacatgtcacatgatgcacacaataaacagacaactatggcaagtacctccaatgggctgggcggtctttcgagaccagaagaaccctcgatgatgagtaatcaaatgtagggcagtacaaatcatcagagccaataacctctcttgctccaatggtgtttccacggtcaaagctgtaagtttgttggacgccttcttcattgaaggtgtcaaaagcgaacaagcccatacagcatgaagccaagacaacattggaattgccccacacttgggttattgaagagtgatggaagtgggcattgaactccggtaattcataggttgccacaagcctcccctttttcagtgaatactgctgaactcgtgatttcggccccccttttatttgcaacctgccttctgtgctaccaataaatactgagtctccgcgtgagaagaccgagttcgccgttccaccgtttcttgccattttaagaccgatgccagaaggtacacggaagtcaaatacattaacactttcttgtgtagtgaaaacaccatcatttcc

SEQ ID NO: 70168 - DNA, 610 bp, Triticum aestivum
  Clone ID: PAT_TA_70168
attattgaacttaatgtttaatggtttctatacaatttagtataaggagggaattcatctcaaaataggtataatgtattcatcaatcaacatactcctcaaacagagaaaccatgaatcacatgatcagctaaagttggaatacattcttacaatcacctcaacagatagtgtacagagagtgatgcaagggctttcaatcatctttctgatgcagggcacgaggactattaccattaagtgccgcatgatacgcacgcttttcagccagcccaagattagacagaactaaattaccctcagtcgcaagcaattttctgacgttgttggcatagactctaggatcctgcttttcttgctcagaaggatagtatacaggcaagcgaaccacctctatgtaatttgcaaattgacagaggagcaaaaacacatgacgtgccccatccatggagtcccaggctggactaaatctcctgcaaggatatctcaaaattacaggttgcaaatggtgcccttgcaagaaaggctcctgtcttaaatgggagaaggtaatccccattcgtagtagtaccctcaggaaagagtaagatcataggggaattctcgtctt

SEQ ID NO: 70169 - DNA, 697 bp, Triticum aestivum
  Clone ID: PAT_TA_70169
tctttggtgacattcatgtactcgcttttacagcatcacgttctatacatgcatcgatcaaaacttgtgcggttgcagatcagccaccaaagtgaagaattctctaacctccttttggttcttagatccaaaaaaacaatttcttctagtatatgtacccttttttctgcttggcctagagttccttctagtatctgtaccaaagtgaagaacccttttttctagtatttgtaccctttggagtcaatgaatgagaaaaaggcaaaatcactactcgctcatagctcctgaatcatgatcttctttttgtctcttcgtgggacgagagtcgtcacgttctcctcggtcagcagatgcaagattgtgcagtaaggaggcgacttcactagctccctcgagcttgtaccgtgctagagaacattccctcccaacagtgcacgagaagtacttgtcacgtttcaggttaaacttgatgttcatgatatctgcttgccacacctttgcttttctttccgattcaggttcaacatcaaattggggtaaggtatagacgtcttcatccttcgcaaggaagtggccaatgcacaagacataatcaattggagtggttatgattttcctgtgacctaactcttgcataattttatcgatggcattaccccttggtgactcccacagggcgcacttcaattgaccg

SEQ ID NO: 70170 - DNA, 462 bp, Triticum aestivum
  unsure (1)..(462): unsure at all n locations
  Clone ID: PAT_TA_70170
gaataaatcgntggaaatttggctnaagcttgaaggttcagntcttttctgctagcagctttgcctgcagctgatgtgcttgntgctacttgcctgcccgccaaaccagtagccacatgccaagatatttggctgccgcccaccaaaccgtcagctgcacaggtgtgctagcttgccagtgcatcggttcccctgtctttcattggccttccttcaagatgatgcggtcggggctgcgtcattgaacggcctangcaccgnggtggtggagcccaaccagggatgaggatgtgcggtggctgcggagccggaggaggcgaagggcgggagacaccgncgtgggttggcggcacgggcaccttgctggaggcctgcnttccatggctgaggagaccaggcggcggcacantgatggctcangttgtggcgtccancgagaatggatccggggaggaacagggc

SEQ ID NO: 70171 - DNA, 420 bp, Triticum aestivum
  Clone ID: PAT_TA_70171
atatatcaacaccaacaaacagaagcaccagacacacacccggatcacaggacaagaacagctactacccggtactgccggcgaaccaagacctaggccctctccccacggatgcggcgggcgagctggatgtccttgggcatgatggtgacgcgcttggcgtggatggcgcacaggttggtgtcctcgaagagcccgacgaggtacgcctcggcggcctcctgcagggcggagacggcggaggactggaagcggaggtcggtcttgaagtcctgggcgatctcccggacgaggcgctggaaggggagcttgcggatgagcagctccgtgctcttctggtacttgcggatttcgcggagggcgacggtgccggggcggaagcggtggggcttcttcacgccgccggtggccggggccgac

SEQ ID NO: 70172 - DNA, 726 bp, Triticum aestivum
  unsure (1)..(726): unsure at all n locations
  Clone ID: PAT_TA_70172
ttagtactcgtgagnggggtgttgaagtgtatatgtggattatctagccctttccatcagttcggacttttggttgcgttcactaatgcatgaagcttaacactggcaacgggcgccggctggtcctatgtgtaatgccccggccacaaccaccggttcccaaccgttacacctagcggtatcgatctagactggcggcacaaaccaacactagtctttcctgcgcattttgtcctcactcatgcgcaccccgggttaacttccgggtcggtcacccatccttaaattgctccaagccaagcacgcttaactttgaggttccttgcagatgggctcctggaaaataaggaattccttgttgatatgagtagtctatcgttcctattaagccaagatgtcacactgcggcttgctggtgcggaacggggctggcaggattggctacgcaaggcaggtgctggctttggtactcgtcgaccggacgggtcagggatccaggcgcagctctgctcagatctggcgtcgatggtgagttcagacggctcgtggggtattggcgacgtgagcgtcgcctcttgcaggcaggtccttctgcttggggagtgccctcggtcgtgccaggtgggtgcccaaggcttggcttcgccttcttcctcgctgctcgaggagtggcggatgccggttgttcagggcacagtggtggctgctactgagcagcatggtggc

SEQ ID NO: 70173 - DNA, 462 bp, Triticum aestivum
  Clone ID: PAT_TA_70173
agtgagtagacaattttacagatcatcacaaggatgtggcaacactagacatacaagcaagggaacacaacctaacacacttagatcaaggctcagtcaaaaggatcagccactgacaaatcatgagtacgtacatggcgagtgaatttattaacttttacttcaatgcgtgcatcttcagaagctctattcaccaactgtagctgcctacgtagataacacatccagtcgtcgatgttgcagttggatttgtagttgtaacggcccccgatttccattttccttagcactttcgcgttcgaaagaaagaacttggcaaagtcaatatatagcctatgaccaccacagtaattcttcaacaccacttcttttagatggagttcaaggcattcaattggatcaagctgatcgtacttccccgcaatattcatatcctttccttcactaaaaatgacatagagc

SEQ ID NO: 70174 - DNA, 240 bp, Triticum aestivum
  unsure (1)..(240): unsure at all n locations
  Clone ID: PAT_TA_70174
tnttgtatctggntacacggtgcattgcattaacattatggttctgatcaaaatatacatacagagggatgacatgcaatcaacagggaatggcatgcaatctctgattacaagtgggattcttggtagcaatacgtagatagatgcatacatatcaacacgcacttcgagcgcacactacacaccacagcttgaagcgggtaaaaatatatacagcctacactgaacccatatataggt

SEQ ID NO: 70175 - DNA, 302 bp, Triticum aestivum
  unsure (1)..(302): unsure at all n locations
  Clone ID: PAT_TA_70175
gcaacttgttnacgaagttcctgcacaaattcctaaacaaatttcctacaccacatagtactaacaacagcagtattggtccttaacccagcctaacaaagttacaggtccagagctgcacttgtgccatatctaacatcactactaccactaccacctccccattgatccacaagagcttgctctattaacttgagcttgacaaacactggaaacaccagctcactgctcctggccagcacaagctgcttccattgctgggatgtagaaagctcatgtagggaaagatttttctgcaaaga

SEQ ID NO: 70176 - DNA, 446 bp, Triticum aestivum
  unsure (1)..(446): unsure at all n locations
  Clone ID: PAT_TA_70176
acaagttacaagaggacagagcacgaacaggaaactacagggtgacatcgatccatcagccgaatcaggcggaagtgaacttggtgacggccttggtgccctcggagacggcgtgcttggcgagctcgccggggaggacgaggcggacggaggnctggatctcccgggacgtgatggngggcttcttgttgtaccgcgccagcttggccgactcgccggccagcttctcgaagatgtcgntgatgaaggagttcatgatggacatggccttggaggagatcccgatgtccgggtgcacctgcttnagcaccttgaagatgtagatcttgtacgtnatncacgctcttcttggacttcttcttncccttcttctcgcccccgccctncttggacgccggcaccttcttctcngccttgggtttcttgcccntgggggtcttctctgc

SEQ ID NO: 70177 - DNA, 557 bp, Triticum aestivum
  Clone ID: PAT_TA_70177
cctaagttgctaattagtacccagtacagcagtgccgttgcttatggaagtcgtagcaagctagcccgttctaggcaaacagtctcagcaaacttggtaaggcaagccctgcttgctcccccagcatacttatgagcgtcaaacaatacggctggcgtgatagcacaatgctgaataaagtctccacacacgtctgcaatgtgctccttcctttgcatgatgatgggctgcgcccccaaacataaaacctagccggtcccattgtatcttcttccttctgaaccttagcacttccttgattgatggaaatgatagagaaaaccgggtggctaggcagtttctgcattggaaggctcagctccaaccttccacttctcaaattctgcaacactcaacagaaatgagcttgcgtttcgatgccccccacctccgaattcctgggagatagaagtcgtgtcttcttgtcccaaacttctcaggctgatttttagcatctcgtcgttattcaacttggggactttatatactacagcgccaatagctctcagattggaatt

SEQ ID NO: 70178 - DNA, 306 bp, Triticum aestivum
  unsure (1)..(306): unsure at all n locations
  Clone ID: PAT_TA_70178
agtggaagctactgtatggacgaactgcagggtgaactaaacagtggagtgcattgaacaactgaatnatgttgaattgtgcacgttcagaccatttcaagccactggagagagagagagagagagagagagagagagagagagagagagagagagatctgnagtgtcnccnccacatgacagaagaatccnctgtctcccgcncttncaanagaggaannggnatctgtattcanangcggnagttcagagnacatttntgntttnctcacagcanacggnggaaagnncaganatattctctgt

SEQ ID NO: 70179 - DNA, 457 bp, Triticum aestivum
  Clone ID: PAT_TA_70179
gcctcgcagttacaagcggtcaagctcgtgggcatgccaattggtaagtaggattgatgcttcacggtacacataaccttcacaactaatgtttgcttacaagatgtgtcatgcagcaagctagtagacgagataataacatgacacaaacactaattgcagaaacacaagagagatcagattaagtagtactactagtagtgggaaagaccgaaataaataaagatacgatgctaccacacaaacacaactaggacaacttgtcttcatctcctagtgtggatccatgcatgacaagttatcttcatgatcactgcggtggcactcgtgcgtcgggcagggtggatacttgtcgagatgttgaggtggggggtggtcgcttgatgtcgatgatgttgactaccacgcgtcttcatccttcatttttctcaatcttttcctcgcttgttcctgtccc

SEQ ID NO: 70180 - DNA, 473 bp, Triticum aestivum
  Clone ID: PAT_TA_70180
ggggttttctgtaaaaaacagttttctagaaattagctaaattcgcagagcctcaaaaaaaatgggccggatctgctggcccaacaacaggaaaaaaaggggtggggcgctaggggtgtgctcacattgggcctaggcccaactggaggtggaggccgggcagctgggcctcgcgcagcggtcaacgggagaaggaggacttgtcgctgtccttgctttggggcggctgggcgctgactcgctgctcctcttgcagcgagacgaagcaggggcgcggcgcttggcgaacggagcttctactccggcgacgaggcgatgcaggggacggagggaggcgcggatcggcgcgaatccgggcggtggaggtacaggaaaggagaggtcgatctgatccggagctacggtcaatgaagagcacgtgatcaaggggatcctgccctcgagctgatgtaggcacggaggacgaggatggc

SEQ ID NO: 70181 - DNA, 385 bp, Triticum aestivum
  unsure (1)..(385): unsure at all n locations
  Clone ID: PAT_TA_70181
ctgttggagctnactgaagatctcttagttggttcctcggcaaggagagatgttttgcattcacttgtttcaccaatctcaaacttatcgccaggacttctattactggaagttaaacggtctgcatctatattatccaaaactgacacaggagatgcaccactcctggcctcctctagcaaacttgagaaccacggaaacatgccctgcctaacatagaagagtatatatgcttcctggtttagtgcacacgtctcagtaatagaatcaacattggagtcattcatcaagtgccaggtgcttggtgaagaacgaatagtgcacacataatggccatagttaggtaagccagaatgctcaacaacaccgtaaagatcatacatta

SEQ ID NO: 70182 - DNA, 348 bp, Triticum aestivum
  Clone ID: PAT_TA_70182
catgtttgcatacatacataggtatacatttgtaggttcacaagtccagtactacatcacatcatacatacatagatatacatttagtactacatcacaacatacatacatacaaatacatttgtaggctcacaagttcagtactacctcacagccaaaagggcaacaatccatcatgcatacatacatacatgggaatatgtcttcgattctagcaatagatccttttagcttgcaaaacacacgtctctaaaattgtgagtgcaagagtagtacacagtaaccattttcctttagtagtgagccaaaaaaaagcaccctcttgacggtgaccgctgaccccaataa

SEQ ID NO: 70183 - DNA, 148 bp, Triticum aestivum
  unsure (1)..(148): unsure at all n locations
  Clone ID: PAT_TA_70183
aagnaatgactcgcatgcatcttccagcagatacagaacctnnncaaancccttagcgcctccatagnaaggatctggaactacagacnccgnatgccgctngcaacaggagcacatcagcnnaaccttcntgggnccactatctgga

SEQ ID NO: 70184 - DNA, 529 bp, Triticum aestivum
  Clone ID: PAT_TA_70184
aacggtaagatagcagcagacacaggaagataaccaaggcggccggacagagatccagcagcccaaagagtccacctaaaaccctcctaaaccaaccacggagatctcatcggacggaccaggggaagacacgacacgacacacgactctcttatttagatcgacgacacgacacgggacacacggggcggcgacgacgacggcgaaaggcgacccgcgcgcgggcggatctagagctggccgcagtcggcgatgaccacctgcttggagcaggtgccgctgcgggagcccaccttctcgatgttcttgacgacgtccatgccctcgacgacctcgccgaagaccacgtgcttgccgtcgagccaattgcaggggacggtgcagatgaagaactgggagccgttggtgttgggccccgcgttggccatggagaggatcccgggcttggtgtgcttgtggacgaacttctcgtcggcgaacttctcgccgtagatggactcgccgccggtgccgttgccccgggtgaagc

SEQ ID NO: 70185 - DNA, 678 bp, Triticum aestivum
  unsure (1)..(678): unsure at all n locations
  Clone ID: PAT_TA_70185
aactgcatctgtccacataacaggcacacattagttataaagttgcctccaacataacccttaacagtccaacttcaaccatcacagcgtagttcagagtttaaatagtccgttacagccaacaaacttaaatgattacacagaaacaacagccccaaaagacaaccatcaaagcatgacactgaaacatcagctccnagcttgcctacatccaaaagcttcttgatatccctggatattcttcacatgccattactataaaacagtagctccaagcttgcatacatccaaaagcttcttgatatcctagttcaaatctacgagtagaggctgttcacttccttggtcttcttcctaactagtcgtccagatctacgagcctccaaattgccaacacttgctgctgtctccttttcagcttgtacttgtgtctcttcttccacttgcatttgtgtctcttgctgatcttgttgatcatcctcatcatcctcactcaccccatcatcatcctcactctcattatcaacatactcattctcttcatcgtcatcctcactctcagtttcgacatactcattctcctcatcatgattcctctttcttttcttcttattaccttttgtaccaacataagaatccttcctgcttgagttgagacgccttattttctcaaaaacc

SEQ ID NO: 70186 - DNA, 677 bp, Triticum aestivum
  unsure (1)..(677): unsure at all n locations
  Clone ID: PAT_TA_70186
gcggcattttattncgcggtcaatgacagcaacctcatgtcctcgtccaatgcccatcttattacacaagctaccaaaatgttaccgcacagtccacaagaaacgacggacgatcaagcactactgcgtctcacgcgtcgtaggtggcctggtaggagaacctgaagaccatgtcgtgcttgtacacctggccgggcctcacgatggacgacgggaagttggggtggttgacggcgtcggggtacgcctgcgtctccaggcacagcgcgccgtactgcccgtacaccttcccggccttccccttctcgttgatgagccagctggcggtgtagaactgcacgccgaagtcgtacatcgtgccggccacgggcgcgacctcgcccgtcggtatcatggacccgtcgacaggggtgtagtgtgaggcgaacatctggagctcgtgcttgaggacgtcgccgctgccgtgaccggccaggttccagtacgcgtggttcgcgaggttcacttggcgtcgccttgttcctcgcagtcacgttcatgcggatactcaggtcgtacgggcgggacagctggtacttcacgtacacgtcgagggcgcctgggaatccttgctctccgtccaagctgtggtagtagaaggtgatgtatgggggagtcaccatggctcacatgctnct

SEQ ID NO: 70187 - DNA, 749 bp, Triticum aestivum
  Clone ID: PAT_TA_70187
catataggcagattacacgacgagacaaaagcagacatacagactacaatatctctagagaattccatatatgcataagactgacaagagtcactacaggtccaaggaacatgcgtacagcacagagtgttacttctggtttgaagcaagtttggcaatgagctcgttcaaaacagagggataggtcgtaattaacggctcccagccatcagtcgccattactttttgcaaacacaagggcgattggacttggataaacttcaagcacgcctccttcaatccgcggcagtggcgctgctcagctagagcaagagtggaggccaccgaggtcacacctatgcgctcagacaatcgcttttcacagataaacttgaggcgctggagatcatatctgtctgctgctacaagcaagtcttgtagccattgcagctccgttgcatcctctgctgcatcctctccttgtccttgttccgcaacttctgccatttcatcctctgctgcttcctcttcttgtccttcttccatggcctctccttcgtcctcctccatgtcgtcctcctccaatagagggagtgagtccgtgtagatgaagctaagcaaagccctgaacacttttgcttccatgtctttgatctggatggcacctgatgcagcagtgccctccttcatggggccaaaggaattgtgccatgaagacttttgatcgggctgcaagcacaaattcggtgtgcagcgaacatctcgccgct

SEQ ID NO: 70188 - DNA, 666 bp, Triticum aestivum
  Clone ID: PAT_TA_70188
ctttaaaggctgcaaggactccaggagcgggaaggggtcaggtctgtgccttgtttgggacaactccatcagtctgagccttcttcaaagttgggcgccgcggccagcatgggtcgaagcgtctcatcgacgccacaatgtctgttcagttcagagacggtgatgtgtcacttgccaccttttcattacagggactacaacaggcttacaccggcctgaaacacttcatacactgaaaactgttggactacaacataggatcatcagcaatcttgctagcagtaatgtgcagttcctcaaaaaaatcctggaagagcttggagtttctgcgcttccatatattccagggtaccctcgatcttgaagtagaggagaggaaagagggagcgtggcggctggggctcgccggaccctaagctggaagggagggtagtggaggcaaccagtcgcgggggaggagaggagtagttgctggcctggatccgcggccaggaggcgcgctcgggcggttgctggctcggatcaattgccgggcggcgctttgggggcggtgggagattgagggaagcccagccgggggcgatgaggggtggtggccgctggatccagcttttgtcgagagctatggaggtgggaaggcgtagccaggggattgggaggtgtgcc

SEQ ID NO: 70189 - DNA, 586 bp, Triticum aestivum
  Clone ID: PAT_TA_70189
atgttacacattctgaggcctgaaattagaattaccaatgatcattgctcaacaagttagcttccagttaatgttttattacactacaagctttgatgaccacccagtagctcaaaatctgttcttgcataaccatactccttggcagtcttgttgcaagagcaacaccaatattgagaaagctgcctaagcaaatcctaccaagaacaaacattggccaagcaacataatcttcagaaaactgcctaagcagatcccaccaagaattgcataggccgatgacatcaaaggctcatcttcctgggcggctgtggctattccaacacactgaagccctcgaaagggatctctccgttgagagcccggacgacatcagggatctcgttttggtgtggctgcacatacacctgcaagaaccgtttcattttagccacgaggaccttgcgcagctgatgattcccctctggcttcccttccttcctcagcagtgtgagcaccgcacacctcctgcgatggctctccaagctccgcaccagcatgctcggattggccacgatatcttccaggctcagacccgcctttccga

SEQ ID NO: 70190 - DNA, 729 bp, Triticum aestivum
  unsure (1)..(729): unsure at all n locations
  Clone ID: PAT_TA_70190
ccgcctatgnaacatcaaggncattacgtgtgtccgtgacaagaaaaatatcactgtagcaacattttctggtctttataccctctcacagcgtgtaaagtacattaatttccaacaacatttcctccagcccgttctcactctaaaactcgagttgcgcatccatcgggaccacactagagaaagaaaattttgagctgggtggaataatttagcaggcaattacaattagcacaataagaaagaaggccggatgaacaccaggcaggctaaaggatctttaagaatatcatccacagtggactatttttctgcttctgtcaagattggatgtgtgtcaacagaacaggcagtcagtgctcaaggctgcttatattgctgcagatatttgtctgaacctaattcctcaagcaatcttgctttgaccaacacactgtcttccagatcttgctggtattcatttaccctgtccgacaactcaggatctcttgaggcaagcatccgaactgccaacaagcctgcattttcagcatttccaattgcaacagtagcaacaggaatacctttcggcatctgcacaatagataggagggaatccattccctgtaatgacttcgtccagatggggactccaattacaggtagagtggtcaatgaagccaccatccctggtaagtgagctgctccgcctgcgcctgcaataatgacctctaagcccctttncttagc

SEQ ID NO: 70191 - DNA, 680 bp, Triticum aestivum
  unsure (1)..(680): unsure at all n locations
  Clone ID: PAT_TA_70191
aatgcttatttatngtttgagacacttctccccagaagtacgctcattgtggcagacgcagcaaaccacctagagctaatagtttattcggagtagcaatagcctggccagctgcttcacagtaaccaaacgacaaacttagtcagaacaaagtccacagacggaacagcgacagccaatcactcgcacagcaccgcgccctcctccagggaatcctcctccgcccgccatgcgaggaggttggcgagcttgccttccttgaccagagggtggctctgcacactctcggcctcgaagcagtggaagacggacctgggcgacccggcagagacagcaacctcttcgttcgaagtcgaagtcacagacctccatctcagggataatgtcagagattccagagagcttggtcatctccttggcacaggaaacgtggccatcagcttgagtcttgaagaagacagaggccttcttcttgtccagcccagtcatgcacatctccagggtgaccatgggctgctcaggttgctcggtggcatagtagatgtgccacttctggccaggcttcgctgggtctccgatcacataagcattgccaccagacttcaggtggccgaagtagcggttcaggacatcaacctcctcagagaagctcctgtggggagcangctgtgcgccgggga

SEQ ID NO: 70192 - DNA, 653 bp, Triticum aestivum
  unsure (1)..(653): unsure at all n locations
  Clone ID: PAT_TA_70192
agcacaattcttacagngnattgtaacatncgtactactgccgactacgtacacgacgcctgccgccatcaactcatgaaacaacaacgaagccagcctaggatgaggtgaacttggtgacggccttggtgccctcggagacggcgtgcttggcgagctcgccggggaggacgaggcggacggaggtctggatctcccgggacgtgatggtgggcttcttgttgtagcgggccagcttggcggactcgccggcgagcttctcgaagatgtcgttgatgaaggagttggaattaccgcggctgctggcaccagacttgccctccaatggatcctcgttaagggatttagattgtactcattccaattaccagacactaatgcgcccggtattgttatttattgtcactacctccccgtgtcaggattgggtaatttgcgcgcctgctgccttccttggatgtggtagccgtttctcaggctccctctccggaatcgaaccctaattctccgtcacccgtcaccaccatggtaggcccctatcctaccatcgaaagttgatagggcagaaatttgaatgatgcgtcnccggcacgaaggccgngcgatccgncnagttatcatgaatcatcggatancnagcanagcccgcntna

SEQ ID NO: 70193 - DNA, 114 bp, Triticum aestivum
  unsure (1)..(114): unsure at all n locations
  Clone ID: PAT_TA_70193
ctatttccaataaggttccaataaattaaatcncacatcctgngcgntnnacagnccaaaatgttttnctccggcnccnttcgctgcgcatnnttnnctctcccagcgggcgag

SEQ ID NO: 70194 - DNA, 717 bp, Triticum aestivum
  Clone ID: PAT_TA_70194
ttcttcttttgaaggcagcacaatacatagcagcttcttctcgcagaaagaagcagcagcggtactccatagctaagcactaagagttaaaaatacagtaagaacgtgggcacaaatataggacacacttatgcacagagagaccggcaggctggtccctggcaattctaggagccgtccaccggcctagctttacagatcagtagtcgtcgagacatcgatcatggtgcttcggttcacgatgatcatccccctgacctccgacgggccgagatggtccgtcaaggccttcttggccgcggcggcggccctgttgccctgagaccgcctaccggcaccaaccgaggtcctcgggctcgacaggcgccccggggagaagctcggcgtggcgtatgccgtcacgaacggtgtgcccgaggcaggcacctgctggtagggtggcaccacggccctgccacaggccatcttcaggtctgcttcacccgttgacagttgctccacatgtctgttcagctcgtcgatgttgagaaggtcgtcgatgcgcgccacgatgttcgaggccaggctctccagaaccctcgagtagctctccaagatcgacttgcccacatccttgttgtactgaattttgctcatgtccaggcttgtctgcgtcagggcagggaacctctgcttcaggcatatcaagaggccctctgctcgctccgcgagcagctc

SEQ ID NO: 70195 - DNA, 188 bp, Triticum aestivum
  unsure (1)..(188): unsure at all n locations
  Clone ID: PAT_TA_70195
aacaggcntcnaacatacaaggttcttacaacacatcaggttgtaaaacaaacaccacanngcaaatgttcaaacagacagataacngataaagccactcgggcagatcataggattgcngcagcatgccttgggcaaagcaccnggcggcaggctntagtnctcgtngccctcgtcaccgnccttac

SEQ ID NO: 70196 - DNA, 721 bp, Triticum aestivum
  unsure (1)..(721): unsure at all n locations
  Clone ID: PAT_TA_70196
gcagcaaagagttctctacagnctcggacaacagnactaataacagcagtctcaaccacctccaacaaccgcagacccaaagtaagcagcagcggtaccaattatccatgtctcctctctcaccctactaaccccattacaaaaattggtgatcttctccgacttgcctgtgcccttgtcctccgccttcacgttcaggataccgttggcgtcaacctcgaaggtgacttcgatctgaggagtgcccctgggagctgggggaatgccagaaaggtcgaacttgccgagaagacggcagtccttggtcatgctgcgctcaccctcaaagacctggatggagacggtggtctgctggtcctggtaggtggtgaaaacctgcgacttcttggtggggatgacggtgttcctggggatcagcttggtcatgactcctccaacagtctcgataccgagggtcaggggcgccacatcgaggaggaggatatccttggtctcgtcaccaccctcgccgctcaagatgcttccctgcactgcagctccgaaggcaacagcctcatcagggttcacacccttgtttggctccttgccgtcaaagtagtccctgaggagctgctggaccttgggaatcctggtgctgccaccaacaagaacaatctcgtggatctgggtcttctcgaggccagcgtcatccatggccttcttcactggtcccatggtcttg

SEQ ID NO: 70197 - DNA, 119 bp, Triticum aestivum
  unsure (1)..(119): unsure at all n locations
  Clone ID: PAT_TA_70197
attgatcaattatngtctaccaagnatgtatattcacaattatagataacaaaattacaaactgnngttgcagatataacaccgccgttacaataaaagaaagattgcaggtgatncag

SEQ ID NO: 70198 - DNA, 239 bp, Triticum aestivum
  unsure (1)..(239): unsure at all n locations
  Clone ID: PAT_TA_70198
taaatatcgggtgtcacaaaacagnaactgtttggtctaccagattggtcagagcgccacagccaaaataaaaacaaaagcagtttttattggctaacaacagctttcgtcccagtgcggtggtgcttccagagaacagagccaggagacantgccatggatcaagtccagctggccgccgaggtggtccggcaactggtggcatcaccatntccatgattctgtttcgntccaaacca

SEQ ID NO: 70199 - DNA, 214 bp, Triticum aestivum
  unsure (1)..(214): unsure at all n locations
  Clone ID: PAT_TA_70199
tggaaaacaacaaggtgatgaaggtcctaggacccgaagatccgaagatcaaaagaaaaagaggaacagccctaatggctgcaacagaacactccaaacaatccacattagacaacgcagctncgactctgacgatgaaccacaaagaaacgaggcnaggttggcgtcacggggatcaccgaacgagccacctaacacncgtnatcgtatacca

SEQ ID NO: 70200 - DNA, 474 bp, Triticum aestivum
  unsure (1)..(474): unsure at all n locations
  Clone ID: PAT_TA_70200
tttttttgcggtagtacaagggcgatagtacatataattaaatnagggcccatactttcaacactaaggaccaaaaggaggaactgtaactgacatgatgcggcgttcatattcattgttcagtgtatgcactaacaaaacattaggtcatgaatcgtctgctgctcgctggttccagataatatgttccggaaagaacacaggcagattcctggtgtggtttcttcgcgaatcatcaaagtgataaatagtaaccttaaaaactttacctgtgttggctccaaatatataatttttcaagagctatgcttctttcgatttatatgccgttgttatattgcttcaagaaccatgattggaataggccagtaccacagcaatagcattaattagcaatactgagatcgataattctgagcacaaaacctttttttcttcttttgctccagccaggcaacaaattctctctgtacc

SEQ ID NO: 70201 - DNA, 169 bp, Triticum aestivum
  unsure (1)..(169): unsure at all n locations
  Clone ID: PAT_TA_70201
ttgcagcgaaacgaaacgataggagttacaactagaagttggatctcactagacaaactacagaaacagacatagccagcaaactggattcacgacagggggggggggggggggggggtcccccccccnnnaanccccccccccccnnaaannagggggnnccccnngg

SEQ ID NO: 70202 - DNA, 628 bp, Triticum aestivum
  Clone ID: PAT_TA_70202
acagctgtttggcacagctagcgcacaaaagatacctagagattacatattcatagggtaaatattctaacatttgtcttgagctgcttgaagcacacaagctggaaacttgccatagtatggcacatagagtagacttcgatataggttaacgaagcttggaatgtttagaatctggcagacttttccagtactgatgctatatgagatgatcttattatcagcaattgtgtcagcaaggataactagctctctctccaggtcaaatgccaggatttcataatcaaagtaccataatccttcattgttagtacggagcattatgttcctcccaaatacattgttcatatttagacgatgcttcaccacccacctatcatatccttccaaactccaaattcggatcatgcaaccatccaattcttgttgtgcatagcataagaccccagatgactgccaaagacgcccgtcaaagcaataaaacctctctggtccatatggaaaccctggcaactgaatggtcctatgattgagctgctgtgtgcatgtatcaggtgcatcgagtgccagaaggtaatgcctccataagtgctccacatacaacaccccatttacaaagagtgaatca

SEQ ID NO: 70203 - DNA, 118 bp, Triticum aestivum
  unsure (1)..(118): unsure at all n locations
  Clone ID: PAT_TA_70203
ttggcgtccccggcggcctnngtcttnttcacacccntgntcttcttcgntcggtncttgcgctccttgatctgcttcctcgacttctcgaccttggttgccaatccattcctganca

SEQ ID NO: 70204 - DNA, 504 bp, Triticum aestivum
  Clone ID: PAT_TA_70204
atgatacattacattatgtagctcatttaaaaatcagggaaagcaatttcgataataacatacatgatagaagagcatcttggtgcagaaactttgctaggcgggctatgtatatgcgatttgtggctactagcagcatgctctttgaggcgatgtacggtgagcaatcgaatgtttgccttgtgtttgaaagcaaaagcatacaccttgccttccttcatgttggagtcctcaaagaactaggtccattttgtggttattgtcgctctgttctaagtcgttgtgatgagacgagcaactgtgtgagggcttccgattccgaacttgatgggcagatctttcagaggacatcctctagctaggtcttgccaatgtcttgctcatatggcagacgtggtatgggatggtagatttcttcacagcaatgagctgctccagtttgttgacgtgctggtttcacctagtttcccaactcacggtgatcatcaaatcctccaatataaa

SEQ ID NO: 70205 - DNA, 561 bp, Triticum aestivum
  Clone ID: PAT_TA_70205
tcctggctgctgagacaagcaggtgtactacatcaatggttttctatagattgaaccataagcacttcctgcgcacacggaccggactgcaagtgcaccaccaggaaattggaacgatatcgtacatatacatgtatatactcccatcgcacaacaaaacgagtgacgtttctcagaagataaccgcattgcaagattacaaatcactggacgtctccctgaagaaaactgcaccgccagactacaaactaaagaaaactaaaaagaaagaattgtaggcactcacgctccattttttgcagggccatgcttgccaacagaaggtaggtgggccgtccccgctgatgccggtgcaagctgctacagctgccacgctggctagctcctcgtcgtcgcctcatcggcatccaccaccaatgttgactgcaatgcccatggagcggactacactgccgatgacagcagagcacgggtccagcgtgtggtaggtgagcgaggtgaaccgcgaggtggggagtagagaaccgccatgcgcaaggaacgaaacctgagggataccag

SEQ ID NO: 70206 - DNA, 772 bp, Triticum aestivum
  unsure (1)..(772): unsure at all n locations
  Clone ID: PAT_TA_70206
caattgcacatagntnaatgatctttgttccacattaaaaacaacaatattaggttcctgtcccacaacagggcctgtctatcaagccatattaaaagcataaacaggtaacacgttgttcttctcttcaacattgcaaaaagtttgtaccgtcatagagctacacctacagtagaaacgtaaatcaggctaaaacagaagcagctccgtttgagaattctgagatgccctgataagagtcgtatgtaagtagcttgactgcaatttaaccaaaacaaaaaaaggaaagcaagaatcttctatgtcacgtttgcctatagttgatatgcccggaatcactcaagctgacaagatcatatgcttgtaatcatttgagccgtcaattagccaaaattctcgacacaacatcaaaatacctctataaaagggaagaaacatgaaaaaatgttatgaacagaatgagaaagatacaaaataaatgtaaactagtgacgaaaatgaagagctacaacaaaaagggaaatcaaaatttctaaacagcattagctactaacagaagaatttgcaaaacttagaagacaactcttgtagtctacattacctatcacaattaaaatataagatttctcaactggataatcaggattgtgctaatgtttactaatcctagaattcatcaattcaagtcctctgtttcagcgagaacatcaaaatcccctttgatnangaccggcacaaatgatggcttatattttaaaaatggtgctgaagc

SEQ ID NO: 70207 - DNA, 131 bp, Triticum aestivum
  unsure (1)..(131): unsure at all n locations
  Clone ID: PAT_TA_70207
cttcattcnnaaagctcacaaaaccaaaccctttanaccttccantctntcnatcanngatgacacgtgcnntnaacgacctntncaaagctttgnaacgcctncttcancgaatgatcgtnantanccca

SEQ ID NO: 70208 - DNA, 747 bp, Triticum aestivum
  unsure (1)..(747): unsure at all n locations
  Clone ID: PAT_TA_70208
gtttggtttctatacagttgttctggcaggagagctttcgcaagcaataacataactgtgctttcttaggagttagtctcataggcagcatatcaaattatcaactagtcaaccaaatccatcgaaaaattgatactttgctgggagcaacttaatatcctccagatgtttccctttccttgaaaagagagacaacatcaatgaggtagttgacgcttcaagtgagatactcttcccatcaactttagacaaataatttccagccttagcaatctcacctttttccaacaacattctgatgatatcatttataagacgggaactgggaacgataccactgttgtccattgatgaaaacatattgtcagcatcttccactgctccgtcttttagaagatttcttatcattactgcataagtagattcattgggcaccaacccactagctggtattgcagcaaacaaatccttagcttcttcttttctttgaaccttgtacattgcattaatcatggtattgagtgtttcaatattgaacttcacattcattgctcgtaatttctggaacagtgcaatcgcttcgtctacacaattagtttgacaaagacctccaagtattatattgtatgtggaaatgcgcactgttgctccactttcaatcatctcatggaacattttcattgcagcaacagttctcccagcacgaaacaacccacccaacatgatgccatatgtaacagtgttang

SEQ ID NO: 70209 - DNA, 346 bp, Triticum aestivum
  unsure (1)..(346): unsure at all n locations
  Clone ID: PAT_TA_70209
cttttctgngggcacctaattaacttggaaaatacaagtatctaatacttcaccatgcctgatacggtctcctccttattgtccattcactactgtnctttgttctttcctttnactaaataaatctctctctcatattaacactncaaaaaaagatcttatatggaagtaagtccgtatacgagaaagaaaaaagaatttcccacccaagctaatgccacctttatttacacttggccgagagccccagcgccgtccctgggcggnacccctcctccgccgccgtcgccgacaggttgtgcagcctggcgaagacggcgaccatgggcgccgngttgtatgtgca

SEQ ID NO: 70210 - DNA, 687 bp, Triticum aestivum
  unsure (1)..(687): unsure at all n locations
  Clone ID: PAT_TA_70210
tattgaccaggtgcgaagcaggttcatacaacacaacaggttgtaaaccaaacaccacacagcaaacattcaattcaaacagacagaaaacagataaagccactcgggcagatcatcaggtcgcaatctcagctgctctagtactcatcaccctcatcaccatcctcaccctcgtcgaactcagcaccaacttcttcatagtccttctccagggcagcgagatcctcacgggcctcagagaactctccctcctccatgccctcacccacgtaccagtggacgaaggcacgcttggcgtacatcaggtcgaacttgtggtcgatgcgggagaagacctcgacaacgctggtggagttggagatcatgcagacggccctctggaccttggcaaggtcgccgcctgggacaacgctgggtggctggtagttgataccacacttgaaaccagtggggcaccagtccacaaactggatggtgtatgttgaggttggtgtatgttgggcgctcaatgtcaagggagcggcggcagatgtcatagatggcctcattgtcaaggaggacagccacatcagtgtgctcaaggagagagtgggtggacaggacactgttgtatggctcgacaacagaggtggagacctgangggatgggtacactgtgaacccaagcttggacttctttccatagtc

SEQ ID NO: 70211 - DNA, 662 bp, Triticum aestivum
  Clone ID: PAT_TA_70211
cgcgccaccggctcgccacccagcttctccctgcccacctcgcctagattctcctccgcccaggatctcctcctccctgcccagcttcctgctcatcaaggaacctcaccgccggccccaggagggcacctctccggccgctggccccagcagcacttcgccagcaaggtcaagctcgcccagaaccacctcccttcttccccgtgtcgccagaaggtccagctcgccgggggccaggggagaagatcaggagctcctcattcgtgaccacctccaggctcggtgctccttgccggcttgtcccctggcaacagtagcagatcctcaactgtagctccttgccttcggcagcagatcctcaacagaagaaacaacaacagatcattggcccttaatagaagcaacagcagcaaatcctcaacattgacagtagcaaatcactggccctcaacagaagcaacaacaacatatcgttcccaattgcaagcatggtagtcccagacctcaatttcactccacccgaagaaggcaacgaagaacctgggggaagaagactcctgtgggagtggtgggcggtgattcaagcgctggtggcgtcgccgtctcatccactgataactccggcggcaacactgctgtagagttgcgaaacgtacatttag

SEQ ID NO: 70212 - DNA, 464 bp, Triticum aestivum
  Clone ID: PAT_TA_70212
ttgcatttgctcttagttgccgcgtccccccttgcttttgttgaccgccccgaaaccaaccgtgttttcgtttcccttttgtccgaccacctaacctctcttgccagctcgcagccccctcacgagcgcgtccgaaactcccccgaacccgaaccggtctgtcgttaccgatggatccggatcatcccctaacgtctataaaacatctccgttttcttatttggacttccctagcctattttttcgtccgtccgattacgatcagagggacgagatagcccctagcctaacccacccgctatatatactagtctaaaccgagaccaaatccctaatttctagggatcctccaagccgccgccgctgtctccattcccctcgagatcctccagatccgatcgagccaaccaccttgctttcagcgccgcccaaccagtttgcgcagccaaccccgaacggcgccc

SEQ ID NO: 70213 - DNA, 550 bp, Triticum aestivum
  Clone ID: PAT_TA_70213
cttacaaaggttgtaacatcgtactgatgccgccatcagttcatgaagcggcgatcaatcctagctgcctaggaggaggtgaacttggtgacggccttggtgccctcggagacggcgtgcttggcgagctccccggggaggacgaggcggacggaggtctggatctcccgggacgtgatggtgggcttcttgttgtagcgggcgagcttggccgactccccggcgagcttctcgaagatgtcgttgatgaaggagttcatgatggacatggccttggaggagatgcccacgtccgggtgcacctgcttcagcaccttgaagatgtagatcttgtacgtctccacgctcttcttcgccttgctgcccttcttcctgccccgctgcttcgcctcgccgccggcctccttggacgccggcgcccgcttctccgccttgggcttcttccccgccgtcgtcttctccgcggccaccgccgcgggcttcttctccgccgccttgggtgccatgggtgctgctgctgctggtggttcgagcgtgtggggagatgggc

SEQ ID NO: 70214 - DNA, 618 bp, Triticum aestivum
  Clone ID: PAT_TA_70214
acaccaattgaaaatatagcagaactacatgcacaagctacctagttcgtctcattttccttgctaaatctttctgagagatacgaaagcagtcttctgttctcaatttgaacaatgctcctctatgtaacctattctgtacactgtttttttatatcggcaagttgatagttgctgaatctaactcctcctggataaactgaaatcaactattcgttgatagcagcagggttggttccagtgtcacccgagaagcttattgcatgtgccaatgccaatagcagcagcaagatgccatgcagcatggatatagggtgtctctgggaagtaatcgtcggcaataaacagcgcacctcccaaaagagatgacatcttgtgcaggttatgtaccgttctgagctctggttcaactgatgctctctttgcgaaggaaacctccatcattccggtgtggacagctgaaaccatgaaaggctgaaacggcagcagcaacgttgatgctgccatcagtagtcctgggttctcatttctgactgccctggataaacactgcatagaaagcatatatgtttgctacgagtgcagattctgataatttgaacagcctttcagtgcaaa

SEQ ID NO: 70215 - DNA, 650 bp, Triticum aestivum
  unsure (1)..(650): unsure at all n locations
  Clone ID: PAT_TA_70215
ttttatatgctaacaacgaagctgtngactacagcggatccgattcatacataatatagctcatgaggatacaaacatgtaggacattatgaagcatcagctcaaccaacagccttcagataaaaggaaaatcgttcacaacataaccctctagtgttggaaagaaggcatgcggaacaagagtttgtttgagctgaagcctagtaggaccgacgcctttgcgatgtaaactggcaaccaacttgccattcatgtcgacctgcagtagccacccagcaaatctgagcagcacaaacaactcgccatccctaggtacgactagcacattccaaaaatcttcatgactcccacactgtgccctgatctccataaccggcatttcaatctggcacttgaaggtccagacctctctttcatagtcctgctgcaacacccagatatcaatgactgtcccttccatgttaaagatggacatgccgagcatgccatccatctcaaacagctcatggcagccaggaacaacggcaccgcacaataaccggaacgactcagttgtggtgtcgaacacgattatcttgttgctttcgctctcatgctgccataggtaccaatataggctaccacggaaaagcaaagatgtggcgttgaag

SEQ ID NO: 70216 - DNA, 223 bp, Triticum aestivum
  unsure (1)..(223): unsure at all n locations
  Clone ID: PAT_TA_70216
taatgtttattntccttngnaaaagttaccantgctncananggatcaaagggaaatttcntatagaaatcatatcctacagaattcctatgagattcctgcaaaccaaaggnctaaccctntccaatccccttgggaanaggattaactgacaaaggcctaaactagcttattacaagaaaggaccataatgtcatcccaaagaagggaaattaantgatca

SEQ ID NO: 70217 - DNA, 624 bp, Triticum aestivum
  Clone ID: PAT_TA_70217
cttacattgcataataaagaccccattttgacatatcaagtaattccatcctatagacacaaacctcactaccagtctgtcatgcattcctaaaacggtatgcctctccagcggtcacatgtgcacggctgggaactttccccgagtgttttgtctgcaagagatggtcaaattacacgatctgtgaatagacggcacacccagctagtatttaacaaaaaaaatgccgttgaattcccatcatgtagaagaaggcactgccaccatgaaacctcatttttcgctgaagtgaaggtctattgcggatcaatgcaagcagcttcaatgttgaaccttcaatatagaatgcaggcccttgagactatacaattgcagtcagagttgattgcaatattgacgcgtatctcacgaacagttaaacaccaacagcacagtgtctactatatagttatctgatctacatttgaaatgtcaagatatgcagtagcgaataagaccactccaaattgaggatgttgttcttgctgaaattatttcgagagctagctgcctaccagggaacgggaatccatcgtccaaccacaaacagattaatttttctgcctcttcccacagtaacacgct

SEQ ID NO: 70218 - DNA, 655 bp, Triticum aestivum
  unsure (1)..(655): unsure at all n locations
  Clone ID: PAT_TA_70218
catatgacgctataggcattattaccgtcactacncggcaacaacatgaacatgcaaagtttaaaaagctcgcgtacaataaactaataatccaaaaccttttcccagcgactggtcagcccatagataacagtactagaagttgagctgcgcaagcgtcacttgtctacccctccgacaagatgaagtagattgcactcccagcttcagactactacttgtggatcgagcgccgctgcgcatcggcgccatcagctaccttttttttcacttgtagtcgaacgaaggtatcggagggctgggcgtatcaaagctctctaatatctccgacttgccgccgctgccgctgggcttcttctcctcctccttatccttccgcttctcttgaacagatccagatccactacccgccactggagtagtagtggcagcgctttttggtttcccgcccaggcctacccttcacagatccatcgccagatttgctcccaacctccttcagcttctggttgctgctgtctttagctaaatcatccttcgtcttgttagctgatccagtggctttctccttgccttctttcttaatctcaacggcagttttaggtgtccccttggcatccttgacagcagttttccccttcgatttgcttggagt

SEQ ID NO: 70219 - DNA, 425 bp, Triticum aestivum
  Clone ID: PAT_TA_70219
tggctggcggcacaaggtgaattcgagttgaccggcgcggcctagccgccgaagccgtagagggtgcggccctggcgcttgagcgcgtagacgacgtccatggcggtgacggtcttgcggcgggcatgctcggtgtaggtgacggcgtcgcggatgacgttctccaggaagatcttgagcacgccgcgggtctcctcgtagatgagccccgagatgcgcttcacgccgccccgccgcgccagccgccggatggccggcttggtgatgccctggatgttgtcgcgcagcaccttccggtggcgcttggcgccgcccttgcccagccccttccctcccttgccgcggccggacatctctggcgcttctctctccggcgaccttcccttggcttggctggtgtgtgtgtgtgcgctgctggtctgcct

SEQ ID NO: 70220 - DNA, 655 bp, Triticum aestivum
  unsure (1)..(655): unsure at all n locations
  Clone ID: PAT_TA_70220
tgtactccctctataaactatataagaccttttacgtcattatactagtttacagagggagtattagtngtaatatgcttgcaatagcgcagcaccattgttcgtcaaagtttaacagcttcaaacatagacaccacgcaagaacaagctgctaacaatgcattcgagcctgagcttgtgagccacagcggtagctgaacagttacacgttcgccggtagagcaacaaataggatgaatgacctgtgccctagatgaactcggggagtaggcacctctcggaaaagaaggctgcccatgcgagaggccctgtctctgttgtacatggagcttttaccagctcaaggtattcttggactgttgaagctttgcactataagcggtttccagttcctccttgcaagctttcagcatcggttgaagaaaggacgttctgaaaaatctgatgtacttttcaagggatgttctctcccaatcgttctcagaatcaatctgcataccagccgcattgagctctcctaacagctgtgataaagttggaacagctgtaggatcaaaatcttcacaattgttgggatcgattggaacgcaaacacgccctgtctttgggtgtatgcagaanggggccttcagtaaatgattcatgtgctttgaca

SEQ ID NO: 70221 - DNA, 599 bp, Triticum aestivum
  unsure (1)..(599): unsure at all n locations
  Clone ID: PAT_TA_70221
agcttgcgaacagcctgcaccttaggaaatgtnatccagaaaaaaaaggggaatttatctccctctttctgaattgtaacaatacatgcaacataagtttgcatcttcgaaacaagtctaccaccacatgctagcatacaacatttataaggtgtatcataacagcatatcangtgatcaaaccaagcatagccgctgtgccttccttgtgggtatcaaaccaagcagacaccttcaaatctactccctccgtccggaaaagcttgtctctcaaatgaatgtatctagcatcaagttagtgctagatacattcatttgagagagaagcttgggacaagccttttcggacggagggagtacaaggttttcaacagttcaccagggtcgatttcatggaagagaggaaacataaggggaagacgagaggcggagaccatgaagtgaaaccaaaactttccactgtgttccttttcagctctgccatagcctgtctgcctgtgtcagattctgccaccgagtgttcgaccctaccccataacactttgccaagctccatcgcagtccgcgtcacgcctcccctgcatctcaaatctaaatcc

SEQ ID NO: 70222 - DNA, 783 bp, Triticum aestivum
  unsure (1)..(783): unsure at all n locations
  Clone ID: PAT_TA_70222
gctcgcctagcaggacacaacgacaggacagaaactaaacacacactcacggacacatcaccaaccgcacacgacttttattctaacgacacggcaacagatcacaggccgatctctaccaactccgggtcacggtggcgatcaactcagcttcagcagcatgacacgtttaccagggaaggatcttccagcgctggttgtcgccctcgcaccacttccacagcacgagggaggtgccgtcgcgcacgccgccgtgctccttgtcgccgtggagagcgtcaaagttgaggtagatgttattcaccatgcggatgcaccggaagccggcgcccacgtcgcggctctcagtccacaacactgactcgtcctggtagttggcgttgtatggcaccagcttcacagggtggccctcgccttgggagtgcttgatggcctcgcctgtcaccttgttgacgagggcgaaggccgggtagccttcctcgtcgcgggggttggtgggcgcgaggaccacagcgccgttgcggacggtggcgctgaagccgtcgtctgccttgcagaagatgcgcacggtgggctctgaggagccgccgcggggggcgttggcgctgcctncggcgtaggcctcttcgccccaggggaggatcttccagctctggntgtcgcccttggcccactnccanaggacgacngtggtgccgtcgtgcaccccgccgtggtccttgtcgccgttganggcgtcnaanttgaggcggattttgttaacatgcnaatgcaacggaagcc

SEQ ID NO: 70223 - DNA, 686 bp, Triticum aestivum
  unsure (1)..(686): unsure at all n locations
  Clone ID: PAT_TA_70223
acaagacaatactgagaggcaacccagnggaagcatgccaacggtcaccactacactttttcttttttcagggaataggtcacgggtactcacaatctacagtatggtgcgatacagtgaggcgccaagcttggaacccgtgggaaatccattactactccaagtcacataataacagctaaagtgctaaactcaacatgtgcatctaccttctttattttgctggtgatgcaacagaagctccagttcatcttatacgataactaaagagtacattgcgttgcctttttcgcggcctgcgtgagcgacaacgtttcttaagcatgtcggcattggccgtcgggtgaatctacggtctttgctgtcacgacccaaaaacctccttgttgcaaacggggcataccttattgatcttcaaccatttggcaacacaagttcgatggtactgatgctgacagggcaatgtagtcagcttatcgcggttcttgtaagccatacagcatatgacacattcatcatgtttttcctttcttgagaatatcccaattttgtatgttgaagacttaaggagagctatcacatcttctggcaaccctttactttcagtcccaatagtttcccctaattgttgtagttcctcataagtcatattatcaggatcaactccatcctncgttaatacctga

SEQ ID NO: 70224 - DNA, 707 bp, Triticum aestivum
  Clone ID: PAT_TA_70224
ttctgctattattcttcctataaactaaaatatctgagaaagtgcaagcatgaataataacatatctcagttcaaattttagcttctagcttgcacacatcaatcctgctacctccacttaggcttaatccatcttagtaagaaattaagtttggttaagcaagcatcactcaggcatacaatcttctgcaccttttgtacttgcaccatttgtagagatacttaattaattccatgaagagactgcagcgtgtggccaaaaatctcctgagctgcagttgcttgtgcatagtacgcaaaagctgtctcgcagaactgaatcacactgatggaacaaagtaggatcagtccaacattaaacaaaaaagagttcatcaacgttcctccccatattgggtgaatgctgatgaaaactaatttcaggccaagcatcatttctccagcaatcactgcgatgaggagatagcagaagaatgcaaaagcagcagtcccaagcagaccccaaacactgtccatctttatgaagatctcattcgggaaagaagatacaattatatgataatatgtgctacccaagcaatcgatacaattaatccaacaatgccgaatatgagttttccaatgtaatcaagcaatgtaaaagcccaggtagcctcagccttctcgacagccttcatgtttttgcgccattttctgcctttgttccc

SEQ ID NO: 70225 - DNA, 337 bp, Triticum aestivum
  unsure (1)..(337): unsure at all n locations
  Clone ID: PAT_TA_70225
gcctaaacttgcagagcctaatcatattgcatttttctatctcggctctnggagaccgatggttctctactggtgaggaagtactcataagatgcctttacccagaaaccttatctatcgtggtanctcttggntggtttcttcttgacaagctngntgatcagtgaagtataaacgccaaaatctggcaccattcctttngcacttttcagctcttcacaatcantaacttttctatgcttgcactgcccatccaagagaatgttgtatgtgatatcatctggggacacccctatattgancattgcatgcagaagcatgtcggcattcttcanct

SEQ ID NO: 70226 - DNA, 577 bp, Triticum aestivum
  unsure (1)..(577): unsure at all n locations
  Clone ID: PAT_TA_70226
aatcttntttatgtggaccgaanaatcagacccgacagcgaaaactgataacaaacatcaccaggttaccaaagtaccgagcaaaaacgacatccatactgcaatacatgtccttgacaggtaatctagaggcagcaaccatagataaacagcaatgatagctctaagtggccttgtcggccttggcagcagaggcggcagcctggcctctgagacgaccagtcctcctagcagcgatgagaccaaccttctggccaggtggtgcatcacggcggacagtggggatgctccacagggttcatggccacaccacgcaccttaggccacgagttcctcttcacacggtacttgtggtaggcgttaccagccttgagcattggcttctcagtcctgccaccaccagcaacctgaccaatcatggcacggcagctgcttgggacaatcttcttggcaccagaggggagcttgatccttgaggtgccgttgtcggggttgtggctgatgacgatggcgtagtcaccggatgccctggcgaagacaccgcggtcgccgacgtggtgctcgacgttgcagatga

SEQ ID NO: 70227 - DNA, 148 bp, Triticum aestivum
  unsure (1)..(148): unsure at all n locations
  Clone ID: PAT_TA_70227
aggcangctctaatactcgtcgccntngtnaccgnnctcaccctnnnaaaaactcagcaccaacttnttcatagtccttntncanggcagcaagatcntcacgggcctnanagaactntncctnctncatgccctcaccgnctantgc

SEQ ID NO: 70228 - DNA, 627 bp, Triticum aestivum
  unsure (1)..(627): unsure at all n locations
  Clone ID: PAT_TA_70228
taatttaattgcgatagcgtaacagaaactgactgttcctagtgtcttaacctgatcatgcagagaaagatggtctttcttggacatgacacggccctgcgcacatcagattacaatcataggcgcacgagcatacagacactgaccaaacgacaccaccgagctaagtacgatgaaatgatgcaacagctgctggctacaatactggtcatgaccagttgcttttttgaatcactatctacagatggtcaggtatcactccctgtcttgaacaggacaaccgagtcaggatcagtccgtctgcgctaccgctatatatcttcaaaggcacagaataaacgtaacttcagttacgcttcggccatgggttattttcctgaaatttccaatgtgccagctttatgcttgatggagcatagtcaacagactgcaggagatcttgggcccgtctgattttgtttactagttcctgcagtttcatcgtggcctcgctaacggtgccagtaggcctaactgatacatgctcacttgangtgttgattttgtttactagttcctgcagtttcatcgtggcctngctcatggtgccagtaggcttaactgatgcatgcacacttgangtcttga

SEQ ID NO: 70229 - DNA, 177 bp, Triticum aestivum
  unsure (1)..(177): unsure at all n locations
  Clone ID: PAT_TA_70229
tccattttatanaccttggnatntgctgctggaggtgtcacgtccattttatcgaccttggcttctgctgntggaggtgtcacgtncattntgtngacgttttcctcggcgacgctttngtactncgacagcangtccatgaactcgttgancanncgctngactttgnggtttgtc

SEQ ID NO: 70230 - DNA, 144 bp, Triticum aestivum
  unsure (1)..(144): unsure at all n locations
  Clone ID: PAT_TA_70230
cgccactactgatcaactgaaacgaaacaacatgatgaaaaagatcttcatcgagctgctccttgagcttggttgnntcacctgcacggnatcatangcacctacaaactgnnatcccncaaggaagaanaactagtncatgaa

SEQ ID NO: 70231 - DNA, 175 bp, Triticum aestivum
  unsure (1)..(175): unsure at all n locations
  Clone ID: PAT_TA_70231
agtatnctaacttnccttcttccttcgggtgcggagcaacaactttcggcgcatncgacgtgcatccgcagggnagctgaactccaggagccaagatgggcctggatagcaagaccaggaggctttgcctttgcgcgtctgaatcggatccggtgctgctgttcctgccgtcaga

SEQ ID NO: 70232 - DNA, 679 bp, Triticum aestivum
  unsure (1)..(679): unsure at all n locations
  Clone ID: PAT_TA_70232
attcggcacgaggcaagnaaccgctggtgacgagctacggctcatgctacagcaacgcggggatgcagccgctgagcctgtccatgagccccaggtcccagtccagcagctgcgtcagcgcagctcctcagcagcatcagatggctgcggccgctgctgctgcctccttggctgcttcccagggaggcagtaatggtggtggggagcaggagcagtgcgtggggaagaagaggggcactgggaagggaggccagaagcagcccgttcatcgcaagtccatcgacacgtttgggcagaggacctcccagtataggggcgtcaccagcaggcacaggtggactgggagatatgaagcccacctctgggacaacagctgcaagaaggatgggcagacaaggaaagggaggcaagtttatctaggtggttatgacaatgaagacaaggctgccagggcttatgatctggctgctctgaaatattgggggccgtcgacgaacaccaatttcccgctagaaaattatcgagaggaggtcgaggagatgaaaagcatgacaaggcaggaattcgttgcacacttgagaaggagaagcagcgggttttctcgtggtgcttcgatatatcgaggagtaacgaggcatcatcagcatggaagatggcaagctaggattggcagggttgc

SEQ ID NO: 70233 - DNA, 120 bp, Triticum aestivum
  unsure (1)..(120): unsure at all n locations
  Clone ID: PAT_TA_70233
tcaaggatggagccatctgacgccgcgacaacgccctcgtccctggtgggagcaacgcctctgaaggccgacctaggacctggggcancggtgccgncgatgcgggtggtgcttgggtcg

SEQ ID NO: 70234 - DNA, 907 bp, Triticum aestivum
  unsure (1)..(907): unsure at all n locations
  Clone ID: PAT_TA_70234
gctctctcctcctcctcctaagatgcagatcttcgtgaagacccttaccggcaagaccatcacccttgaggtcgagtcctctgacaccatcgacaacgtcaaggcaaagatccaggacaaggagggcatccccccggaccagcagcgtctcatctttgctggcaagcagctcgaggatggccgcacccttgcggactacaacatccagaaggagtccaccctccacctggttctcaggctccgtggtggtatgcagatatttgtcaagaccctcactggcaaaaccatcaccctcgaggttgagtcctcagacaccattgataatgtgaaggccaagatccaggacaaggagggtatcccaccggaccagcagcgtctcatctttgctggcaagcagctcgaggatggccgcacccttgcagactacaacatccagaaggagtccactctccacttggtgctcaggctccgtggtggtatgcagatcttcgtcaagaccctcaccggcaagaccatcaccctggaggttgagtcctcggacactattgacaatgttaaggccaagatccaggacaaggagggcattcccccggaccagcagcgtcttatctttgccggcaagcagcttgaggatggccgcacccttgcggattacaacatccagaangaatccacccttcaccttgtnctncgccttcgtggnggcatgcaaatctttgtcaagaccctcaccggcaagaccatcaccctggaaggttgagtcctcgggcaccattgacaatgtgaaggncaagatccaggacaagganggcatnccccgggaccaanaaacgcctgattttttgccggcaagcagctcgaggatggncccacccttggnggatacaacattcagnaagggtncncc

SEQ ID NO: 70235 - DNA, 540 bp, Triticum aestivum
  Clone ID: PAT_TA_70235
gggaaacccaccttgtttagtgcgcatgttaaaaaggaggattagcataagttggttttcagcgggttgctcttgcttgaattaccataagttggcctaacattgtagcatcttatcccaatgttgtagatttctccaccataacctccacaccactgcctaatatccacaacaatgtctttgacatactcgatggttccttctcccacgaggatcaccagaaataccatgctggttttggctttaactggatggggtcagggttaagtcttctgtaaggaaaaaaaacaggggctccgcaaattcactacagatgtatggaatttagaagtttgccctgcttaagcagggagacagtctcttattcatgtgaacaaatgaacaaaaatgtgttcctggattatgaacataaataacttctaggctgggtgttggtctccactgcttatttgcattaaatttgtaaaatttactttttgttgactagcaaaactcgttagtatcttttactttgtaaaatgcatctaaagctggcatcaa

SEQ ID NO: 70236 - DNA, 135 bp, Triticum aestivum
  unsure (1)..(135): unsure at all n locations
  Clone ID: PAT_TA_70236
gcaggnaattcggcacgagggtataacgcatactagttgttatgtctatcattgacttgctatatgtcgtgctttagttattttgtatcacatgttgctgacttaattgttttgcctaatgtgtcaaaaaaaaaa

SEQ ID NO: 70237 - DNA, 699 bp, Triticum aestivum
  Clone ID: PAT_TA_70237
gcctcacacgtgtgaaaaataaaaataaagaaatggttgagaagctgaggactttcatcactgacttgttagaaccacctagcataccagtacaagttcagccagaaaacagcactcgaggcactaatttccagaagttgcgcacataccttctattgcttggcatccttgccgccacagttaccttccaagctgggctgaatccaccaggaggcttttggacagataccagtgatgggcatattgctggtgatccaattttggaggccatcagtccgaagcgctacaaggcattcttctattgcaatgccacagcatttgtagcctctttggccatcatcatcctactccagagccagttgattaccattcatgccatgaagcgtcatgtactgcaaacagcaatgacactggtgctctttggtcttatgggagcctacgtcgctggaagcagcaggaagttctcaacatccatatatgtgttcgtcctagtcctcctagtgttcgcctatgttgtacttcatattctatatgagaggacactagggaatactgggagcacagcagggaatgctgagagcacagcaaggaatactgagagcacagcagggaattctgagagcacagcagggaatactgagatcacagaagggaatactgagagcacagcagggaacactgagagcacatcagggaata

SEQ ID NO: 70238 - DNA, 606 bp, Triticum aestivum
  unsure (1)..(606): unsure at all n locations
  Clone ID: PAT_TA_70238
cgggggtcagttatgcgccaccgcctgccgtgcgcccatctnncccctctcgccgccgcaatcgccgtcggatgcctcgaatgaggatccagagctgcttgcgaacaggcgaccaaataagcagctccccctttgggagccgcagtacccaatcgaagcagcaagagcagcagctcttttgggagcggcgatccgcaatcaagcagctctgcagccggcaatccaagcaatcaagcggctcctccccgagccgcagtcggaaatcgaagcaatcaagcggctcctctctgagccgcagtcggaaatcgaagcggctcccctttttagtggctaatccggaatcaaagcagtcctttctttcgaattcagtctccgagtctccattggtggcgaggacctagaggctatatatgtaaatatctggcctggtggacagcctagacatcagtacccgccaatttcaagaggagacgagcaacaactccctaaacatcagttttcggagtgaccagcaactcgggcgatggccaagtcttgtcgtcggcgacgggctgccaaattgaatgctaagaagggtaagaaagttgataggctcagcgcactgca

SEQ ID NO: 70239 - DNA, 591 bp, Triticum aestivum
  unsure (1)..(591): unsure at all n locations
  Clone ID: PAT_TA_70239
cgaggcagttggtgaattaagtnctcagcacttggattttatggtggccattgggaacctgatggtaaatcaattcttgcacatggctatggtggattttttcatatgtggagagatgttggactggattcggaaaattggcagccccagattgtcccatctggtcattttgcacccgtatctgacttaacatggtctagatctggcgaatatttgctaacagttagccatgaccagacagcacgcatatttgctccttggagaagtcatgttaacccaggagatgtgatttgttggcgcgaaattgctcgcccccaaatccatgggcatgacattaactgtgtggcattcattcagggtacaggaaaccaccggtttgtttgtggtgctgatgaaaaggtctgtagagtctttgaagctactttatcattcctcaagaccctacaggaagcaactttgttgaaacctgacaatgaggattttgacaatgtgcaagtccttggagcaaatatgtctgctcttgggctttcacagaaacctatatatacacatggaaaggaatccccaagcagcgcttctaatgatggtcca

SEQ ID NO: 70240 - DNA, 609 bp, Triticum aestivum
  Clone ID: PAT_TA_70240
gccttgcctgcctgctcgcttgcttgcctcttcctctccctctctaaaatggccgctgtttagttcagttgttgacctgaggacagcgagagagagaggaggagagaggtggtggtggtctggtggatatacagatcatttggagcttactgtcgcctcgcaagaagccacactgctgcacttggagctcctcgcttgccgggctggttccttctcctccctccgattcttgggaggtgccgagcaatggaggtggaggcgcacgagaagaagggccaccgggccttcgccaaggcaatcaagtccttcggctcgcacaggcgttccaacagcgatcttgacaagatgtgtggcaaagatgcgctctacgcttcagacaaaacatttgtcccgcctaagcaagtggaaggcgtgaaggccaaggtgaagagtgatttgagtaaggaggtgcagcctgggagaggcgcacaaagctccctgagaaaagagattcttcaactagaaaagcacctcaaggatcagcaggtggtgcgtggcgccctggagaaagccatggggccggacgctgccccggtcaacaacctcttgcacgagatgccaatgccaaag

SEQ ID NO: 70241 - DNA, 693 bp, Triticum aestivum
  unsure (1)..(693): unsure at all n locations
  Clone ID: PAT_TA_70241
ggnctgcaggnaattcggcacgaggggtacagtcagcacttgtggctgaggccgtgagcgcagccgtgtccttcctgttcaccggccgcggggagaaggcgtcgccggagcgcctcatggagaggatggaaatggcgcacacaaggctgtctctggggctcgagaggaccaggaggatgcccatgaccatcataccgttgttttgcctaaagaagaagctcaaggatgcgtttgaggagtgcgatggtctgctcgacaaggcgagggatctccggcaggtggtgccctcttttcccacaaagattatgcaagccgtcctgccctctttcgttgtcccgaaaccgaaacaagatgtgctgagcagctctgttgttgcaagatttgagtggcttgccgaggaagccgacaagtttgtcagggacgtggagtccggatcgtcgctttctcactacaggttcctgaaccctctcatcgggcagcttcttgaaggtaaaaatatcctctaccacaaggtgcaaagaagccagtcgtgttctcttggcatatggccggtctttgtggaagagtatggcagggttgcaaggctagcttttctttatgaagaccgcatggcgccgcataaaagttttaggctaatgttggctctgagactgtacgagagcacaaacatagttggagttgccgcgcagtgtt

SEQ ID NO: 70242 - DNA, 688 bp, Triticum aestivum
  unsure (1)..(688): unsure at all n locations
  Clone ID: PAT_TA_70242
cgaggctcgaggnatttcgtttttgaagagctagacgaggtgctttcctactatcctcagggttaccatggagttgacaggcaaggaagaccagtatacatcgagagattagggaaagttgatccaaataaactgatgaacatcactactgttgaccgctacatcaagtaccatgtgcaagagtttgagagagccttcttggacaagtttccagcatgctctatcgcggcaaaaaggcatattggttctacaaccactatactagatgttgaaggcgtgggtttcaagaacttcagcaaaacagcaagggaaatgttaactagaatgcaaaagatagacagtgattattatcctgagacactgcatcagatgtttgttgtaaatgctggcggtggtttcaagctactatggaattcagtgaaaggttttcttgaccctaaaacagtctcaaagatacatgttttgggaacaaaattccaaagcaaacttcttgaagtaatagatggaagccaacttcctgaatttttgggtggaacatgcacttgtgctggtgaggcaggatgcctgaagtctaacaaaggtccatggaatgatcctaacattatgaaggttgcacataacaaggaagcaaaattttcaaggcatacaagacgcttatctgagatcgagcaacgaaggggttcatttg

SEQ ID NO: 70243 - DNA, 149 bp, Triticum aestivum
  Clone ID: PAT_TA_70243
acgacgccggcaatacagccaccggctcccctctcttccctcttatctgccgcccgaatatcctcggtgccatcggacgcgcttttcttttgttgcctttacccaaatctcaccttgttcctggattggatttctgcttgctttcttga

SEQ ID NO: 70244 - DNA, 657 bp, Triticum aestivum
  Clone ID: PAT_TA_70244
gctccctccctcctcgtccacgcgcgctcgcctccggccgcctccgctgcgagccctcctcctgctgtcaccgcctcccatcccctcggcgacgcgccgcaggacccgcacggcccaagcttcgacgacggcgcgcaatgatagaggaagagagaaggagaggtatggtgggggatctgctcatgagctggaggtgcgcaagtttgggtagcagaggatggcttgccggcaagctcagccctctccgcctggtccggagacgcccgttggcgagcttcgaccacccacatcggggcagagggagccgcgtgcgtggccagcaagtggaacgacgggggagatgccgcgccgcgggcttgacggggaggagagatgaagagggcgcgtgtgggcggctggccgaaggggaaccatcgcgtctctcccgcatctacgaaccgcaggtcagttttgcacagggcaggcatgtcttcatggtgcttgcggaggagcagggctgctgaggaaaagtggtggttggggaggaggacgcccttgtccttgcccttgtccttgtcctgtgttgctctgtgcatggtcgttgaaggcgaggacaacctgtgactcctcgtgacaaggaaatttcctccatcccctctcttcctctcatgcactgtt

SEQ ID NO: 70245 - DNA, 635 bp, Triticum aestivum
  unsure (1)..(635): unsure at all n locations
  Clone ID: PAT_TA_70245
gaggcatctgcatctgcatctcggcatccttcccggnaaccttccccgaccttccgccgcgcgccggagctctcctcctcctcgcggtgcttgatttgcttggaccccaagctcaaaccattcccccattccatttgtatagcccagctcatctcccatccatgcccccaaccacaaaacatcactagtcactgttgctagcgcgcctccgtccgtatacgccaaacgcctgggcctgggccatggccgccacaccggacgagttcctgcgggcgggggacgcggagcccttctccccgtcgctcttcctcgacctgccgccaacgccgtcgcccccgcgcgcccccgcctccgacgacctcgacttcatctcgcgcatgctcatggaggaggacatcgacgacaggttcttctaccagtaccccgaccaccccgccatcctctccgcgcagcaccgcttcgcccagatcatctccgactccaacaccaacccatccaccgacgactccgccgtcgccagctccaccttctcctccgactctgctaccgccagatcggcctcctcctgctccgactctgccacaaacaccgccaaatcgacctcctcctcccactccgccaccaccaacaccgcc

SEQ ID NO: 70246 - DNA, 659 bp, Triticum aestivum
  Clone ID: PAT_TA_70246
gagcaaactcacacaacccacaccaccgcagcccccaaccccacccgaagcagcagccatggcccccaaggcagacaagaagccggcggccgagaacaaggtcgagaaggcggcggagaagacccccgcggggaagaagcccaaggccgagaagcggctgccggcgggcaagacggcgtccaaggaggccggcggcgaggccaagacccggggcaggaagaagggcagcaaggccaagaagggcgtggagacgtacaagatctacatcttcaaggtgctgaagcaggtgcaccccgacatcggcatctcctccaaggccatgtccatcatgaactccttcatcaacgacatcttcgagaagctcgccggcgagtcggccaagctcgcgaggtacaacaagaagcccaccatcacctccagggagatccagacctccgtccgcctcgtcctccccggggagctcgccaagcacgccgtctccgagggcaccaaggccgtcaccaagttcacctcctcctagactgacggcgtgcagttggtttctgcatctgcatctgtactgttgactctgcttatctatctatccgcaagtagtggtagcagtagtagcacctgtgctgggtgattgccaacgctttgttggcccgttggttgtaaga

SEQ ID NO: 70247 - DNA, 692 bp, Triticum aestivum
  Clone ID: PAT_TA_70247
gggcctacgctgccgtcggccgagtggcctcatggctatctacgatacactgcttagccaattgttcgtcgtctgtgttgttagccagcaagtctgtgtcgttagccagcaagttgggtaattcttctgttgcttcacggattttcctgcacgttgtgtctgtattattgtcactgaagatatacctcaactgaagatctagctcgcgacgatgatgtacctaaggctcggatgcaaggtgtgagtcaacaatgccagtagtgagtcgagagaagtggagaagagggtccctccaggctccatacatgaatggtggtggcatgtggcaatgtcggggaaagcaaggaagatgttgttgtacatcgtcgaacatataaaccctggtggccaaactaaatgttttatattcctttgggaaaattttaaggaaatccccccaaacaaattattcagtgtgcctccctattttgtccagataactacttcaggttaggcaagagaaataaaaagggtaaccatagatatatggtctagcatcacgaggttcaggttcctgctgttgatcaaccgttgcttcagtcgagagattaaagaagactgaaatatgggctcaagcgattgctatgtccgacctgcacaagaatgccaagaagtctttctcggcgatgtaagccacggtgcatgtttctgcc

SEQ ID NO: 70248 - DNA, 596 bp, Triticum aestivum
  unsure (1)..(596): unsure at all n locations
  Clone ID: PAT_TA_70248
gaggaattcggcacgaggatctctctccctcatccctccttctcatcaccggccgccgccgcggccaggccggcgtggcggctcgccatccatccaccagcaacaccatcgcctccagccgccactccaccccgcaccaccagcaccaccccatccattcgagcgccaccaccaacacccacgctccagatcgaagaaaggagcggcgcgacccaccagacagcacgtctgggtacccgcgcccctgctgttgctcttctatcttccctcgccttgctgctgctcctccacttctcaactcaaacctgctgctgcttattcttcccgcgtccccgctgctgctcttcttgcgcctctgctgctttcctcttcttctcttaaccctgccgctgcccttcttctttcctgaaacctgctgctgcacttttctctgaaccttaacttgttgctgccacttcttcttctctgaacccaacgctgctgctgctcccttcttgcccatgcctctgctgctgcctctcttctcctacaccttttgctgctgccatctctctctctctctctctctctctctctctctctntntntntntntnt

SEQ ID NO: 70249 - DNA, 491 bp, Triticum aestivum
  unsure (1)..(491): unsure at all n locations
  Clone ID: PAT_TA_70249
gaggaattcggacgaggccactatggccccacgacccccaccttcctcccgctccagcctccacctccactaatttcttccatccgtgggtcacgccaccgtccgtggatctccacctccccgaccagccacctccaatcccgggcgcaaccagcgccgccgccctgttcatcgtcccgaggcgaccatgctctccaaccgccacagccctaccgcatccggcgagatccggctgcccccgcacctccctcccgctaaccgccggcggacgcccctccctctccaagcatgcggctcgcgaccagtggatctagtgcgtgctggcggtgaccactggatccgctgccaccggcctccttcccccgacgcggatccggcgggcacgaccccaaccacccctctctgccgtggatccagcgggtgcggatcttactccacctcacgccctggttgcgcgcggcggcgctacctcaccccccccccccnccccc

SEQ ID NO: 70250 - DNA, 658 bp, Triticum aestivum
  unsure (1)..(658): unsure at all n locations
  Clone ID: PAT_TA_70250
aggaattcggcacgaggtctccctncccacgcacacccaatcccctcccctccaccctagccgccccgctcccctccctctccacggcgccgccgcctcctccccttctgccctgctctccaccgtgccgcctcttcctcctcttcactgccctctctagcggcggcaaagatctaccgacaaaagggagacgacggcgacgctcgatccgatctgctgaagagaaaagatgagagggagagagacaaggaaggagaggagggagaaagatagaggaaagaggagagcgaggtgtgatggcagatgagagagggtcaccggaaggagcgtgacgacctgcagacaaagggcggcggcggcgccgctcgatttgatctgcgggagagagaatatgagagggagagagagaaggaagaacatgagaggagggagaaagagagaggaaagaggagagggggttgacggccgacaggagaggatcaccggaaggagtgccgccggctcgtcgtctttcacaccgggtgaaggagcaggggaggcgggcaacaaggatgggaagcatcgggccgtcatggtgcggtggagatgctgggaagaaggaggagggcgtctgcatcatccccaggggtgctcgtggagctgctcgtcaatgagatcc

SEQ ID NO: 70251 - DNA, 692 bp, Triticum aestivum
  Clone ID: PAT_TA_70251
tttcccccgcctttcccgccatcgaggtcattcgcttttagccgccgcttgggaattccgctgcgcagcgtcggcgacggagatggcggccgacatggagatgccagatccggaggagctcgagtggatggagagcaacggcctcctcccggaagaagaggagtacgcctacttcgacgaccccgacgagggcttcctcccggccgccggcgacgcgtgcaaaccgcacgcccccccgcaggagacggccacctcccccgcaaagcccgcagatgaggtgtcggaagccaatctgaagcggcctccccctccgcctccgccggagcaggaggaggagaggagcaagaggaggaatgtcgatcgggtggattcggtggacgaagactggctgcggtactcgccccctcccgccgccgaagccgttgccgagaagattgtgtcgcggttcgcgtcggagatccagggggactctatgcccgtcacagcgcccaacggagaaagagtttatgccaagcttgcgacggagaaattggttagcgaagtaattgagggaactaggcgaaggacttcaatttccaaccacgatgggctcctctcagaatcatttcattcgttgacaatgcaagcggagcaagaggctatagcaaaggccttgatggaaagcacagaggcacagtatgtcgagggttgtc

SEQ ID NO: 70252 - DNA, 624 bp, Triticum aestivum
  Clone ID: PAT_TA_70252
atagcgaggctgcagtatttggagacattgcacgtaaggcgaactttgattagagagctacccagtgagattggggacttacagcagttgaagactctagtgatgagtcgcaacctaaagctggcagagctgcccagggagattggggacctcaagaatttggagactctggacctgagttacaaccaggagctcacagagctacctcgcgagatcaggaaactgcagaatttgaagcaactgttgttgacatttatacccgtgacgaagttaccaaaggaaatggtggggctaaaaaaacttaaaaaattggcattagattcggccatcagcgcactaccctgggaaactagccaactttcgaatttggagggagtggctgagtgcgtccggcaagcttggaagaacagtgatcttgtgtctgagttctccgcggagatcctgtccattcaaatggatgcatggactactgaaaggggtgggctaactgttggcacaaaacacatgcacattccatggtggatcaaggatcacttcaacgaccttgcctacttggatatcaggatctgcaaactcgaggagcaggatctgaagattctgcgggagatgcctagcctgaaagac

SEQ ID NO: 70253 - DNA, 349 bp, Triticum aestivum
  unsure (1)..(349): unsure at all n locations
  Clone ID: PAT_TA_70253
cgcctgcccgcgccgccgccgcctccttccgcagnagctccctccccgcgggcgcgatggtgtacatcaagaaccagnaagacaagggcgtactccaagcgtttccaagtcaagttcaagagaaggcgccagggggaagaccgactacagggccaggctgaggctcacgaaccagggacaaggaacaaatacaatacccccaagtaccgttttgttgtgcgatttaccaacaaggatgtcactgcacaaattgtctatgctaccattgctggtgatatcgtgatggccgctgcctactcccatgagttgcctcgctacggtcttgaagttggcctcaccaactatgctg

SEQ ID NO: 70254 - DNA, 448 bp, Triticum aestivum
  unsure (1)..(448): unsure at all n locations
  Clone ID: PAT_TA_70254
gtcgggccgtggcaagggaggcaaggggctcggcaagggcggcgccaagcgccaccggnaaggtcctccgcgacaacatccagggcatcaccaagccggcgatccggaggctggcgcgtcggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccagggacgcaccctctacggattcggaggctaggccgccaccaccaccagattaggagctagcccatgtgtagggttcgtggtcctcgttgtaatcgcagtatctcgctgttgttcgctgtgttctgtaggatcgaatggaatggaattgaaattaaactaaaaaaaaaa

SEQ ID NO: 70255 - DNA, 302 bp, Triticum aestivum
  unsure (1)..(302): unsure at all n locations
  Clone ID: PAT_TA_70255
tcaattacaggaatctgttggctcttcaataatacaggcagctggnaaaaccagtccaatcagacaaacagnaaagcatcagnacaccatgtcccgaagggccaagttgaagtcagtgaagtctcttcacattgacacagggaaggaggaagcaggactttgagctacagctataagaacgaagaagcccaaaatgagaatcgtgtatgttctcaaaattgcaagggagaatgtgcagcctgcatggttttgtttgataattttgatgtcaaagctggagagaaggaaaggatggttgcacc

SEQ ID NO: 70256 - DNA, 540 bp, Triticum aestivum
  unsure (1)..(540): unsure at all n locations
  Clone ID: PAT_TA_70256
ttcttgtatggtcacttgctcgacgctgattggtggaagnatattgcggggctcagnagggctttaaaactggtcacgtgctcgacgctgattggtggaagagagggcgtggccgtgaggtctgatatttctccaagtacactgcgaacgcgtgcctgctgtttgtacattcttgacctgcgacggaatggagtgcaacaaggatgaggcccttagggcgaagcaaattgcagagaggaagtttgaatccaaggacctgcagggtgccaagaaattcgcactcaaggccaagtctctctttccggatcttgagggcattatgcagctgatcatcacctttgatgtttaccttacctcagaactgaaggttgctggtgagaatgactattactctatcctctctgtcgacacgtcagcagatgatgaaacagtgaagaagcagtacaggaagttggcacttctactccatcctgacaagaacaaatcagtgggcgctgagggtgctttccagttggttaaagaggcatggactgtgttatc

SEQ ID NO: 70257 - DNA, 645 bp, Triticum aestivum
  Clone ID: PAT_TA_70257
gcatctccgcctcccacgccgcctcgcttcccggcgaagccacggccgtctccgtcttccaccccaccccacgtgccgtgctccgcacgtaagtgcacattcccctcgcccccctcgtcgcggagccggttctggtgccccgccatctgaattgtgccatcgaggggagcatacggcgaaatggcggttgccgcgctcctgcgccggggggcgctctcgtcgtcgtgccgccatggcatcctcatttatggtatccgaatgcccgagaaaagaagcgcaatgtatttttgcatgttggtcctacaaatagtgggaaaacacataatgccctcaaacgattagaagcaagctcttcaggtgtgtactgtggacctctaagattgttagcacgggaggtagcagaaagattaaacaaagctaatgttccctgtaacttgactactggacaagaaagggaagaaattgaaggtgcaaagcatagctcagtgacggttgagatggctgatgtgacgactgagtatcagtgcgctgttattgatgaaattcagatggttggctgtagaacaaggggttgttcatttacacgtgcactgctggggctttgttcagatgagcttcatgtttgtggtgacccagctgttgtcc

SEQ ID NO: 70258 - DNA, 401 bp, Triticum aestivum
  unsure (1)..(401): unsure at all n locations
  Clone ID: PAT_TA_70258
gcggcagggcggcaaggggctgggcaagggcggggcgancggcacaggnaaggtgctgcgggacaacatccaggggatcaccaagccggcgatccggcggctggcgcggaggggcggcgtgaagcgcatctccgggctcatctatgaggagacccgcggcgtgctcaagatcttcctcgagaacgtcatccgcgacgccgtcacctacaccgagcacgcgcgccgcaagaccgtcactgccatggacgtcgtgtacgcgctcaagcgccagggccgcaccctgtacggcttcggcggttaggggatagctagcttcagtgtgtctaccaggtcgctgctccgcgaatgcttgtgcctgtggtttaatttaatgcttgttgtgaggaagtgcaaaaaaaaaa

SEQ ID NO: 70259 - DNA, 384 bp, Triticum aestivum
  Clone ID: PAT_TA_70259
atggctatcggcgccgcgctcttcttcttcttcctcgctgtggctctaacagcggcgcccggtggcggcggcggcgatgcggcgctcgtggagcacaccttcgtttgttttgttcgaacatataggtgagcgagataatgctaaatcacctgtgcaacgacacgccggttattgtggtgaacgggcaattgccaggcccagcgatagaggccacggaaggagactccgtggtcgttcatgtcatcaacaagtcacctcatggagtaactatccattggcatggagtgaagcagcaactgaattgctgggccgacggggcagggatgataacccaatgcccgatccagccgaacaagaacttcacgtatcggttcaacgtcatcg

SEQ ID NO: 70260 - DNA, 423 bp, Triticum aestivum
  unsure (1)..(423): unsure at all n locations
  Clone ID: PAT_TA_70260
ctgccgccccagncgacagtggtaggaagggaatggtcctcccttttgcaccgcttgctgttgccttcaacaacatgagatactctgttgacatgcctgcggaaatgaaagcacaaggtgttgatgaagataggctgcttctgctgaagggagtgagtggcagtttcaagccaggagtcctgacagcactgatgggggtcagcggcgccggcaagaccacgctgatggacgtgctggctggcaggaagactggaggctacatcgaaggtgacatctcaatctccggctacccgaagaagcaggagaccttcgctcgtatctccggttactgtgagcagaatgacatccactcaccaaacgtgacggtgtatgagtccctggtctactctgcatggctccgtctgccttccgatgtcgagtcgg

SEQ ID NO: 70261 - DNA, 586 bp, Triticum aestivum
  Clone ID: PAT_TA_70261
ccccaccaccgaagctcccaaccccacccgaagcggcagccatggcccccaaggcagacaagaagccggccgcggagaacaaggtcgagaaggcgacggagaagacccccgcgggcaagaagcccaaggccgagaagcggctgccggcgggcaagacggcgtccaaggaggccggcggcgagggcaagacccggggccgcaagaagggcagcaaggcgaagaagggcgtggagacgtacaagatctacatcttcaaggtgctgaagcaggtgcaccctgacatcggcatctcctccaaggccatgtccatcatgaactccttcatcaacgacatcttcgagaagctcgccggggagtccgccaagctggcccgctacaacaagaagcccaccatcacctcccgggagatccagacctccgtccgcctcgtcctccccggggagctcgccaagcacgccgtctccgagggcaccaaggccgtcaccaagttcacctcctcctagactgacgatgcgtcgcttgttgtgacagatgtggctgtctgatgtatctgcaagtagaagtagtagttcgtgtggtagaagat

SEQ ID NO: 70262 - DNA, 312 bp, Triticum aestivum
  unsure (1)..(312): unsure at all n locations
  Clone ID: PAT_TA_70262
cgccgctcctcgccgtagagccgctcctcgcgccgccataggtcctgtccccttcttcttcttcttcttcttcttcttcttcttcttcttcttcttcttcttcttcacccaagcagcagcaacaggtacactcgctgctcctcgccgggacagcagtggcgcagccgcaagcatcggccgaagcaccaagcagcagcaagcacgcgcaagaacagccccggccgnccgccgctgctgctcctcttcctcggccacgacagcaacaggtggtcaagcacgtgtgcnagcagcatcagtccggtggttttgacg

SEQ ID NO: 70263 - DNA, 445 bp, Triticum aestivum
  Clone ID: PAT_TA_70263
gaacaatatggtcgaaaccacagttgggaaaggaccaaatatagataacagatgaacttatcacaaggggattattattataacaagaagcttccatgataagttccacatcgggtccatgggcatgaacacaaggttcaaggtcgactctcatttctctaatgcataactttccattcacttctcgctttcggtgaagctgtagtgttgatattttatctggcaaaacaccagaagagtaagactcatgaagactctcgggttcaaacagattagggaaggcgtaggttcaacccatagaggcatcttaggaacctttcccagaaacttcaggagtaaaaatatcaatcccgagagtagagcatggttgaggaagcagaagatacaatttgccaaaggcattatgtatccgaggaaaagctcacaaggttactgtatatgaagg

SEQ ID NO: 70264 - DNA, 415 bp, Triticum aestivum
  unsure (1)..(415): unsure at all n locations
  Clone ID: PAT_TA_70264
ggctatagtaggttataaggcacagnagtgagaatggtcatcgacagtctggaatcggcttatcaccgcgtgggaagatcgcaaagaatcggtcgttgttgagggtgttcacttgagccttaattttgtgatgggcttaatgaagaaacatccatcaataattccctttatgatctacatatccaatgagggcaagcacaccgagaggtttgctgtacgcgcaaagtacatgacgcttgacccaaccaaaaataagtatgtcaaatacatcaacaacattagaaccatccaagagtacctctgtagccgagctgataaatacctagttcccaaggtaaacaacactaatgttgaccggagcgtggcttccatccatgccaccgtctttagctgcctccgcaggcgagctactgga

SEQ ID NO: 70265 - DNA, 166 bp, Triticum aestivum
  unsure (1)..(166): unsure at all n locations
  Clone ID: PAT_TA_70265
aagcagccgagcggcaccaccancccctccctagccgctccccctccttctcctgcccctgcggcggccggnttttccgagatgcgcggggagcggctggggagctgggtggtgtcctacaccgggatgtcggcggacaacatnaagggcctgctgctggcggtct

SEQ ID NO: 70266 - DNA, 601 bp, Triticum aestivum
  unsure (1)..(601): unsure at all n locations
  Clone ID: PAT_TA_70266
actctccctnngccccgtgtccagnaatctaccccccggctccaatggcggcgaaggnaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggcgtcaagatggagttgatcgatgccgcatttccacttctcaagggagttgttgcaacaactgatgttgttgaggcttgcactggtgtgaatgttgcggttatggttggtggattccccaggaaggaaggaatggaaaggaaggatgttatgacgaaaaatgtttcaatctacaaagctcaagcatctgctcttgaagctcatgcagcccccaattgcaaggttttggttgttgccaacccagcaaacaccaatgctctcatcctgaaggagtttgctccatctatccctgagaagaacatcagttgtttgacccgcctagaccacaacagggcactcggtcagatttctgagagacttggtgtccaagtttctgacgttaagaatgctattatct

SEQ ID NO: 70267 - DNA, 490 bp, Triticum aestivum
  unsure (1)..(490): unsure at all n locations
  Clone ID: PAT_TA_70267
ggctgccgnggnaggtgacgaatttacttgcaaccactccgcggngccacgctaaggaagacgcagaggaaacactgtctaggatagcagaagcatagcctgcagctaggtggtggtacatctgaagcctgtcagccttgccatgtcactcagaaatttctgcgatgagtaggaaccagactgaagaaatcgacacttgccatgctgttaactgaagaaatcgacacttgtcatgctgttaactgaagaaatcgacacccagcagtcgattggcgccaaatcggaagggctcaacgtcgaccgtcagatcttcatctaacagcaacttacagcttcgctcggagttacaacaggccaccacccttggtcgcacatccagcggctctgaacactggagcggccaaagtttgagaatagtactgtctgttgtatgcaacttgctctgttccagtattgggctatcagcctatcactgggagagaccaatctc

SEQ ID NO: 70268 - DNA, 519 bp, Triticum aestivum
  Clone ID: PAT_TA_70268
cttcctgcagccgcgtcgcccacgttcccgaaaaccaccgtccgccatggccgatgaacccagtgctctcgagcccctcggcttgctcccgcggcaccaacatgctcgaagaattgccgacgcgtccagggtgggactgctctccaatacggactccaggtcattcttggactgaaaggattccagatagtggccatggtggatggatgatatgaggtgatctgggtgctgcatttgatggccatgatctgtttgctgcaggccaactccctgcttgtggcctctgaaggagacaacttccagttccagtagacctatccgatagaattctcgaagctattagcttgcaagctctcaatcagacttcatgtagcaagaaatgtgatgtctgaagggatgcacatgtctccttggcaaaaaaagagaccgcaattaacacaaatccaatgcatcaaggtagaaaattcatcattttatacaaggactatggagttaaattttggttggttgctttcgact

SEQ ID NO: 70269 - DNA, 867 bp, Triticum aestivum
  unsure (1)..(867): unsure at all n locations
  Clone ID: PAT_TA_70269
taagcgaagccaaggctctctcgtcctcctcctcaagnatgcagatctttgtgaagaccctgaccggcaagaccatcaccctggaggttgagtcctcggacaccatcgacaacgtcaaggctaagatccaggacaaggnagggcatccctccggatcagcagcgtctcatcttcgctggcaagcagctcgaggatggccgcacgctggctgactacaacatccagaaggagtccacactccaccttgtgctcaggctccgtggtggcatgcagatcttcgtcaagaccctgactggcaagaccatcaccctcgaggttgagtcctcggacaccatcgacaacgtcaaggctaagatccaggacaaggagggcattcccccggaccagcagcgtctcatctttgctggcaagcagctcgaggatggccgcacgctcgctgactacaacatccagaaaggagtccaccctccacctggttctcaggcttcgtggtggcatgcagatcttcgtcaagacccctgaccggcaagaccatcaccctggaggtcgagtcgtctgacaccattgacnatgtgaaggccaagaatccaggacaaggaggggcattcccccggaccagcagcggtctcatcttttgcttggcaagcagcttgagggatgggccgcacccttgcggatttacaacatccagaaggagnccncccttccacctttgtccttccgcctttcgggggagggcatgcnaaatctttgtcaggaccctnactgggcagnaatattcccttggaggggggagtnatttgacaccatngacacngggaagcccagaatcccaggncagggggggnaatncccccgggccagnag

SEQ ID NO: 70270 - DNA, 244 bp, Triticum aestivum
  Clone ID: PAT_TA_70270
tttttctgcatgcaagaagttgaaagaggcgatctcaaatgtcaaagctcaggttgttaagaggaaggaaataattatgagaacagagatgctgaaattggctatagatcaatcaatgcccctggcaaatatcgaagggttcatccaagtgatcaaaagacaggtggatgtgttggttcaggatgaagggaaaccttacatttatgattgtgaagatataaattcaattctcgataagctccaa

SEQ ID NO: 70271 - DNA, 563 bp, Triticum aestivum
  Clone ID: PAT_TA_70271
gatggctccactgaggcacctgcatctgaggggggcacttctgaagtatcagaaacagcacagtcctcaacacatccatctgtagcagaagaaacttatgatggatctgttgagaccagtaactcaattaagaaggaaactcagggtcatcaagacactgaatattctgatcctaacggtgaagctttaccgagtcaacctggtaaatccgtaagggacatgcctgttggtagaacgtcttcacctgaaaaattggatcaatcaagtgttatgggaacagaagaatctatggatgctggaaaggaagacatcgatgatgggaacacctcgctgtcacaaccagcagattccatgcttgccagttcagatgatgtaaatgaagctaaggtgaacgttgttcaagcatttgatgtccaaaaggaaataatcagctcaccggagagcagtgatatcgctgacgaagccagtcatggggaagtcaaagcacatgatggtgaaactaatacagccgagaatggggaagaaagcaatcaaacggaagcacatgctgtatctgttgttga

SEQ ID NO: 70272 - DNA, 442 bp, Triticum aestivum
  Clone ID: PAT_TA_70272
atgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacagcgcggacggcggcaggacgaaccacccctggttcagccccgactcgaagcgcatggtgttcacctcggacctcgccgccgtctc

SEQ ID NO: 70273 - DNA, 481 bp, Triticum aestivum
  unsure (1)..(481): unsure at all n locations
  Clone ID: PAT_TA_70273
ccggggcaacggcaccggcggcgagtccatctacggcgagnanttcgccgacgagnangttcgtccacaagcacaccaagcccgggatcctctccatggccaacgcggggcccaacaccaacggctcccagttcttcatctgcaccgtcccctgcaattggctcgacggcaagcacgtggtcttcggcgaggtcgtcgagggcatggacgtcgtcaagaacatcgagaaggtgggctcccgcagcggcacctgctccaagcaggtggtcatcgccgactgcggccagctctagatccgcccgcgcgcgggtcgcctttcgccgtcgtcgtcgccgccccgtgtgtcccgtgtcgtgtcgtcgatctaaataagagagtcgtgtgtcgtgtcgtgtcttcccctggtccgtccgatgagatctccgtggttggtttaggagggttttaggtggactctttgggctgctggatctctgtccgg

SEQ ID NO: 70274 - DNA, 557 bp, Triticum aestivum
  unsure (1)..(557): unsure at all n locations
  Clone ID: PAT_TA_70274
ctgtctcatcagtcctctcctacccccaccgccgccgccgccgccgcctcctcctagctctcacccgccgccgtttcctcgcaggttcgcgtcaccgagccacggnaatcttgcagcccgtgccacccaccacatccactgatccatcctcttcctcctcgacccacttctccacactcccaccaccacaagcacacaacgaattagtacatgcgaggaggagtagctaggtagagagcagcatccatggcggtggtcagcgccgcgcacggcgcgtttgggcctctggtggggaagctcacggccttgctcgccgacgagtgcgggcggctgaaaggggtccgacgtgaggtccagtccctcagatctgagctcgccagcatgcacgccgcgctcaaggagtacaccaagctggaggacccaaatgagcaagtcaagttttggatttcgctggtcagggagctggcctacgacaccgaggacgtcttcgacaagttcatccaccacctcggcgacacccgagaccatggcggcttcaaggacttctttcgcaagac

SEQ ID NO: 70275 - DNA, 592 bp, Triticum aestivum
  unsure (1)..(592): unsure at all n locations
  Clone ID: PAT_TA_70275
ggcatcatcatcctcatcgatccacccatcgnngctggttctggtgccagcccaaaacctaagaacctccatgaacgagcactgaacccggcctgacagaccgcaagaacgaactgtgatgatgggaacagagtgcataaccgcctcactcggcgacgatcctgaaccctcagtcccgcctggatttggaccgccacctggatttgggccgtttgctgcgtatgcattgcaaggaacccagaaggatgccaaacttgctgatgctcgtcctagtcctgctcaagtgtttcagaatgagaagaaacatgttgaatccctggaaggccagccccattcagctcagagccgaaacgacacgcactgtagtacttccgggagccatacgtgtaggcagtcgctgcggaacaggcctccagtcgattacagccgctttgataatatgtcggatgaagattccgatgtcgaagtagtagaaaaggcggctacgagtttagtgagacgcagacagcagttacccaaaggagtttttcgaggatgtgcggcatgcagtgactgtcaaaaggttgttgcaagttggaatccagctggtgca

SEQ ID NO: 70276 - DNA, 659 bp, Triticum aestivum
  unsure (1)..(659): unsure at all n locations
  Clone ID: PAT_TA_70276
tcgtgtgttcgttgctttacatagctcgatgctgcgtcttggncggtttgcacttgcgttttatgggaccccaactcgcccacggcttgtagcccttgttgcacaagnaagaggttatttcttcgagtggtcaagatgagccacctggnaatgcacatgatctatcttccatactcggnatgatgttagatatcctgaagaggttcatctgacttctggggatgcacctcgcgctacagatgagcaaataaagaaagcttcgaatctgttgagacgtattgacctgaagcatttctcagtacgccattttgctaacccaggattacaaaaacactacgggattttggaggccttagctttaggtgaggatgagatgccggatataaaggatgagacccttccagatgaagaaggcttggctaggccaggagtagttaaagctatagaagaatttaaggctgcagtgtttggtgaaaattatgaccaagatgaagctgaggcagcagcagcaaaaggtggggcctcaaagaagaggaaagcaattgcggatgcagcttcacagaaaagcgcggcttatgattgggcagaccttgcagataatgggaagctgaaggacatgacagtgatggatttgaagacctacctgacggcgcatggcc

SEQ ID NO: 70277 - DNA, 632 bp, Triticum aestivum
  unsure (1)..(632): unsure at all n locations
  Clone ID: PAT_TA_70277
accgtagcctccttcgacntgcgagatggtctccggccgcggcgccagccgccttcgccggccaaggagacaaaggcggccggttccggtcctaatacttccaagaagaggaagctagcgggacaccagcgccgtgaagaggtgccgacagcggcagtgggcctgcacatccacggagaggtgctagcgccgccgccgggggcgctagatccgaaatcgacgggcaaaccgcccgccggaggggaggtggacggaggagccgtcgaccgcatcagcaacctccacgacgataacctccgccacatcgtctccctcctccccgtcaaggacggcgcccgcacccagatcctcgcgtcgcggtggcgccacctctggcgctccgcccctctcaatctcgactaccgtgagttcccctccggctgcttgcccccctacatcgattcccgcattgacgtcatctcgcacatcctttcctcccacccggggcccggccgccgcttctgcatcgaaccgtgctacctccacgccccggaggctaccgtcgacgcctggctccggtccgccgctctggacaaattgcaggagcttgagaccggctctactatatgcattgacccgccgccagcgtccac

SEQ ID NO: 70278 - DNA, 461 bp, Triticum aestivum
  Clone ID: PAT_TA_70278
aggcgctgctgctgtcgccgtcctccccgccgccgcccgcctcctgctgctcgcccgtggacgacggccaggaggacttcctacagcaccaggtgtcccggatggacacgctcgccggcatcgccatcaagtacggcgtcgagatatctgacatcaagagggcgaatagccttgtgaccgatagccagatgtatgcacacaaggcgttgctcatacctctaccaggaaggcccatgccgtcctctgtgaagctgaatggctccagcctacgatcgaaaagagcgtgggctccgaacaatcagcaaaacagggacattatggattcactagattcagttaagtctagacagcagcagtcatctcttgcaatgagcagcttgcagagctactacggcctgagttctgaaagaggagacgacatggattgcagtactgaaatgtccttgtacagcaagggaggc

SEQ ID NO: 70279 - DNA, 372 bp, Triticum aestivum
  unsure (1)..(372): unsure at all n locations
  Clone ID: PAT_TA_70279
cctgagcgcgagagatggcggcgaagggcgatgggccggcgatcggcatcgacctcggcacgacctactcgtgcgtcggcgtgtggcagcacgaccgggtcgagatcatcgccaatgaccagggcaaccgtaccacgccgtcgtacgtcgccttcaccgactcggagcgcctcatcggcgacgccgncaagaaccaggtggccatgaaccccatcaacaccgtcttcgatgccaagcgtctcattggccgtagattcaccgattctactgtccagagtgatattaagctgtggcccttcaaggttgttgctggacctggtgacaagcccatgatcaatgtccagtacaagggtgaggagaagcagtttgcag

SEQ ID NO: 70280 - DNA, 565 bp, Triticum aestivum
  unsure (1)..(565): unsure at all n locations
  Clone ID: PAT_TA_70280
gagggcagcatccatggcacccaaggnccgccgagnaagaagccggtggagaagacccccgcgggcaagaagcccaaggcggagaagaaggtgccggcgtccaaggagggcggcgacaagaaggggaagaagaaggccaagaagagcgtggagacgtacaagatctacatcttcaaggtgctcaagcaggtgcaccccgacatcggcatctcctccaaggccatgtccatcatgaactccttcatcaacgacatcttcgagaagctcgccggcgagtccgccaagctcgcgaggtacaacaagaagcccaccatcacgtcccgcgagatccagacctccgtccgcctcgtcctccccggcgagctcgccaagcatgccgtctccgagggcaccaaggccgtcaccaagttcacctcgtcctaggctcctcgtgcgttgagtcttgtgtttctttcttcttcctcgtctgaggaactctgtaggtagctgtgtgttttctgacagtgtcatgttgtaacaatggtgctgctgaataaatagtcatgttgctgcttgaaaaaaaaaa

SEQ ID NO: 70281 - DNA, 565 bp, Triticum aestivum
  unsure (1)..(565): unsure at all n locations
  Clone ID: PAT_TA_70281
ggtagccccacttccccccacacgtagatattttccctcgccccctctctccctcgtcacactccctcgtgcccagatccgccatcgacgaacgccgtcggcgccgccatccgtctccaccaggacgaccggcaaccaccgtgcccgttcgtcgagtccgcgtgctcctccaccatcccctacgccgcctgagaccacttcgtcctcgcctccctggncccgacctcgaccaccacgaccaccgccgctgcttcaccgcgccacagcaccgcatcgaccgtcccgtcttcaaccccgaggtccggcgccgttcgccgtcgtttccgtcgcgcctgctgctcctaacctctcgacgggcctccttgtgcctcctcgaccccgagaccgctgctgatgccgctgtgatcaactatgtcgacgacgaccccttcttcttgtctgagcaaccagttgatgcaaccagatggtggatccatggagccagatgccacccccgccgactactactactacccaaagggtgccttctactacgtggagccggttcatggaacgacgactagga

SEQ ID NO: 70282 - DNA, 557 bp, Triticum aestivum
  Clone ID: PAT_TA_70282
gattaacaatgaacattattaccgtgttgactgtttctttgctgttctggatctgttaggagaagagtttaatgacagatttaatgaggtaaattctgagttgcttctatgcatgtctgctttgagcccaagtgatttattttctcgttttgacaaggcgaagttgctgaaattagctaagcattatcccgatgactttaatcaccaagatatggtgactcttgagcatgaacttggtctctacatagataatatactccatgatacaaggttttctagcttggacaaaataggtgatctagctaaactgatggtggatacaaggaagcacctctcctatcctttggtatatcggcttttgaagctagctttgactcttcctgttgccactgccactgttgagaggtttttcagctatgaagattgtgaagaatgctttgcgtaacaaaattggtgatgattatttgagccatagcctaatttgctttgtggaaaagggactgctggacgaaattactaatgaagtgattgttgatcggttttcataagatgaaaga

SEQ ID NO: 70283 - DNA, 278 bp, Triticum aestivum
  unsure (1)..(278): unsure at all n locations
  Clone ID: PAT_TA_70283
ggctgcaggnaattcggtacgaggcacctcgccgtcgcgtaccgggccagctgccgcgagcgccgccgcctgctcgtctaccggatcgacgtggaggccgtacggctgaaagggggccaccagacacccaaggggctgaagcagtgcagcgtctgacatggtgttctcaacttctgatccgtacttgtagtacagtagtagtaggtggagatagtttttcttgctagccaaaattttgtcaagttattatgcaaaaattgtgaggtccaaaaaaaaaa

SEQ ID NO: 70284 - DNA, 620 bp, Triticum aestivum
  Clone ID: PAT_TA_70284
agaccggaacagcataccactctacctccgcaccaccggtgagcttcttctgccggagtggacaagacagggtgggagcgccaccacgtacgaggacagaggaagacgaccatcgaggcgacgcaggacttattcaagatgagtgatccatgtgaatgctgccagatcaagcttaagtttctaaggcagatcaatggcaacttcatgcacagcctggtcataccggagtggtttgtgaaccaatttggaggaaagatctggagaactgtcaaactagagtcccctaatggtaacgtctatgatgttggagttaccgagaatatgaaccgaacaattttgaagtctggatgggcatcatttgttgatgccaataaaatagaagaaaattattcactgatgtttcgttaccttggaaacacccgcttcaaggttacaatattcgattccagtggtaagcagaaagcgtcgtgctgtgctaggatgggaactgctgcttctgatgttaggaacccaagcacatttgatgttgataattctagtagttcttgtggtggtactactcagtcttcaccaagtgaaagatcagattcagatggaagccaaaaggaaagctcgtacgg

SEQ ID NO: 70285 - DNA, 636 bp, Triticum aestivum
  unsure (1)..(636): unsure at all n locations
  Clone ID: PAT_TA_70285
aggaattcggcacgaggatacnacctttgctctcccttctttcccttccctggctgggccttcccactagaccaattgatggatcgatgcatatgcacatcagtgggaatggacaccgtgctgagctgagcttatatcaacatcgttcgtatacctattacctagtcacttccaatatagtcgatctcatatttctcatgtgaaagaggaagaggagagcgctcgaccaaggagtagaagcaactgtagtaccagatcaagaagtagatcttgctagctaggaacatataaagtactcaagtgcaggcagctactagcgctactgcactcgccaatgttgccttaccaccctaaccctcacggcttctggatctcccgagaaccgcccgcgcaggtgccaaaccctgccagcggcttcgccatggcgcctcccgcgcatctggaccatcagattcagcactacgaccacttcttccccggccacggcaatcagttcaactccgagacgctggaggcggtgctcatgaggccacgtccgccggctcctcctctggtggagatgccgccggcgaacgaggcaagaaccggcgcagtgcaggccgccggcaccggacacgccagggccaggaagaggcc

SEQ ID NO: 70286 - DNA, 564 bp, Triticum aestivum
  unsure (1)..(564): unsure at all n locations
  Clone ID: PAT_TA_70286
gagggtggtttgtnaggctgtgctcatggtgatttcagctgcggcggcgccggcactcgaatccggaacgacgtcggcggccaatgatccggcggcgcgcttgggggcatccgtttcggcctatggcggcgccgcggcggcagggtcgggagttggctcgccggattcggtggtgcggccggtctctcctgatatgcgcccgtcggaggagggggtggcacagcaggcggcggagagggctttgtctgatatcgagttctccggggggtcctgcacaaccttcagctctggcggcggtgatgtggcggccggaagcgccgacggcgctcctccgcccgtcgtctcgcgctgctcgattcagtctgtacaacacagtgacaaagcttccgtaaacaccaccatccgcgttggctggaagcgcaggccaagaggcccgcaaggaccagccgagcgggcggtagtggttgatcgtgtgccagcacttgaatctgccatacgaggattcactgacaggaggactgaggtggtagtgaacccggtgcttggcacaatattcgattctct

SEQ ID NO: 70287 - DNA, 663 bp, Triticum aestivum
  unsure (1)..(663): unsure at all n locations
  Clone ID: PAT_TA_70287
aggaattcgtncgaggatggtcttaacttccgggaggaggaacgggagagccagcagagcctgctggccagcatcctctccatctacgacatggtggtcatggattacccgaggcagtacgagggctgcccgctcctcaccatggagatggtccaccatttcctcaggtccggggagagctggctctctctgggccagcacaacgtcctcataatgcactgtgagcgaggcggctggaacgtgctcgccttcatgctggcgggcctgctgctgtaccggaagcagttcatcggtgagcagaggacgctggagatggtgtacaggcaggcccctcgcgagctcatccagctgctctcgccgctaaaccccatgccgtctcagataagatacctgcattacatatctcggaggaacgtgagcgcagaatggccaccaggtgatcgacctcttaccttagactgcgtgatactaaggaataccccgggctgtaatggggaggatggatgtagaccgatattccgtatctatgggcaggatcctctacttggtacagataacagccccaaggtgcttttttcaacaccaaagaggagtaaatatgttcggcattacaagcgggcagactgtcaattgattaagatcgatatccactgccatattcaa

SEQ ID NO: 70288 - DNA, 651 bp, Triticum aestivum
  Clone ID: PAT_TA_70288
gcgacgccgacgacccggcggccgtgggtgggggatacgcgggcggagacgaggccggggggagcgtcgaaggggaagagcagctggaaccggacgacggcgatggccggcgtctcggggaggaattggaggattctctcctcatcgccggcgatcaagagtgccatgacagcgacggcggccagcagtcaagcgagaacaccatgtcgcaatcgaatcagtcacggcggctgcaaatcagaacacacacggggtggatggaatgccgccatgacatcggcaccttcgcccccggcttgctctccatctacgaatccctcaagccgtcagaggatcacatgtccaagcagagccggctcatcgactccctaacaaagtcagtgagcaaagaatggcccaacgcccagctgcatctctacggatcatgcgccaattcctttggaacttcccacagcgacgtcgatgtctgcctcgaaatcgatatcggcacggggagcgaggtggagcttcttctgcggctggcggagatcttgcgcggcgataatttcgacagtgtggaggcgattaccagtgctagagtgcccattgtgaggatgttggatgcagggagtggcttctcttgtgacatttgcatcaacaatctgcttgctg

SEQ ID NO: 70289 - DNA, 660 bp, Triticum aestivum
  unsure (1)..(660): unsure at all n locations
  Clone ID: PAT_TA_70289
gaggccttaaggttaatgagnatactgggggaagcgccgtggggtgtactcaaacgttatgggattcttgggtggcataaattgggcaattcttgttgctcgtatatgtcaattgtatccaaatgcatcgcccagcatgttgatatctcgttttttcagagtctacagccagtggaagtggcccaaccctgttacactttgccatattgaggagggtcctcttggcctccctgtttgggatccaagaagaaacttcagagacaggggccatcagatgcctataattacacccgcctatccttgtatgaattctagttataacgtatctactagtactaggtatgtgatgatccaagaattcacacgaggatacgagatctgccaggcaatagatgaaaatagagcaacctgggatgatttattcgagccatatccattttttgaattatataaaaattatttggaggttggtatcacagcgagaaatgaagatgacctcaggaattggaaaggttgggtagagtctcgccttcggacgcttgtattaaagtttgaacgatatactcatgagatgctccttgcgcatccgcatcccagagatttctcagatggatccaggccgcggcatagtttttacttcatgggtctttggagaaaaca

SEQ ID NO: 70290 - DNA, 583 bp, Triticum aestivum
  Clone ID: PAT_TA_70290
gtttagaacaacaacaaatttcatctgtatataacaggggtataaaacgaactaggggaacaaccagtacgaataaaccctaagagaatccaacagcatcagatcaagaccaacaaggtgggctagctgcagaacgagccagccgcattcttttcagtatatgtcgactgggagagagaaccctttcatctttcgaggacctcttcccagggcaaggcgcaaccctcctggcgcatcaggcgatcgccgggcgcaacatggtgcgctcaagactttggccgcccataggttatcaccatcacatactctcccccagaggagcctaccgacgtctgtaaatggcgcgacgggccaaccctcagccacctatccatcaggttgtgcaccggttgtatggggtttattgactgcccacagcagctcagttcaacctcagactcacttccaagactgagcttctgcataatatacctttggatggatgatgcggctatacttccatcttttattctcaaataatgggcaggtatctgtggcaaaggtgggacacctttctgctcaaacgaggcaatcaatgagaacc

SEQ ID NO: 70291 - DNA, 583 bp, Triticum aestivum
  unsure (1)..(583): unsure at all n locations
  Clone ID: PAT_TA_70291
tgcttagcttagcacagtttgacatggatncagtaacaatgtcaaaacacatggctaaacttaagattgctcattacaaatcatatggattcaataccatctatttgtaagcagtctcttcagatcttcgtcatcgtcagagaagtcgattgttttgagcatatcctcccgtgctctgtcgctatctgctcggactcgggccctcttagcaagaaagtcatcatcaacctcgacgtatccattcttggcgtactcactgcgtacccaggcctgaaatttggaatagtcctcaccaattttatagtaggcacgcacaccagcataataagccaccatttcctcatccatctcctcttctggcgaaggaatcaagtcagggttctggagcttcagggccttgaagtcagacggggcatcacggtcatcatcgatcacacgggcaaggatccaacacttggtgaattctgcttcacaatgataggaagagccgacatcgaaggatcaaaaagcaacgtcgctatgaacgcttggctgccacaagccagttatccctgtggtaacttttctgacacctctagcttca

SEQ ID NO: 70292 - DNA, 632 bp, Triticum aestivum
  Clone ID: PAT_TA_70292
ttatatagcctgtgtacatgtcgttggatgtccgctacaaacggacgactagtggatgaattgccacgatcagccgtatgatagggacgaccaagcgcgaatttcaaaacgttatactacaagggacaggtcaaacagactgaagaaatgatatacaagttctaccgcctaagcttgtataaacaaccatttctattgtcccacagagaagacagccctttctattgtcaccacagggaagaacccatttttattgaccaaaaatttattttacattttgctcaacactagttacatataacttaattctacattttgctccaaacgaactattattatgttagaactatacagctttgtccccagggatgactttctccgggaatccctctgttacaagtataacggtgtattcgatggccttcttgttgctgcaggtttactggcatccctggtaactaatgcccagggcaacatacatatccagtgtgcatctgccatagagaaagcaccaggttcttctggtaaaagaggtcatcatttggcactggcagtttgtggttgtgattgaagtgagatgtctagctctttgattggatgactgagctcatctttctcattttctgattccc

SEQ ID NO: 70293 - DNA, 592 bp, Triticum aestivum
  unsure (1)..(592): unsure at all n locations
  Clone ID: PAT_TA_70293
agtttacctactgtgaattgtctgtttngaattacaaaatgttcaacaatgtccaagtttttttgtcacaacatgaaaaaatattgacgttaaaaatatcctggagagtgagatcatcaaatttccctattgtgaatccatgcagttgcatgccataaagaaggtttgagattgctctttccaggtgaccacagcatagaacatgagtgtgtactggtcacagtgaactcattgcagcctgcagctggcacagctcatcttccagcagagaatagtcctaccaaatcagttttctctgcgacgaatcacggcccatcttctggcaggtgaatgcacctgacacaatttcatcttttctttaatgcaaccgagttcattcatttattccgtttaccagaatgttcaaacagttcatcatcagaaccttcaccttcctggcagaaatgttatctgaattttcaggtgtttccgatgtttagttttcataattgtagggctcgaaaagggttgagcaaggatcatcatcatgctgcagcatggcagcggctctctcaaactcctccctgatgatcctgattgtctgcctgtcgac

SEQ ID NO: 70294 - DNA, 600 bp, Triticum aestivum
  Clone ID: PAT_TA_70294
agcacaaccgccgccaacacaacacctcgagagtcctcgccgccggagaagtcgcaagcaagatggccggaaggaagggcggcgacaggaagaaggcggtgacccgctccgtcaaggccgggctccagttccccgtcggccgcatcgggcgttacctcaagaagggccgctacgcccagcgcgtcggctccggcgcccccgtttacctcgccgccgtcctcgagtacctcgccgcggaggtcctggagcttgccggcaacgcggccaaggacaacaagaagacccgcatcatcccgcgccacctgctgctcgccgtccgcaacgaccaggagctcggtaggctgctcgccggcgtcaccatcgcccacggcggcgtgatccccaacatcaactccgtgctgctccccaagaagtcccccgccgccgccgagaaggaggccaagtcgcccaagaagaagaccaccgccaagtcccccaagaagaaggtcgccgccaaggagtagccgcccgcacccatagcctagccagtgttgcttagatccatttctcatggactaagatgagatcctgtatgtaatgcctgctagtctgtagtgcccg

SEQ ID NO: 70295 - DNA, 402 bp, Triticum aestivum
  unsure (1)..(402): unsure at all n locations
  Clone ID: PAT_TA_70295
ggnctgcaggnaattcggcacgaggnagnaactccctggnacattctggtggaaccaccaacaagcacgacatcatggatggtgctcttgtccatcttggcatccctcaggcacttctccactggctccatgcacttcctgaagaggtccatgttgagctcctcaaacctggccctggtgatggtggaatagaaatcaactccctcgaagagtgaatcaatctcgatggtggtcaaagtcctccccaccaaggtgagtgtcaccagctgtggccttgacctcaaaaataccctcctcaatggtaaggagagagacatcaaaagtgccaccaccgaggtcaaagataagcaccttcttctcgatctagctagagccatggcagccgaccaagggcgaggggcc

SEQ ID NO: 70296 - DNA, 673 bp, Triticum aestivum
  Clone ID: PAT_TA_70296
ttaattcaagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagggttccgttactaacatgtttacttccattgtaggtaacgtatttggtttcaaagccctacgtgctctacgtttggaggatctacgaattccccctacttattcaaaaactttccaaggcccgcctcatggtatccaagttgaaagagataagttgaacaagtatggtcgtcctttattgggatgtactattaaaccaaaattgggattatccgcaaaaaattatggtagagcgtgttatgagtgtctacgtggtggacttgattttaccaaagatgatgaaaacgtaaactcacaaccatttatgcgctggaga

SEQ ID NO: 70297 - DNA, 921 bp, Triticum aestivum
  unsure (1)..(921): unsure at all n locations
  Clone ID: PAT_TA_70297
caggaattcggcacgaggatccaattgaacttgaatctggtgatggtatcatcgttcaaggtcaatcatcacttcatcctactgatatggatgttgacgataccccaagtaaagatgaagaggctgaagcatacaacaaaatggatgatgaaccttctagttccagcaagcaaaatcaatcgaatgcagatgatttaaggaacaatattcctaattggactggttacaatttgcgtacccctgatttgaatgatatgcttttccacaatgaagatgatgcagggccatcttcttcatactatcatcctagtcccttcccttgtgatgatcctgcatctcctgcatctcctgagtatgtaagcgctcaagccccggctacacctggcttaatggaagaaacagttccttccagagtgcatgaaagtcctgttctgagtccgcaaaggaaagcttcaccatcaagcaacgaggaagctgcaaaggttgacaattttgctgctccgccctcagattttctccattcagctgcagcaaatgctaatgatgctgttggtgctgggatggctgaatttggattggctaagcctgtgcaagttgagtcttctggtgccgtacaggagaatcttgccgctccatcctcagatattcttcattcagctacagctaatgctaatgatgctgttggtgctgagatggctgagtttagcttggttaagcctgtgcaagttgagtcttccggtgcagcacaggagaaccttgccgctccatcctcagatttgctncattcagctgcagcaaatgctaatgatgctgctagtgctgagattgctgaatttgggattggctaagcctgtgcaagttgagtcttctggngctggagctncaccctcggattttnttcattcagctgcagtaaatgct

SEQ ID NO: 70298 - DNA, 250 bp, Triticum aestivum
  Clone ID: PAT_TA_70298
atcccgtggcggatcagcggctgcctgtctgaaccggcaacgcatctcctccctcccccctctccagtctccctactccgacgatctatccgtcgagcctcctcaccgcgccactcgcagcagcgccggagggggaggatggggcggccgccgagcagcgggggccccgcgttccggttcacgcacgcggaggtggcggagatggaggagcacctccgccacctcaacaatgccatcccgcagcgcaacg

SEQ ID NO: 70299 - DNA, 555 bp, Triticum aestivum
  Clone ID: PAT_TA_70299
gtctcctcctcctcctcctcctcccgccagcgacctccactgcgaccgacaggcaggaccgaagcctccggcaaactctgatgtgaatcatcggcatgtgagcgcggctttcaagctatcctgcttggcccgattactagtttcgtcgtcagttagcacaaatggcggaggctgtgctccttgctcttggaaagattgggaaggttttaactgatgaggttgccaaggccttggtggccaaggtgttagcaaaagttggtaacctgattgatctgaatgacaagattgggcaaatagaggttcagttaaaagccatgaacaatatcatacgggagattggcacaatgtacctcaccaatgagttcatgaagggttggattggggaggtgaggaagttggcctaccgcgttgaggatgtactggacaaatactcatatcactctcttcaaatggcagaagaaggttttctgaagaagcgtttcctcaaaggatcacattatctcctggttttcagtcaaattaccgaagaggtagtcaagatagagaaggacatca

SEQ ID NO: 70300 - DNA, 693 bp, Triticum aestivum
  Clone ID: PAT_TA_70300
ggccatttagggtcgagccgtgtaggtattcttggatctcgttctctttcgacccctattgataaggttgtctgttcttatatatactgtacaatcgggtattgattgtgatatctacgatgcttttttttaagaagaagattagggattccactgttctgtacaaacatagtatgattagctccatacatgtattttcatttcgtagaaaaaaaactttctgagcgaaggggataaatttgtcaggacaacaaaattatgttaagactagcactgcacttgcttgtacatattaagatatgctatttgtgatcttgaagttgaaagaaaactttttttaggaaaaactccagtccggactacctaagaaaaattgaagaaaacagtgatcataaaggatgatcaaaatcacatgtataaacaaactgtaaagaatggtagaagacatcaaagctcgccgcacgaatcgtgcaggttgctccactagttttgtgaaatagttcttccataatcatttaggcccaattagaacagtgatgattgcttgtggtgtaagtgtgttgtcataagtttggctttgactgttgttccttggttttggtatagaaattgctcgctgatttgttgattctatctttctttaatttagctgtatgaaataagcacctctgattcttggttgatctctatggt

SEQ ID NO: 70301 - DNA, 656 bp, Triticum aestivum
  unsure (1)..(656): unsure at all n locations
  Clone ID: PAT_TA_70301
ggcacgagggtcgtcccccgcgcgcgctacttcacgcgggnacttgggctcgcgaggccgccggaatcccgcgggcgaggctctcctctccccgccgcgtccccagactggttgatctgtatgatgacattcgtaaaatgatactgtattttaacatatatttgagatggatgatctgccagatggtgaagggcaatctgatatacactctactgacgcaaattggctgtcctcacatgaagagcataagttccaatccatttccttggctaagcaggaccacaattcggatttggcagattcttctcttaactgtatgaaaggtgaccattcattttgcgcttctcaggaattatggtctactggatctctatcgagtccaatacccaatggattttactcaattataccggataagaaactgaaggagtgttttgacgccattccttctcctgatgatctatattcccttggaatagagggcttcaaggctgagataattcttgtggacttagagaaggataaaaagctatctgcgataaggcagctatgtgtagctctggtaaaaggattgagttctaacccagccgcaatgataaaaaagcttgcaggtttggtttgtgacttctataagcgaccaaatccacagctcagcc

SEQ ID NO: 70302 - DNA, 491 bp, Triticum aestivum
  unsure (1)..(491): unsure at all n locations
  Clone ID: PAT_TA_70302
gccttacaaggatcatgaatggatctttacttatctgcgatttgtgcttctaactttccatcatagtgtgtattttgataagcctgttgttcacttnatgtttcctctatctatgcttgcagattcaaataaaatattcacatggcatcagcgaccaaattatttatcttttaaacttttaccaaagggacagaactttttttctgatcaacaagaggtggaggaaacaacaaatacaagaatctatacataatggacgcagaggccggggagaacgctggtgaagcggaacggataacagatggcgattggactggcacacacacactgccaatgatctccgaacagagactggatcgtgtgttctcatcaaaccatgacaggcctgcggatgcgccggagcttgaccatggcctagacccagggaacttcgttgtttacttggtaaacacaatcgaccgctctgtggtgagggtaatccagagcgggta

SEQ ID NO: 70303 - DNA, 623 bp, Triticum aestivum
  Clone ID: PAT_TA_70303
gcttgtgcaggccgcctactcccctcctcggctggagcaaggtgccgccgtccctccatcctcgcgacgccacctccttcctccgctgccggcagaggcgaccggctagggttcagttgccgccgccaaaacggaagccgtgctgcccggcgagtggcccggcgccccagcaagttctccttctccagctatcttctcatccccgttcctctctccatccctgctcgtcccctcctccttgaccgcctctcttctcctctgaaggagcacgaggtctgctgctgctcctgagccgccacaaggacgtcaggtggaggagatcccatgccgacgggccgctcatgccggtgtccgagctcttggatccgttggattcaccgttgctgtacggggacgggtcggcaggggtgctggtgttggcatcgggaaggggaaggcgtcgccgatgaggatgtgaaggaggacgaggtcgagccgggtcggtgaagggtgcggccgttggctcgcttgccaagcggctgcctctctcctcctcgtctttgacgccatgaagaagatcaatgttgagaaggatgcaagctacaggagcagcagacgcgtcgtgtgagccttgggtgattgat

SEQ ID NO: 70304 - DNA, 594 bp, Triticum aestivum
  Clone ID: PAT_TA_70304
gcatcaatctgcctaggcaatccacgacaaacacgaagagtaaggggatagggggtccccttgtcggagccctcttcgacgaagaatctgttctgtagtgtttgaatttaccaagatcctctttgaagcagagtagaaaagagcggagatccgacccctccattttggcccaaagcaaggcattgaagcagcttaagaagatattcccaggcaactgagtcaaaggctttggatatgtctaacttaagcataactgcagggatcttcttttgtcttagtgtctttgccatggcctgaagccttcctatgggctgagtccgagtccgtctatggagaaaagtgtcttgtacgatgcacacaagtctgctcgcccatcagttttggcggacttggcatccctgacctgtttttgtcaaggttgggcgctcaaggtttgctggttatggcaggatgccattgatcctgataaaccgtggcaagggttgcctctgccggtcgataagcaggtcaaggctctcttcatggctagcaccactaccaatattggttgcggtacgaagatttgtttttggcacgaccactagctcgatgata

SEQ ID NO: 70305 - DNA, 311 bp, Triticum aestivum
  unsure (1)..(311): unsure at all n locations
  Clone ID: PAT_TA_70305
aacgaacgagacctcagcctgctaactagctatgcggagccatccctccgcagctagcttcttagagggactatcgccgtttaggcgacggaagtttgaggcaataacaggtctgtgatgcccttagatgttctgggccgcacgcgcgctacactgatggggttcaggggcgacgacttgccggtcaccggtggcggtatcagtgaaaaaggcaggttcagttatgggtttgcaagctgtgctgggaaaagggcatntatggaggatttctacnagacaagagtggatgatgttgatggagagactgtngg

SEQ ID NO: 70306 - DNA, 619 bp, Triticum aestivum
  Clone ID: PAT_TA_70306
gcagagagagactgtcatttgatgacttcatgcttgatcctcttgtggagcaattctctataattttaaattcaccggtgctgtccccaaatcctgatgactggagcatgcagatggaggtgttgaagtgtttactccagcttatccagaacttccctagactacctgaagctaaaatttctgctgttcttgcgcctctgtggcagacctttgtttcatccttcaaggtctatcacctgtcaatcattcaagcttcagaggatgttgataatgtcggatatgattctgatggtagtgaaagaagtcttgaatcctttgagattcagttatttgagctatggacaacaattgtgggaaattctatgttagcaaaggttattgcaggaaacattaaagagctagcatactacactatatcctttcaacagataactgaggaacaggtgcaaaactggtcacgtgatgctaaccagtatgttgctgatgaggatgatgtaacttatagctgtcgtgtgtctggatctcttttgctggaagagatagtcactgcctacgaggattatggaattgatgcaattttggaagcttcacaagtttgttttcgtgaatcacgtgaatt

SEQ ID NO: 70307 - DNA, 676 bp, Triticum aestivum
  Clone ID: PAT_TA_70307
attcggcacgaggcaccgcctggtcttctcgatggaggtggaggagtaggggatcccgccggatcagaggcgtgcgggcaccgtggtgggcgtctccggcagcgacggcgacctgcagctacggcgggggcgctcgatttagtgcagcgccatggaccggtccctgcagaagtgagagaagatgagggagagagagaaggaaggagaggagcatcgatggtggttcgagcgctgccgcctccatcctcgcaccatcttcgtcacacgcagccgcctccttccgcacccctcttcttcgcgcacggcaacagaggcaagtcctgtcagggaataatattattcaggtagcatctttttcgtggaagaggagtgagaatttaaaggtgcatgctacatagaagcttagatctgtaatcaagctgtggaagagaatactgtaagagatacttctataagtagagacttattgtttttcattcagttgaagagctctccatgcttaagatcttttctaggataattgcgtcgttaaatatgaagttcaggattcgctcatgtgccaaagccagctcggggaagccttcctggactcctggttgaccacgacaatcacgacacggtgagtggattttgaatctttcttgagccgtcggatcggattagatgtgtatatggt

SEQ ID NO: 70308 - DNA, 646 bp, Triticum aestivum
  Clone ID: PAT_TA_70308
ggaaagcagaagcaagagcttgtcgcatgggcgatgcgcgagcatttgcttagcaacaacgtaaagtcactgggcagtagcacctcaaagaagggggatgactctcagaaggcaattgttctctctgctgcccctcggagcagacggctgaaacggaagcaatcatcggttacgtcggaggagcacgggcttttctctccggggaggagttgcaacaatgcaaactcgccgagaagcaacacctccaggaaggacgttcagagattcagtgtgcagccttctgcatctcagaagaaaccgaagctagggcaaggcctggccgcgttggagaagcacatttcccggcctgctgccactcaaagcacggtcaagcagccggccaaatccagctcctcgatgaagacacggaggcagcatcggcctgaagactctccgatgataaccgttcagcctgccgcccctctgacccggagcaaacggaagcaatcgaaccgggctgcgccggcgaggcaggcggcgagaagcgaagctaggggctctgccaaggagaaagagtacgtttgcttcagcctgtggctgaacttctatgaatcagagtgctccagtggatcggccgagccgctcgtgaacaagagaacggtgcaga

SEQ ID NO: 70309 - DNA, 654 bp, Triticum aestivum
  unsure (1)..(654): unsure at all n locations
  Clone ID: PAT_TA_70309
ctgcaggnaattcggcacgagggctcgtcgtctcgcgtgagctcgacccccaaccgatccgggcatcttctccggccggccgggatctcccgccgtcgtgcaacggccgagtggccggccgggctgggaccagtttgtcttcgttccggtgaggggtgagttcagagttgtagcgccggcgggcggcgaccggagtggaggagggaggcgggggtttgcgtccagtatcccccgcgactgcgacgccggatagcggaagcggtggcggaatctggcggccgacgctccggttgatcggtctgaggtggggggcacagctaatcttggcgaaaaatcgggggttcaactaaagccattatgcctcgcgctgaggttgcttttgcaatgcatgccggtgatggtgaagtagaggcagggttcgctaagctgcagggtgaggattttgagtactacatgcagacctactcgatcatgctgggccgcagcagcaagaaatcgatggtggatgtcgatctctccagccttggtggggggatgaacatttcgcgccaccatgcgcggatattctacgacttccagcgccgccgtttcgcgctcgatgtcatcggcaagaatggctgccatgttgagggcgtcctgcatctccctgggaat

SEQ ID NO: 70310 - DNA, 622 bp, Triticum aestivum
  Clone ID: PAT_TA_70310
aggaattcggacgaggccaaatttcgttccaaatcgcgccgcctgctgccatcccatcccatcccctcgcctctgcttggacctcctccgcttcctcgcccttcttgacggacggacatggctgtttcctcatgggttccaccttctcttcccgagtccagcgccgccgcctcaggctcaggcgagtcaggcctggtcctcctcgacatgtggtgctacatcgccgaccttcccaacaacaccaccgccgagggcaccaccagcaccggcttgcctatcaaggtgaccctccgcgccgcccgcccgccacatctctcccacttttgtgtccactgccctggcctcgacttccgcataacagggcccaagattgtcgccaccgacgcacatctcgtcctcctctgcgttcccatccaccccaacagcgccaccggagcattggactgggactacttcgtctacagcccgcgcgcccagcggctagatctgctacccaacccggaccccatatgcctcaacgactccgcaactgccctcattagccgccaagacggcgcttggtatgccgtcgctgctctcggttacgctaaccccctgtacgatggcggcgcgctcattaggt

SEQ ID NO: 70311 - DNA, 589 bp, Triticum aestivum
  Clone ID: PAT_TA_70311
acagcccccaccaccgaagctcccaaccccacccgaagcggcagccatggcccccaaggcagacaagaagccggccgcggagaacaaggtcgagaaggcgacggagaagacccccgcgggcaagaagcccaaggccgagaagcggctgccggcgggcaagacggcgtccaaggaggccggcggcgagggcaagacccggggccgcaagaagggcagcaaggcgaagaagggcgtggagacgtacaagatctacatcttcaaggtgctgaagcaggtgcaccctgacatcggcatctcctccaaggccatgtccatcatgaactccttcatcaacgacatcttcgagaagctcgccggggagtccgccaagctggcccgctacaacaagaagcccaccatcacctcccgggagatccagacctccgtccgcctcgtcctccccggggagctcgccaagcacgccgtctccgagggcaccaaggccgtcaccaagttcacctcctcctagactgacgatgcgtcgcttgttgtgacagatgtggctgtctgatgtatctgcaagtagaagtagtagttcgtgtggtagaag

SEQ ID NO: 70312 - DNA, 611 bp, Triticum aestivum
  Clone ID: PAT_TA_70312
gtctgtcccgattcaaggtgcggcggaccgaccacgtcgaatccatccagcccggattcatccactccgtgaatcgccgtccggctgttcgtctcttgaaactgctaccgtgggtttgaaggaagtaatcactcttcagtttctctccaaccattcatgacggatgatgtgcgcccctcgcggtccttaatggatgcctggctctttgtttctcattcttccgctgtgtatatatgcttcctctaggctaacttttctaactccagcgacagaacatccatcagcatggtgctcttctaggttcccctctgtctttattttttatcatccatgtacgatatttgcttcttccacccaacttgtacaggtattgttcaaactgggagatggtcgattgattcggccagatattggaaactggttctcgcattttttttctgaaattctttaggtgatagttctaatggcttctggacaggtaattacttcacttggactaccagatttcatttttcgattcatgttttaccatccatgtttttacagcatagaagattaattactcatatatctgttatccacaccatggttcttctatttgttgctgtacg

SEQ ID NO: 70313 - DNA, 592 bp, Triticum aestivum
  Clone ID: PAT_TA_70313
cacgctccaaccaccagcacccatggcacccaaggcggcggaaaagaagccggtggccacggccgagaagacgacggcggggaagaagcccaaggcggagaagcgggcgccggcgtccaaggaggccggcggcgaggggaagcagcggggcaggaagaagggcagcaaggccaagaagggcgtggagacgtacaagatctacatcttcaaggtgctcaagcaggtgcaccccgacgtgggcatctcctccaaggccatgtccatcatgaactccttcatcaacgacatcttcgagaagctcgccggcgagtccgccaagctggcgaggtacaacaagaagcccaccatcacgtcccgggagatccagacctccgtccgcctcgtcctccccggcgagctcgccaagcacgccgtctccgagggcaccaaggccgtcaccaagttcacctcatcctaggcttcatcgtcgtcgttttaacgaatcgatgatgatgttctgtatgtagttggcagtacgatgttacaatatttgtaaggattgtgctgcctgtgtgtttgaagaaatagtgatgttgctgtttgaaaaaaaaaa

SEQ ID NO: 70314 - DNA, 503 bp, Triticum aestivum
  Clone ID: PAT_TA_70314
cgttaacgaacgagacctcagcctgctaactagctatgcggagccatccctccgcagctagcttcttagagggactatcgccgtttaggcgacggaagtttgaggcaataacaggtctgtgatgcccttagatgttctgggccgcacgcgcgctacactgatgtattcaacgagtatatagccttggccgacaggcccgggtaatcttgggaaatttcatcgtgatggggatagatcattgcaattgttggtcttcaacgaggaatgcctagtaagcgcgagtcatcagctcgcgttgactacgtccccgcggaggggccgaatctccgaggaggagggacgagatggcgtcccggcagcacaacccgaaatccaagacgctcggcaacaaatacatgctgggggacgagatagggaagggcgcgtacgggcgcgtctacaaggggcttgacctggaaaatggcgacttcgtggccatcaagcaggtctcgctggagaacatc

SEQ ID NO: 70315 - DNA, 660 bp, Triticum aestivum
  Clone ID: PAT_TA_70315
ggttattacagaagcacctgctactccgacgacgattcatatttttggatttcactagactggcttcgccaatgggcggataatgctacccctccctcttccattgacaacagtccaattcagtgtgaacatggaaaagttccagcatctaaagtcacatccatgaagcgattatcggctaaagcttgggagaagctactttccaagtacggaggaggaccaacactcagcaaggatgatgtttgcaaggagtgtctcaaggatgtagcaaaaactgcagtttctgctgatgtctatcgtgatcggaaagcatcgttaaagaatcttgcagaagctgcacttgctggaagtattccagaaggtccttcttactttatttcgaaggcatggttgtcccattggctgcgaaggaaaaatgtggatatcacttttgatgctgataagggaccaacaagtgctctaagatgcagccatgggaatcttcttccagagcacgcttctggggcaaagcgggtatctgtgccagagagcctatggctatttctctatgaaaccatcgcaagggaagctgatgatattgtgacttttccgtcagatactcaaccatgcgaaatctgtgacgacaaattgtcagctgttgcttctgttgaggataatctt

SEQ ID NO: 70316 - DNA, 129 bp, Triticum aestivum
  unsure (1)..(129): unsure at all n locations
  Clone ID: PAT_TA_70316
ggtgggacaaggcatcttgccaagcaaganttggtgctttggacctgagacgacnggccccaacatggncgncgacatgtgnaagggagngcagganctnaatgaaatcaaggactctgngggggctgg

SEQ ID NO: 70317 - DNA, 177 bp, Triticum aestivum
  unsure (1)..(177): unsure at all n locations
  Clone ID: PAT_TA_70317
tctacactagatttgagatagaaaatangaactaggaacttttctgagcttttgtatgttccgnctacatcacaagcggtcttncgattgtgtcgagtgcatcacaaaggcgcaggaggaaaaaggaagaatcagccaaaatctgacaagatgcaaaggcacatatnaagtgtgggc

SEQ ID NO: 70318 - DNA, 605 bp, Triticum aestivum
  Clone ID: PAT_TA_70318
aggaattcggcacgaggggcggcggggctgagcagggagtgccggcgcaggctggagacgctggtggggcggatgctggaccaggccacgctcgacgacctcctcgtgtccggcgacggcggcggcgtgtacgacgtgagcctggtcatgcggctcgtcagggtgttcgcgagctccgtggaggaggacggctcgccgtcgtcgtcgcagaggatgaggaaggcggggaagctggtggacaagtacctggcggagatctcgccggaccaggggctgcgggtgtcccggttcctcgccgtcgccgagagcctgccggactccgccagggactgctatgacggcgtgtacagggcactagacatctacctcgagtctcacgcggagctgaccgtcgaggagcgcgcgacgttgtgccggtgcctcaactacgagaagctgaccctcgaggcgtgcaaggagctggcgaggaaccggcggatcccaccgaggattgccgtgcaagcattgtccttgcagcggccacccaattcgctccagagccccttgtcgtcgcctacaccgaagcgggtcatgtcggatgacgagaaggagaaggagacactaag

SEQ ID NO: 70319 - DNA, 645 bp, Triticum aestivum
  unsure (1)..(645): unsure at all n locations
  Clone ID: PAT_TA_70319
ggnctgcaggnaattcggcacgaggagacaactcaaattcctaaaacgagtcgaagtgctcgtcgtaagaaaatcaaaaggcaacttaggaagcaagagaaagaaaagctgaaagagaatgtggactgccaggaatcagccaatgctgctgactgtccatcctcaagcaatcacaatgatcttccttgcccgtcaagcaatgagaatggccctcacttgagccatgaagcagaggaggaagaatctgatgcatcagaagatattgttccagttgtggttcgtcctggtcacattcgctttgagccagcaggtgaaccaaatacgtcatcagcgaaggaagcacaggcaaatttcacgtggggtggaaccatgagcaaaaagaagggacagaagtggggaatgaacagctcaaacaagaaaagtgctgataccggcaatcttgggaaaatagttggaagtaatactgaagttaaccatcttgtggtagatagtagggatgaggaaaatgttttttctggggccagtaatcaaaaggtcgatgagatcaatcatgatctgttagcaaaggaaaaatctgttgctgaggaagggaagtctaccagcgaacctttggactttgaagctctgtaccccctaacacgtctt

SEQ ID NO: 70320 - DNA, 108 bp, Triticum aestivum
  Clone ID: PAT_TA_70320
tcggcacgagggttgtgttgaaactttgtaaggagcaccatcgttagatggcttgttaccctctcccatcaaggttggataataatatatgctttctgaaaaaaaaaa

SEQ ID NO: 70321 - DNA, 693 bp, Triticum aestivum
  Clone ID: PAT_TA_70321
aattcggcacgagggagagtttaaggcaaagtatgccattaacagcttgcaacatcctcatttgcgaatcatgtcccgtatgctacagagaaaggagtatgatgtatgctatcggcgacgtactgaagagatctacgattttttggtcgaacttatcaatttgaaaccttacgttaagcaaactgattgttcggatgatgttatggatcgtcttgtggaaagctgtcaaccacaatctgatctttggcgaagttatgcactaagggcagttgatattttccttgattcgttgttgattttctgggagcctcagtttcatcccttgatacgtgagcgccacaaggagcaactgctaataagtgcccgtgagttagctgaagggtgtgcaattattgagccactggaacctgaccctgatgatttcttggcgcacttgcggccatatgcatcggtatactttgagagtaagaaggaacagtttgggtattatacagcgaaaaaacaagtacgtctgcatgaagagttcgataattatttggctacatgcacatgggatgatgctattgacttgtcttctttcatggaaagtgctcgtagagatgatgagaagtttgcagaactggatcctgatcttgccaaaatgtcctttgagcggatgaccaatattgctgagcggaaacacaaaatgaactc

SEQ ID NO: 70322 - DNA, 691 bp, Triticum aestivum
  unsure (1)..(691): unsure at all n locations
  Clone ID: PAT_TA_70322
gcaggnaattcggcacgaggctggaaacttctacaggncaatatggcacataaaggtgttgataacactcagttggaggggcttctgattgttgaaaattctaaaggaagtcatgatgatgggagttttgagcttccttgtatgagtgagatcactcccgaagtagacttcatcaaggatgttcctaattcattatcggcttcctcttctgctaactatgctactgatctaggtaacagtagtatgagtgaaggttcagtaacaggaacatcagaggagccaaaaaacagcgaaggaggactagaggcaagtcaaattaaatcgttgattttagaggaacttgaaggatcttgtgtaactcaagcttctccaagggtacagagtaaatctgagcttgaagctgaaacttatggaagggaaaagtttagttttgtaggtgaatcttacctacataatgaaaatgagaagataattgaagtaccccgcgaatcgctaatctccgaagtagagaaagctgaaggtgaggtggaacttcgtccacacgcacattctgaagagtctgttccagatgaggatgttgagtgtcctgaagagagtgacattactcagcaaaccaataatccggtagtatcaaccatgctgaacgtgtttgagatagccagcaagttcatcaaaggagaccttgatcaag

SEQ ID NO: 70323 - DNA, 664 bp, Triticum aestivum
  Clone ID: PAT_TA_70323
ggcgtcgccgggctgccctccgtgggtattgccgaaatacaccgtctggatcaagcgtggcacgatgaaagaaatcacccattgggtacccctctgccgaagtgatattggtctgtgtcccatttgtcaaggtgaagtataccatgcctgtttcattgaagaccagctgtgagccgttcccaactgtattagatgcccagtatggatcataccgaaatgtagaatgctcggcgattggataaaacacaagatcaccatcagactgcacagctaagagaaaccggccattggcgtagtccgtggggatgagacggcttctaagtaccttgtcctgctgacccacaggaagcacttgcgtgggcaggatggtatcagccgggacatcaaaggtctcccactttgctttgccatctgcatcgacaagcctgaagtcgcctgtgtcgagcattctggcgtaggctgcaccagggacccggggactccagacttcatcgccagatgggttgcgaagggagagcagcccatcagccgtgagctgcagcacggagctggatggcacttgcaccggtgtgtcttgactgcccttggcgtaccaagcgacagtcttttcatggatcttgttgaaccagacggcgaggaggtacaaggaggggttaccttccat

SEQ ID NO: 70324 - DNA, 647 bp, Triticum aestivum
  Clone ID: PAT_TA_70324
ggaaccctcccccttggagccgcagggttccttccttctatcccctctgtttgttcccgtgtcgaggggcaacagcaacaacgaggaggaggttctttgccttctctgcgcgcagccagcagttcaaggcccttaagattaagattggcggtcactcttcgtcgatggcgaacacgggtttatcacggcgtaactcttgtccaaaggttcacagcgcattgtgcagtgagctgactatgatgctagataaaatctcctctattcttccatcaattgaggcagctcgaccaggatgtagagcaggaatacaggaattgtgcaacttataccatatagttgagaaaggaaggctcataactcagcactgcatcgaatgtagtaaactctacttggcaattacaggtgaggcgattttatcacggtgtgaaagggtcagagactcacttaaacggagtctcttcctgattcagaatatggtcccaacagtattagctaatcagattgctgacgtccacaatgatcttcgagatgtaaaattttctgttgatccactggaacaagaggctggcaaatcaattttagagatgcttcggcagtctgatgcaactgaagaacttctacttcagacattcatgcaggcagcttca

SEQ ID NO: 70325 - DNA, 146 bp, Triticum aestivum
  unsure (1)..(146): unsure at all n locations
  Clone ID: PAT_TA_70325
ggccgccgctacacctggnattcgctagccgccgcgaggctagggcgccctcgatccaatccgttgccctgctccttacggcgcatcgagggcggctgcgttgtagaggagggagcggggaggagacgaggtcgaggcggcgcggg

SEQ ID NO: 70326 - DNA, 593 bp, Triticum aestivum
  Clone ID: PAT_TA_70326
cgaggaaaacagagagcagccgccgccggctgttgaccccgccgccaccaattcaccaccgtcgtcgtcgtcgtcgccgccgccgccggggctccctccctccttgcctccgccactgatgggctatattctgttgcatctgtggcaaaaatcatttgcgcagtctgtggcaaaaatggccactgtagcatgtggtgttgccagcagaacaagtcggagaatcgcgcttgcacccgctgtggagagatagggcacagtaccagtacacatggtctcagttgctcaagctgtgacgagtatcatgaggatggagagtgccgattgggcggtgttaaatgctttctttgtgagtgtcaggatcattatcttgctaagtgccccttgaattcagtattgactgaggcatttcagagtcagagagagaacttccaagctgctctgcggcttgcactatcaaaacaacgcgacccatcatctacacctcccaagtgttccgcaaaatcagaaggaaaagtactggccgccaacaagcctaaatcgattgtccgatgtgtaaggtgtggtgaggaagggcacaggcgcaagaagtgtcc

SEQ ID NO: 70327 - DNA, 263 bp, Triticum aestivum
  unsure (1)..(263): unsure at all n locations
  Clone ID: PAT_TA_70327
gcagggaccagggagaccttcctgtttgaagattggtgggggtgaaaaatcggacgaggagagggaggcagcgtacgtcggggatgggacgaagtcacgaagaggttggaggaaacgtgagaggaaaaacgaaacactacgtttttttaggtagtagagaagataagtgacgggtctgtttaggacacatctagatgtgacatacctgatgtccattatgtttgtggtctatttttttttttgccctancttttttttngtnc

SEQ ID NO: 70328 - DNA, 537 bp, Triticum aestivum
  Clone ID: PAT_TA_70328
aggaattcggcacgaggatgcagtcccctgaatgttatcctcaggtgatgcccaagcctgttctaactatacttgagctgtcatttcctcttgcgtcatctgaccttggagccaatagtttggaaaacgagttcatgacaaggaagttgcatctctcacagatccaaaagaaaatagaagaaattgctgctctgggtcttgacacaactgcatttgaagatgaagcattcaatacagaggctgcacttgaccggtgcatcctgagactcatctctacctgctgcaatggtgataagctagtccgagccactgagcttgcaaagttactgacgttggagaaatcaatgaagggagcattaacacttgttacacgcttgaaacttcctacattacaagagaagttcagttcattacttgaggagagaatgttaaacgatgcaagaactgctggaacagtgggtgtttgcttgaatccggccagtacaaaccactcaccagcgctccatacaatccaacctgctaaaattgtgcaaaatg

SEQ ID NO: 70329 - DNA, 398 bp, Triticum aestivum
  unsure (1)..(398): unsure at all n locations
  Clone ID: PAT_TA_70329
gcttcaaggtgctcaagcaggtgcacccggnacatcggcatctcctccaaggccatgtccatcatgaactccttcatcaacgacatcttcgagaagcttgccggcgagtctgccaagctcgccaggtacaacaagaagcccaccatcacgtcccgggagatccagacctccgtccgcctcgtcctccccggcgagctcgccaagcacgccgtctccgagggcaccaaggccgtcaccaagttcacctcgtcctaggctcctcgtgcattagttcttgtgtttctttcctcttcgttgtctgatgaattctgtagctagctgtgtgtgttctgacagcgtcatactgtaacaatggtgctgcctgaataaatagtcatgttgctgcttgaaaaaaaaaa

SEQ ID NO: 70330 - DNA, 672 bp, Triticum aestivum
  Clone ID: PAT_TA_70330
attcggcacgaggcttctcttctctcctctccttaccttctccccaccaccgtcgacctcatcccctctcccctgccgtgagctctcgtcccgagcaagccgcacgaggacgagcacaactcggacgaggttgccgtgggaggccatgggtgagaggaaggagccgttgtcagttccgcatcctcgcccgcgacaccaagtctcgttgcgcctccagtcctagcacatggtcgcgctaatcccgccccacgatgtcctcgatccgaagctcgcgtaggatggggacaagctggggatggagagaaacgaacgaggaggtcgagcagtctgtggtgtcgccgcagtcgtcctcatccctcgtgcgtgctgccggagagacgatccgccggaagctcgactatatgtgcccgcatctctttccttcctttcctccgcatgtcattttttgtgtcattctcctcccttttttcagaaaatgctcttggagttgcagccttttagggaagagactcttcaagaggtgatctattttacgcaaagctttccatgaaccaattcatctttcttgagtgttcaatagtgcttttggttagaagctgcaaaatggaaatgtgttggagctattgacaatttgacatcactcaatatctgttcagatatactcaatatctg

SEQ ID NO: 70331 - DNA, 476 bp, Triticum aestivum
  unsure (1)..(476): unsure at all n locations
  Clone ID: PAT_TA_70331
tgcaggnaattcggcacgaggctccagttcatctcttcccctctcacctcctcgccacccaccaacgacccgcagccacacgtctccgtcgccgttggcttgattccggccaccgtcgtcttatcccccctctccccgcacctcctcacagcacgcagcacctccacccgcgcccccctgtctcgccgtcggctcctccccggaacgtatcggcctacagcagtgccgcccgccgtccggctaccgacctcctgtcctacggcgacgacagatttgagcgcagcaacacctcctcaccgcccccccccaccccccaccacgcaccacgcagcaagagaagcacggtaggaagcgaggatccgccactgttctctccggccacgctcgcagcagccaagacgcccgcagcaccacccgcggccatgagtatctcaggcgaggtccccgacgaaggctctgacggcgaggaggtcttc

SEQ ID NO: 70332 - DNA, 123 bp, Triticum aestivum
  unsure (1)..(123): unsure at all n locations
  Clone ID: PAT_TA_70332
acagttgngcaggctgaatggnnaatggnacncncnctgtaacggnncattaancncgnnggatgtggtggatacacncagtgtgaccgatanacttancagnnccctaacnnccgntacttt

SEQ ID NO: 70333 - DNA, 472 bp, Triticum aestivum
  Clone ID: PAT_TA_70333
ggtcttctctgtatttttgtgctcctcctaaatataatgttttctcttcatgccttttccaaaaaaatgattagtgggtccttcttaggtaaagcttcttttctactactcatataagcacgtgtgaatgcacatgttttagatctcatatgaaagcaactcgattgtacaccaaaaaataactgctgtgttaatatagttttctctcatgccttgcttgattgcgcaattgtacagccaaatgcttatctcacatgaggaagaaaacttacagctgctgtgttgatatagctttctctcatgccttgctcaattgcagaattgtacaatcaaatgcttatctcacatgagaaaaaaaacttagtgtcacatgttttacggagatacaaatatatagatggccataaagaaattctattcgaagctgtctaactgattgagtgagctgaaacctgcccgagccaatttattt

SEQ ID NO: 70334 - DNA, 681 bp, Triticum aestivum
  Clone ID: PAT_TA_70334
gaggaattcggcacgagggatcgtcggagactccggaccggacgtggtgctgaaggaggccattcgaataatcccaacggccagctccgctgccctcgctgcagccaagatcctgcatctggaggcggaactcaccaagcttgctggtgacaaggtggcgatggcggagaggattgggaagctgggcgccgtagtcgagaggctcgtcggcgagcatggcggggtggttcttgacctcggggacctgaagtggatggtggaaggccctgccgcgtcgtcgtctgaggggggcaaggcggccattgccgagatggggcgtctgctcaggcgtttcgggcgcggtgaagtgtgggccgtggccactgcagcgtgcgccacgtaccttaggtgtaagatctattacccagggatggaggatgaatgggatctccaagccatgccgattgcccgcagcacaccgcttgctggagctgctctgaggcctggaagcagtggaagtctcagcaactcggtggggatgttatcaccaatgctccggcctttgccggtgacaccaacacctctcagatggccgccagggggtggccatactcagatggtgaagccagccatgtgcatgctctgcaagggtggttatgagagtgagctcaccaaacttgcagcggagcggacggcagtatc

SEQ ID NO: 70335 - DNA, 576 bp, Triticum aestivum
  unsure (1)..(576): unsure at all n locations
  Clone ID: PAT_TA_70335
gcaggaattcggcacgagggtcgctatggaccactaaagaaaccgagnactgaagtgcacaagaacacaaatactgctaaagttgtcttcaggaaacgtgtcgatgctgaaagggctttcagtgttgctggcaactttggctcttttggaccttcacttcgtagttttcgccttgcgaatatgccattttctctaacgactgaattgaattatcctaagttacgctctgaagatggtggcatggagattcctgcttgtagggtgtctggagttgcgctggattctgcgcaaattggcatcgtagacaaagctgacaaaggtgaaactgtagggaatccatcagttgaacacactgagatggtcaagcttgcaggacaatatgaaggcaataccgagcgtgctttacatgccggaggcagaaatgaagagtcacctgatgttctctcagataccatgcaaactggaattgtagatgacaccccaaaacacaaacttgtgtgtgtacatggtgttgtcgaggcctcggaagataccatggaagttgataatacggatgagactcgagggggggcccgg

SEQ ID NO: 70336 - DNA, 636 bp, Triticum aestivum
  Clone ID: PAT_TA_70336
gtctatcgagaaatcttcagcaagcaaggatggtgatgttcccctttgcaacaccaagctttttgaaatgaatgcgcagaaatcatttggtgctcgttttggattagaggctgctcaggtagtgatagaccttgttcaagctaggaacaaagacaagcctaagatatgtttagaatctcttgtaattgatgtcttggactgcatagcaaactcagctttgaatgcgaaacctattgctacaccaaaagtttcttcaagcgatgttcaatctctaaacaacttctcttttggcaataagtttatttctattcactctttcatccttgaaagaaacattgaaactattgtcgaaaagccatctcctcaagtccagcacccaatccccaatttgaatgaagcttctacttttgttgctggtgttatttcggatggggattttctcaatccagtagtattatctagttcatctccagttcctaagagtgtggtgaatgaagctaatgcggaaggtgcaattccaatggatcctctatcttgtggaaaaagtgcttctgatgctataggtatatccccttcaacaatgcagtgtccaattcctgctattggttcttcgctgatgcattcagctggtcctga

SEQ ID NO: 70337 - DNA, 580 bp, Triticum aestivum
  unsure (1)..(580): unsure at all n locations
  Clone ID: PAT_TA_70337
gaacccccacaggncctccggtgattcggtccggggacacccgacccgagcaagctcgccgtggtgagtgagcagcggcattgctccctcggttccgttcatccgttgggggagcggctttcggtccaggccgagccggattcgtgcgtgatccccggcaggcgagattggcggcggcgttcccctcttgccgcccgcctggcgctcgattcggtcccagatttgggggcttccctgttccgagtccgggattccgtcgaacccagcggcaaatcggttccagatttgaggagctttccttgcgcggcgacgccaccttccataccaggccccataagagaagcggagctcaggagcggataaattcgatcctgctgcttcgcgttcagggccctctccggcttgctatgagacaatgagggaagagagcaacaagaagaccaaggtctcctggtccaaatccctcgtcaggaagtggttcaacatcaagggcaaggcgcaggatttccacgcggactacgacgccaccacccaaggacgggatggtggtgatgaacggaggaccagctgctcgcagagg

SEQ ID NO: 70338 - DNA, 609 bp, Triticum aestivum
  Clone ID: PAT_TA_70338
gcctgtcctcgcctcctctctctctcgctctccctcgctgctcgccgctgcatctcctccgtcctgctccgactcggcggcctcctccggccacccgtctcagttgtaaacatgcttcatcattcaaatagccgccagcagaggaacagaggatcaaaaatcaaaacgttactcaaggtcaccttactcttaggtgtggctgtttggcttgcgtatcaggtgaagcattcttatgataagaaaaatgagtactacaatgctaccgaggaccagctttcccatgatgatagaagcatgttccagggcaggaaagaaaggctaggtactaatggtgatggtaatgcggagaaggccatagagacaactgatgtaataggcaaacaagaggaagagaagagtggagaaagtgtctttgagaaagacaatacggactcccatgatgatgattccggaaacacagagaggtcagaagctgaagaaggtcaagccagtcgcgcagatgataatgcagaagcacatcgtaatgaaacatctgaatccaagtcatctgatgctgagactaaaagtgatgtccatccaactggagatgatgtaccccatgaagaagag

SEQ ID NO: 70339 - DNA, 576 bp, Triticum aestivum
  unsure (1)..(576): unsure at all n locations
  Clone ID: PAT_TA_70339
gncaccatcggacaacgttcaaggnctaagnanccaggtacaaggnagggcatccctccggnatcagcagcgtctcatcttcgctggcaagcagctcgaggatggccgcaccctggctgactacaacatccagaaggaatccacactccacctggtgctcagactccgtggtggcatgcagatcttcgtcaagaccctgaccggcaagaccatcaccctggaggttgagtcctctgacaccatcgacaacgtcaaggccaagatccaggacaaggagggcattcccccggaccagcagcgtctcatttttgctggcaagcagctcgaggatggccgcacgctcgctgactacaacatncagaaggaatgcacactccacctggngctcaggctccgtggtggcatgcataatcttanacaagaccctgaccggnaagaccatcacccctggaggtcgagtactntgacaccatcnacaacgtncaaggnncaaggatccaggnacaagggagggcatctccaccggtaccagcagacgtttnatctttgctgnanaagcagncttgnaggatggnc

SEQ ID NO: 70340 - DNA, 600 bp, Triticum aestivum
  Clone ID: PAT_TA_70340
ccccccaaaaccctaccacatcctcctccaccgacgccagccatggcgtcgcgtcgcccccgtgacggtaagcgcctctccccacagcccatccgtaaccctagccccaaccccagcccgaaccctaaccccgccccctcccgccccagtccgcgacccggtgctggacatggttttccaggcggcctccgacgacaacctccccctcttcaaggcgctggtcatggtgctggacatgggcaggggctgccccaaggaggcgattgaggggttgagggtggaggaggctgggaagctccaaggtttcagcgcgctgcacatcgccgccactagagggagcctgcgggtgtgcaggtacctcgtcgaggagctgctgatagatgtggatctggtcgacaaggaaggtccatctatcttcagaaccctagtctatcggtttaggaccccgcgcacacattcagtgtaggttttgtcaaattgtatgaagtgccattttacatgctggatttattgttcacaaaggttgcttcatctgtactctgtaggttaggcctcacgacatctgactgttttgtgctttctctgggtttggcatagtgg

SEQ ID NO: 70341 - DNA, 788 bp, Triticum aestivum
  unsure (1)..(788): unsure at all n locations
  Clone ID: PAT_TA_70341
ccggncccgccagcgtctcatctttgctggcaagcagctcgggntggccgcacccttgcagnactacaacatccagaaggagtccactctccacttggtgctcaggctccgtggtggtatgcagatcttcgtcaagaccctcaccggcaagaccatcaccctggaggttgagtcctcggacactattgacaatgttaaggccaagatccaggacaaggagggcattcccccggtaccagcagcgtcttatctttgccggcaagcagcttgaggatggccgcacccttgcggattacaacatccagaaggaatccaccctccaccttgtcctccgccttcgtggtggcatgcaaatctttgtcaagaccctcaccggcaagaccatcaccctggaggttgagtcctcggacaccattgacaatgtgaaggccaagatccaggacaaggagggcatccccccggtaccagcagcgcctgatctttgccggcaagcagctcgaggatggtcgcacccttgcggattacaacatccagaaggagtccacccttcacttggtgctcaggctccgtggtggcatgcagatatttgtgaagaccctcaccggcaagaccatcaccctggagggtggagtcatctgacaccattggaacaacgtgaaaggcgaaagatncaggacaaggganggcattcccccggaccagcagcgtcttatctttgccggtaagcaagnttgaggatgggcngcacccttggcgggactacaaccatncagaaaggagtccaccct

SEQ ID NO: 70342 - DNA, 438 bp, Triticum aestivum
  unsure (1)..(438): unsure at all n locations
  Clone ID: PAT_TA_70342
cattcactagcaagcaacactttgntttagctgtagccaattcagnacgagcagcggcgacaactccgacgcaacgggcttggcctgcgtcagcggcggcggggtccatctcctccctcgagcagcggtggtggcgtgggacacagcgggctcggccgcgaagatggatttctccggcggggcatttaaaaatgctgatgtgccgatgaatcctcgcctctgttcctcgacctcgcgtcagggacgcatatgcccctacgaccgttcctcctcgtggtcagtgacgcaaagccgacgacacggaagccgctgccgttgttcctctacgggacggttgaaccatagaaagcgagcactcaaagctacagaggcaaccagtccaaaggaataagtaaggtcatgccagttcattcaactgttcaagctcaactaagtgtt

SEQ ID NO: 70343 - DNA, 251 bp, Triticum aestivum
  unsure (1)..(251): unsure at all n locations
  Clone ID: PAT_TA_70343
ttgaataatggggatcgngncacttctacaggaaagattaaaacggaaagcagtgccaagattaaggcaagtaaagatatctataagaaatggcagcagaagtcacatagagcaatcggttctggtggaaaagatggtgcanaaggaggcatatccacaccagctggctatcaaagaggaaacagaagataccctgcagccggtcgcgggcgttcgtctataccaaatgctgatgtgccatcagagataag

SEQ ID NO: 70344 - DNA, 347 bp, Triticum aestivum
  unsure (1)..(347): unsure at all n locations
  Clone ID: PAT_TA_70344
atgcaatggtacatgacaggttgggnatattaatataactatatttggacatgataacacggtgtttgctctcaaagnatttgagtctaacttctgctgttttgtagttcttcccttccaaacaggggnaagaggccctaaattcccttaaaaaggggtttgctaaagatgangagcttgatttgatagtagcggaagttcatcctggcaanacagaggtgggcaccttgcggctgtttcaccacatcctgaatgaacttgaagtgcctctcatcactatgtgtgcctatgangaggcagcctntgcacgcatgacccttgagaacatgctncaatgtggttaagcc

SEQ ID NO: 70345 - DNA, 480 bp, Triticum aestivum
  Clone ID: PAT_TA_70345
atggcctcctccttggcagccctgaaaatgcagcagccggctcttttgatcgcctggcctaccactttgcccaaggtctgcggtcccggatctccagtgcaagcaccagttgctctctgccggagccactgccgtctgatagaatgtcggtgcaacatattatacaagagctgtcgccgtttgccaagtttgcgcacttcactgccaaccaggccattctagacgccaccaagggcgatacacatgtgcacatcgtcgacctgaacattggtgagggcatccagtggccatcgctcatgtcagatcttgcccgtcatggtggcatgtcattccacctcacggcggtcacagcagacgccgactacagcgacggcgttcaccatgcatctgcgcggcggctctcggagttcgcggactccttgaaccttcctttccagtacagctctctctgtttacacagtgatgaagacctgcatgaat

SEQ ID NO: 70346 - DNA, 472 bp, Triticum aestivum
  unsure (1)..(472): unsure at all n locations
  Clone ID: PAT_TA_70346
tttgtagtcacacctgtggagcaatcatcatgatcatgtctaaattccactaatcatgtatgtcgctattagttccgtaacctaatccatggatctatttcctcccaactattaatgtacctgggcagtcttccaatagcatgcaaagtatattatatttcattgataatcgaccagttaccttaaagatatagaatacttaactacattccatcaaatgataatcccatgctgagtaagtaaatcagtttcatgcacaaatacatgtatgattgcacaaataatgtattattccataatgaggtaagctgaatattaaattttgttggatcgagtctattcgtggaagtcttgngctattgactaccaggntgtattctctgaaatctttttgtacaggcggtccaaagntgaggaagtggantggagcacccgaatngcttcccaaggatggggggngccgagggcgaag

SEQ ID NO: 70347 - DNA, 141 bp, Triticum aestivum
  unsure (1)..(141): unsure at all n locations
  Clone ID: PAT_TA_70347
aaccctcgtccacaagtcctcctcccaggaccaacgccgncgccgccgccgacgccacccccatctgccctccgccctcgacctcgtncaccaacctgtgcaaccccatcggggtacacgcccgtcgactcatcgttgcnt

SEQ ID NO: 70348 - DNA, 266 bp, Triticum aestivum
  Clone ID: PAT_TA_70348
acgacggccagccttctccgccgcctcctcctccccaatcaccttcggagccagctccgggcgccccctaccgcctcccccgcggactcttctccttggagctcgacggctgctacatggccctagggatggcgccacggcctcgggctcttcttccacaagatccggttcgaggtcctggtgtgggatcccgtagccggccaccagcacctcctggccgtccccccggaatttcgagttccagggggccaagggtgatatcagcg

SEQ ID NO: 70349 - DNA, 253 bp, Triticum aestivum
  unsure (1)..(253): unsure at all n locations
  Clone ID: PAT_TA_70349
gcccttggnatattaccgtacgagttcttgttactaaaatggnatgcctgtcatgagtaagctctgtagctcatgcacaatagaggataaggctgatgatcctgacgctgaagcacgtgtgaattctgttagggggctaattctggtttgcgaaacattaacatctaatgttgatcagagctcagatattggagaatctgtatatgcatacataaaagttgaggtcatgccagctttattcagagcacttgna

SEQ ID NO: 70350 - DNA, 646 bp, Triticum aestivum
  unsure (1)..(646): unsure at all n locations
  Clone ID: PAT_TA_70350
caaacacgcacaaacaactctcgctgtacccccatcccgccgctgtgccaagnagtcgcagnagttcttcgtcggctagtcggagccggccacctcctcccccgctgccattgatcatgtgcccaagctgcccagggacgaggaccaggtggtatgtgtccgggacagatcgcaacccgggcatccggttctacaagtgcccaaaccaggcatacggaggcccttgccgtttttggctgtgggaggaccaatacgcgtactacatcatcggtgttggcatcaaccttctcatcgaggccgccggtggtggaagcaacgtcatgtttgaaatgggtcgcgccatcgacgaaatacgcaccgcagctaggaacaccatgacgatatgcatgctaatgcttttcgtcctgcttgccaaggcggccggctggcagtaaaaacccgtgtggcgtaccaccagcaacgaagccggaacaactgcttgccaacgaagccgtgacagtattgtttattatttgtagcacgtatgtatccagagtgcagtgctatgtacggaccgtccctacgtacgtcaaaaaaggtaccgtggcgagcccaccaggtgcgacttatggcgctgtattcggatgtatcgagctatgtattcacg

SEQ ID NO: 70351 - DNA, 654 bp, Triticum aestivum
  unsure (1)..(654): unsure at all n locations
  Clone ID: PAT_TA_70351
cggcacgngcttccgcggtcgtctatcgccctatctccttgccctctgcacctgcccccgtcttcttcggcgccactctgagcctcctcggtcttcaacctcctgcaatcttcaagctcgcggcacccaatccgagcaaccagccgtcaattcgagcgacccccgttaggaatccatggaatttgaggtggatttcctggaagagggaggagaaaggatgatagtggggttcatggggaagaggagtccactatccgcgactctctccctcaggggaacatcgcagatttgtctaggatctctcaagcacgagatcccctggacgtctcatctgtccttgcaggcatgtgttcttcctcctcttatgagatcatcatgtgcaaatatgctagagttgtactccctctgtaaactaattgtgatctaaaaaatcttatattagtttacaaatatagtacataatatcttgcaaggcctgactaataagtagttgtggcttaagatgcttctggagactaattggaatggtggaattcaatcggactaccatatgagcataatagactatgaacataatagactatgagcaccattcagattataatgaatagaagtgaagatccgaatgtcaaacaaaaaaatacagtgctaaat

SEQ ID NO: 70352 - DNA, 328 bp, Triticum aestivum
  unsure (1)..(328): unsure at all n locations
  Clone ID: PAT_TA_70352
atatatacataatacatgattataatatgcatgcnctgctaacaatattgtggctgtgtgtgtttctgggtaaaaggttgttttaaatctgaagggaattgcttgtaggctaggttattgacaagttactccctctttaaacaaatgcaaggacgttttcggtcactactttatagtgttataaaatgtcttacatttgtttacagcgggagtaccatatgtaggatgaaaaagaaattcangggaatttacaattcatgtgttattgttactcaaaagtgagattgcattacataatgtgctnacagctgtagtgatgctgatccga

SEQ ID NO: 70353 - DNA, 481 bp, Triticum aestivum
  unsure (1)..(481): unsure at all n locations
  Clone ID: PAT_TA_70353
gcgtcggaagangcggctgccaaccgtggcgtggcaacgagggacgtcgttgtcgacgaaaacacgggtagtatcggcacgcctgtttcttccctccaacgcagctgctgctgctgccaccggcggcgagaggctccccgtcatcatgtacgtccacggcgggatccttctgcaccgagnagcgccttctgccgcacgtacaacaactacgccaggtcactcgccgcgcgcgccggggcgctcgtcgtgtccgttgagtaccgtctcgcgccagagcatcccgtccctgcggcctacgacgatgcatgggcggcgctccagtgggtggcgtccgtctctgacccctggctctccgactacgccgaccccgggcgcacgttcctcgccggtgacagcgccggcgggaacatngtctacancacgggcggtgcgtgcggccagcggtggtggcactggaaaccacatcgacgtcgagggcctt

SEQ ID NO: 70354 - DNA, 692 bp, Triticum aestivum
  unsure (1)..(692): unsure at all n locations
  Clone ID: PAT_TA_70354
agggctctctcgtcctcctccccagnatctttgtgaagaccctcaccggcaagaccatcacccttgaggttgagtcgtcggacaccatcgacaatgtgaaggcgaagatctaggacaaggaggacatctccctggaccagcagcgcctcatctttgccggcaagcagctcgaggatggctgtacatttgctgactacaacatccagaaggagtccacccttcacctggtgctccgccttcgtggtggtatgcagatcttcgtcaagaccctgacgggcaagaccatcacactggaggtggagtcctcggacaccatcgacaacgtgaaggcaaagatccaggacaaggagggcatccccccggaccagcagcgcctcatctttgctggcaagcagcttgaggatggtcgcactcttgctgactacaacatccagaaggagtccacccttcacctggtgctccgccttcgtggtggtatgcagatcttcgtcaagaccctgacaggcaagaccatcatgttggaggtgggagtccttggacaccatcgantacgtgaaggcgaagatccaggacaaagagggcatccccctagaccaccagcatctcatctttgctggtaagcagcctgaggaatggcccgcactctggcggactacaacatccagaaaggagtctacccttcacttggtgct

SEQ ID NO: 70355 - DNA, 588 bp, Triticum aestivum
  unsure (1)..(588): unsure at all n locations
  Clone ID: PAT_TA_70355
atgctcacatcccccaagtgtagnactcctggttaaattcattaagtattcaaggttccgttgacgttcccacaattttaaaagatagtattaggtatggaaaccctcctcccctctttatcctctctggtttatatttgcttacattgcctcatacacttgtatttgcttacactgcctcgtacacttgtatttgctccatacattagtctagtcttttagattgtgcaagttgctatgtctcataagtttctcccattataatgtgctttgccttgtattcatattagatttgtcacattaaattatgctgtttgttactgatgaaaatttacctaaattgtgctattttgttagtgatgcaaatttatctctgttaggaatttgtatgtggcacttgaggttctgctagtgacttttcatattagatttgtcacattaaattgtgctatgttgttagtgatgaaaatttatctcttgtaggaatttgaatttgtatgtagcacctgcggttgngctagntgcttcatattangttctgtcacattaaattctatttattttggttaggtgangtaaatttatctc

SEQ ID NO: 70356 - DNA, 655 bp, Triticum aestivum
  Clone ID: PAT_TA_70356
gagcggctgaggaagcagcagaagagcgtcgtcgtccccatcggccgcctgtccattgggttctgcaggcatcgcgccattctattcaaggctctagcagattttatcggcctgccatgccgaatcgcgcaaggttgcaagtactgctccgcgcctcaccggtcctcttgccttgtcaaaattgaaaacgacagaagatattcaagggagtacgtcgtggacctcgtcgttgcgccagggagcatctgcagcccagactcgtccatcaacgggcagctgctctcctctgtgtcttcacctttcaagacttcttgcacggcaagtttggaaaactacgcggcaccggttgcggcttggaatcgtgcgatagctgacgatcgttgcaactcggtgttctcagattctcaatattcagttgccggggacaagaaccctgttcaagcagacacaaaatgcggtcaggtcatgcagaatgacaactgcaacaacatgtcagtgtttcaagtgtcaaggcaatttaaggcgatggaggtcggcaccgagggtgtcaataaggagaacatccctggtcttacactgccgaaacacctgctcgctgagtcatctttcgccatggattggcttgagatatcatgggatgagcttgagctcaagg

SEQ ID NO: 70357 - DNA, 621 bp, Triticum aestivum
  Clone ID: PAT_TA_70357
gctcaaccccgcgctcccgtcctgccgcaccaccgctcaatccacctccggccgcagatccgtcgctccctgtgagccagcgccgccgcgcttactcgcagcacacaagcgtagctactagctatcagccaagagagaaacgagagaccaagatccagatgtcagaaatcgtcaacaacctcctcggcaaactcgccgacctgctgagcgacgagtgtcagaagctcaaaggggtggagcgtcatgtgcagcacctcggggatgagctcagctccatgaaagctctcctggaggcgctggatctcagggataaactcgaccccttgaccaaggactggcgggaccatgtcagggacatggcctacgacatggaagattgcatcggcgacttcctgctcaatgttggaagtgccaatgccaatgcaggttttattgagaagaccactcaacttgtcaaggacctgtgggcgcgtcatcagtttacaatccagatccaggagctcaaggatcgtgctatagaggcgaatcatcgacgcaaaaggtacaagcttgatgatagcagtagctctagctctgcccttgtgcccgtcgatcctcgggtgtcggcactctacacagagg

SEQ ID NO: 70358 - DNA, 597 bp, Triticum aestivum
  Clone ID: PAT_TA_70358
ggcgtggggctgctgtcatcccgtacgcactggcggagggcgggtggctcagcctggtgctcctcctcctcgtcgccatggtctgctgctacaccggccagctcctgcagacgtgcatgggcgcgtcgccggacgtgcgcggctacccggacatcggcgcgctcgccttcgggaccaagggccgcttcgccgtctcggccttcatgtacgccgagctctacctcgtcgccatcgggttcctcatactggagggggacaacctcgacaagctgttcccgggcaccagcctcagcctcggcggcgtgctcgtgctctccggcaagcacctcttcatcgtgctcgtgtccatcttcatcctgcccaccacgtggctgaggaacctgggcgtgctcgcctacgtgtcggccagcggcgtgctcgcgtccgtcgtgctggtcttctgcgtgctctgggccgcggtggtcgacggcgtcgggtttcaggggaaagggaccatgctcaaagtcagcggcctacccactgcgctcggactctacactttttgctactgcggccatgccatattcccgacactctgcaattccatgaaggaaaagg

SEQ ID NO: 70359 - DNA, 452 bp, Triticum aestivum
  unsure (1)..(452): unsure at all n locations
  Clone ID: PAT_TA_70359
ttcggcacgaggcagcaagnaagcncgaatcctagcctctccctctctctttgcgtgttcgtgctcatcgccgccattcctcccgctccccgccgttgccctgccgcctccaccggctaggtaccatggatcatggccgatgggagagtacgccatcgttgatccattgcttaggttggtggcgcatgggtcgggtctgggcagaaggccggcacctgcaggggaaaacggcgggggttggtgcagcggaaagtgaggatgggttggtcgtagagggaggctcgccggccaaaacaaccggagcaaggaggcagtgtcgccatggaggaaggcccactggccggagcagcaggagcaactgcagccgctggtcggcccgacgcaccgcctcctctgctgcggcccgcacggtcaagaggggcagctgcaccgtagctggcggcgagttcggc

SEQ ID NO: 70360 - DNA, 575 bp, Triticum aestivum
  Clone ID: PAT_TA_70360
gttccgattccccctctctttctctctcttctttctctctctctttcttgctctgctctggaagcagggggtcctgatttgggcgcgggcgccgtccgccgtgattcggttcggctgatttgggaggtctgctcgtttgatccgggttcgctgattggttgattgattgattggttggttcatctccggcggctcgatttgagggccggtcggcttggtcgccatggggaactgctggggcgccaagatcagctccgacacctcctcctcctcctccccttcagggacgaattccaagtatgctactaggaatggggcggccttgagcagctccagcagctatgcctccgcggcgtcagtgccacggagcgagggtgagattctggagtcagccaatgtcaaggccttctctttcaatgagctgaggaccgccacgagaaacttccgtccggacagtgtgctaggcgagggagggttcgggtcagtcttcaaggggtggatcgatgagaagacccctcaccccaactaagccaggcaccgggatggtcattgctgtaaagaagcttaaccaggaa

SEQ ID NO: 70361 - DNA, 471 bp, Triticum aestivum
  unsure (1)..(471): unsure at all n locations
  Clone ID: PAT_TA_70361
ggnctctctgcgtcctncctccccaagcatctttgtgaagcaccctcaccggcaagnaccatcacccttgaggttgagtcgtcggacaccatcgacaatgtgaaggcgaagatctaggacaaggaggacatctccctggaccagcagcgcctcatctttgccggcaagcagctcgaggatggctgaacatttgctgactacaacatccagaaggagtccacccttcacctggtgctccgccttcgtggtggtatgcagatcttcntcaagaccctgacgggcaagaccancacactggaggtggagtcctcggacaccatcnacancgtgaaggcaaanatccaggacaaggagggcatncccccggaccagcancgcctcatctttgctggcaagcancntagangatggacgccctcttgntgactacaacnntccacnaaggagnccacnccntnannnggtgctncg

SEQ ID NO: 70362 - DNA, 575 bp, Triticum aestivum
  unsure (1)..(575): unsure at all n locations
  Clone ID: PAT_TA_70362
agagagctgctactattnttaagaggaagcggtgaagaaaccgatgctcggttaatacatattttgttccttgcaaaagaaaaacagttgctttaattttgtgtggatacatagttggatgtttggcaatatatattaaggaccccgataaggcactgacgttcggtatgggagaccccggaccgaacaactcgttcgctaccggacgaagatcaaccgaacccactcgttcgggaggaaaacaccccagcgcgaacgccccaatcatcaggccctacaggcctctttcctgtaaaaaagaaaacaaagaataaagcctagattaagttacgactagtaaaaacccagtttttatatgtgactaataaacacgggtcttttgcacaacaaaaattgacatgatcttttgcaattatacggaaaaaattgccatgctcaagtttatgttttcaaaaaaaaatggcgcaaaaaaaggaagaaagtcatggcaatttgcgcttctttacactacaaaaagttgccatcactacgaagtttacactacgaaaaggctgtcgtgaagtttacatacatat

SEQ ID NO: 70363 - DNA, 559 bp, Triticum aestivum
  Clone ID: PAT_TA_70363
gctcttctggctggaggattgttaggtttttccctgccgccgccgccgccgtatctatctgcccatctccggcgattggagtcttgatctcttctggctggaggattggctcctctcgccctgaagccctccttccttgagcagcccctcttgcctcttcaccataggccgaggccgaagcgggggcacaccggcgccgccccgagatactctattggcagtgcgaatcgacgctgccacccaagatcttcaactacccttccgcatccctgcaccaacgaccatggtaccgaccctcaactcatctccatatcactcttctatgatgcatcacatctgatccatgtcgtgatagcggcagcagcagatccatggcgggacgatcttggcggtatgttctgtatgctagctttgcatacttgttactgttctttcaattttcactcatttaatctttggaatttggagaagcacgagatatttatttgccaaatttcatcttttagttgttgcaaaaagataccattgccaatgggagagtagccacaagtttttttgg

SEQ ID NO: 70364 - DNA, 293 bp, Triticum aestivum
  unsure (1)..(293): unsure at all n locations
  Clone ID: PAT_TA_70364
ggagtncggtggcacagtgagtngtgacatacacgggagacgacgagaggcaaagcacagtagagattatggctcctctccctctgctagcagcagcagtgatagctgtggtggcacttgggtctgtaggggcttatgcggcggcagggcaggagcaggaggccggcggcgggaacgacctgaggcagcctcccgtggcgcggggcctgtcgttcgacttctaccggcagagctgccccagggccgagtccatcgtgcgcgacttcgtccgtgacgccgtcagcaaggacgtt

SEQ ID NO: 70365 - DNA, 146 bp, Triticum aestivum
  Clone ID: PAT_TA_70365
gctgagttttgaggattttgccttcagcggcgagacaaaatcctcaaaacccctctgtgagcttaagtactcatctgccagcttcctcaatctattctcatccataaggtccagcaagcaccgtctgccctcacactgaaggtgtg

SEQ ID NO: 70366 - DNA, 413 bp, Triticum aestivum
  unsure (1)..(413): unsure at all n locations
  Clone ID: PAT_TA_70366
aaggggctcggnaagggcggcgccaagcgccacaggaaggtgctgcgcgacaacatccagggcatcaccaagccggcgatccggaggctcgctcggaggggcggcgtgaagcgcatctcggggctcatctacgaggagacccgcggcgtgctcaagatcttcctcgagaacgtcatccgcgacgccgtnacctacaccgagcacgcccgccgcaagaccgtcaccgccatggacgtcgtctacgcgctcaagcgccagggccgcaccctctacggcttcggcggctaggcgtcaatctccgtccgcaacccgtcgcctcctcgccttcagccaacaactccgtcccgccgtggctgcagcctgcagacgcgagaaaactgtcatatctttcgttcagtagctgtagccggaac

SEQ ID NO: 70367 - DNA, 616 bp, Triticum aestivum
  Clone ID: PAT_TA_70367
ccgcacccgcgcctccctctcctcctctcgcccctagcgccgccaccacttcctccttccccatcgccgcctggcctcctcccctcacgttctcctctttccacccttccgatctggcgccgcccaaaccctaacgccccggcccggccccggctcccacaggagggaaggaggaatggcgtggcgaggcaaagccgcacccgaggctgaccagtaggcctccgccaaggccgcgcccaaggctgaccagtaggccacggtcaccaagcgcccgcacaagggaaccacgtcggggaagaagaagccggcgcccaagtccgttgctgctgcacgccctctctagccgcctctcatcgtcctcacgttcggcagaaggaggacgaggacgttgagcggacatgggctatcactctctccgcgggcgagctcgagcgctagagcattagcgaggacctccgcgagttcgtcaacggcatgaccgtaatcaccttccgtgacttcccccttgcaagatgtgttggagccgtcggatgtgtccacgttgttgaatgtgcctcagcatctgaacgaatggcaggctagggataccactcacgtcctctcgcccgtcaggatt

SEQ ID NO: 70368 - DNA, 311 bp, Triticum aestivum
  unsure (1)..(311): unsure at all n locations
  Clone ID: PAT_TA_70368
gctcttgacctgattcgtgatcgaaacttcagtatgctcatagactcctgtttagagggccaattttcgaacgaggaaggaacagacctgatgcgtttagcttcaaggtgcctgcattatgaaccacgagagcggcctaatgtaagatctttggttcttgcactggcttctcttcanaaggacgttgagtcccaatcttatgatctgntggataanccccgnggnggtgcatttactcttcaatcantncntcnttctcctcttgctgaagctngctccananaggatcttactgcnntncntgancntct

SEQ ID NO: 70369 - DNA, 322 bp, Triticum aestivum
  unsure (1)..(322): unsure at all n locations
  Clone ID: PAT_TA_70369
ctgaaaagatgtggtggggtgcctttagctatccttacaattgctagtttgctgtccagtnaaatggaaagagcacatacacatgagtattggtccaaggtgcataaatctatgggttcagggctagataatagtcatgatgatgtgangngngngngacagatattatcagtcagttactctgatctacctccacacctaaagacttgtttactgcatcttagtgtgtntccagaggattatgagattnanncnganganctgntntggnnntgggtgggtgnnggttttgtgnnnnnngnncnggggnngngctcgnntg

SEQ ID NO: 70370 - DNA, 475 bp, Triticum aestivum
  Clone ID: PAT_TA_70370
gcctctccacctcctacctcccgacgggtcgctaggggccacccccaccttcctccggtgggcggcccctctgatcctgtcgccggtgcctacccccgtctcaccgtcgcccttgctaccacacaatgccggatctcggccatcccccggctccccgcgccaccctgggtaactcgaccgccggatcgcggccatccccagtccccccacgccgccctgggcctttctccccttcctccactccctcgattcatcaccacctcccctgatgtaccgcgatttcgggaggacagcgccgccatgattccccgatctgggtggtcgacgatggcgtccatggcggctggcgtttgtctcctgctggtgctgtgccccacggcgggggagggaggttagggaggggatgcagaggatttgtggtcggcggcggtaggaggcagtaccggggttcgggctggtgatgcagcgtgttggg

SEQ ID NO: 70371 - DNA, 806 bp, Triticum aestivum
  unsure (1)..(806): unsure at all n locations
  Clone ID: PAT_TA_70371
caagatgcagatcttcgtgaagaccctcaccggcaagaccatcacccttgaggtcgagtcgtctgacacgatcgacaatgtgaaggccaagatccaggacaaggagggaatccccccggaccagcagcgcctcatctttgccggcaagcagctcgaggatggccgcaccctggctgactacaacatccagaaggagtccaccctccacctggtgctccgcctccgtggaggcatgcagatctttgtcaagaccctcactggcaagaccatcacgctggaggtggagtcctcggacaccatcgacaatgtgaaggccaagatccaggacaaggagggcatccccccggaccagcagcgcctcatctttgccggcaagcagctggaggatggccgcaccctggctgactataacatccagaaagagtctaccctccacctggtgctcaggctccgtggaggcatgcagattttcgtcaagaccctcaccggcaagaccatcaccttggaggtggagtcctcggacaccatcgacaatgtgaaggcaaagatccaggataaggagggcatccctccggaccagcagcgcctnatcttngncggcaagcagctcgaggatggccgcaccctggcagactataacatncagaaaggagnccacccctncacctggngctcaggcttnnnggaggcatgcanantttttgtnaanacgctcaccggcnagancatcnccctngnaggnggagncntngncaccattgnncaatgnnaaggcnaannatcccngncaanggnnggcnttnccc

SEQ ID NO: 70372 - DNA, 467 bp, Triticum aestivum
  Clone ID: PAT_TA_70372
acgagggaaccctagccgccgctctcctctcccatgacccgcaaccaccaccgctcctctctcctctgcctcgactcccaaccatccaacccaaactccggcggcctcctatccctccagcgccgccgctccagccacaccttccttcctctccaaaggaagggaagggaagtgaaggggaggggaggccccagatcgagcggagcgacgcccagatccgcagcggcaccggcaccagcgcgccgtcgtccacctggtcctcgaggaaggccatggatgggggcagaaccctagccccacacccatccatcacggcggtggccttctctcggtggggtggggagcgaagttttctgatgtggtggccctcgacgcctgcgacgggctgcagcaccttggcttcaaaggtaggccatcacaatggaaacagaaggatgagcaccatggcgggcgtgcaggtgcaggcc

SEQ ID NO: 70373 - DNA, 375 bp, Triticum aestivum
  unsure (1)..(375): unsure at all n locations
  Clone ID: PAT_TA_70373
ccccctttgcttgctttctccaactctgcatttaccttgcttgcttagaggaggatactgagtctagttaaggattgacaagacttaatttcccgttcccctttcttactgaccagtgcaattgcaaacagcagcaccaactcgatctactcaaaatgatagtttcgttctttcttcttcttacatgtttaagacctcgctngtntacactcgagcaattggggttgatcctcaattagcttggtgtacaggttcattctcaggttgcttacttctattgtgcaattgaaattgggagaactactgatgcttccgtttgagacatactgattctttttttttcctgggtttgtggatgagggaattttgtgacct

SEQ ID NO: 70374 - DNA, 420 bp, Triticum aestivum
  Clone ID: PAT_TA_70374
attcggcacgaggagccgctcctcccgctcctttctccagccaaaccctctctcactgccttgaagacaatgccggctccagtgtgccgctgcaggccattggccatggcagtgctgctactcattgcttcactttgccatctcggttcttgcaatggaggagcaggaggaggcaggatcacaaggctccctgggcagccggaggtgaactttggtcagtactcgggctacgttgaggtggatggcaaggggagcagggctctcttctactacttcgtggaggcggagcttgatcctgccaccaagcccctcgtgctctggctcaacggaggacctgggtgttcttcacttggtgtaggggccttctcagagaacggccctttcaggcccagcgggcaggcgctggtgaggaatgagtac

SEQ ID NO: 70375 - DNA, 603 bp, Triticum aestivum
  Clone ID: PAT_TA_70375
tccgaaacgcggaaggagggaaggttccgttccccttctccctcgctcgaacacgacggcgccaccgccgtctccttccggcaccatgtccatgccgtctccttccggcaccaagcgtttccttctccttcgtcgctgaccccctgacccctcctccatctccgtctccctagtgcagaccttcctcctgccccggcatgggcatggcggccacgaggctcacggacgacctcctcgtggagatcctcgcgcgcgtgcccgccaaatcgctcgcccgtttcaagtgcgtctccaagcactggctgggcctcaccttcgaccgcagccaccgcaggaggctcccccagacactgtccggcttcttctacagcagcgccggcgaggagtgcttcctggagtcacctgtccacttcaccagcgtcgagggcagccgccgccctctggtccgcacctcttccgcgttccttcccagccaccggcgcgtcgacctcctggactgctgcaacggcctcctcctctgccgctggtacgaagtctctgcccgtgccgacgagttccgttacgtcgtgtgcaaccccgcgacggagaagtgggtcgtcttgc

SEQ ID NO: 70376 - DNA, 286 bp, Triticum aestivum
  unsure (1)..(286): unsure at all n locations
  Clone ID: PAT_TA_70376
aacgccaccaccgctgtaanccaaatcaagtcaccggtgcgcatcataaaggtcaccttctacctagcggatccgccggccgtctcccacttttgcgtccatggccctgatgtcgaccctgggcactttgctgttgagccccgggttctattctcggagaaggacctcgtcctcctatgcttcgccttcaccagcggctcccgaagttctgtccaggactgtaatctcgtngagtacttcatctacaaggccggccgatgcaatccgtccctcagatcgatcccgg

SEQ ID NO: 70377 - DNA, 923 bp, Triticum aestivum
  unsure (1)..(923): unsure at all n locations
  Clone ID: PAT_TA_70377
cgaggggaaccacaaatccacacccaatctcgtctccgatcgactcgagagctcgtcgaatcctcctcccccatcgtctcaagatgcagatcttcgtgaagaccctcactggcaagaccatcactctggaggttgagagctctgacaccattgacaatgttaaggctaagatccaggacaaggagggcattcccccggaccagcagcgcctgatctttgctggcaagcagctggaggacggccgcaccctggccgactacaacatccagaaagagtccacccttcacctggtgctccgcctccgtggtggtatgcagatttttgtgaagaccctcaccggcaagaccatcactctggaggttgagagctctgacaccattgacaatgttaaggctaagatccaggacaaggagggcattcccccggaccagcagcgcctgatctttgctggcaagcagctggaggacggccgcaccctggccgactacaacatncagaaagagtccacccttcacctggtgctccgcctccgtggtggtatgcagatttttgtgaagaccctcaccggcaagaccatcactctggaggttgagagctcccgacaccatngacaatgttnaggccaagatccaggacaaggagggcattcccccggaccancagcgcctgatctttgctggcaagcagctggaggacggncgnaccctggncgactacaacattcagaaaggagtncacccttcacctggtgcttcgcctncgngggggnatgcagattttcnngaagaccctcaccggnagacatcacccttgaggtggaggtnccnannccattnanaacgnnanggccanatcaggacaaggaggnntttccccggaccaacaannccngatntttnttggnaagcnnntgnaggacggcc

SEQ ID NO: 70378 - DNA, 625 bp, Triticum aestivum
  Clone ID: PAT_TA_70378
gcacgaggctgactctctccactcctcactttcttcctcctccagccgcctcctctgtaactcggcgcctcctctgcagcaggccgcatcctctgccgccacgacgtcgcccggcgcccccacccacccacaccaccaccaccaccaccaccaccacggccttgccccgtctcctcctatccccaccggggcggctggccgaggtgaggttcgtggcgtgatggcggcgttgatcgtggaggatcgtggcgtggtggggctgtgtagcatcctgaacgggggagtctgctggcagaacattcgttttgaaccgtagatctgtttgatgtaacgtggactgttggatgcatctaagtgggtttgatcggacgtgggcggttatctcgtgtgcactttgtggggcatgtttggtcttttaatagtagtatagataggaaaacaacaactataccaagtgcatcaagatagtgttcaatcttggggaagtaaagcttcctcagtacactgtggacctaatggttgaagataactggaaagctcttagaaattttaggcagtctaaggcctctgttttacttgtggtgagaaaggttcaaggatcatgcgtgcaagctaggagttcaac

SEQ ID NO: 70379 - DNA, 435 bp, Triticum aestivum
  unsure (1)..(435): unsure at all n locations
  Clone ID: PAT_TA_70379
tttacgacacattttggtttctcctctggtaaacctggctaactctagtgtatgtatgcaagcaaagtcagcatagatggaaaaatgatctgatttattgagcttgtgtattttctggtaatcttagtcattgataagaacacttgaggacgtacatgctcatgacaacaattcttagttatagtaccagtatctgatttgatggggaaataagtcaaaataagagtgagtatgatagtataaattatttttctggtcagttcaaatagaagcatgtttgctcctctccggtaccataaacccatcatataccttcctcaaaacagccatcatacctacctatcatgacatttncatagtcattctgagatatattgtcatgcaacttccatcatcatcatatacatgacttgagcattcattggcatattgctt

SEQ ID NO: 70380 - DNA, 588 bp, Triticum aestivum
  Clone ID: PAT_TA_70380
cgaggcactcaccaaatgtgaccgtgtatgagtccctggtctactccgcatggctcagactgccttccgatgtcgagtcggaaacaagaaagatgttcatagagcaagtgatggagctggtagaactgaattcactgagagatgcgcttgttggactgcctggagtgaacggcctgtcaacggagcagaggaagaggctgacgatcgccgtcgagcttgtcgctaacccctctataatattcatggatgagcctacctccggccttgatgccagggccgcggctattgtcatgaggacggtgaggaacaccgtcgacacgggcaggacagttgtttgcaccatccaccagcctagcatcgacattttcgaagcctttgatgagctgttcctgatgaagagaggaggggaggagatatacgtgggtcctctggggcaccagtcgtgtgacctcatccaatactttgagggaatcgaacgggtcagcaagatcaaaccagggtacaatccggcgacttggatgctggaagtgacctcacaggcacaagaagacatactaggtgtcagtttcgcagaagtctacaagaact

SEQ ID NO: 70381 - DNA, 559 bp, Triticum aestivum
  unsure (1)..(559): unsure at all n locations
  Clone ID: PAT_TA_70381
ggctgcaggcnattcggcacgaggagccgccagnaaggggtcgaagagctgacgaggggggaagcggcgggaaatcgtttcaccgtcaagcggagagccctcccatcccaatccaatggcggcgacggcggagctcgtctgatccgaatcgcgctcaagggtttggtatttcagctgcttcggcattgggtgctcactgtggtcactgaagaaaccaaatcaatgaagcaaataaatgagaaatgcatcataaaccacctcccaggggacctcgttgagcgggtgtttttcggacttccagtgagcactctgttgacgtgcgtcggagtctgcaagcactggcacaacatcatccgggatccacagtttgttgcattgcacctccagtgtgcgccaagttatgcccttctgttcttcccgtcaggtttggtttcaggcaagcactaccctagtgatgctgtcctaattgatgaagcctggtcgccatcgacatatatagtgccagtgattgggcctggtgattttctttttggttcatgcaatggccttcttggcttat

SEQ ID NO: 70382 - DNA, 567 bp, Triticum aestivum
  Clone ID: PAT_TA_70382
cgaggaggaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggcgtcaagatggagttgatcgatgccgcatttccacttctcaagggagttgttgcaacaactgatgttgttgaggcttgcactggtgtgaatgttgcggttatggttggtggattccccaggaaggaaggaatggaaaggaaggatgttatgacgaaaaatgtttcaatctacaaagctcaagcatctgctcttgaagctcatgcagcccccaattgcaaggttttggttgttgccaacccagcaaacaccaatgctctcatcctgaaggagtttgctccatctatccctgagaagaacatcagttgtttgacccgcctagaccacaacagggcactcggtcagatttctgagagacttggtgtccaagtttctgacgttaagaatgctattatctggggtaatcactcgtc

SEQ ID NO: 70383 - DNA, 622 bp, Triticum aestivum
  Clone ID: PAT_TA_70383
cgagggttgagacagggcatgaatgatccagatccatttatctaatgagaggtgtatcagagaaataaaaaatatattgaactacagttcgtgactttatgcgaagaattctaagggagcaagtcattttactggggctaataaacccataccccgcatctcgtctgccccgggtgcggaggcgagcttcccggcgatggcggcagcgctggattcgatctgcaggagagacagggaggtgcggcttcaaatgggagagggtcttgagacagcttcacaagtatttatgatgatcatttgcatgatcttgcccagttcttatagggcctgcagatcagctgggaggagcagtggcaagcagcagcagcggtggcaagtagaggcagtgggcagcagaagcccatatgcatctgctaggctgcgtgaactgtagatcgattgagtgcccgaccaggatttaacttggctgctataagatggaggggtcctcggccggaatctccatcaatttgcgtccttgggccataatctccatcaaattccgtcgaaatttgcacgaagcgtccaatgtcgccacagagtttgctggaggaacaagaacattggtccgtccagtgtcgcc

SEQ ID NO: 70384 - DNA, 187 bp, Triticum aestivum
  unsure (1)..(187): unsure at all n locations
  Clone ID: PAT_TA_70384
atcttgttctggaccagaagttgcttgaggaatccttaaagaangaggcaaagaggaanaaggaagagatggacgaaagaaagaggaagtacaatgtgaantggaacgacgaggtcaccgncgnagacatggaggcctaccgtatgacgagagtccgccatgacgatcctatgaaagattttctcaa

SEQ ID NO: 70385 - DNA, 582 bp, Triticum aestivum
  unsure (1)..(582): unsure at all n locations
  Clone ID: PAT_TA_70385
ccgtttaattcatncactgaacccctaataagtcggcttaatccatcacatctcatcaacaacaaaaggcctttttctatatctatcttcatcacttctctacatcagattatacatttgggcgagtgggtgagaaccagctagaatgtgatctcgcctaaagtggcaccatgcagcaagtttctgttaaactacatccacatcaactgccactgccaacctgccaatttacattaactgtttacacgggaagctttacacatgtcttcccgtgcgaccatttgttagacaacaaaaatagttgacgattcctatggaatgaatttcgatgttgtatgttatttcttccgagtaaacgctaattgttagattatcgcatggtagtggtatatatatctatctttggcagatctgcagtaagatcaaattgttgcccatgcaaaaattaagctagatgtacggcgtacttgagttatataggttctatttacagcacatacatgtaccgtgtttgaaaagggatccaaatctatgttttattattattaaacacccatatgaaatttccctgcaaatgtaacc

SEQ ID NO: 70386 - DNA, 592 bp, Triticum aestivum
  unsure (1)..(592): unsure at all n locations
  Clone ID: PAT_TA_70386
gaacacggcccttcttagcacctgtggagaggggagagggccggtggattttttggggtggctgtggaacagcaagaacactggagttccgggtccgtcagagcacgatgctgcactcaatccactgatctgctgagcctgattcatctgggaggttgctgtgaaagtgactgttgccactggccgangttcaccattgacgccacttacttcatccatcggtcaagccaataattccacacaaacgcccaactaatggagaagacggccctgagcgttggcaagtccgtgctgaatggagcgattagatacgccacatccgccctggcagaggaggtggctctgcagctcggagccggcgcgaccaggtattcatcaccaatgagctcgagatgatgcaggctttccttgagtctgctcatgacgagggagatggcaacagggtggtcaaggtctgggtgaagcaagtccgcgacgtagcctacgacgtcgaggacacactccaggagttcgccgtgcgcctccagaagcaatcttggtggcgtatccgtcgcaacctactcgaccggcgtcgtgtggcaatgcagatgaa

SEQ ID NO: 70387 - DNA, 647 bp, Triticum aestivum
  Clone ID: PAT_TA_70387
ggaaagtaataagctatggaagattttgtgaaaactttttccctcgcttatgaagattttggtcttttgattttgatttatgatgtatgattactacgtactttgatatttgatctctttattacttcccctgattgaaaaaagtagcgtggctttagtcatttagatccttaactaaactataaagtctagacactttttctggtttggtgagtagttgattctgacctaagaaatgcaaatattttcgaagcactcaccgtttaaatgggactcttgcaatttggcgcaaccggtcatcttaactagtttacacatgctgttaggtatacatatttttctaaaccagaatgtgttttaacactttttttaatagacaccaaactatgtgttttttaaacactatttttaacacataccaaaatatatgttttgtttttatgcttaaggatctaaattcttagcgtgtatattttctcaaacataagattgctgaaaagatacaggtatttccaacatcatgctcctttggtgagctaagagagatttctgtatgcaggctgcacagactatctttttttcaattattaaaatatcacctgcttatgcttcatgacatgtaacattattggtagtcatgttttgcc

SEQ ID NO: 70388 - DNA, 537 bp, Triticum aestivum
  Clone ID: PAT_TA_70388
gacccaacccaactccggtacgccgtcgtctagggtgccatggtcgccgctttggctggccggcgccgctgcctctagctccaccgctccacgcctccatcctcggcctcaagtgcaccgcatcctccgcctcgccggaccaccgcgaatctccctccgcctcgactcgacggacagctgccgtggtcttccgccgccgcctcaacctctgtcttcttgcacccaagtcaagtccgacatcatcattcatcctctccccgaagaacatgggtgcaaccaaagttcaggaagctaaggttcacagggcgcacgtacgtaccacactcaccaaggatgggtgtgtccagaggctggagcctcttgcacttcgctcggcaggggccggttggccaatccaaggtgaaatggtagcgaggttgaaggctgctggccttctgccactggcccgaatgatggaaggaattcccagggatttccttgacagggatcttctcagcgcgctagttgatcgttggaatccaaggactcatacatttc

SEQ ID NO: 70389 - DNA, 587 bp, Triticum aestivum
  Clone ID: PAT_TA_70389
agcccccaccaccgaagctcccaaccccacccgaagcggcagccatggcccccaaggcagacaagaagccggccgcggagaacaaggtcgagaaggcgacggagaagacccccgcgggcaagaagcccaaggccgagaagcggctgccggcgggcaagacggcgtccaaggaggccggcggcgagggcaagacccggggccgcaagaagggcagcaaggcgaagaagggcgtggagacgtacaagatctacatcttcaaggtgctgaagcaggtgcaccctgacatcggcatctcctccaaggccatgtccatcatgaactccttcatcaacgacatcttcgagaagctcgccggggagtccgccaagctggcccgctacaacaagaagcccaccatcacctcccgggagatccagacctccgtccgcctcgtcctccccggggagctcgccaagcacgccgtctccgagggcaccaaggccgtcaccaagttcacctcctcctagactgacgatgcgtcgcttgttgtgacagatgtggctgtctgatgtatctgcaagtagaagtagtagttcgtgtggtagaag

SEQ ID NO: 70390 - DNA, 567 bp, Triticum aestivum
  Clone ID: PAT_TA_70390
gcgcagtcccacaccggagttcagcgtcaaaggagaggaggagagatcaaggagggagccgtccctaggtgatgggaggtcaagcatcggcaccggagcgcagcgggataggcgacgccggccggccgccgccccaccacaggcttcgtctatgacgcagagaccggcggcgctgatgtgtcgatcaacgagcgccgccttaagtcctcagatcggcgagggtggcgtcgccttcgtctacctcgacaaggtgcaggacacttgagaaccgactatgtttgtgacagtatgttggggctcaagcgacaatgagcaggtgggaggatcattcgactgaccaagtgcagtatgatggtgatctctgaacagttgcaaggaggctaacaacatgttagctctttttaatatcttggttgatgcgatctgtcagatttagcccaccgagtccttattttgcatttactttgcttctctaaagttctcttcatgctgtaaggaagacgcgagggttggttgcattcctgctgctgccttgcttgagatgaatccatttggttcttttgcctt

SEQ ID NO: 70391 - DNA, 563 bp, Triticum aestivum
  Clone ID: PAT_TA_70391
ggacgtgtccagctacttcagcatgtacgggccggtacaggacgtgcgcatcccgcaccagccgaagcgcatgttcggcttcgtctccttcgtctacccggagacggtgcggctcgtcctcgccaagggcaacccacacttcgtctgcgacgcgcgcgtcctcgtcaagccttacaaggagaagggaaaggtccccgacaggttcaggcatggcggcggcggcggcccctgcctctctcctcaccaccgcgagttcgcctctgtgggcaacgcgacgccgcctgccggtctgctcgactccagggaccccttcgacctccagcagccgcaaatcgggcagagaatgctgtacgggagcatggccggccacgaggcggcgtttctgaggaggaggctggaggagcagcaggaggcggccgagctgcagcatgccatcgagctgcagggccgccggctcatggggctgcagtttcttgacctcaagaacaggggccaccacctcctcggctcccccgtgggctcaccttccgacggcaatggcggctgcttcagtgggaacggca

SEQ ID NO: 70392 - DNA, 620 bp, Triticum aestivum
  Clone ID: PAT_TA_70392
agaagggcacccccaatgttccctcaaatgacaactctggttttacgtttcaacatgtacctcctgcagaccgtcctaagggtactgtttcagcagttccacttgcttcaaataaagacgataaacagaccagcgcttcaccttttatgtttggtgccaagccatccaatacatcagatttggaaacatcaacaaccgctggtgtaaaaaccaaaggaagacttggggagagtgtcacgaagcccgcatcattggacacacctaatttggagcaaggcaatggaagggaaggagctggagatatccataagtcatctgacaaggtgttgcctacggctgcaccaacattgactccacctctccattttgcttctgctgcatctacttcaccgggcctgagcaatggcttgtcgcacacatcaccaccgaagttgtcaaataccacgcccactgataaacctgctgtcagcaccgctccattaactaccattgccggcttctctgtatccagcaacagtccacctgtttcatcttcggttcctgcatttccaactatcaattttggctccagcactccaacggtagcagcaccaaaaccagagacgacatccacagagaca

SEQ ID NO: 70393 - DNA, 597 bp, Triticum aestivum
  Clone ID: PAT_TA_70393
gcgccaaacaaccaagcagaatagaatggaagctccctccgagcagagcaccagaccatttcttccttccaatcgtcctgcactcgtcttctactgcccatggacatggatggtcccgacgactgggtctgggtgcgccggccggcggaggaggaatcgtggcgtccatggacggccgaggaggaggaggagcggccgctcaaggtgacgttctcgtcgccggccgagtacttcacggacgcggcgccgatcggcaacggcagcctcggcgccatggtttggggcggggtctcctccgacaagctccagcttaaccatgatacagtatggaccggcgtgccagggaactacaccgacccaaaggcaccgggtgttcttgcggaggtgaggggattggtcgaccaaggaaggttcgccgacgccacggcttcagccaagggccttttcggtggacagtccgaggtataccaacctcttggtgacttaaatatcgagttcagcacctcggatgaggtgtatgattcttacaaaagagagcttgatctacatacggcgactgctctggtcacatacgtcgtcgggggagtgcagtacaca

SEQ ID NO: 70394 - DNA, 702 bp, Triticum aestivum
  Clone ID: PAT_TA_70394
gaaatcttagtactgctgtgagccttgaagtcttgggaataattgataagttttcagttgctgcagcttctcgaagcatctcgactgactatgctaagctagattgtgtaacatctatcttgatgggtcttttatctaggagccagcccttgactttttggaaagctttccttcctgtggtctataatatatttagtctccatggtgcaacactgatggcaagggagaatgaccgcttcttgaagcaaattgcttttcatcttttgcgacttgctgtattccgaaatgattctgttagaaaaagggccgttgttgggttgcagatccttgttaggaactcattcaactatttcaagagcaccacaaggctgagggtcatgttgactattactttgtcagaactgctatctgatgtgcaagtaactcagatgaaatccgatggatctcttgaagaaagtggtgaagctcggcgtcttaggaaatcactggaggaaatggctgatgtaaggagtaaggatcagttgaatgattgtggccttcctgttactgcactggaagtggctgctgaaggttccacagacaataggtggtcttgggtagaggttaagcatctatcaaagtgtctagtccaggcccttgatgctggccttgaacacgcccttttgggttctgtaatgagtgtggacaggtgtgcagctgctg

SEQ ID NO: 70395 - DNA, 551 bp, Triticum aestivum
  unsure (1)..(551): unsure at all n locations
  Clone ID: PAT_TA_70395
gcatgaaggaggaagataccagcaccagcaccagcaataaagactgcggcaacggcgacaacagtgtgtcccggcgagcgtgagcaatggcagcatcatctctgactccgagtacctgaccaagacgctgcccaggtcacatgtcaaggacttcctcttggacgatgccgcccccttggctgttgttgtcgtctcctcaaataagtcgtatcaggttagttccattgcactgcaaatactaccacttctattgggcaagcaaatacaacttgaaagtataagtcgtatcaggttagttccattgtacgccagtgtcgtctggcacgcgaagtcaatttcttgcatcgcccattgttgttcatctgctactctaaccagtaaccatcccttgctcccaataattttgagctcgcaaatatgacattggttgcttgattagcattatttctttcaaggacaaaactaattgtcaattctttttggatacagcagatggattttggatgcagaccaatgtggnttcttcatagtactagggagccgacaataaa

SEQ ID NO: 70396 - DNA, 394 bp, Triticum aestivum
  Clone ID: PAT_TA_70396
tatgagtgatggaaagtgccactaaattttgttctacagttttacttgggccagcgttgatcttggaccagctgcagaacttattatatgaaatggtagacacacccatgacgactagttaaataaatgtatcttgtttggaggggtaattactaaacagaatttaccaaatattcctaatgttttaactggcaactgatggaaggctaccatttcctggatgttgcttgctgatctttcatagtatcactgtgatgcagaaatcagccttaatggtagcgttatttgtgaagtgtatatcgctggttgcaagcctgccctttaatgggatatcttgctccgtacttgaagtttttatgaaccaacatatcgttatttatttttacctagtcac

SEQ ID NO: 70397 - DNA, 654 bp, Triticum aestivum
  Clone ID: PAT_TA_70397
gaccgagtgcgagtgcgagtgcgagtgcggcggcgacatctccgcctcccaggaggacgccctcgccgcctccccattcctcggcgccgcccctctcgatctgtcccagcagcagcgggaggaggaggaggtggaggacatggtcaccatgtgtaccctcccctccacgccttcccgttcgccgtcgcccgcgcctcccccagaccccttcctgggcgccgacgacaacgacgaggaggtcttgtccgatctcccccagcagcagcagcagcaggaggaggaggaggacgccgtcaccatgtgcaccctcccctccaccccttcccccaccaggtcgccgtcgccaccgcctccttccccgcaacctcgccggaagccgagggtgtgcgtcaggaaggtcagggtcaggggcgccaagatccgcaccccgacacccagccccgacctaccgccggcagtggagccacagccacagccagcccaaccgacagcgccggagcaagcagagcagcagccccatgcggatgcggatcccctctacagggcggtgcaaatggtgggcgccctcaccgacgccaccgccacagccaggagcagcagcagcagcaatgagaatgccgtcgaggacttgctcgcgctcgcccgccgtcgcgg

SEQ ID NO: 70398 - DNA, 605 bp, Triticum aestivum
  Clone ID: PAT_TA_70398
gtcgctgcatcgctctgtcctgtccccgccaccgccggagaaatgccaccccggaggcgggatcgccggagtcatcgcgacccctcgccgtctccctcccgcccaagcgggccacgagcttcaccctcgagcccccgcctccgcctcgccttcatcgtccctcccctgcttctcctcgtcctcacagtgcttcacttcaccggcctcctttcccgatcccctccttacccccaaacgccggggaagaccccactctccgtctatgatcgcggcctagtcaagcgccaagtctccgccggcgagatccttgccgagcacgctagggtttcggagaaccggtcgcgccgccacttccccaaccccgtcctggcctacgtgaccccctggaattctaaaggctatgatatggcaaagttgttcagcatgaagcttactcatgtatcaccagtgtggtatgacttgaagagtgataggaataagctatctttggaaggacagcacaattatgatgctggatgggtctccgaacttcaaaatagcggttctttggtagtgccaagagttgtcttagaggcattccctggtgttgtacttctgaaaaagaa

SEQ ID NO: 70399 - DNA, 655 bp, Triticum aestivum
  Clone ID: PAT_TA_70399
gagttgcatcatctaccagttcggatatgattaagagcttggacgtgaaggcagcaaagcaagcaaaaaggtctgaccattcgccgcagttccctgcaattttgcagatgaacgatgttccgttcatcggatcaggtgacctgcacactacaggttttacagtaacaaacggatacccgaatgaccccagatatacttcacaatttttaagaatgccgtacctaagttctccgagctccgtgtcttcagaaagccttgagagtttcagagatgcgaacgaacttttgaagcaagaggttcaaaaactaaaagaagaggtcaatagcttgagacagcaacgtgaactgcaagacgcggagttgaagaagtcggaggcaaaagccagtgaagccgcagcccttgctgctgaagaggcgtccaaatcaaaggccgcaaaagaggttataaaatcactgacggcacaggtaaaagaaatggctgagaggcttcctgcaggagactctgacgtgaagccgccacgggtcccatatctacctgctggtggtgtagtttctcctgaaatggggagagaaggccagaagagatatgagccagtatccattcattattctcagacacctacttctgtcacatcttcttggtctaacgggctccc

SEQ ID NO: 70400 - DNA, 660 bp, Triticum aestivum
  Clone ID: PAT_TA_70400
gggaaggtttgacggcgaccagcggatgtcagctcgcatggtggtcggcgggttagatcgacggcaatttcgatgcccgcatcggcgtcatcagcaggcgtatgtcctccatgtcagccgcgcggcgggtggttgtcgtcgcggcgctgcaattgaccgtcgtggctgcgatggttcgagcacggttgacatggattgcaggaggattaggatcccgctgtccctgtttaaggttcgtggtcctcccctatttattctcacgcgcatggacccaactggcgtgatgccattcttctccttgcatgcggctgcaagtccctcctcttacaccatgtcgaattctagttttttcttgccaccttactcctactaggtaacatctacttactgatgtgattgcttccaagattttagtgcttatgtgtcctccgtaatttccctttggatctcattcgtgctggctcaccacttgcatttcttgcccacgaggtgtttgttttaatgtctgagtgggaactgccgatgaaaatgtgctcaaagaggcgcttctaccaaggtgacgcacagtaatagattgatggtattgcttctacgatcttacgagtactgaatgccatgttcaagattgaggagatagataagttccttgtgtacaaagct

SEQ ID NO: 70401 - DNA, 632 bp, Triticum aestivum
  Clone ID: PAT_TA_70401
gcggcggttgccctccaaacatagttacctacaatgttctgatagggctttgtgtgatgccaccgaatttgaggaggtcaggcaagttttgatggagagtagaaccgaaggttagacgcccaacactgtcacatacaatacgtttatggatggtctctgcaagaaaggtagggctaatgaagcactcgagcagtgggatgttatggcaggccaagggttggagcccacggattttactttcagtattctcctgaattgcctttgccatgccttgaggattgcctatgccatacacttgttagagtggagtgcatcattggaacggtatgccggtgctgtcgcgtacaacactgatgagcaggttatgcgaaatgggtcgttggaagcgtgttctgaagctgttgacagacatgatcaagagaggtgtgacgccaaacacgagggccttcaacattgccattcgtgctctttgctccggtgggaagttatccatagccaggggcgtggtccgtaacccaggggtttctgcaaacgtcgtgacgtataatacgctcatttattattggtttcactactgtcgagatcttcatgaggtttggcgcctaatttccgacatggcggcagagaagatt

SEQ ID NO: 70402 - DNA, 569 bp, Triticum aestivum
  Clone ID: PAT_TA_70402
gctttctctctcaaacctaggcaagaaatcacctacccctctctctttctctctctcagcctctctctatcctctccttggcatctcatgcccccaagctaagcttctaggccgcgctgatccatcgcttgcatgatcctgcatggaagggggtagccagctgggggcgtgccttcccagcctctacgcgctcgatccgtacgcatcccctcccctcctcgctccattgccgaaccagcacaagcttcaccagctgccgctggtgctccaagagcagccagggaaccacggcgtgatgttctcctcggaccatggcggaggcctgtacccgctgcttccggggatccccttctgccactccgccgccgcctgcgagaagtccaccgggttcgcgcccttgggcggcaccggcgaggcgggcacatcggcggccagagcgggcaacgagtttgctagtgctactactaccaccacagccagctgccatggtccgagctcatggtggaagggggcggagaagggaaagatgaaggtgaggaggaagatgagggagcccgcggttctgcttc

SEQ ID NO: 70403 - DNA, 664 bp, Triticum aestivum
  unsure (1)..(664): unsure at all n locations
  Clone ID: PAT_TA_70403
ggcgacggttccgacggcggcggcgagctctcccgaccttccaagncgttggagatcgctcgtcatgcatgtgagggggaggaccatgggtctgggagtgtttggcttcagaggggtcaaaggggaggagttcatgaccatgttcagcaatatggttcggagagtggtttcggaggaggtagagaaagccatgttcagacaattcagtgcagcagcagcagcagcagcacctccaaggctattagttggccagagccagcgtccgaggtatcagctcacgttcttgaatgatctaaaacctgtttacaccatgatgaagttagaagccaaggatgggtcggcccttaaggtggccatggttgaaaacctcgaaaacgaccagaaaaacgttgtcaggtttggtcatctttcttcggttagggttgaggttgtagtcctccatggcaacttcaatgctaaaaaagaggaatgctggactcctgaggaattcagcaagcatatagtatggggccgagagaaaagcgcaaaactcctcaacggtgatctgacgctgaagctcagtggaggggaagcttttcttggaagtgctaacttcactgataactccagcttcacaagcactaagaagttcaggctagggctgaggcttgtcaatgcctctgga

SEQ ID NO: 70404 - DNA, 665 bp, Triticum aestivum
  Clone ID: PAT_TA_70404
ggttctcgagttcttctgcggcgagatcgagggagatcaagggaaatcgaggaacaggcatttctgaaggttctcgaacccctcccttcccatggcggcgaaggagaccgaacgacgttccttcggcgacctccccgaggagctgatcccggagatcctcgcctgcgttccgcccaagcacctcctccgcttccgcgccgcctgcaaggcctggtgcgacctcgccgccgaccccgccttcatccgcaagcaccactcccgccagccagcgcagcccctcctcttggcttacgacgagcactgcctcgaggccgtcaacctcagcaccaacaggcgccgggcggtcatgcgggttacggtgtctggccgcgtgccctccattgggtccgacgtgctcgcgctccacgggtcctgcgacggcctgctcctcctcggcttccgcgagaccttcctcgtctgcaaccccgccacgcgccaaggtgctcacctgcggctgctgtttcgtgatggcccggaattcctggggttctacaagcacgccgcttctggggagtaccgggtgctgtaccacctggtcgagggcctcgacggggagtactcctactacgtcctctcgctgggatcccagcaggcgatcagggacatcgagctgctcacgtcgtcgg

SEQ ID NO: 70405 - DNA, 629 bp, Triticum aestivum
  Clone ID: PAT_TA_70405
ggcttttgatgttattgtagttttacaccactgtgtgatcgatgaattcgaggtccgatgcccatctgggggccggagtagattcatcagacggtggagttgagtgacccactcattgatcccagatgtgctcaagtgaagccagggatttgatccatccatcttggagcggatgaatcaacagagaatccatccggtcaacaagtgaatttaggcttgattaattagcaggagcatacgagtctcttgtgcacatgtagtttaggtgtacacaggttcaggtagtcaactgttaagcatggtaggattcgcaagctgggcagtaggcggcgtcacggtacaatccagcagggcggcggaggaggcggacagtggtgactggggaggatacgaagtgggatggataggttgagggaaatttgtgggtctggactggagcagagggagatagagaatgggtgagaaagatgggagatgttgataggtaacacctgtagcaacgagatgttgatagtttacttttcttcatctccaacgcaactatcaactgatgcgctaattgtatcatcacagttctcatgtaagcaaaggatcttgcttcttcccgaattagatttttgaagtattcc

SEQ ID NO: 70406 - DNA, 222 bp, Triticum aestivum
  unsure (1)..(222): unsure at all n locations
  Clone ID: PAT_TA_70406
gagagaaaagacactgncacgtacaacatatctgntagtgtgcttgaggtgnacaatgaacaaatcagagacctccttgnaacatccccttcatctaagaagttggagatcaaacaagcaggtgaaggatcccatcatgtgcccggcatagtngangccaaagttgaggacataaatgaagtttgggatgtcttacaaactggaagcaattcgagggctgta

SEQ ID NO: 70407 - DNA, 903 bp, Triticum aestivum
  unsure (1)..(903): unsure at all n locations
  Clone ID: PAT_TA_70407
caatctcgtctccgatcgactccacgctcgtcgaatactcctcccccaccgcctcaagatgcagatctttgtgaagaccctcactggcaagaccatcaccctagaggttgagagctccgacaccatagacaacgtcaaggccaagatccaggacaaggagggcattcccccggaccagcagcgtctcatcttcgctggcaagcagcttgaggatggccgtaccctcgctgactacaacatccagaaggagtccacccttcacctggtgctccgcctccgtggtggtatgcagatttttgtgaagaccctcaccggcaagaccatcacccttgaggttgagagctctgacaccatcgacaacgtcaaggccaagcagctggaggatggccgtaccctcgccgactacaacatccagaaggagtccaccctccaccttgtcctgcgcctgcgtggtggcatgcaaatcttcgtgaagaccctcaccgggaagaccatcactctggaggttgagagctccgacaccatcgacaacgtcaaggccaagatccaggacaaggagggcattcccccggaccagcagcgcctgatctttgctggcaagcagctggaggatggccgtaccctcgccgactacaatatccagaaaggagtccaccctncaccttgtgctgcgcctgcgtggtggcatgcagatcttcgtgaagaccctcaccggcaagaccatcacccttggaggttgagagctncgacacaatcgacaatgtcaagggccagatccaggacaagganggcatttcccccggaccagcagcgcctgatcttttgctggcaagcagctggaggatggtcgcacccttgcagactacacattccaaaaaggagtccnccttncncctggtactc

SEQ ID NO: 70408 - DNA, 635 bp, Triticum aestivum
  Clone ID: PAT_TA_70408
ggactccagcagcacgcacctccctaacatcccgcgcgccgcacgtgacgccacgcatgccattaccaagcgcgatctactggtcagatctggacaccgtcgacggctagccaatacccggccgcccggagcccgcgcggacgaggagctagcggcaattcagagagagcgagccatggatgtggcaacgggcgctataggatccctgctccccaagctagacgagctcctcaacgagaagtacaaactgcaggtgagcatcagggaagacatagtttctctctcccgggagatgaagagcatgtacgctgcccttggcaaggtggccgaggttccgcgggaccagctcgacgagcaggtcaagctggtcaagctctgggcaggggaggtcaggcagctgtcgtacatcacagaggttatcctcgacaagcttcttatgggagtccccgactcacaaggctctacggggcccatggaaaagaagtgcagttggttcaagaaacgcaagcttcgcgatgagatagcggacacaatcaaggacatcagggttcgaatccaaaaggccgccgatcgatgtgaccggtacagggttcatgatattgttaataattacagagccccagtcgctatagatc

SEQ ID NO: 70409 - DNA, 606 bp, Triticum aestivum
  unsure (1)..(606): unsure at all n locations
  Clone ID: PAT_TA_70409
gccgcagcccctcctcccaatcccctctccaccctctgcatcccaaaatccgtccatacgaattcgagacaatctttgcaaatctctggagttccgtggccacgtcttcggatcctcggggtttctccgaggatccgattagagtctttgcaaagacggactgacgcatgcgttgcacgagtcgagccggacgcatgacggggatggatgaattttaagcaaagcagtagcgagttcgtggtgtagaggcacaagatttggtatgccctggtcggagcgattgataaacggcgagcttattttacctatggcaacgcatctggacgggtttcaccaatccttcaacccgcccaccgtaccacgtcaacacgtaatggatgcgccttgttcacttgcggccgcacctctgcagttgtcccatcaaataaaatacaacagtggatagcgccagtactgtgcactgcgaagctatttttttacacgagcctaccggaagcaaacatgtcgtagcagctcgtgacgtgcagaagctgaagtggcatctcaggttgcccgtgacgccgtggatgtaagcaaagtcgtggccagtttttttttttttttnna

SEQ ID NO: 70410 - DNA, 650 bp, Triticum aestivum
  unsure (1)..(650): unsure at all n locations
  Clone ID: PAT_TA_70410
ttcggcacgagggaaatgagaagggcaacaagnaaactttagcaccacgctgggagggaatgataatgcaacaatattcaaaggacaactgagcaatggttctgtggttgccattaagcgtatagagagctcaccaaaacaagatttgctggcattctgcaaagaaatggaatttcttgggcggctgcatcatcgacatcttgttggacttaaaggttattgtttaacaaaatttgagaggttccaggtttatgaatacatggaaaatggaagccttaaggatcaccttcattgtaatacctcacgactgatgtttcattctcattccatgtcttatgctacatcatttgttgaattatgtgcagaaaagcattcttctctttgcagcgtcaggtaaacttctgctgccgtggaaaaataggatccaaatcgccattgatgttgcaaatgctttggtaagtttccggaagtgtgttatggattctgaattggatcaagtaattcatgctgccctgcggtttttccctgtttgtctaagtcagcaattggaatagttggtgttcgcttaaaactgtagtttgtatgtgcaccaagtgtatatcggttcccatccatttctttctatcgacaccaagtatatttcaaatgtt

SEQ ID NO: 70411 - DNA, 655 bp, Triticum aestivum
  unsure (1)..(655): unsure at all n locations
  Clone ID: PAT_TA_70411
gcagattggtgctgatatnaggaaattctcttaccgaactagaataagagttcattcaaagatgaaagggaagatgcagaaatgtcagcttgaagcgggcattgatatagttgtttctacaccccgacgtcttatcaacatggttagaaccactcaagtctcccttgaggcaataaagtatctggtcatatgcgagcttggtttgatgctggatatggggtttgaaaaaacgttaaggaagatagttgatgacatgcatattccaccgaaatctgccagacatactttactttccagcggtactttccaaccagcagtacagaaactggcttgggatttcttgtcagattacttatttatcaccgatgggaggttggagttcagtattggcctaactaagcagaaaattgagcttgcctctgaagaagagaaaagaggcctcctgctaaatctgttacagaagcaatccgtctcttctgccggcatgagccaactcagaacagtagtttttgtcgagacaaaaggaaaggctgattcattgaagaattggctatgcaatgaaggttttcctgcaacagtgatctttgctgacagttcacagcaggagagagagagcgcatcgctacctttccagattagcggcatttctatcctg

SEQ ID NO: 70412 - DNA, 570 bp, Triticum aestivum
  unsure (1)..(570): unsure at all n locations
  Clone ID: PAT_TA_70412
ggttttctcctgtgctctgcttctagtgacggtagtgtctcctnctttggctaatgcgtccagcaaagcaatacatcaggtctacattgtgtatctgggggagaaacatgatgatccctccatggtcaccgcatcacaccatgacctactaacctcggttttggggagcaaggctgaagccttgaagtccatagtttacagttacaagcacggattctctgggtttgcagcaatgctcaccgagtctcaagccgagacacttgcagaattcccccaagtcatcaatgtgaatcctaacacttatcaccaagtacacacaacgtcgcagctgggacttccttggccttgactataagaacaaccaccaacaacaaccgagcctccttagaagagcaaagtacggtgaggatgtcatcattggggtgattgatacaggcatatggcctgaatcaccaagctttgaagacaacggatatggatctataccggaacggtggagaggcacatgccaaactggccagtcgttcgacaacacaaaatgcaatcgaaagataatcggggcacggtggt

SEQ ID NO: 70413 - DNA, 592 bp, Triticum aestivum
  Clone ID: PAT_TA_70413
gccgcacacctcttccacgaccccgtcgcccgtcggttcgccaccgccgccccacgcgatgccggccatctctcccctatttctatcttctcccatcccacacgacaagagcgcggcggagggcgaccgccatttctctctccctcgcccccctccgcctcacccgtctctgtctcctctcccgcacccccgacacggcctcatgcttccaggcgctcgcctggaaggaggcagccgcctcaacagtcttcggtgccggtgtgggcacggggagcgggctgctttcgatgcttgacccgacgctcaccaacgaggagcagtactgccgtgagcgcacccaggtgcaggcgcaagggcattgaggcagagaggttcaccgtagaggggatctcagtgagcaggcacgagacatgcgtcactgcgccggccccatactgcagcagtgtttggatcgacaaattatcaagcacacatggtacgatcatcaagtagtcgtgcggtgtattgcaacagccgtgaggtaaatgagaggggagatccaggcgccggagaggaggaagaaggtggtcaaggccacacatcagctgaaagt

SEQ ID NO: 70414 - DNA, 692 bp, Triticum aestivum
  unsure (1)..(692): unsure at all n locations
  Clone ID: PAT_TA_70414
gtgacaatgaaagtagcctgagnaggagggaaaggatataaccctgaagatgtgcatcatcttttggttgaaaattatgatgcagagttgattaccaagatgatccatgggatgggaaatttacgcactctcctcatttatgatgatagaaaggatatactagtggaggaaaaattcattgggaacttgtgcatgaggctgcccaagctgcgggaattcgctgttacttacacaggtggtagaacaggggaacccaataagttcttcttcccagaggctattagtatgttaaagcatctacgtgattttgttttctggatagagggtccatgtacggttgtttttccagtcgcactaactaaacttcaccatctccggctgctaaatcttggtgccagtgaaaaagtggagtttacctctcttgaccttctcaatttgcagcacataatctggaagtgcatgaactttcctaacgtaggcaagctgacctcactccaaacattgtcatacttcatagtaaggaatgaaaaaggttatgaggtaaatcagctaagggatctgaacaagcttcgcggcaaattgaacatcagtgggcttgagaatgttaaaagcaaggaggaagctcttgaagccaatctaactgccaaggaagggatcgcgacactggtgctggaatgggatggtgatgacac

SEQ ID NO: 70415 - DNA, 545 bp, Triticum aestivum
  unsure (1)..(545): unsure at all n locations
  Clone ID: PAT_TA_70415
agtacaaaggggnaagnaggggacaggcaagctgatagcgggacttctacgctgccggaatcctctccctcgttccctttgagacccaccggccagctatatggccagaggctcctttctgtgtggtccagggccaggcacaccttgaaagccgtgccccgcaccttgaaagccaggccccacaccttgaaacctgcctctgagggccacgacggtctcctctggtggtacaacctcgtgccatgcaacgccggtgagctctccatggcctatgttcaggctaataggctgatggaggaccattgtcgcgtagattcatctcctaccctcggcacctttgttggtatttttgatggtcatggtggtgccgaagctgcccgcttcactgctgagcatctcttccctaatatccaatccgaagccacgtctagctggcagggcgtgacagaggaaaccatcaggaaggcgttcctggacacagatgaaagcttcatcgctcatgtcgagaaacaatggttagtcaagccccagcttgccgccgttgg

SEQ ID NO: 70416 - DNA, 102 bp, Triticum aestivum
  unsure (1)..(102): unsure at all n locations
  Clone ID: PAT_TA_70416
taacctgtgcggncacgacctgaacctgngtatcgcgncggtggcggacagcaaggtcctcttccccaacggctggctgctccccaacgggtaagcacgagt

SEQ ID NO: 70417 - DNA, 498 bp, Triticum aestivum
  Clone ID: PAT_TA_70417
tgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgatggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcatttagtgtctggtaattggaatgagtacaatctaaatcccttaacgaggatcc

SEQ ID NO: 70418 - DNA, 563 bp, Triticum aestivum
  unsure (1)..(563): unsure at all n locations
  Clone ID: PAT_TA_70418
ccttgctacttanctagnaactccttggtgctgatcaatggcggcggtgaaattggaggaagtgagaagggcacagcgggcggtgggtctggcgaccgtgctggcaatcggcacggccgtcccggccaactgcgtgtaccaggccacctacccggactactatttcagagtcaccaagagcgagcacctcccggacctcaaggagaagttcgagaggatgtgcgagaagtccacgatcaggaagaggcacatgcacctcaccgaagagatcctgacaaagaaccctagcatctgctcccacatggagccgtcgctggacacgcgccacgacattgtcgtcgtggaggtgcccaaacttcggaaagaggcggcagagagggccatcaaggagtggggccagccgcagtcaaagatcacccacgttgtcttctgcaccacctccggcgtggacatgccaggtgccgactaccagttgacgaggctgctcggcctctcgccgacggtcaaacgcctcatgatgtaccagcaaggctgctttggtggtgccacggtgctccgcatgg

SEQ ID NO: 70419 - DNA, 104 bp, Triticum aestivum
  unsure (1)..(104): unsure at all n locations
  Clone ID: PAT_TA_70419
catatcaatttgactatagagaacacanctatgtagaatattacaccatagcagatgcatcanttcgaccaagganaaagatcaggggaatggtattacattct

SEQ ID NO: 70420 - DNA, 708 bp, Triticum aestivum
  Clone ID: PAT_TA_70420
cctccttcctgcattgttgtaacttgtaagcctgcatgcatgcatgataatacattcccaggagattgcataaaaagaggctcaagagaaagtaagtaagaatactacgtactgctacaagttcggtgagctagagactaatgcctgcttctcctgcgtaccactaccactaacactacaccaccttcgtgataaccaattaaccagccttgccttcccagctcaacacaagtggaatgagcaaccgacgctactaactcagctccagtttacgcaacatggccagcgacagcaagatttgagcagcagcagcgcggctatgcgtccgtccaggcagcaaacacaggcatggaggaattcggccccctcaacacgtgggcggcggccggcgctggcatcgccatccacgggctcatgctggcgacgctgacggcgttgggatgcttggcgtacagcgagggcaggctgaacctctctgggctcccctctctcgagttgctgaggctggtcaccagggaggacgggttggagtagttgatcttgcctgagacgtcgatgtcatgcgccgccgactcgacgtcgaacccggcgatgccatgcagggacgagcgagggtcgccgccgcccatgaagcccttctgaaggtctgccacctcgggggtgcactgtgcagcttgctgcggtgttccatggagtaccatcctccag

SEQ ID NO: 70421 - DNA, 162 bp, Triticum aestivum
  unsure (1)..(162): unsure at all n locations
  Clone ID: PAT_TA_70421
tacacatgtacaggagcaaaacgagagaaatgtcccaaagattcttcggcagagaacactctatgctncttcccaagcttgnaccccaccacccctntcacgctgnccatcgntcgacggacaacaaccgggggtcattcagatgcctttctggaggtagat

SEQ ID NO: 70422 - DNA, 156 bp, Triticum aestivum
  unsure (1)..(156): unsure at all n locations
  Clone ID: PAT_TA_70422
aaaagcaacaccncnncacataggancacatgcatcctgagcnnccatatgacatgacaaaggaacaaanagaacaaacatgctagaacaaaccaaggccagaaacgaaganccacacangancggatggaangcnagngtgtggccngaagcagc

SEQ ID NO: 70423 - DNA, 679 bp, Triticum aestivum
  Clone ID: PAT_TA_70423
agaaacgagaaactggacagtggttttctcggttcaagagacaagggcttctgaattcagacaaagacaaagagaggaccctccagggtcttaacagtttgctttgcagttcactcatcagcagcagcagcttagatagatacttagatactagtaggtataggttcgaagtgtccgtagatcagagaaagccggtcggtcagagaacaatggcagagcagtagcatctgctgccgattgacttcatccctgtattcacccaaccacagccttccttgtagcgctccaccacatccaagattgtatctgcttcacctttgaccccacccagagtgaatatcgaaccaccgagcacagctgaagagtggtaccctctggtgtagttcattggttccaccatcacccatgacggcattcttggctcgtacaactcaacggtggatgccattgctccagcatcagcatcataaccacccattacatatatcttctcatcaagcactgccactgtatgacaacctcttactgtactcattgctgggagcattttccagttaggctccctaggatcaagcctctcagcagagctggtaacaaacatcgtactattagcaaaatggaaattatgcattctcactttgaagaaataacaagttcattgtcatgcaagccataaaga

SEQ ID NO: 70424 - DNA, 125 bp, Triticum aestivum
  unsure (1)..(125): unsure at all n locations
  Clone ID: PAT_TA_70424
ctgtgacaaacncngcatgtcaccagccancatgaacagcgtgacccagcaagnccatctacatcgntgctcgacggcgatgcgctatctacgccgaaggngacgcngatttccancccggaacc

SEQ ID NO: 70425 - DNA, 639 bp, Triticum aestivum
  Clone ID: PAT_TA_70425
gttagccttctgaaatctgaaacactagtcaccattcaagatcaagatttagctccccaaacataatgactcctttttagaagccagacagacaacaagaactaaaactacaaccgtggaatgtcaatgtgcatacccgggaggccatgatgcacaacttgtggagaaattatgagccagtacacagtgccgatgcatatactccctacaaaatcctgtgtaaacttcagatcgagacaatcattctcaagtatcctagctaagcaggaaattataacttccaaacacattgccaccagactgatacatccttccgattaccaagagaaatgcaaattgcttaaaagaatactgagatagtacaatgtaacctgtcagactagtccaaagttacgacactagcatatacagaaatttaatttagtaaatcatctcggcacattgctgtggctagatttggctctgtggcctcattgcatcaataagtttactcaactcataaagatcttgtcatcaaatatcagtatatactcacatcttataaagttggctaatatcaaaaaatgcaagcagacaaatcaacatgaactactgaataagtaaaactacagatggatatttgaccaaatgagcacacga

SEQ ID NO: 70426 - DNA, 112 bp, Triticum aestivum
  unsure (1)..(112): unsure at all n locations
  Clone ID: PAT_TA_70426
tctattacttacatatttggcacaacactattcagtttgtcatattacttacaaatcggcgcaatttgtctgattgcgtcaacagtacatgtacacatgttacagcctaana

SEQ ID NO: 70427 - DNA, 623 bp, Triticum aestivum
  unsure (1)..(623): unsure at all n locations
  Clone ID: PAT_TA_70427
atnagtattccctctatcccaaaataagtgtcactgtattaacacaagtttgaaccgcaaaaaacaaaataaaaattagtacaacttcagtgacacttattttgggatgcagagagtattatataactataatgaaccctgctgtgtaaaccaatggattgagttggtaccctgcaaaatcatccatggtctggtatgttcagaaacctcataaatgaaaagaacaagcaaacatcaggggactgcacaaaattgtccacgttgtacaagtacaaataatcaaccagactagaatagcaacggcagcacgtgccctgaaaacccaagttttatctctgatttcctgtaccgttcttcccctcttcgttgcctcttctctcgtaacggccaccagaatctctgtcgtgcctagaccgcttgctctctgatctatcttctcttcccctgtcatcgcccctctgcttgtcgcctcttggtctctcgggcgatttctcgtacccgttcctatctctatcttttatgtccgatctttcttctcttcccctgtcatcgcctctctgtctgtcgcctcttgatctctcgggggatttctcgtgcctggtcctgtcactatgttttgtgtc

SEQ ID NO: 70428 - DNA, 108 bp, Triticum aestivum
  Clone ID: PAT_TA_70428
tacatgaaaaatagcacaaggttcctacagaaagctgtagatgagctttttctaaactaactatagcatggtagatgacactatcatacaaaatatttacagggaagc

SEQ ID NO: 70429 - DNA, 216 bp, Triticum aestivum
  unsure (1)..(216): unsure at all n locations
  Clone ID: PAT_TA_70429
ttacatacatattatttccagaaaaagagagaggaaaagtagcaagagctgaagaagaacgagtcccaaatggagtctagctagaagcctcagccctcgatcgagagggcaagcacaaccaccgatcgaacagcacanacacatgcacacgaccctgcaccggccaccanccctnaagaaacggaacaagatcacnctaaaattaagctatancgg

SEQ ID NO: 70430 - DNA, 651 bp, Triticum aestivum
  unsure (1)..(651): unsure at all n locations
  Clone ID: PAT_TA_70430
ttatatttattcnatnaacttcctacctattaacctgaaagtttttttngataaatgattcagttctcaaatgagcaaatcgttaatctatactccgcctctcaccgtgcagccgcccagaatagaagaggacgactagagtagaggagtctaattccaatccaaacaattgagggagtctaattatttttccgttcttgattgtttcaattgcacttccttcattggagggttgcttggaaagtgcgatgcccatgttcaatcactgaagtaatgaatctaaacaagaaaacgaagtagaagtgaaaaacttttataatatatttttacatctctttgctcagttttcccctttaatgtccctctccgtcattattcatagtaatgtgctcctcgctgagaagatttgagcacgactacttgagaattgagctcttcatcgattggttacaacatgtggccgtagtggttgcggcagcacccctcgtcaccgtctatgtaggcagtcggaaggaatcaccatggccatctctcacatggggaggagtggaggtaaagaggagagagcagaatggtgttgcgagaggaggaagatgcttataggaggatagggtgaaacaacggtggggtgggccaatcacgtggctgcgc

SEQ ID NO: 70431 - DNA, 713 bp, Triticum aestivum
  Clone ID: PAT_TA_70431
cacaaataatggcactgcgaataaatttagcgtgctaatcatggtttaacagaggaaatgctaactaaggtagaaatccagcaagaataatcatttagttccattatcaacatgtatctgtgtaaatcatccatgccaaaatgtgttgctgctgggatagtcactactgaaactttcaagatcaacttctttgaacattttcattggctagctttaggaaacggcaagttcatggccgtctccatcggctgcgggctgaacccgaaagagagctacagcgccaaggacgccgccaagtgggggatcctgaactgaatcgtcaaggatggcactgcccccatcgtcgacatgttcaatgtcgccagcgccgacatgatggacataagcagctaaagctgtagagatgcattaacacaaaaacacaagataattcccaacgaaaaactgacaagagcatgaactcatttgtatacaccctctgttttctccacaagatattcctctgcttatgagttaacatgtgcaaattcatgaacaaattgaaaaatgcccaatggaagaaaacacaaaactgcacctctaaattggtactccctccgttccaaattacttgtcataaaaatggatgtatctagaactaaaatacatctagatacatccatatctgcgagaagtaattcggaacgaaagggagtacttcaaaattacatacc

SEQ ID NO: 70432 - DNA, 580 bp, Triticum aestivum
  Clone ID: PAT_TA_70432
actgtttgatgcaacagagcatgcttgcgaactatagcaatagaaaacgggctggctctgaaaaaccccttgaaaatgtacagactacaatgtactaggactaagacatgctgcaagaagagtctcttctttggtttcaatacatacagccgcttgaagccagtaaactctttatttgccagtccacaggaaagaatgccgccttcgtgcccgtgcttctcttgctgtgtgcaccaatgtctaatcttcttcaggataatctttccatcaaactgtgaattggacttccggattgatgaaccttgatgaggctgaatacatacctctgatcatttccgtcatatatcctccatcttgggaacaaaaaactcccacctaaggctttgactcaaaattgtccaaaaggtgaccgggtatacaaactaagaccagccgctgatcacgaaaggagctgcaacatcacccaaactcaatacctagttgtttaacttcttgaaaattgtctggtgacaaactgctctcatctttcatctcgatatcaatggtctctgcgttaatggccaccctgcatagtccaaga

SEQ ID NO: 70433 - DNA, 254 bp, Triticum aestivum
  unsure (1)..(254): unsure at all n locations
  Clone ID: PAT_TA_70433
acatctttacacctgatnngtncagaaatncancttacaacatggctactcacctagctacgagtgcagaggcgcacagcacactgcttgttcgtnacagttctacanccacctgtnngttctttattcttnacccatatggacancatgcacagngaatttnngnnccaattgctgatcttgcntgcactcttntgatttatgaagcccgagtagtnttttctgcctncacggcaacattctgcacattgcca

SEQ ID NO: 70434 - DNA, 629 bp, Triticum aestivum
  Clone ID: PAT_TA_70434
catgccgacggtctgatctgaacccggtggagtgttacaggctctacaagaaaattacagggtaaaaaacaacaccactatcccaatagtacagttgcacaacatctacatcgccgatcagtgctcagacaaccatcattttcttgatatagcatgcttgaagaaaagtaaaaacacgacaggagtttccgtatcacgtcgtctcctggaaggacgcaaagcgggattgagccgcggggttcgcttgcatgacgcgggctgcgttcgacatttgctccctgccaccagatttcggctggaacgctctaaacatgccacgctcgccaggttcaatcccgagggtggtccagatcgaactctttgcagcttcgtcggggtcatctatccggagcgtcttcggaatccacaaggatctttctgccttttcaccaccttgcggttcagaatctctcgggtgttttccgaggactggagaaccactatctgaacatgtactactgcttgtgggaggtgctgctgacatgttataagcaggtccaagccacggcgcgctccacgcaccattaggccagggagaaaccaatggccagatggaaggcggcattacagggaaaggaatgggtgggcca

SEQ ID NO: 70435 - DNA, 733 bp, Triticum aestivum
  unsure (1)..(733): unsure at all n locations
  Clone ID: PAT_TA_70435
tatcttttgctncattcaagaatgcaccaaataaaactacatgatggccttgagcaagaataaaacacaaattgcaactttggaggttgtgtctatctcatgatagactgaacaaatgtcacaactgagactactcttacacaggcagaggactttttcctggttccccgtcagattgttgattgcttgaatcagttgcaacagaagcacctttccagacatcgcacccactttttccacttctccttcactaaccttgccacttcgtcaaatgacaacacgacatgaatgacgatgtagatgatcacggcaatgacgagtgcaaaaatgtatgcagatgtcttcaacttcctgcagctgcccgcggcatatgccccaagtaaaccaagcaagtccaagaccattgctattttcatggcaaagagagatctcttgtacttgcttattgtgttgttcagtaggaggatgaccatgaccattgaggccatgaatgctgtggcgttgcaatagaagaataccttgtaccgtgttaggttggtatcatggaggattgggtcacctgcaaaatggccatcccggtcatcaggccaaacccctcctggcggaagcagaccggcttggtatgtgacagtgactgcaagagttccaatcagcatcaaatctttgcgccatttgtgctctgttctcttactatcagtatcatgtatacttctcgtgtgattcattgatggat

SEQ ID NO: 70436 - DNA, 224 bp, Triticum aestivum
  unsure (1)..(224): unsure at all n locations
  Clone ID: PAT_TA_70436
aggccaaccgaattcaaangatcatacgcagggaaagaacaccagcaggcntactaggccctaacctacaacaaaggaatcccagatcaatgcctacatgagctttttgcttgtgtnaaacaaagccaacaaagcagtggtggaagcctgctatgttatcacgatgcctgcaatgtcaccgagttcacagtcaaacccgcatagttgttttgtcacccgttaag

SEQ ID NO: 70437 - DNA, 618 bp, Triticum aestivum
  Clone ID: PAT_TA_70437
ttcgttacaataaggggttcgtcgtgccaggctccgcggcgctgttgcttccatgtgatggtgttgtttggcatcggctacaaaaacagccacgaggaccgggagcttgcagcaacagcatctccgaccccttcctgatgagctgcacgttgtggaccaggtcccagtggagggccgtcattggctccacctgcgccctcttgctggccttccatagaggatgaggagtttgtggtagcatctccggcccctccctgacgagctgcaggtcgtagatgaggtcctagccgaggagaacattcccctggaggagggtgtttgacaacctgaggaatggccgtgatatcctcaccgctgacagcgccttcaaatcttaggcccaaacaagcttgattgacgaggaacccaagttcttgggttcgtggaggccgctgccatcacgcttgccaatggatgttctggagagcatatctatgtgaagaaaagaaaaggctgccacaggacgccgctcaagggaagaaaatctatgctggagatgggagagcaagttttatcttgtggagggcgagaagacggactgatggaccttgtagcggcgcttggttgtaattgagctcg

SEQ ID NO: 70438 - DNA, 669 bp, Triticum aestivum
  Clone ID: PAT_TA_70438
cttaaataagacatgatccgaattaagcaactagccgccccgtgccagcaggctcacaagacacaggcatataatatatcaagcacatcaccatctgatagaggctatttaagcaaatacagtagaaagcttttctctgctctcaagtctgaacttctaacgccttctcttcaaccctctcctagtttcagtgatcggcttcgaaacacgaaaactagcccacccatgtgctgagttccagtccatttcatagtccgtcagctctgggtgttgaatgaaataatcgattgcctctcttcttatcccctcttctatttggtgtaagctactctcgtccgggaggttgggcgagatatgaggtgcaaagccaacagacagctttagaggtggccaggctcttatggtgttgatataggcttcattacttgagctcctcgagcagtgatcagaagctgaaaaacaacacttgaataaaacgaacatcacttcttgtgggaacctgcctgtcaactcggatgagatggtattgttagcacatggcttgttgatcccatttgctatgcaacacattgggtctggactccattttgtagtcattcggactatctcatcccagcatagcgaatcgactgaatcacagtacatgacatcttgtgtaggtaatcgagt

SEQ ID NO: 70439 - DNA, 660 bp, Triticum aestivum
  Clone ID: PAT_TA_70439
cttaatcggtgcccaaagacgaccatgttgtcacatacaagtatgaaagcaaggtcccctttcgtcgatggtgttccgcaaagtacccgaacaactgcacaataacttgcgtggatttgtatgacagtgggacgtaacttcaagttatcagatggacacagaggacttcaatgtggagtcgctgagtttcaaggtggttgatctcgatggaatgtcttagatcgaatctaatctaggctaataaaactagagcttcgattccgttgtattggcgcttgaagtagaagctgccccttttcctttggtcttgaggcttatttatagcttgtcttggcccgccaggctccttcgtgttttgatccctgataatcccattgtcatagcacttttcaaagatgaaggtagtatgtagtgttaaacacacaaggagctagggtactgctgcaaaatactttgcgtacagcgcactgcacattcgctttcccaaactgcagcgaagtgaaaaggatagctgggtctcaaatcaagaaacaaactgccatatatgtacacagaaaccgaatcaagaaaccagatcaactaacttcccatggcatcagtcagctcgtctgactgcatgcatcataggggagtactgacgatatcaatacttttgcactc

SEQ ID NO: 70440 - DNA, 554 bp, Triticum aestivum
  Clone ID: PAT_TA_70440
agcacaattcttacaaaggttgtaacatcgtactgatgccgccatcagttcatgaagcggcgatcaatcctagctgcctaggaggaggtgaacttggtgacggccttggtgccctcggagacggcgtgcttggcgagctccccggggaggacgaggcggacggaggtctggatctcccgggacgtgatggtgggcttcttgttgtagcgggcgagcttggccgactccccggcgagcttctcgaagatgtcgttgatgaaggagttcatgatggacatggccttggaggagatgcccacgtccgggtgcacctgcttcagcaccttgaagatgtagatcttgtacgtctccacgctcttcttcgccttgctgcccttcttcctgccccgctgcttcgcctcgccgccggcctccttggacgccggcgcccgcttctccgccttgggcttcttccccgccgtcgtcttctccgcggccaccgccgcgggcttcttctccgccgccttgggtgccatgggtgctgctgctgctggtggttcgagcgtgtggggagc

SEQ ID NO: 70441 - DNA, 157 bp, Triticum aestivum
  unsure (1)..(157): unsure at all n locations
  Clone ID: PAT_TA_70441
cncaaaagacaccacacatacaacacagntgagatgtactaacgggancgcaaaangaaagaacaaacataggnacatgtcnaggagnnagactaatagggcgaatgcngnanaactcatggaaacatggtnactgagaaaacaagncatgctaagt

SEQ ID NO: 70442 - DNA, 709 bp, Triticum aestivum
  unsure (1)..(709): unsure at all n locations
  Clone ID: PAT_TA_70442
aactggggaacaaactacaacagtagcactttcncctctcttccttcccttggatngataggaaatcctcacttttccaagacagaagagaagcaagcaacggattgagcaactagcgcgaaagccgttgcgcgttagcgcatccgttttcttgcttgatttttatacgattttttgagcaactagcgcgaaagccgttgcgcgttagcgcatccgttttcttgcttgatttttatacgattttctgaagtgatctgtccaactaagtagaaaaggacactagagtgtggctacacgtggtatagggctgctcgtcccgcctggtgttgagggagctaaagtggaactctcacatacatgttccttaagtttttagctcgctaaatgatacagtcctcgctgatggatcggcaagtactccacggtcagcggctatcagctaacgttatgggccgttagtggtggttcattgcctatagtgttgtaatccggaatccaagttttgtgataaccgtgttgtttactttcagtgttgtttattgttcacagctggattgagctcagttgagagtgtcatgctctgtcaatatctgttgcaggagttgtcattctctgttactagagttgtcaatctcagatgcaggagttgtcagttgcagccattctcgctgtgtcaagcttgtgacttgcgttgtatcaggttggtaac

SEQ ID NO: 70443 - DNA, 619 bp, Triticum aestivum
  Clone ID: PAT_TA_70443
ataataaagcgtaattgatagcgtacctaatatcaatacagaactaagttccccctaatattaacgtgcattgcacatacacatttactagtatagataggttgctcctctaacatggtatcatgacactaaatgattttactttggatgccgtaactcatccaaatctcgatcgagttgtttgtcggtctccggatcgacctcggcgtacagtcgatttgtttggcttgtgacgctcattcctaattggatggtagggtctctctctagatcatgtcgctgccctcttcttctctcgcctggccatgttgtccaccgccgctcctaccacctccattctctccgccatccgagccgcatgtcctcgtccggatcgcagtagctccctcaagtccgctgcatgtagccaccgtagaatagccatcctgacaaaaaactcttttttttagattttctctgagttggtcgagaagaacatttaactcacaatcatgaaatgattggccacgcccatgttgggttaataaactatgcagaagttttggaatatttggcttctgagacaccggcacaaatgcaccacagtgaaatcgccccttcagcttatggtatacctcat

SEQ ID NO: 70444 - DNA, 150 bp, Triticum aestivum
  unsure (1)..(150): unsure at all n locations
  Clone ID: PAT_TA_70444
ttaaaaaactctgcacatcatacatctcagcacgcangcagcacacccagggcacacacacccacnancacacacgcacgcacacgagcacacacgcacgcacacagagattctttgntaagancatttttttttaagactaacaaaaaa

SEQ ID NO: 70445 - DNA, 662 bp, Triticum aestivum
  Clone ID: PAT_TA_70445
cggacacagcacaacaaaatctgtaacataaacagtggactaaaccacacaatccctcccagggtgctttgagctcttttgtcgatgatggacctcaccgcgtggcgaggtggactacaccgatcggcgacctgggccgcattctatcgcatggtgaaccgcaacactgaatagaagcaaacggatgtgcacgccatgagaggctacagagagactgcaggcaaagtgctagtgagttgcatacgcgcacatggatgtggagtctatggtaggtggaggtgcaaccatgtgaaggcttgccgccatgctacacaagctcggggcgatggtgttcctcgtcaaggacgagctctgccttggagcaccacctctggccagatccgacagggaagaagcctgcccacctgccgtcgtccatgcccaggaccacggcgtggcttcgtttgccgatggtcacatgcgtccatcaccaaccagaggggatgcgtccctgcgccatgtaccgcaggcagtggacaactccactaggaggagcggcgacccctgtagcggccggacccgaggcaggagatgccggatccgaggctggagcaatgaggggggccatgccagcgagggtgcactgcattcacacgcccatcggactgcacgggggggggggg

SEQ ID NO: 70446 - DNA, 630 bp, Triticum aestivum
  unsure (1)..(630): unsure at all n locations
  Clone ID: PAT_TA_70446
tattacacaataacagcagttttgataacatgcngtacatacggcatttccgaaaaagaaaaaaaaattaacagtgcatacaacatactggtagagtgtctcggccccatggactatttatttatttttattacatgacgaaaatatgagtgaaatgaagaaaaaagattaactcggaagcatgcatgcatataatgttatgggcaaacaacaacaagatgcgtgtctgtatatgacctcgaaagcttcatctgtatatggtcacttttggccggcgatacaagatgcatgaagatggttgcagatagattcaggtactagtaaagtggtacttacgatgatgaaataaccaaccacacggaaggattacctcgtcgcctccatcgccaacgaagaaaccgatcacgctgcttccagggtctcctcctggatctcagcgccactcccatcactgctggaaacctcctgtgcgctctccttccttggaaaacgctccctctttcggccagagaccaaaatctcgatccagcggggatgctcctgggcttctttcctcacgacgtcaatcatcgcgctcacacacgggctgctctctgctgctcctttataccattcctcgttgcatctgaa

SEQ ID NO: 70447 - DNA, 480 bp, Triticum aestivum
  unsure (1)..(480): unsure at all n locations
  Clone ID: PAT_TA_70447
tgtcttaatatcttngtagagcagcagttgagctcagctgcttaggaatccaccatcaaacagctacaaacaataactgaactccatgaagcaagtgctccttcatgcgagcttcttcagatgaacttggtaactgctaccactacgggaagctgaagccgccgatgcccggcctggcaccggcaggcgggctgatgtagacccagagcagcgacacgatcatgcagatgagcccggaccagacgaagacgatggtcggcacgcggncgcggcgtcccaggagccccttggcgaaggggtagaggtggcacagcacccagaagctgaagaaggcgccgttgccattgctgtaggtgcccttggtctcgaagagccaccgggcgtggtcgaaatcggccggcttgccgccgccgttgccattgctgctgggcatgggcatcttgatggagtgaaccatggagaagcgcttggacatggacg

SEQ ID NO: 70448 - DNA, 168 bp, Triticum aestivum
  unsure (1)..(168): unsure at all n locations
  Clone ID: PAT_TA_70448
tcngaagtggaagcangtncatttaagggtatactgtcgataatgtgatcgaatcccattggtctggagngatcttgnngtnnntnaaccnggntntgnagaaaatcaagctccactcgtttnnntctcnntccattacatcngagcccatcatgtagcatatctaac

SEQ ID NO: 70449 - DNA, 595 bp, Triticum aestivum
  Clone ID: PAT_TA_70449
acttttttttctgacatacaaaatgaccgccgcttactcacattatgagcttcattgatgagacggcaagacacatggcatacaagacaggaatggctaatcccagacctgcccttgtatgcaaaggtaactgtcaaaagtatagaagctaggaaacgctatagaaactagctagtgccaacaaatctctgatgcaaaacggcgggcagatcaacaaagatataacggagtcgcagcatcaaccatttcaactggatttagaagttccttctgcctcctccgctgtttctgtgatcccctgaagaagttccttcggaattgcagctgggtctacctcatagctatctttggggacgtttggagcttcttccccagacaacctatagaaggggacctgatgtgaaaaccgaaacatctcctctttcggaatcctcttgatgacgttccggttctggtgacgctgaaaaactgtccgaaatccagtgaccttaaccaagggaattacagagattccatgatcttcgtcataatcatccagtacctcaaccagatcatagacatgcagcacattatctggagtatctccatcccattc

SEQ ID NO: 70450 - DNA, 175 bp, Triticum aestivum
  Clone ID: PAT_TA_70450
gcatgttgaatattagctgccccctgcatgatgataatcaaacactaaatcgacgggggcaagtccgaagtccaaactgctctgtccacgccagagcacggtcaaattaacaccagatcagaggagaagcgatttgcactgtccaaaaactatacaaaaatcatgtgtacacatg

SEQ ID NO: 70451 - DNA, 685 bp, Triticum aestivum
  unsure (1)..(685): unsure at all n locations
  Clone ID: PAT_TA_70451
tccgagtatagtagtnaagagaccaatttcaagactttgcaacccagaaatgtcccctcgtttccctgccagctcaaaaaggcctaatgtgcctttgctttctacggatcaaccgcacttgaacaaattttccatgaatctgttaataatcccttgcacttctagtcggcgactcagtgcgcatgatggaacacttggtcaaatttggcaagagcaaacactacccgtgcacataaatacaatttttgggtggaaaaaagtggccgagttcactggaagctctctgcctgcattttctggtcgtccccagtagtgcatcggccattgagcggtaccaagaggaacaattttgaacaaattctcaaaaaattaattttgatcggaaacaaactctcaaaataagtgggattcttctttgtccggagcaaatttccttagattcagtcacattcagatgccccccaaaactctgacaaaactgggcgtgcgtaaataattggacactgaatcacgcggggagcagaacagaataggaaactactgtacgtaattcgctggtggatggagggagggatggcggcgagagagagagagagagagagagagagagagagagagagagagagagagagagagagagagagagagagagagagagagagagagagagagagagagagagaga

SEQ ID NO: 70452 - DNA, 678 bp, Triticum aestivum
  Clone ID: PAT_TA_70452
aaaaacaaagaaaaaaaatctaatctaattgtcatctcgcccaatctcgcggtgtcacgatccggcaaccgcagacctgctgcagtctcttgtcatgtcctctatgacggcagcgccgtggcaatgcatccagctcaactccagggccgacgactttaagatgagttgggacgttgccttcacgtagctcgagggtggcgccagtaccagcgcagtgcagctcatcaagatcgagtgcgcggcatggccccggccaggtaatctaatggctttcttcactctcccttaattttcctcacaaatcaaacacctatttgtgcaaggggaatctcatcaaacacctatttgtgcaaggacgcgactagcgggcaaacgtctgcccgctagcgcctcctggcagcctcccgtattaagtaggtttcggtccccttgtccagatttggaaagtgagagggtccaccgtctcttgcgtctctcatccacccagcgagagggagcgctctcgacgcgccgttcccacgcccttctgcttcttctccccacgcccctctcctcccttgcccctcatctgaaggtccctgtaatggcttgttcatcgtgattgcaaactccctttccaatgttttccccttgtttcttccatctgcatgagcaactagtattgatttgtactgcacc

SEQ ID NO: 70453 - DNA, 530 bp, Triticum aestivum
  unsure (1)..(530): unsure at all n locations
  Clone ID: PAT_TA_70453
actcttcccttcccttcccttgctattnttattgattattcattattattattattacatcaaccatatagaagatataggcctacctcccaggagccaggactctttaagactgaggaaccactggaacagcagctgagcccttgggcttggccgccacttccgcgagagaggggcagntccgnggccgcgaactgatcttgtcgctcagggaccgcctccacttnctacccgtgcttctgttgccaccaggtgtagcagcggcagcggcagcacatgagcgcgccgtgtcaggaacatgtgtagtggtatcaaccttggacaggcttcgcagtttcctcggcgtgccgcggttattatgctggctgccgtccggaaacctgttgctcaggcatttgcttaagccggtgtgcaccatgatgccgtcgtcgctcanataaccgttctccatactgtcccgcatggccaggtcgtcgtattcctcatcggacctgttgcagtcctcgtccacagacccttccatctcatcg

SEQ ID NO: 70454 - DNA, 667 bp, Triticum aestivum
  unsure (1)..(667): unsure at all n locations
  Clone ID: PAT_TA_70454
tgatatgccgccggtnngtttaccccaagtacagcaagatgaggtccatggcactcagatagatccggggttggttttatacccattacaaccagtgaaaggtaatcttctgaactttaatgcaaaagtaaagcaagtgaacaaggagacagtaataaaggtaataataattcaaatagcgacccaactacagtcttcagagccgttttcttggatgtgcgaccaagggtggtggagtgtcgtaagtcggggtggagcttgcatgccgccaatccactgctgggcgtcggtttctttcagttaaaatcatgagaagtgtcgatttcttcagttaacaagatgacaagtgttgatttcttcagttaacaacatgacagctgtcgatttcttcagttaacaacatcataacaaatgtcgatttcttcagaagatgatgcagtctggttccattgcacacacgttatgaacatgaaaaaggcctcacaccgtacatgctcatcacagcaatttaattctgagcaaacatcacaagccgacaggctatatgtgcgtctgccagcctaggcagtgtttctgcttcttccttagcttggcttcagatcttccgcggactggttgcaactcaatccatcaccctccttgacagcgattctcgcatgaatgaacg

SEQ ID NO: 70455 - DNA, 678 bp, Triticum aestivum
  unsure (1)..(678): unsure at all n locations
  Clone ID: PAT_TA_70455
ctacaaactgtatgcaacaaacagcagcacggnactgactcatggagcaaaagctaggctgaagataagcacacaaatgtacaggatgtacaggacacatgcacagattacacacacctgggaatcatccacaggctaattgtcaattattattacaaataacactggatggttcaataagttgcggccaactggatatataggactctggcaaactaaaacacatgtggacatttgcgatgatgagatcaggcatggttactcgctggcttgacaacggtgacagggcaggcggcattgttcacgacgtaatcgctgacgctgcccaagagcaccctgcagttcagagatacaaaagatcagcactctattatgatgaaacaaacacacaatgtggcttaagaacagcttggaggtcgtttggccggtggtcgcaacctcttgagcttgccaaggcccctgctcccaatgaccagggagctgatgggcatgtcatggatggcttggcacagcttctcgcggggatctccaaacaggacttttgaaaccacggagacctccttctgcttagctatagtgttgagcatgtccagcgtttcagcatcaggcttcaccccatatttcttttgcagttgaagggtgagagaactccgagagggggatcaaaggcgagccgga

SEQ ID NO: 70456 - DNA, 668 bp, Triticum aestivum
  unsure (1)..(668): unsure at all n locations
  Clone ID: PAT_TA_70456
ctccctctccctatacaatgtcgatagcagagataacaagttcatctagaaaatcctaaaacacaggtttttgtccatagggtagatatagcagatcgcatcagattctagatatccattcatgcctcacaaaatatgaactttaagccgcaaagacatctcaaggggacatcctagtctactcccagccttgagcagggggttgcaccgcggcgtatctcatgggagagtcagtgtcacagaaggcaatggtagggatgttccccagagcagactccttgatgggctggtggtcggtccttgggtcggtgaggatgagcaggcggggctcgctgaaggaggtctgcatctggttggtgaaggtaccaggggtgtgcctcccggcgatggcgttggcgccggtgtgctgcgcgaacttgaggacggcgcgctggccgtaggggcgggcggactggacgatgatgtcctgggggttctcgatggcgacgatgaccctcgccgcgagctggagcttctcccatgtcttgcccagattgatgatgtagatgccgtcggagcggcgcttgtaggcgtagcgctccatctggaagtcgcagttcttggtgccgaggtggacgtcggcggcgagcatcatctgtatgtcctgctncttctgggacagcgcccga

SEQ ID NO: 70457 - DNA, 142 bp, Triticum aestivum
  unsure (1)..(142): unsure at all n locations
  Clone ID: PAT_TA_70457
ttgctcgangaatctgacgggcactacagactagcagncnctanatacaggatcgnatcntagtccatnagaaatggatctangcaacantggctaggctatggggacgacggctactctttcgtggcggccgtcttnttct

SEQ ID NO: 70458 - DNA, 123 bp, Triticum aestivum
  unsure (1)..(123): unsure at all n locations
  Clone ID: PAT_TA_70458
cctgtataaagcttacaataaacnccagcgtctctagctgctcaggttagcaatcaacccgtcatcctacttgtttctccaacagctgctactgctactagtactacaatacatacacataca

SEQ ID NO: 70459 - DNA, 642 bp, Triticum aestivum
  Clone ID: PAT_TA_70459
tttgatccatctatatagcaccttgaatggcagacattttgcacctcaaaacaatagagtccttccgtggaagtgaaccttcaacatcttcaacacgcctacgtagcataaaaggttccaaaatttgatgaagcctgtgaataataatcactttcttctcggtctccaaccaatcatcttcttcgttaggtgtaggagcatccctctgaaaaggctttgagaaccaatcttgaaatgccttgcggttgtcaaacacttctggaagcaacaagtttagaagggaccaaagctccttgagatcattctgtagaggagtgccagtgagaaggagacgtcgctggcaacgatagcgatcaagatcacgggccaagactgactctctgtccttcattcgttgggcctcatcaattataatgtacttccagtcaattcttgaaagcttagaacgatcaaacataacgaattcatatgttgtcacaagaacattaaatttgacagccaaaacctcttgagagaacaacttttgcctttgatcctttgcaccaacataaaagatgcaagatgcggatggtaaccaatttagcagttcactcttccaattgaccaagacagcatttggcactattatgagatgtggtccat

SEQ ID NO: 70460 - DNA, 759 bp, Triticum aestivum
  unsure (1)..(759): unsure at all n locations
  Clone ID: PAT_TA_70460
caaaaacagaggggtaaaaacaagcatcatccatttgttgcatctgtcttcatcattaaacctaacggcgtacaaaaactcctgccaattgttggcagcccacatcatacagttgtaatacaacctactaattcgcacccccaaaacctgcgctcgtcataggctcgcactccgcagcaggggcgtctttcttgtcgtcttcacccttgggttcttcgccctcggctttgctgccatcgccatcttcgtcgtccgcgggggaggcatccttcatctggtaatccaccttgaagtcgtagtccgcgtccatgtcgttcagcacgctgaacttgttccccttgcgccgcttcttctccgctttcttcttgcgggggtcgaggatgccctcggcggtgtacagcttgtcgtgctgcgtgccaccactcgccgccgccttgcttccttcacggtcgttcgcgtcggacatcgattcgtccttcacaggcgcactctgcgtcaggggatcctcgagcatcgcttcatcaatctctggtggggcattagatggaatttcaatatgactgaactcctccatagattttagaccactaatatatgaagactcagctttgtaaatttcatcaacattgaattcacttccatcttctgtgataattaccgcattggcgtcctccacaacatcccttttaggtggcagtgtaaagtanggtaccttgccttcattncagtcatgaatcactatttttgcagcagcttnca

SEQ ID NO: 70461 - DNA, 894 bp, Triticum aestivum
  unsure (1)..(894): unsure at all n locations
  Clone ID: PAT_TA_70461
cagatgctnaaaaataaccccaatatgaacgcagacttttacggtgttgcttgctcggacacatatattacctgccccctacccctaagtatgttgcctactgaagaaaaacagatgctgaaaatagctataggagcacagatattacagtattgcccacggaaaaaaatctgttgcctactgaagaaaacagctactgataaatagctaccaatatgaacacagattactatagttttgcctgctgaacacatatattgcctgcccacaccccaaagaaacccgcagcaggtctgtattttttttggcagtattcgggtgccatttggtaccatttggcaggagttcagggttgatatatgcacttctctcattcatgaatcatgacaacatattttattagttcatcccgcatgagcacttgctgctggctaataaacccatggacacataaagagatctaccttattttggatgttcacttccatcaagttgcggaccttgtcagcttttgtcatccttcaccaggtggtatttccactcttcgagtcctgggctgccttggatgtggtggcaatgaagctatcaattgcggttcaacaggcagcgagctttcccctgagtgatcttcttctccactttgggagcttgatgattcctgctgtggaaagacttggacagacactctcgtctttctttgcagtttttgggntgagcttgcttctccttgagcctcgaacttgatctcagaccagctgcgggccttntttttgagcagcagcaccagaattccttgancgcattagcagcagacagactggaactcgctcttgaggtttcccctgagngatcttntttttcacttttgggagcttgatgattcctgctggggaa

SEQ ID NO: 70462 - DNA, 364 bp, Triticum aestivum
  unsure (1)..(364): unsure at all n locations
  Clone ID: PAT_TA_70462
gacctttttcttntatgagnctaaaaataagagttccaagnctgctacttaaaaagtgcatgctgcatctacaactattttgctatacaaatgtgcatctcaaaaaaagaaaccacaagatcaggaatcaagatcagccaaaacttctcatagaaacattgactaaagtagcgactagcctttctgagttttgcatacctcatggtggaattatccatcactggtgatggaggcaatggaactgcaaaatttacaccacacatcacgcatgcatgtgctcccatgtgcaaatgcatcagcagccactcacccaaaaacatgtacacccgggcatgcacatacggcacaccccgggggggggggg

SEQ ID NO: 70463 - DNA, 166 bp, Triticum aestivum
  Clone ID: PAT_TA_70463
cacacaggggcaaattgcatagttacagccttttgattaggataggaagacgagagaaggcaggaaggctagtagcaagcgcagagaagatcaggcatcagcgtagtcgatctagggaccaccaagtcttggaactccagttgcccagccgcgcgtcgccttgaag

SEQ ID NO: 70464 - DNA, 703 bp, Triticum aestivum
  Clone ID: PAT_TA_70464
acagtgtggacaaaagagatgtagttaatttgaaggacaaaacaacaatggatgtttatcagtacctctctacagtctacagttgagaaccattttaatagctcccttcctccttgctcttttcctcaacattaccagtctctacattgtcctcgtcatgcagaaacgcctgaacacccaaaaaaataggatggttgggatgcccaccagcttcgttcctgatccaagcagctgcagccttgctttctgaaagtgtggcaccttcgttacaaagcgttacttgtattactttgagacatgggagatgctcaatgcctaagtagaagccataagctttcgccactgacacatcaaatgattgctcaagcttctcaagctttggcatagtccctttctggaacgttatatatgccccatccagactaaggaggccaaacctcctcagacatgggaatccagttaccgtaagctttttctttggtcctgtagccaagtacatgtgtagatcaagtaacgatgggagctcaccaagagtgtgcagatcctcctcccttaattcatctaatccgatggtcacgtgagataggcttgtgagtcctggagaaatccactttggtacggtcgctgaatgcattttaccataaatgcataatttctgaagggaggatggcagaggggaccatgagtccatgaagtcgaggga

SEQ ID NO: 70465 - DNA, 406 bp, Triticum aestivum
  Clone ID: PAT_TA_70465
gacatattacaccgggcttacactaatagcacatggcacatctcgcctaaacagcgctttgcatactacgggcacaccttcataattattccaagtactccgtgaacatgcccaccatctacctgctaagcaggaatactactttgaccagcgccagcaagatcagcactccgacaaacagtatggctccgtctaagaacacaagaacacggagggcggcggtggatgtgcctccttgattaacccatggctgggccctgaaaacttgtgcaacggctggaacacttcgcatctgctctcggacacgaaccctgcggttcagataagatcccgcctggctacttccgtgcactggctgctgcgccgcccccagatgatagctcagctcggcaaggtactcgtcctc

SEQ ID NO: 70466 - DNA, 586 bp, Triticum aestivum
  unsure (1)..(586): unsure at all n locations
  Clone ID: PAT_TA_70466
aagtggaaacttgaacgagaacccaaaaatataatgataatgaaaagccacgatgatatcatacagattttcccccaggaaggtattatggagaactgccatcggcatggcccttcttcttatgaaacatgcctgtgatgtttggcaacacaaagcccttcctcaacagcgttctgttgttcctttgatgcccatcattcttctcggtgggttttccagcaggagccttgtgtacagatgaaagtgtggttgcgtgtgcttgcgcttctgcagaagacacggactctgcagctttcttctgttccttttcacgccacctcttaagctcaccttctacagccttctttgctgcttcagccgtctccgccctcttcagtgcctcctctgttgctaattccatgtcctccatctctctccgggcagttttcattttctgtattgcctcattctcactggctctaacagcttccacttgcgccatggcagcagctactttcatctcactcaacttctctgactcctttaccttacggctaagagattcaaactccgcttttgagattgngacctttcctncgggttcaga

SEQ ID NO: 70467 - DNA, 746 bp, Triticum aestivum
  unsure (1)..(746): unsure at all n locations
  Clone ID: PAT_TA_70467
cattacatagcgttttaaagaactagctcataatccatcatgcaaatgacactagtcagattaaccatcacatgtggattatagcaaaattcgaccacacatccacacccattgtctaaaacatgcccttgtgtcgttaacgccagcgtctccaaagcaatcttgtctccacacattaattcggcactgaccaacggttgcaggtcccccaaacaaaacaaggtctagtttaccatagatcagcgatgctcgatgctgattttcacatcaccgacaatcagctgcaacgcctgcaccaacgagctaacccttggatcatgttcatggcagcagattttgaccctctcgatgcaagggtggctgcctgagcccgacggcagtgctccccttgttgacgacagagcaggttcagaatccttgcacgtactaaattcctcctttgtgagcttaagttttagctccttcagcttgcacgagcgctggaggatgcgaagcagcgggtagaagtcagcagccatgcaccactcgcccagcaccaggcttgtcaggttgctgaacatcgggcatgtcctcaaactcctctcgaacgagacctcgcagtagccggtagctatgtggtagggcgtcctgcctcctggtcgccggcggcggcggcggcggcgacgcagccgtgcgaagcaatctctctctctctctctctctctctctntntntntntntnantntntnnnnnnnnnnnnnnnnnt

SEQ ID NO: 70468 - DNA, 759 bp, Triticum aestivum
  unsure (1)..(759): unsure at all n locations
  Clone ID: PAT_TA_70468
aattcggcacgaggggctgatggaggcggaggccgcggctaacaagnaagtctgatgatgaggcggagaagcaggacgtggaggtggccggcgctgatgcagctgtgtcagatgatagtgaacacaatctagacgccacaaagatggaaggagaggcgaaggaaattaagtcagaagaggtgaagaaaatcaagtcagaagagcctggccaggcaggtgtatctgacaatccaattgtgtcgcaagatagtgagcaaagtataaagaaggtgtatgttggtggcatcccgtactattcatctgaggatgacattagaagtttctttgaaggatgtggtagtatcactgcgctggactgcatgacttttcctgacaccgggaagttcaggggtattgccattctcacattcaagactgatgccgccgcaaaaagggcattggcccttgatggtgcagatatgggaggattccttttgaaagtccagccttacaaggctaaccgcgaaaaggtcaaatctaaccatgagaaggaagattttgccccaaagatgatagagggatacaataggacatatgttggaaacctagcttgggacgtaacagaggatgatctgaggaagttcttttctgattgcaagatctcatccatccgttttggaacagacaaggagacaggtgaattcaaaggctttgcacatgttgatttttctgatagcacatctcttgctattggtctgaagcttgaccagaacgtgatta

SEQ ID NO: 70469 - DNA, 524 bp, Triticum aestivum
  unsure (1)..(524): unsure at all n locations
  Clone ID: PAT_TA_70469
cgtaggttcctccgaacataactgccccagaaacagaaaaaaaatctttnatcatgggtcaggaataaaaataataggaaacctaaacaaataaggacaacgattggacctaaccagaccttacatgagaaacttccaaaacaggaaccatgaaacgaagaaagaccgatctgctttccacagggtcacagccacctcaacccacacacctccacccatatataaatgagtacagccggccgcagaagcacagacccaaagaattagaagtcagcaaagatgtcacacacgactaggcaactcgacctcgacacgaaaagccacctcagccacctccgcccgcttcacttgacgttcgataaagtcacaccaaagcacactcaacgcatgacgaagccatgcccagctactccaatcgacatggaagaagggacgccaaagcacttttggcctgaatcatcagataatttagtaattgttattaacagtcttattttctctagatataatctttataaatattg

SEQ ID NO: 70470 - DNA, 640 bp, Triticum aestivum
  unsure (1)..(640): unsure at all n locations
  Clone ID: PAT_TA_70470
tttggatgtgcnttnatgtccccntgtgaaaaatcatctttattcaaccttattcgatttgaagttaagcttgtgacatgaaacgactaaaacttaggggaacaatgtacttttcctaaatattgataggaagagcagtcaagaaagccaatgtataaggagatgtagacttgccaaaaggtgtagaccaacgtggaagcttctcaagaaccgtctcaaccattggtgtaaccctattcacatccgttcttagttttaccagaggagaaaagttttctgctttagtttcttttgcagatgcatgtgttccattacttgaccaaaaaagggttaactcgaattttgttggtgagctcttgccacctgcaaagcggattgtatgccatccatcaacctccctcttaccacccagatgaaccaacttattcgagtccactgagtaagataatacatggaaaggttaacaagaagtcaaataataactatctagtccacctagatttatccatctagttaattgtagctcaccatgaatagtgaagtcatcaatttcctgtttattgattgccagcgaccaacgagtagatgacttagtatcaattgacactattgttctacgtgcatcatcagtagcataatc

SEQ ID NO: 70471 - DNA, 694 bp, Triticum aestivum
  unsure (1)..(694): unsure at all n locations
  Clone ID: PAT_TA_70471
acttagctttttaaatttntaacctactcataacctggcattcttttttgatcttctttttacatgcctcctgctagttctactgccattgctttatgaaaattgtttcgtcgatgaccttcgacgccacagttcttgcatctagctggcttcctacgacagttcttgtgaccttgcctacgacaaatcgtgcaaaatctggtccgtttagcatatggtttgcactctcactcctctgggtgctagtcatcttcgcacagaaaacgcccttaaaataaggtttcgcccatttcttacgaatctcaaacaggtttgtcatgtacggatgagatctcagcttgtacttgtccagcaacatctcccaacctttttcaaactcatcttccgacagcatgtgctttatcaccttataaaattcagccctgaattcacttttctttgtgtacaaactaccgagtgtctcttttgcctttttcaggatatgccacttgcaccatcggtcggtcgtgtttggcataacgttcttgatcgctagctccatagcccggttctgatctgttagtatggtcacaggtggagaacctcccatcattcggaggaattctgagaaaacccatacaaaactatcttcagtttcatcacgcacaagcacacctgccagggtcacactctggaaatggttgttcacgccaac

SEQ ID NO: 70472 - DNA, 776 bp, Triticum aestivum
  unsure (1)..(776): unsure at all n locations
  Clone ID: PAT_TA_70472
caaaatgagaatgaatngattcttacatggataatntatattatgatatccagttagcataagttctacagcgaaaatatccatcataggaggtggatacccttgtaagtgccatcttctgtaactactaataatagtgcttcatgcaaatagctttgagcggcatgaacatttctgtaccatcttccaacatagccacatttatgttgatggcagctgtaccttgaagatgcgctgcttgaggtgcttgagcagatccatcatgcgcgtgcccctctcctcccacggcttcatcgcgacgaaggctcgagagaaggagaacgcaggtcctcacaggttgtaagcgcccttgaccaccgtgtcggcatggttgagaagagatggatctaggcggtggtctctggtggcgagcaaaatagaagttgcacgtgcccatagtagctgtgtcagcagcggctatcacaatgaaatataatcagtgcttgtcgtcctgagttcaatcgaaagcagaagcagcaacacgatttttcttgtctccattggatctcaaaagtagtatatatggattacatttgacccaatctatccattggaatgcccacttcttcggtatagggggtacatataacatcagctgcctcaacttcaaaacatccgcatgctattgtatcggtcgccatatatatgaaggggaaaatgtcagagttcaaattgatattaagagacaatggtgaagaaagaacatatgatgcaatctgtcaaacgccttgtgagca

SEQ ID NO: 70473 - DNA, 653 bp, Triticum aestivum
  unsure (1)..(653): unsure at all n locations
  Clone ID: PAT_TA_70473
tggattnaccctagtttnatcntggacatgaatagagtagcaaaccgttttactggaaaaggatagcttgctgattagctaagtagccgttggatgttacatcatggggtctagaattattacacagaatggatgtgacaatggaattttacatagttgctgaatgttaactcagttacagaatgaattttacatagttgctggacttgatctcccttttctgaatggtttcttctaccccggctttcttcttgataccctcagctgaggactatgatgtatgctctccctcttgttcctttgctgcaccactcacatcctacagcggctccatactttcaggacgaccggtcaccggcggcggactcttgatcggcggcgtcccaccctcacctgccgagctccaaccagtggcaatggcagcggcgatccctaaccgtagagtcgtagcggtgaccggcggccaagctccagccagggaggggaagacggcgatccactgcacctggacggatggtgtcagatggatgggaaggccgcgaccaagctccagtcgggcggcgggcggcggcggaagatcctggtttggcggcggtgggcggtggacggcgggcggtggaggcgctcctcgctaggtcaggatgcgtgtgttc

SEQ ID NO: 70474 - DNA, 529 bp, Triticum aestivum
  Clone ID: PAT_TA_70474
gaagatcgattgtagttgatgaagttatgtacgatgtacagtattaattggagttggagcaccactgaaacatttgcagcttccctctaactgagcaatgggtgagccaggcaccatcagtaaaaacctctgcaaaacactaacattctatctaatctaccaccataatcgttcgtaggaactaaggcctaatccccagaatgaaccaatgatcatctatacacaaaatctctctccagcactaccccctctcctcctctaccaccccagtcacaacaaaactgtctgctaaaacaatgccatcagccaaggtgtggccggcgaacctctgtaggcgccccgtgagctccggcgccgttggtcctgatgcgcgcgtagacctgcaggttgccatggaagaagccgacgatctgctccagcgcggggacgaagccgaccggcagagtggccgacgccgcaaaatggacatgcctcaccacctcgtcgtgcttggccatctcgttgtccagtttcctcctcatcttgtgcc

SEQ ID NO: 70475 - DNA, 549 bp, Triticum aestivum
  unsure (1)..(549): unsure at all n locations
  Clone ID: PAT_TA_70475
aacatgctttctgaggtatatgttgatngctaaatggatatacacatcaatgtagcaaatatttgtgactctcctttcctttctagaaacatctaaaggcgctctttctcttcctggttgaagcatcatccagtgccacaaagtccatgttgttcaggtcgaattttgccattttgtcagcaccaatctgccaaatttgaggaatgattccctaaaatagtagaaaagaaaaaaatacacaaactagttactgaagatcaacaaacaacaagctagtattttttttcagggaagcaactggatattatttaattaacctcgcaaaacttgcagactagagaagtggatgttaagctgccaaacatacatgaggtgcttcaagttaaattaactgaacaaacaggttatagtagcggctagtacatccatagcagagaaacagagctctcaagagcgatatatagagtggttgtctccgggaaagagaatgtgtgggggtcaagagcattactaacaatagtacaatataaaaagaaaaaactcgagacc

SEQ ID NO: 70476 - DNA, 247 bp, Triticum aestivum
  unsure (1)..(247): unsure at all n locations
  Clone ID: PAT_TA_70476
gttcccagaatttaatgacnggacggngacgctggtncaaaatgcaaatccccantaaaacttattcagctnttggacacttccnaatgactgactgactgactggtntaagacgacggngctagacagactccgccttggngtaaatccgnacggngacggccaagcccagtntcgnnagggggaccaagaactggaggatnttgatgacaaactcgggggtnttgncctggttgtagtgcggntg

SEQ ID NO: 70477 - DNA, 756 bp, Triticum aestivum
  Clone ID: PAT_TA_70477
aacatgcatcattgcattgtttacggtacacacaagtctcgtgatgctacagaccaaaagtacaacaaaacttccagcccaggtgatatgattggcacccaggactgaaacaaatggcgtatagtgtattttctcactatatcaaagagaataacttagtcgacctcctcgatcttggggccagcaccgccgctggcagccggcgcgtcctcaaactcgtcaacctcaccaagctggttggcgtcaagccactggatcgcggcgtcgacagcatcctcaatcttcttcttgtcgtcagcaggcagcttggaggcaatcttctcgtcctggatggtgttcctcatgttgtaggcgtagttctccagggagttcttggcatcaaccttcttcttgtgctcctcatcctcagacttgtacttctctgcatcctggaccatcttctcaatgtcgtccttgctcagcctgcccttgtcgttggtgatagtgatcttgttcttctggccagtggtcttgtcctcggcagagacattcaggataccgttggcatcaatgtcgaagcagacagtgatctggggaacacccctgggtgcaggcgggatgccggagagctcaaacttgccaagcaggttgttgtccctggtccttgtcctctcaccctcaaaaacctggatgagcacaccaggctggttgtcggagtaggtggagaagacctgctccttcttggtggggatggtggtgttccgggtgatgagcaca

SEQ ID NO: 70478 - DNA, 514 bp, Triticum aestivum
  unsure (1)..(514): unsure at all n locations
  Clone ID: PAT_TA_70478
agacagcacgcccatacctaagcaaatgttacacgggggaattagcgtacgaaattcaccgtctaatgtgaaggagggacaccgggcatcatcgagacgagaggcttgctgcaagtcgtccttcggtgccctggaaccccgcatttgccgcatgtggccaccttcctttcctttttggggatatcacctcgatcagggcaagtgctggctttgtgacctttgcccctgcagatggaacagaacctagatctcttggcgctgtctttctcataaggagctttatcacggctagtggttgaccggcctcgtttgttttttctttccgaggcaagcagttcttgttcaacattgggcatcaggctggaggcgacttcagagaaatgtgaattgtacccatgaccatttgggcatgatgcttctgaggcctggctaattggaggatgcacagacaccgaagcggcatcgngtgatttagttcgattgccttncacacttnttacggagaaagatgnnt

SEQ ID NO: 70479 - DNA, 386 bp, Triticum aestivum
  unsure (1)..(386): unsure at all n locations
  Clone ID: PAT_TA_70479
gaatcctcgtataaaactctgaaagatcttattacngcaagtatgaaatgtgttaaatgcanatgttcaacagcaatccaaacagaaattccagatncatctcaaaaaatgaatcccaaacgagcaagaaacagagccttttcaggatgcanatctggcctgtcatgtgccaactttcacctccgtcaatttgcatacgggcacgacaaggtgtaactttnctccatgaccaggaggttccactgtgcatgcgggtcatgagtcgagaacacggaccaggcaggagtggagttctcgtatctgttatgcgtgacgcgggcaaacttctccacatcctggttctcctccatgtcgtcagggtcgatatcaacggtgaagatgtcaca

SEQ ID NO: 70480 - DNA, 654 bp, Triticum aestivum
  Clone ID: PAT_TA_70480
acttacaccagagtaacaatatatatacctaaaaaagaatttaacaaaccaaatgatttcatataggctagagctgcctaggaaaaatccatcaaaactatttgcaggaaagctgcccgtttatcttcaaaactgtgacctgtaagtagccagaggcttgacataccagtgcaaaacatcacatgttctttcttctggacactcggttggacaccggaaccattgactcaaagctttcatacccatcatcgaacaccctgctgcgacgctcaaacgccctgctgtgacgtaataactggcttgctgaatcataccccatgagtagatgaagtgccgagtctgaaaccttcttgctactttgtgtggcagcaagggatggtccagctcgagtagacaagcttcttgtgaaagatggtccatattcttcacttacactgacgggataagaagcactctcagttctagcaacttttctgttgtcagccttgcttaatttttgggttagttccttactggcatttgcattggcgtgatttacagcaggaacagacaatacaataaccttggagcacttaccacactgcattttcccaatctttctttttgacatgtagatatctgatggcatttgaaccaaaaagaaacagctgttgc

SEQ ID NO: 70481 - DNA, 628 bp, Triticum aestivum
  Clone ID: PAT_TA_70481
atattaattaatatgtccctatagtttacatgactggtgacataagcgataatggttgaaaagcaacacgcgcagcacaaaagcaaaggtacaataggagcattttcatctcttgttgtgaaaagaaagtcctgcctaaagctagaaatgcacaagtataatatattattgacaccacttttgttgcttagaaatcagaacatagagaaagaaaatggggtataaaatcacttccaccaattccaagcgaagataaacctgaatggacaggcacatatattaagaaaggatatgatttgaagtgtagaatcacttcgtaagccaattcccataaggctatgatgggaaggaggtctggaggacggcgccgcatgacgatccctatccatgccgcgcgtagtcctagacctcacttgtcagatccatgaggatgaattgagggagagggaacaggagcagcacgcggtagatccactttcaggctagctccctcatcacagatacttcattgtaggagcttcccaactttgccttctgagtgtacggtctcttccatggtttagactccataccaccttcgacgccaccaccgatgaccgatcccaatcattgagccgagcctggaggc

SEQ ID NO: 70482 - DNA, 544 bp, Triticum aestivum
  Clone ID: PAT_TA_70482
acggtgcgattcttacacgattacacggccacaaacacacccggacagctaactacgagacacaggagcaggagcactctacgaggaggtgaacttggtgacggccttggtgccctcggagacggcgtgcttggcgagctcgccggggaggacgaggcggacggaggtctggatctcccgggacgtgatggtgggcttcttgttgtaccgcgccagcttggcggcctcgccggcgagcttctcgaagatgtcgttgatgaaggagttcatgatggacatggccttggaggagatgccgatgtcggggtgaacctgcttcagcaccttgaagatgtagatcttgtacgtctccacgctcttcttggccttcttcttgcccttcttgtcgccgccctccttggcggcggacttccccgccggcagccgcttctccgccttgggcttcttcccggcgggcgtcttctccgccttctccgccgcgggctcctcctccgcgggcttcttcgccgccggcttcttctcggccttgggcgccatgggtgcc

SEQ ID NO: 70483 - DNA, 287 bp, Triticum aestivum
  unsure (1)..(287): unsure at all n locations
  Clone ID: PAT_TA_70483
actaaacangtcggggcttcatcaggcttntggaatctgcaggcggngncaaagagtgactcccgnnggccggccggnccttagccgccgaagccgtngagggtgcggccctggcgcttgagcgcgtagacgacgtccatggcggtgacggnnttgcngcgggcgtgctnggtgtaggtgacggnatctcggatgacgttctcgaggaagatcttgagcacgccgcgngtctcctngtagatgagccccnanatgcgcttcacgccgncccgccgcgccagccgtcg

SEQ ID NO: 70484 - DNA, 149 bp, Triticum aestivum
  unsure (1)..(149): unsure at all n locations
  Clone ID: PAT_TA_70484
gacctaacaacaacattgcnagctcactcaggtgcagtccttgaggattncagcgaggccggcgcgctgctcgtcggtgagctgctccgggaagacgatctngagcttcacccgtagatcgncccgngcgcctntntgctcggcgatgg

SEQ ID NO: 70485 - DNA, 699 bp, Triticum aestivum
  unsure (1)..(699): unsure at all n locations
  Clone ID: PAT_TA_70485
agtattttcctattgatgaatctgtttatnactatctacagttctgatnaatgcatgagaggaaaataaaatacattcatggaacatatttttcctgtaaattagaaagaagcctaccttatcttagcaaacaattgtgttaccgtgtgaagaaaagaaaagaaaacttacagctacaaccgagtttcatttacaatcttgagcccccagctgacgtcttcgcagtgcctcacgtacggcaccaccttgcccaggtcggcgtccctcttcgccctgcagtcgaagtagggggcctggtggaagcacggctcgatggacatggcacggccgcacggcggctccggcacgacgtggttctcgggcctgtacatgatccacggcgtgaggccggcgaggccctgcgcgacgtacccgaaggtggagaagccgctggtgatgagcacatcgctcatgctcagcaggtagatctccgccagcgccttcatgttgtgcttcctgttcttcttcttctgatctgatcactgtaccaagagctcaaagaggtcccgagaacggcaattgtccggttattcccagcggccgctccatcggtcacgccgatttgtggcagcagcttttcaccctgggcacaggaaaggatctgctctaaaacgtgtggaaaacggcccgtttctttgcaggatgcccttcttctcaaat

SEQ ID NO: 70486 - DNA, 693 bp, Triticum aestivum
  Clone ID: PAT_TA_70486
agtgttattcctcctaacataacataactcttaatatgtgtgggatgcagtctgagctctgaaatctgacagatataatgaataaaatacatgtgagattcccgtgtttctatcctgcctcgccgcccgtaaatgacaagaaaagaacaggcaaaaataatcatcatctattcgaaaatcttctcaccagttgagaagaccaagaaaatgactgaactaaaaatacagaggtatgccggaacaaagaagactgttttccaggtttccgagttcgttagatccatgttagaagcctttgcagcctccagaatgtttcccgtgaggccgacgccaactatcccagccaatgtcccagctgtattggaaacccccatcactatgccggcgaactttggagcaacatccatgtggttcacggcgaaccctgctcttcctagagccagaaagccaagggacaccgatgagcagatcacagtccctgagggcgtcccgaatgaagggagggccatgagtgcaagtgccgagacaacaaacccgatggtgttaaggagcttccttgtcttggtaactgataagatcctttttgtaatcaagtgatcagcaaccactccaccaatgttggagaatataaacatgttgaaatagggaagcatctttatggttgagactaggacggtatctgatcgtcttcga

SEQ ID NO: 70487 - DNA, 196 bp, Triticum aestivum
  unsure (1)..(196): unsure at all n locations
  Clone ID: PAT_TA_70487
agcacgctncttcgccggcacaaacatggattggccattnttaatcaacagagctctttaaccaacgaccatgattttgnggttgctactggtgcttgnggaggagctgctgcaccctgagctccagctcccggatcctnggcgcccactcgcgccttatctctatcggcctcgcctcccccgccacggcctcctc

SEQ ID NO: 70488 - DNA, 680 bp, Triticum aestivum
  unsure (1)..(680): unsure at all n locations
  Clone ID: PAT_TA_70488
cctgtgnacccagttgaagcacatctacaccatcagttgccgacgatgcaatgatgacagcaaaatggaatgactttctagtcccataccaattctagtaccacctaccattcctagtaactctataaatctcctcccaagataacaccacctaaagaacggaggacagtctccgatgacccctcattttgaaatatactgtgtccatttgtccagtaaccgccagcttgcaaaccatccggacggatttcttcacgtcccttggtgaatacaccttcagcctaaatccaatccataatcaagcaacatatccagtttctttctgtgaacagatatcaggtaggcaccgagatgtcgcgctgtgtttaccttagaagatgttcaaagctcgtcatcgccactcccggcaagcaccacaggcccagtcggcactctcaacaggcaggtcgctttcatcccaaggtgagcactgacggtgtatgcacaggccacagactaggcatttgaggtcaggtggcggctgggagttgttgcacttcttacacggtgcatcgtcaggagggggagcatttgctgggaagtgcatatttgaagacacgtcttctaccatgaaagccatatcatcaaaactggctatttcttggtcgaaacttcctgtgcagttaccatcatcttgcaaa

SEQ ID NO: 70489 - DNA, 182 bp, Triticum aestivum
  unsure (1)..(182): unsure at all n locations
  Clone ID: PAT_TA_70489
tggctccatcaaactgttgctctctcatagacaaatcnggacaccactcggccttntggatactgcactacaggtgcgcaacgaaacgcaaganaagcttagaatcagcctatgctgctctgtggnnccgcctaggngagcanggaaaccagngagacaaactccagagatcttnctgccnt

SEQ ID NO: 70490 - DNA, 244 bp, Triticum aestivum
  unsure (1)..(244): unsure at all n locations
  Clone ID: PAT_TA_70490
aaaaaaaaaactttacaaaggatcgagnggaagaaaagagtgaagctccatgacagcatcatacccccgtttttttccgttngcgaagtngctagcncatccaaggcaagcccctaccacccaagaccttgttgcccttggccgcaacaacccggggcgacaacctcgncttccctctcatttntttgcacaccatctccagctccgccacccggccctgcatccgtcctaggttnaaccttag

SEQ ID NO: 70491 - DNA, 652 bp, Triticum aestivum
  Clone ID: PAT_TA_70491
accaatttacgattaccattacaaagcaaatcccacaattatcagaaagttttcaagacactcaacatctgacagttactgacaccaacattggagagtcgactgacaaccatagataagagcaaaaatactgaagacagcatagattttagcatacagtgcgattagcacttgacctctttcagcccatgtgcaaagtacaggaaagttggatcagcagctccctccttgtagtaggcgaacaccacgccgccatcatcatgcatgctctcgccaacaaagaactgaaggtccttgagcttgctaagaagatactttgtggcggactcaacattcttcttgaaagcatctaggtcatccccttcaagcttggcagagaggttcttgatgtagcgcttcatgtgagagataaactgaagacggaaggtgtcaacaatgtcaaccaccttcacggcctggtcatcaacaccctcatcatcaccaccaccctcagcagagggattggctccaatgtccacatcaactgctccttgaacgacccaatggccatcgacttcccagagcacgccgttctccagctccctgtaagggaacgaatccgacagaagctcgtcgccggaaagcttgtcctggtacacgagcatggtgccgc

SEQ ID NO: 70492 - DNA, 486 bp, Triticum aestivum
  unsure (1)..(486): unsure at all n locations
  Clone ID: PAT_TA_70492
tgttntattncatactaatagctcggaattacacagtgaaaaaaagnactaggagttatttacagcaaggtaactgatctgtcagctgagatttgacaacaatagtccagactaaccgactgctaattcggcatttctcaaaacaacatgagttgaactaaggtagcaagtatattacaagcacatggtatgttaccttcaccgcgaccatgacacggcatcaatctcatcccttgctgacttgtatagctcaagcctcttaaagcattgctgcctgcgccccataagagcacgatcctcatcaaggagtagcgcgagctgcttagcatctttactgcccacttgaatatagaaatagttcagcaaggaccgcttggcttcccggacttggcagtgaacaacagccttgggaatagtattcttcantgtgtccgataccatgccaatgtacgaggacacattagaagcaatnctcctgaagtgcgc

SEQ ID NO: 70493 - DNA, 676 bp, Triticum aestivum
  Clone ID: PAT_TA_70493
aagttttgagaaggagaacagcgatgtatcccagatttaaaacatttgtgtgatccaatgtctttattgcagatgcttaaataagaagcctcgaaatcacttagacctcaccttgatctcctcaaggtaaagtttatgaagaactcatctagtcacttttgcttgatgtcgatgtgatctcctcatggtaaagttcatttagaactcatctagtcacttgtgctcgatgtcgatgtgatctccgatctttcgcaaatttccttgagacaaatccacagcttggatgctctcacccatagccatccagaagatgcggtgggcctacagctagagaggctagccacaaaatcaaatgaaatctgggtaaccataaatctgaataatttattaaaatatacgagtaatttaattacttaaattaaatcccttctccaaaaaattcaaaaaaatactggccagagaaacgcgaaccttgggatacccagtttctctttccgtagccatgtttaaaaatacttgctagagaggcacatataatttctaaattgagtggtcagtgtcccccttaccgtagccgtgttttttgccagaagcaccacagccatgttgacagttactccaactatttccaatattccagtcaaccaatgggtcgagtccttgtgcccctgctttc

SEQ ID NO: 70494 - DNA, 124 bp, Triticum aestivum
  unsure (1)..(124): unsure at all n locations
  Clone ID: PAT_TA_70494
aancaaaggannttacactgntcagaacctagatnttacaaangatcagactctanacactngngaatttacactgntaagaacctagatattacacaagatcagactctnaacactagatatt

SEQ ID NO: 70495 - DNA, 229 bp, Triticum aestivum
  unsure (1)..(229): unsure at all n locations
  Clone ID: PAT_TA_70495
ganacaacagagggaatgaaaacacaaagcacggagacagccaaagacgaaaanaccagccacgnccagcagaacccgnaacnaggaatgaccaaacaacagataccnncaagaagcgaaaacagcagcgatgccaaaacaagcatgcagcgatgaaaaacgcangaaaacacaagcgcacaatacnatgaccagacaaagctganccgaaacacnggatgancaatag

SEQ ID NO: 70496 - DNA, 286 bp, Triticum aestivum
  unsure (1)..(286): unsure at all n locations
  Clone ID: PAT_TA_70496
caatgtgatatagtaaacatgaataaataaacttctaatatgaattttattagagatatcgtaggaaacagttcgattcgagcataacggttatttttcctaaatttctgatattggctcaattgctgggacatttgngatcatgtggttcagttacctatgataaagttctgagaagtttagttacccctaacaaaaacactcagaactatcatctcttagaggatggctaatagtatancaagcggatgactgtatccatcaacaagccccaagaccacccgca

SEQ ID NO: 70497 - DNA, 768 bp, Triticum aestivum
  unsure (1)..(768): unsure at all n locations
  Clone ID: PAT_TA_70497
gctgcatattnaggaaattagtttttgcacttgagacagacgaatagatttcagttacacttaaaagaaaatcaactactggtttatttttagttcctccataaaaaaacactcatcacaacacataggatgaactacattatcgcagcctaagttcatctgccttatgacagttattcctgcgatgtccttcaattccacagttcttgcatctcgccggcttacgtggttgctttggtaaatcccctcgttcaggtcaggttgttctcttatgtccttgctgcctgcatatgccgcaaaatctagttctcttacttaaaccctcatatggggccttctccttactgctcgtcggccttccaacttgcttccgctttgctggtgctagcaggttatccagcctagtcactgacacattagctgatatgctgtcatcatttccgatgatcatttgtgtaccttctactgcctcgaatgcgtcgggatctgcctcaaacctactcggaatggtgtttgcttcaaccctactaggaaccgtattattagctgccaacctgtcttccaatcctaggccatctctgacctctgtgagtggcttcatttcagctgcacattggttgaatagtgtagtcaatcgctcgtatgctgccacacttgagtcacccatcctaacaagttccatggcttgcatatacatgttgaaatgccgaaaactaaatgggtttccctgggcattgtctttctggtactgcaccangtgggctggaa

SEQ ID NO: 70498 - DNA, 187 bp, Triticum aestivum
  unsure (1)..(187): unsure at all n locations
  Clone ID: PAT_TA_70498
aatccatgntgatccacgagntcccatagtttgcaagacancacacagctngtgcaagattgttgcttgtgtctgacctccgggctcaaaattttgccctcgccgagtgcactagcagctgacgatcctacaggatncgagggtnngggctgggccacatnctgtgtcatacgttcatgtctgcggc

SEQ ID NO: 70499 - DNA, 670 bp, Triticum aestivum
  unsure (1)..(670): unsure at all n locations
  Clone ID: PAT_TA_70499
aaaaggnaaatgaaccgtgatgcatctacaagtacaacatataccatacttttcctataggtccaaacaagtgtagaaggagcaccaaaaggctacagagaaaacaacaccaaacataggagctgtaaccaagaagcaacaaagcatcctcctgcttacaattacattaagaacagaggtcgccagcgtggtatcgaacgaaagaacagattaccttgcagggattggaacatagcagccaaagtcacattgttgaggtaacaacttggcaagaaaaacatgacgtgcaaatagtctttcagtgcatggatcacatagtctgcaccacagttctgcaccagcaatttaccaactaaaggatgtaacctcgatctgaacaaacaaacaatctttctatgtgcagtagctcctcttcgtgtccatgaacaatcacgtatgctgaacaatgtccgtgtgcgtttggtgctatcactgggtctcagtttttccagtttgttcagggtcagcgtcatttgagccgctcgacccggaactggcatcagcactctgatgttcattgtgctcgccactggttgatgtgttggtttcaatcttgatatcttcctgatcaccattgcttgtcgcttttgtagctccatcaatctggttctncacagcctttgtctcttct

SEQ ID NO: 70500 - DNA, 462 bp, Triticum aestivum
  Clone ID: PAT_TA_70500
ttcgatcctacagaagatagcgaacaacagcgagatgctgcgattacagcaacgaccacgaaccctaggcactctaatctggtggtggtggcggcctagcccccgaaaccgtagagggtgcgtccctggcgcttgagggcgtagacgacgtccatggcggtgacggtcttgcggcgggcgtgctcggtgtaggtgacggcgtcgcggatgacgttctcgaggaagatcttgagcacgccgcgggtctcctcgtagatgagccccgagatgcgcttcacgccgccccgacgcgccagcctccggatcgccggcttggtgatgccctggatgttgtcgcggaggaccttccggtggcgcttggcgccgcccttgccgagccccttgcctcccttgccgcgccccgacatcttctcgcttctctctcttcttctcctgggtgaggttgacctgtctttctttgtc

SEQ ID NO: 70501 - DNA, 266 bp, Triticum aestivum
  Clone ID: PAT_TA_70501
aacagctgaggaacaccgctggctaccaattcatgcttgaattagggcgagaaaacaaacttggcacatgcggcaagtagtccgtaacaaaacaaaacaaaaccgcacacatgcatgacataggagacaatgagtaaaaaaaatgattattagcaagtccgaggaaaaagcgggcgaacaccatgctgactcgatcggtgctccaagtgtgtgcgtgagtctcggctagcttgtggcgacgaggccgtcctcttcgactgagcccg

SEQ ID NO: 70502 - DNA, 289 bp, Triticum aestivum
  unsure (1)..(289): unsure at all n locations
  Clone ID: PAT_TA_70502
catgatagataggtaaaggcttcttaactgctggtaaatttggtactaaacaaaattgaggtctctcagctacacaaacatgttccattcacctcctgttgctgtagtagtgcctgtccctctctctgtccctttccctttccctctccctctccctctccctctccctctccctctccctctccctcgatccccccgaccntaagtgctgnctgcncgaaaangaaggnctnggngnccaggcaccatcgncataaccagatgagcttcttcttccggcaccagngat

SEQ ID NO: 70503 - DNA, 674 bp, Triticum aestivum
  unsure (1)..(674): unsure at all n locations
  Clone ID: PAT_TA_70503
ttcttaatgttttttctttcnataaaggctggcacttttcnatttnttagaatgaggacatcaaaataggagtatttacaagttgaaaggaagaagaaaacttaggaacatgtgtttatactttagagtgtggtacattttgacaaaacacatgtatggaaccgataaaaagaagaaaatacacgtacaaaatgttacacaaaaaccaaccagggtttgcaaacacttgactgggctagtggcgggtagaaatgaatccaggaaatgagaaaataaaattcccatcaggacgaacgtggtaattccttcttcaagacaggtttgtttggatggttgagaagcttgttcgacagttcagtctcgagtgtttcattattgttaccaatgatcaagacttccttgagctcaggtagacaatcaaggccatcaagatcatatgacgccccactggagcagtcaagcttgagcagctctagacttttcatcgtctctgaaccaaacttcacagataatgagctggagctgcaaccaatctcgaggatcttgaccattttataggtgggcaactccattgcatgcaattcagccttaaactggactgggctgcttgatacgaaggcgtagaatacatagatttggtacctcgccgaggaacttaatgtctcgttctttca

SEQ ID NO: 70504 - DNA, 282 bp, Triticum aestivum
  unsure (1)..(282): unsure at all n locations
  Clone ID: PAT_TA_70504
aaaaattacatacattctacagaacatnaggaacagccagntcttaaatcggngacagcctgctacagannacatggcgcttttttncttccatncanntgnctattnaggaacatgtcanttttaatgaancaagcacgatgttcnataaactgnacatatgaattccttgtcttctttntgntgnngcagttncatttactcatnaagttgngtgcttggcactgagtnnatnaacgnggatgataatatcgtcaatattgggacgaactgnacgatgtg

SEQ ID NO: 70505 - DNA, 351 bp, Triticum aestivum
  unsure (1)..(351): unsure at all n locations
  Clone ID: PAT_TA_70505
aaaaaaantnacatctcatgtnangccaataggctcccctatgctacagaatggcaaagaggagattcctacaacagtatcactgtcacccaggttatctgagcagacaccaatcgagcagacgatggctaaaacaggctacaggtattacaatttgcacgcttcagaatcagcccctaggaaatacagttttcatgatgcgacccatgggctcattcataccagggaaatggatgaatcggctggatcatttcactcttctttccaaatcctcccggtgaccctcaatttaagctccttcctctcaccaccagagaagaacaaggccatgttccgttggattattagccc

SEQ ID NO: 70506 - DNA, 779 bp, Triticum aestivum
  unsure (1)..(779): unsure at all n locations
  Clone ID: PAT_TA_70506
atatgtaaaagtctggaaactgataatgtntaacacaacctattaacgaaagggtttaaccnatgtcacacagcactggatatatgtccgagcatcagcagctctcccatatatctcccggggatttctccacaggacagagataaagcagctcttcagttgcccctcttccggcaggcctagaacggcatgccgtagtagtcgcccgcaaactgggggctccagacccagaacacattttcggcgacaccggactggttcgcaggatcgtacaccggggcatctccagcgccaggttcttcagccatgggtgcgttgttgacgacattcgccgggtttgccggctgaagtgcctggttccaggcttcgtcttcctggagcagttcctctggtgaaatgccatctacctggagcagatccactaggtcaaggccttgctgctcctgctgtccttccatctggttcgcccagaatttctccatctcttcccaatccaagtcactgaaggcttagactgcgcattctctacagcggggtggtagttgcctgctagatccaccagataaccagcgcccatgtttgcagcaggcacctcgttcacttcatgcggagtaactgcggcgtgcgcctcgtccatggtgtctttctgcagagtaactgcggcgtacacctcgttcatggtgtctttctgcagagtaactgcggcatgcacctcgtccattgtgtcttnctgcagagtaactggcggcgtgcacgtcgtccgggggngtctttctgca

SEQ ID NO: 70507 - DNA, 701 bp, Triticum aestivum
  Clone ID: PAT_TA_70507
cttgctacttgagactttatcactagaagttaccctaggagatatatgagaagccaacaagagcaagagagaaaggctgagatcgaaatcaaataaggtggctcactaaccaaatacgttttcctcaaaattcttcactgcaacgcttacaacaacacaaataaagaacgtcatgagcttctttcttttaagattggagcccaaacagacacagaggtcagtggcctggacttccagcacaacacaagcctacccttctcatgcacaacctcaaaccccctattgaacaacccaaccagcatcctggcttgagcaacattgcagccactcaggtcacaagccccatacctttccaaaaccacaggagtagtgacctcaactgtcacagacccatactgccccacaaagtcctgtatccttggccccaccatctccctctccacaagtctcaggcacgccccctggttaccaccaaagaagcagctcgccagtgactcgaacacccgtggtaaagtggtgcaatgcctcgaagaagaagtcgacaaaggaggccttacatagagacgcctcctttccgactctaaccagctcctcttctacgatgaccattaactttggctgtaacagtttaacacaggcaggtaggagtgccggtaacttgctcagcaacttgtaaggcatgcctggttgtgtcacatgag

SEQ ID NO: 70508 - DNA, 225 bp, Triticum aestivum
  unsure (1)..(225): unsure at all n locations
  Clone ID: PAT_TA_70508
accttatgagatnaaaccggaaaagatnaacattggtgcttcggtaaagttngctccatntactttacctntggggganatntagnggnggttgtntccggcggggcggtanaggcggttgtaggcggcctcnccgacaaggtaaatccnaaaggcnacaatggcnatgcctanccccggagtggcgtggcncanntggttcccnaccatagggngcctcctcca

SEQ ID NO: 70509 - DNA, 683 bp, Triticum aestivum
  Clone ID: PAT_TA_70509
cgactacctcaaccaatgtcatgtctcctacatcgctccctgcgacaccattcccacagaagcctcgacgacaacagcactggtccctcctgctaatgcccaactccacggagaagccgtcgagaggggaaacgacaccaacgtccgatcacaaaggatctagggtttcccccggagccgaatctatgcgggaggggtgcgacagcaatgctgcatgcctccaaggtctacaacgaccacagccaccgcaatcaccggtcacctaccgaagccaagacatacagggtcttcaccaaagcttccaaacatcctacccgcaccgccatcaacaactccaccgaagtcaaagaagcccgccgccggagagaccaaccacaccttgcggaggccaacgggcggccacatgcagcgccagccgttaaatctgtcaaccgtcgaccggaagccaggccatcggacacagcacaaaccaccatgccttgccgagaaccatgccggcgagtgaccagaggtgtgcaacccgagggcaagaaccacctcggtttccagccacgtccaagctccatacgcgtgcccaccggaggacagagacagcagattcgacggacaaagatgcagccgtgctccatcaccacaagactgctccaccatgccgcaccaacagcagcaccttccccgtgcca

SEQ ID NO: 70510 - DNA, 635 bp, Triticum aestivum
  unsure (1)..(635): unsure at all n locations
  Clone ID: PAT_TA_70510
ggatatgtacggtgtacaaaacgagttattcagtagagagtcatactttagaactggaaacaaatcataacacagatactgaccacaactcagcaacaagtgactaattcctagcaacctacttcagaaatcagaatatataacactgtcatcaccctccataagattctgaaacgaagctggaacatgcgaacaacttgtcccattgacggcctgtcattctcctcgtcctgaatgcaccaacaggcgaccctgcaggtgacatccagctccttcacattagcatctccttccagcctagcatccagcaggcacagaacctccccttcgctcacctgagcagcggcatagaccggaaaatatcgatggctcccaaatttcaccacctcagtgctccttctccccgagatgatctcgaagagcacaatgccgaagctgtacacatctgccttcttagtgatcggcagccccgatatccactccggcgcaagatatcccatggttcctnggatggnggncagcgcggagttgaattctnnnncaancanntttnncataccnaaatnnnaatnttggggcanaattntnnatnaancannntnnnntnangnnnnnannnnnnanngnatnataca

SEQ ID NO: 70511 - DNA, 173 bp, Triticum aestivum
  unsure (1)..(173): unsure at all n locations
  Clone ID: PAT_TA_70511
ccgtcctggacgcagcggcagatgcacgcagcgcttnnncggtcatgctgcgcgaggtgcnctgtgcgaagaaagcgtcaaagccaatnnagcgtgantncatngctcgntncatncgnnttcngcgcctttngtcgnncctgttgggnnggggggggggccttttttnncnt

SEQ ID NO: 70512 - DNA, 665 bp, Triticum aestivum
  unsure (1)..(665): unsure at all n locations
  Clone ID: PAT_TA_70512
cttttttatggtatgttgcattgaattttcaagacaaaattgaaatcctactttcaggtgttcctgcaaaggataacaaaaagaacggacatcaaaagaattgatcaaaatttgcagcagatgttttcccctaatctgtggtacacagcagctacacaatcgcgttggtctctcttctaacactactgaagtcaccggtgatgccacaaagcaattcccatctactgagatctctcaacgactgaacaagtatcatctacactacatctgttgcctcaggccgaaccaccagaaatatagtccatctgcggacctgttgtgcaatctcggtcatttcagttgtagccactgaggcacgatcgtcagggttttactgaggatgctacatatttacgccagggagggtattagctagattagatcactccaaacagaagaatcgccttcgccgcatcgagcatgtacatccttgagcctctcgacggacttgcatatgccgctgcagctccaatcaaaggatgccacgcagatattgccagcttgccctttccactcacaatctggtggagttccacagnacatgttcctttcatnaatatgattaacctntaacccaataaaccatgacccannngatacatnttnnntnncatacttgngnaana

SEQ ID NO: 70513 - DNA, 162 bp, Triticum aestivum
  unsure (1)..(162): unsure at all n locations
  Clone ID: PAT_TA_70513
aattagctcgnaaaaaccctcatctgtgtcaagcgccaaaaaaacnggggcactgnnggctacacgatgatccccatcgctcactcatgctgctcgtatatctgcatgtnggctncagagagagcgaccatctgcggaagggnctnggtgncntggngancc

SEQ ID NO: 70514 - DNA, 124 bp, Triticum aestivum
  unsure (1)..(124): unsure at all n locations
  Clone ID: PAT_TA_70514
gtgatacanggttaagctttctcctcgttgnncgcctacttggatcgctgcctcatctttcggcgcttcctcttgngcctnctnatcctcttcttcttncacttggccctcatcgcggaggtgg

SEQ ID NO: 70515 - DNA, 757 bp, Triticum aestivum
  unsure (1)..(757): unsure at all n locations
  Clone ID: PAT_TA_70515
catgtttctttcttctgcatacaatgggcgcaggggcaaaacaaaaaataacaatnagagtctgcaagcgacagctcccttgttagttaggtggggtgttgcaccagctagaccagcattacaggttgcgagctaaccaaaatagaacacatcataaacaagaataagagcatcatccataacatatatcatgctgcctgcctttcccaatatcccttccctcctcctgcctgcctggatgcaaaatcttcttattacggttttgcatcagccatcatggttgaatctatggacaccggaagatcatatcggatcagatgtgtagttttgtactcggggactccccactaaagctgatgttcctgggccggcctaggcgcagcgactcttcatggttgcttgagaaggcgatctccgtgcacgacgaggacttgctgttgttgtcgttggcgcttccgaccgtgtcgctgctctccatcgggctcttggctgatggatatggcgccgtagtcgtcactctttctttccttttctccaagaatcgggcaagggatgagtcgacgacgaggtctgacttgtgggaggcacaaccaactggcctgaagattttggcactgcggaatcggtgttggagctagatgtgctcttggggagacatgcagcttgagacatgatggacatcggtttggaaatggccggcaaaggaggtgaaacacgctgtgggtatgtgagctagcatctgctttgcaggtgaagc

SEQ ID NO: 70516 - DNA, 152 bp, Triticum aestivum
  unsure (1)..(152): unsure at all n locations
  Clone ID: PAT_TA_70516
taatatgcacggcttnnctactctgctgcctgcctgacttcctactactcacatcctacaacngagcgncgacgctcaagagcagcgcggngacgacgntccggncgaacgacgtgacatngncggctgcccgccaggagccggagtccgtg

SEQ ID NO: 70517 - DNA, 139 bp, Triticum aestivum
  unsure (1)..(139): unsure at all n locations
  Clone ID: PAT_TA_70517
aacacgatggatgatcgacacgcgcccggacactcattgcttgnctgggatgttctncaggagctcctncaggacctggancagatcgncaacgatcccgnaatccgcgacctgaaagattggggcgttcgcgnctttg

SEQ ID NO: 70518 - DNA, 554 bp, Triticum aestivum
  unsure (1)..(554): unsure at all n locations
  Clone ID: PAT_TA_70518
ctnaggctgcttaccaagcaaaagatgagatgctggtggtctagggggatgccctntttgtcctggatcttcgccttcacgttgtcgatggtgtccaaggactccacctccaacatgatggncttgcctgtcagggtcttgacgaanatctgcataccaccacgaaggcggagcaccaggtgaagggtggactccttctggatgttgtagtcagcaagagtgcgaccatcctcaagctgcttgccagcaaagatgaggcgctgctggtccggggggatgccctncttgtcctggatctttgccttcacgttgtcgatggtgnccgaggactccacctncagtgtgatggtcttgcncgtcagggtcttgacgaanatctgcataccaccacnaaggcggagcaccaggtgaagggtggactccttctggatgttgnantcagcaaatgtacagccattctcgagctgcttgcccggcaaagatgantgcgctgctggtncagggagatgtcctccttgtnctagatcttcgcctttacattgtncgatggtgtc

SEQ ID NO: 70519 - DNA, 695 bp, Triticum aestivum
  Clone ID: PAT_TA_70519
gtctcaacatttttcctctttaaatttgcctgaaaaaaaatatttaatttaagatgttaaaaaacatggcaaacttgccatggcaagttaagatgttcaaaacatgaaaacttgccatgacaattctcaaaacttgccatgtctcaacattttttcatctctcaaaatttgccatggcaattttatttaattaagatgttaaaaaaatggcaaattgcaatggcaagttaagatgttaaaaaccatggcaaacttgccatgtctctcaacattttccatctctcaaaattttccatggcaattttctttaattaatatgttcaaaaaacatgcaaacttgccatggcaagttaagatgttaaaaacatgaaaacttgccatgacaaatttctcaaaacttgtcatgtctcaacatttttccatctctcaaaatttgccatggaaattttctttaataaagatgttcaaaaaatggcaaacttgccatggtaagttaagatgttaaaaaacatggcaaacttgccatgtctctcaacattttccatctctcaaaaattcccatggcaatcttctttaattaatatgtccaaaaacatggcaaagttgccatggcaagtcaagatgttgaaaaacatttttcaccgcattgttgccatgatggcaaatttcgtattgtaaacttcctttttttttgc

SEQ ID NO: 70520 - DNA, 670 bp, Triticum aestivum
  Clone ID: PAT_TA_70520
ttaatgaattggggagagcatcgttcccgtacatccttgccggctcatcatcattacacaacaccgaaaagaccaaattaatacaagttcatacacacctattctcataaaaaacatacaaactctctagctaaagcatttaaacccaataataaatgtgatcaacatcacaactaaggtaacaattgttccaacaacataatgataccaagcctcattatcgacggcatattttctaatcttcaagcgcattgcatccatcttgatcttgtgatcatcgacgacatcagcaacatacaactccagtttcatcttctcttcttcaattcttttcatttttctttcaaatactcgttttctttttcaactaaatttaacttctcaacaagagggtcggttgcaattttcggttcacatacctccaaggtggtgccggcgaccggacggtgcggggcgatcgacggtggttaggacggggacagaaaggcactaagtaaaccacacctttgtgaacacttggatggacgggtgcctccaaatcttgttaaattttggtaaaaatggaggtgagctcgagcaagaggggaagaaaacagagtggaggggaaaaacagagagcttcggctcgggctggacaaaaccactatatatagtgatatctttagtccca

SEQ ID NO: 70521 - DNA, 692 bp, Triticum aestivum
  Clone ID: PAT_TA_70521
atttcttctctaattgatgtaccgaaactgtttcaatacatgaacggtgtagtcgttcaatgttccattccatagattgacagacattagctccgcaccttgagagctctacggaagttcggacaggacattgcaaattctaactgcagatagtttagattcttcatgtgaacaaacaattccagcatattgatgaagccctgcttgcaaacttgctgccccgcttctttattccccagtcaagatccttagtttgaaccaaccatgttgccattacaaacggcacaaatgtttcttcttctgcacctttgcctgaggagcccagtgatgcagcttaattagcagacatcacttcgattcaagaacacagaagagaatcatgtgtctttaactggataagctggtttgcttgttgtgtataccaaccaaagaacgaggccacggcatgatgtagggataggaagaaccactagggatgcgaccaagcttgttcagcgccactgtttccatgcagaaggataggagccagggagtcgaatgctgatgcggcatcacccgacaataagcagagaagtacacaaagccatcaataatcgccctaacagtcacttcaaatttaacattatcctccctggatctacaccgaatgattccagccatctcctgaaacgggagtgacttgtgcaacatcc

SEQ ID NO: 70522 - DNA, 342 bp, Triticum aestivum
  unsure (1)..(342): unsure at all n locations
  Clone ID: PAT_TA_70522
cgagctacagaggaaatngcganctaaacaagtcagggtctcatcaggcttttggaatctgcaggcggngacanagagcgacgaccgtcggccggacggccctagccgccgaagccgtagagggtgcggccctggcgcttgagcgcgtagacgacgtccatggcggtgacggtcttgcggcggncgtgctcggtgtangtgacggcgtcnnggatgacgttctcnangaagatcttgagcacgccgagggtctcctcgtanatgaggccggagatgcgcttcacgccgcccctccgcgccaggcgccggatcaccggcttggtgatgccctgaatgttgtcg

SEQ ID NO: 70523 - DNA, 120 bp, Triticum aestivum
  unsure (1)..(120): unsure at all n locations
  Clone ID: PAT_TA_70523
gncacttgttgacaccnccctcggtatttnnatgggannaacatgtaccanccaacantcntttnttttcgtcacttttaacantagtctcattttcnctantccatnctttatttaagt

SEQ ID NO: 70524 - DNA, 654 bp, Triticum aestivum
  Clone ID: PAT_TA_70524
tttggcacttcatacatagggaataatggaacatattccttttacacaaactgagtgcacttcaaaaaaatctccaaaaaatgcaaaacatggatggagtggactgcgtcgcccaactttatcataaaaaaaatgtactccacgcccatgccccaaggagaaacaccgccgcactgcaccacctcaaaatacaaacaaaagtcaagtggtggactgcacgcccgtgctgcctgaaccacgagacactcgccgacgagctgcatatcttcgacgaagaagaattcactgacgcccatactacaaggtggcgtggagtcgaggagtactcgaggagggcacacacccactccactgcacgctggagtcgcggtgcactgcatcaccatggtcgtgctgcttgagtggcggagtatcagccgagcaaactgcaaacaacatttacactaaaccgcatatgaaaatcacaaaaggtcgtcgctgaagcagtgcactcagcaggtgcgtgtagccatcatcgactccccacgcagtacacttctgcactgtgagtcgaacatcaacgggattcgtcagtagcaactgcttcttcacctgaatgggttgacaaaagctactcccatgggcgctggagtcgatgatggaccattgtggacg

SEQ ID NO: 70525 - DNA, 185 bp, Triticum aestivum
  unsure (1)..(185): unsure at all n locations
  Clone ID: PAT_TA_70525
cataattacgacactntantgggtatgccgtggggtccaggactctcccaattngcctacacgagganttccattanncaacacancacactgacagttctcaaccagntaattctgaccgtgntgctntctctccatcgccagncgcgcnncttctagctagtngtcctagcctaggcatanna

SEQ ID NO: 70526 - DNA, 434 bp, Triticum aestivum
  unsure (1)..(434): unsure at all n locations
  Clone ID: PAT_TA_70526
gtagtacttacangcaaggcatttagcgtgtatagctcaactcgataacaagtagctaactcattaatttgctacttaaccaattggttttgatatgtatttctggaaagagatcaacgccaagttgccaaatctatagagcaagttttgaaggagaactcagccttcttctaaagcacaacagatgatacgtttcaggcaaccatctaacagatgatacatcattgatggcgaacctcgatgggttagaagtagtgaagacacgacccaaacttgaaataacacctcaccgggcacactgaccgaaccatcaggctttgcctacacataatcaaaacaggcagagcagcataacgtagttaggcaacaatctctcctaaccactgatttatggccaatctcatcaccgataaccacggagacccaaccaagct

SEQ ID NO: 70527 - DNA, 735 bp, Triticum aestivum
  unsure (1)..(735): unsure at all n locations
  Clone ID: PAT_TA_70527
tgatagtattggagttgaaacatacaaaangtataatatgttgagacatatcaggtatttgaatacctcaaggaagaagctgcaatcaaccaggttgccattgcatgcctagaaaagggcatctncactcttaactggtngagaacattaagatatacacacatatttnatataacttgcatgtaaacctaggcatgagcagcccagaccgatgacccagcccgaaccctgatnacaacacgctcattaactatcaagtccaacagtttttcgcacaccaaaccaccctttcaaaatgtctaangaaactttcttgccacaagctgtactttccatcattttcttncagttgtgtttgtccgtctattagttagacgagatgcagtcaaacccaattgaataatatggactgctcgtccatttccatgctccatnttatgtgactgccactgtatcgggatgaactcaagggttgcactctatttgttgattggagcagagcccaaattangatccctgcagcaagacaaactgaacttatcaaacaagccaaaaataangaaaaatgtgagcgaaagtgaaataaagatgataagattggaagaatctaggataagaagatggnccttnttactgataacatggagggaggcaaaagacaaaagcattacatcaccttccttggaagtttaagcctatgaaatattacacaggaaaacataatctgctatctag

SEQ ID NO: 70528 - DNA, 311 bp, Triticum aestivum
  unsure (1)..(311): unsure at all n locations
  Clone ID: PAT_TA_70528
tggatgccaatcataaaaaacgataggctccggtgtatggtggtctagtaaacagacacttcaatctgaaccttgtattccaaccaaatttacttgagaaatctcgagacatcaccaacggnacgcaaggagaatcaggtcttaatcaatcttaagacatcaccaacgagatgaagggagccagtaaccaagacctccttgagcgcnaggtcgttgacgaggcggcggaatcttcccatcatgcggcgattcangttgccgttattcttgtcttcatcgcgtaagatcaagttgaagtcaccgnaaagcat

SEQ ID NO: 70529 - DNA, 206 bp, Triticum aestivum
  unsure (1)..(206): unsure at all n locations
  Clone ID: PAT_TA_70529
ttntgctncaacacagagncaacacncggncaanaagacaacaggctgggcctacncttccatccatccatgtncaagagagcagatgtcggngcncagctgacggggtcnacaacaccatnaaaactccntgngcnccactngcagtattgngagcncctntcctnttgaacatcgntcgtanagctntgaggcgagctcgagga

SEQ ID NO: 70530 - DNA, 499 bp, Triticum aestivum
  Clone ID: PAT_TA_70530
gtcgggattacatctctgactctggaggcaaaagcgcggattagctacgcctttggcgtcttcttgctaggccgtagtacgagtaaatacaatctacagttagatctttctagtggagtaaactgtacaggagagtaagcgcccggtaggttaacaacggggcaactgaactatattttgcctccccttttgcttgataacacaggcttaggatggctgtccgaagtgccctgatctggtgttgtaagtcttaatgcaaatagaattcacatgcttcgactgtagcagcaatataccgggtgaataaacagcagccgacgaacatgagatatggccgcaagactcagcttgaacaaggaggcctgctatagcacctgctttgccatcttttcttggcaaatcctcgacaatgcttccacatgaaaattctgtagctcctcaaggactttaacctccaagcctctgatatcttcacccttcaatctagacattgcgtttt

SEQ ID NO: 70531 - DNA, 391 bp, Triticum aestivum
  Clone ID: PAT_TA_70531
ttcgattaaactagtatgaattgttgttgttacatgcagagtaagtaaacccagctctcttgattcgaaagccaagcaaatcgctaaaacatatgatatgaatgaactgaatatagttgtttacaccctggtgtatcatatcagacagtaacagtaagtaactaagctttcaagctcgaaagccgagcagcaattcctaaagcagactaggccaggcgctgaggagcggccactgctggggcgcgcagggacacacgcccgtactgctcacaggagtacttcttgtagatggccttgagcttgctgtccggagcagctgcgtgtgccatgaccagcatctttgcaggctccaggagctgcggttcagcgaatccggtgtggtgcttgaggg

SEQ ID NO: 70532 - DNA, 423 bp, Triticum aestivum
  unsure (1)..(423): unsure at all n locations
  Clone ID: PAT_TA_70532
aaaaanaaaaaggaaactacttaatacattaacaacacatagggaagtagccctggtccaacggcttgagaaaggacgaacaaaagctaaaagaagaaggatcaaccagtagcagcaccatcagcctcccagcctcacaacttcagccagcctggtgaactccaggttttctcaaatggataatcttcagccacattcaagcatgtaacggtgccacagtatacaaaattgaatgatttgctttttcgtttcatcattccttcccctgaattttcattcacttttgcctacaataggcattgcagccccttgcaacataggttcaaattaaccagagcacaagggaatagatgggagaagagacgaccaaaaaacacccgcgcatgcctaatcctcgtacaattggtttctctttcttggatc

SEQ ID NO: 70533 - DNA, 711 bp, Triticum aestivum
  unsure (1)..(711): unsure at all n locations
  Clone ID: PAT_TA_70533
gtcccgcatgaaactgactgcatcaccagctacaaatcctagaatnagggcagcattacaacttttagtctttcaggcaagtctacgaaattcagttgcttacagaaaacatgaaccaattcaaacagacatactaaggttggcaagaattggaacctcactttactatccaagttagagaaaacaagaaccaattgaaacagacataccaagccacggcagcaatcgactcctgtcgaagatgcacttcttatcaaggcatcagaagtgtgatattgatatcatgtgtgcagtgatggtaactctgtgtacaatggcacatacggcagatatggcggcttgccatcttcaagattgcagatcactttgacccgccgactatccatattatagcacatgaaggtggtatcccaacccgcagtaaaaaagatcaagttacattccggatgaactgcaatcaaatggaagtccacattaaggtcaagaacatgtgtccctccagataaatatgaagtttcaacgctatgcttcaatatccattctttgctgtcgtagtcctcgagaacatgaactactagtcgaaccacacgggcatcttcatcttgatgaaaattggcataatgcaggcgaccctgtgactgctgaatatgaccgccatctagaccgccaggggcgccggaagtccgtccatgtttcccccttccgtgtcca

SEQ ID NO: 70534 - DNA, 494 bp, Triticum aestivum
  Clone ID: PAT_TA_70534
tacttaacaataaggataagagtacattatcctccttgacggtaccatctgattgaaaaggttcaacggtgacaattaatccatgcataatacaacagttcctgtcagctgcagcttgcagaccaagagtattatttcttctaaaaaaagacttcccctaaactcgggaagtggatctggacgagcgagggcatcccctctttgattttgtagccaagcgatgacttctcctccaatgtccactcctggcgcatgtgcttgcacctttgacacactggactcttgtatagctttatgtcctccagattcactgctgcttgcatgatgctcctggcatagctcacgagtttgtcttctgcttgaaacctcccatagatactgagcccagcaaggttgtggtgcttgaaatcagatgcagatggttcccactccagtcccttgtccttctcctcgctaaatgcgccattcttcctctgctccccacgatgcgtagt

SEQ ID NO: 70535 - DNA, 630 bp, Triticum aestivum
  Clone ID: PAT_TA_70535
catttttggacattttgaatttccgagagtctttctgaagaattctcaaaaccttctccacatgagacaaatgttcctcaaagtttttactgaatatgaggatatcatcaaaaagcaccacatcacatactcttagacaagaagacaatgagtaattcatggcaccctggaaggtgcctggtgctccagaaaggccaaatgctaagacagaagtctcaaagtgcccattatgtgtctggaaggttgttttgtattcctcactaggtgccaatcttatttggtgatatcatgcctttaagtccagcttagaaaaccatgcaacagctgtaattcgtccaataattcatcaacgataggaatggggcacttacccttgacagatatggcatttagatgtctataatctagtaccatcctccaaccccttctttttcttgaccagtataacaggaggagaaaagagactattgttgtgtctaatcattctagttttaagcaattcagctacatgttcctccagtttatctttaagttgtggagcaaccatatagggcctgatagatattggcctggccctggtgactaagggaatgacatgatcatattgtctttttggtggcaacccttcag

SEQ ID NO: 70536 - DNA, 501 bp, Triticum aestivum
  unsure (1)..(501): unsure at all n locations
  Clone ID: PAT_TA_70536
attgggaaanatatatagcgttgagcaccatgtttaagtagagatacagcgggtaaaagatggtttacaccgctgcatagagggggaagagttggtgatgatggcggtgaagttgttggtgaagattgcggtgatgatgatggcccctggtgttactccggcgccacgggaagcgagggggagagagccccccctccttcttcttccttgccctcctccctagatgggagaagggtttcccctctggtccttggtctctatggtgtgggaggggcgagagcccctccgagataggatttgtctctctgtctctctctatttctgcgttcccctgattgccctttctccgtttcgtatatatatatatggagatctgtaactttgattggactgaaacctccgccgagatttttttctgaaaaatanctttcttgcggcaaaagaatagcaacaaccaccttacnaggggcccacnanggtcaggggcgcgccccccctgcc

SEQ ID NO: 70537 - DNA, 491 bp, Triticum aestivum
  unsure (1)..(491): unsure at all n locations
  Clone ID: PAT_TA_70537
atatttttaatnnggtccaagtgcaataaattgaaatggagaaaacataacggtggtactgcagaaataactgctctacaggcgaaagagctaacaagtccctcaacggtaaaaagaagcaagagttgaataacagccttagtaggctgagaagaatgacgataagctctcaagtatcaagtcttcgtgtcatcgccctcgctgtgattctgagaagaaatgccagcatttgaacttgaagcaccaatcaatcaatccatgcttcctactctgaatgttcctcaagtcttgtatgttaatttgtctgctatataaagctggtctggaaagtttggaaatatttgattaattttcatgcctatttcccgtcgaatcgcatcatccaatatatgttgcagtatctcattgaaccatatgccattttgttgtgcacatgcaattccattaagctcaacttggtgaatgacactgcacaatttttcattctcaga

SEQ ID NO: 70538 - DNA, 192 bp, Triticum aestivum
  unsure (1)..(192): unsure at all n locations
  Clone ID: PAT_TA_70538
ggctagctctcaacccagctccctcacaacccagctccctcgctccctcactctcactcaactctcttncaatcgatccatccatccatccatccatcggtgcagctcgcccagagcaccggcgatggaggccggcgacgaccctacgttcgtcgcggagggcaccgtcaccagcatcagcctcgccgtcgc

SEQ ID NO: 70539 - DNA, 124 bp, Triticum aestivum
  unsure (1)..(124): unsure at all n locations
  Clone ID: PAT_TA_70539
cgaacgacaaactgtncaaaccaacanantncaccatctccaacaacancggngacgacanccaacgcccgcnctcatcccacacccgncggtnagtnccatgngacggntgntgngcncannc

SEQ ID NO: 70540 - DNA, 703 bp, Triticum aestivum
  unsure (1)..(703): unsure at all n locations
  Clone ID: PAT_TA_70540
agcttttgtagtgaactataatatgtncctggaacatgggacgtagaaaagacaatagcaatgtgtgttcaagaagaggagagactaaaagccgcacatggtggtacactcaactatgtgcatggtcacaaaagaaagaattataatctaaacaacaaaagttctccttcaaagccacaaggaaaagtttcctatcagcatcagcgtcagcaacagcctttctcagtggacaaagacacttgtaagtcctctatctttgagtaggcaatatccatcgcatactcgatgagtcgaggctcgacgcagtcaccatgggtgctggtgaacattacccagccaaagagccagagcacgtatatctctacggcgcactggctctgctcctcggtaagttccttcagcctgacaagcttcccatacgtgctacgcaaccatgccaatgtgggcccacgcagctttgcggaatcctcctcctcctcgggctccttgagcttggtggatttctttgtggccaactgcacagactccttgagctgtgggtgctcagtctgcttcgctgatatttttcttctctttgccggtttctttgagaacccgcgcagctcctccgtgggtttcttagcctcactgctgggtgtatttgaaacattcagcaccgagtcatattctgggacgtgcttgcaaaanctcgtgcccatatctt

SEQ ID NO: 70541 - DNA, 253 bp, Triticum aestivum
  unsure (1)..(253): unsure at all n locations
  Clone ID: PAT_TA_70541
agcggaaagcacctgtctctgaccaaaacatctggatcccaacacataacttaaacatntgacaaacacgccaggcttgtaagctcactagntaacttgnccntggctcttgtcttggttgacagcataaatcatgttaatcctatggaaaaataaaatcgaaaagcctactggtttcatcagacgaccacctgataccaatcaacacaaaaatggccaatccaatcttggcctgngctatgccagctctcac

SEQ ID NO: 70542 - DNA, 149 bp, Triticum aestivum
  unsure (1)..(149): unsure at all n locations
  Clone ID: PAT_TA_70542
taataaggngaaacatatcacattacatnctagcagcaactcacgagttcgcaaatcaacaacacatnaggcanaactnaaaaacgatggntccaggagcataggtntatatccttgcagataactggctatagcnaaacgactcanca

SEQ ID NO: 70543 - DNA, 601 bp, Triticum aestivum
  unsure (1)..(601): unsure at all n locations
  Clone ID: PAT_TA_70543
tagtgtatagttcaaagttcaccaacaggnacaaaagtaggagcatgaatgattggtacttgaatcgttgcatttatcgctggtcatttaaagcgggctgttgtagctagtagcatctgcattttccaaagatacataggttatggaagtagactctttaaaagggataaaaccctatgtttcaaatcagctgcatagagtcatcaattgttcagatgagcaagttcattctgcacgtcgacaatagctttgttgtgttgaaagaaggcagcagctttgctaaggtcattgccatgtttagaactggttgagcatacaccgtttttagctatgcgataaatcccggcaaaagtgttttggacttgatacatatagcctgcaaagcctttgctaagatctctgatctttgaattatgttctttgatctcctttctttctcccttaacaaaccaattagatgcagtcctgtttcctttagtttcagtttgttgtaactatagtccttgagaaccttgccacgcagagtctccatgcatctgataactcgagcagctctgtccaactttgcagcanaaaaactggtggtgggagccgcagctta

SEQ ID NO: 70544 - DNA, 130 bp, Triticum aestivum
  Clone ID: PAT_TA_70544
gactcgagtcttgcaggaactaggtaataattaaaacgaccgtctgggtactattttatgctgctaccatatactactaactactaaaatgcctagggctaaagacaacctaggacttgttttttttttt

SEQ ID NO: 70545 - DNA, 636 bp, Triticum aestivum
  Clone ID: PAT_TA_70545
acctaggactcgaaccgtttacagaaaatggtgttagtatgtctgcaaacatgacatggacgcaacatctaagaaaatccaacgagtaacatgcagcagctcttcagcctaagctgtggcacccttgcccttcttcttctggagcttcctcatgtagaactccagctccttgccctccaggatgtacctgtagtttcaagacacaagtattaacaccatagctaacaagaaattgtagagtactgctttatgttcttccagaatttaatatacaaggggtgatgaacagatgaactgtgatgcttacccatcagctctgccacactgtccagggcgagacgaaatgcaggccagcagccttccaccactgaactgctcctcaatgtgcgagtccagtgtacgtccctgctggcgcttctcaagcttcctctggacattgttgctcttctttgcttcctctgtggcagcagcagcaacctcagcctcttgcccctgtgcataagaaaatcacacaaagcaaacataagcagtgaacagggataagactgggtcagggattggatacaatccaaggggaaaagggcataatacaaactaggggccttactggcaaaatgcaaccattaaaataagatg

SEQ ID NO: 70546 - DNA, 553 bp, Triticum aestivum
  Clone ID: PAT_TA_70546
atgctaagatacattggtcctcaaactccccagtcaaactggcagtagctgtgtccctcgatgtaacattgtgtccaatagtgaaagatgaaaaatgactaattcaagcatttttcaagtgcatggcacgggacagtcatttgcagagtggccatgtctccagacatcgcaatccactaccgaacctgtaaacaataccacgacgaaccgtcacggcagcaacctctttgccataatgcagccttgcgactgtatttcgatcatttgacgaccatagcaccgcttcatgaagctccccttccttccagcggatgtcaacagttacatcgccacgggccttcagccctttgacgctgcccatgggccacttatctctcggtagagcggggagcaagtataggtcactctgtgtgctctggatcaacatttcggcaatggcagctgcaaatccgaagtttgcgtcgatttggaatggtgggtgtgctgtccacaaattggtatagagtcctccttcaaactcaaccttaccaccgggaggaaccaaggtgatcag

SEQ ID NO: 70547 - DNA, 564 bp, Triticum aestivum
  unsure (1)..(564): unsure at all n locations
  Clone ID: PAT_TA_70547
tatttattnggcagcaccattgttacaggatgacactgtcagaacacacacagctagctacagaactcatcagacagggaacaggaaagaaacacaagaactaatgcacgaggagcctaggacgaggtgaacttggtgacggccttggtgccctcggagacggcgtgcttggcgagctcgccagggaggacgaggcggacggaggtctggatctcgcgggacgtgatggtgggcttcttgttgtagcgcgcgagcttggcggactcaccggcgagcttctcaaagatgtcgttgatgaaggagttcatgatggacatggccttggaggagatgccgatgtcggggtgcacctgcttgagcaccttgaagatgtagatcttgtacgtctccacgcttttcttggccttcttcttccccttcttgtcgccgccctccttggacgccggcaccttcttctccgccttgggcttcttgcccgcgggggtcttctccactggcttcttctcagcagccttgggggccatggatgctgctgcttcttcttcgaaggtgagaaaagtttgc

SEQ ID NO: 70548 - DNA, 682 bp, Triticum aestivum
  Clone ID: PAT_TA_70548
tgtggtcgcggcagatcgccggccgctgcatgggttcatagcaggaaaattcgtgatcccagagttggtcactttgaacttcccgagaaccaagacttgccagcacatgcgctggtgtgttacagtttcggggagagagctccatccggtactcgatgaaacccaaacggagacgatattttgcctctctgaataaagctcctagagctgctctgtcactggcgtccgaacacacaacctgtttcagatttagacaatccgtttcaaagatgactttgcccatgccaaaattttctgaaaggtcgatcgccttcaaaatcgcattgctttcagcctgtaacagtgcagacaagttactgagcggtccagcggctgcgaacaggatatctccgtgcggcgctctagcatgcagccccaacctccagtaccagattctggatagtatgcacagtccaggttgatcttgacgaactcagatgacggcttccacttgctcgtatcctgtataacaggctttggagagggcgtgaaaaactggcaccattcagcaacatcaaaagacagttgtgcactaaattcttcaggcttcagtctgcgttctacatgcctcatattattcctcagtccaccacttccacaataggcatatgacctgaagcttgatgttttccggttgtgcaaa

SEQ ID NO: 70549 - DNA, 630 bp, Triticum aestivum
  Clone ID: PAT_TA_70549
aaagaatgcgctccaatgcatacaacaaagagacatgcgatttctttttaatacttcacatcagaagttgtttaagtttaactggcattgttcagaaaataacattcataaacagatattcctagagaacatcaaaaaagtagtccaaaccttgtccaatttcccagattgaaagccctgccccccaatcttgcgcttcatccaaacgtacagaaagagacaacagcgtcggataaaatacagcatgcctcacacctttatccgaatatataaaaaaatgctctgaacttttgtcatcccattgcaaagatggcttgtacttctcaagtaaatgaatgaaatctcttccagtaatagaaccaccaccaccacctttagaaagtagaaaatcattcccatagaaattaatcccaaggaatatcatgtgagaatgaacttgagaagcagaacccttggctggaagaagtgttgtcaaagaatattgtatccacttcagaggtgcactggggccagggttttgtggtccagagaagtcatatgtcataagagaaaaaccacctactgaatcagccaactgcaggagatcttctggtccaaagtcttgattgttgggcccttccatccgtggag

SEQ ID NO: 70550 - DNA, 518 bp, Triticum aestivum
  Clone ID: PAT_TA_70550
ttgtttggaacaccgacacggcaccaaacagccggttgaattattctaatataattgaacccgagtccttttttatgatagtacagaaaaggaaacttaaaactatcctagtactattattcttcaagagtagacgatttgcatacccgagttttatagttttatagaaaaaacagatatactccctccaactaacacaatgctaactactctattggttcagctccctccgccctagcccttttccagagtttgtaatcatccttgattcagtccacaagatcactaacattgtgctgcactcttgcattcttttgcttccacaagatccaacatgtgagcgtaactaaagaatcgacctgccttcagcaatctgccatgtgtatccaacagtcttccagattatcccaaatatttggcctcaggatcatgcctagcgagacagtgccatcaagtttgccgtgcgtagacacattgaataagaacattggtgcctgtctgcaaaatgtgtattaggc

SEQ ID NO: 70551 - DNA, 198 bp, Triticum aestivum
  unsure (1)..(198): unsure at all n locations
  Clone ID: PAT_TA_70551
actaagattctccaaaaaagacttgacactaaaacttntgctagataactcgatggcagncaccagagcactcatttcttcttgatggcagccttggtaaccttggcaccggtggggtccttcttctccacgcccttgatgacaccaacaggnnccgtttgtctnatnttnttcacagcaaagcggccaagaggaggg

SEQ ID NO: 70552 - DNA, 531 bp, Triticum aestivum
  unsure (1)..(531): unsure at all n locations
  Clone ID: PAT_TA_70552
taatggtgactgtctatctaaaccaattacnaaagcatgcatgcttctacatacccagctaatttgaagtgttttgtgtgcgtttcggcaaatatcggccgatcgatcagaaggaagtgaaggcgcagctgcccgtgtggtcgccgccgatcgatcagaaggaagtgaaggcgcagctgcccgtgtggtcgccgccggcgtcgtcgtcgctgcagggggtgtgggtgtggcggccttcgtaggtggtgatcaccatgcggcagtcctccgacagccgctccacacgcttcttcacgcggcagttgctgtgggtgcaccggtagtagctcctgggatgaaggctgttcttgacaaccttctggccgtacttcctccacttgtatccgtcgtccagcacgtccacttcgctcctggtctggaagcagaaccgcggctcctcatcttcctcctcaccttcatctttcccttctccgccccctttcaccatgagctcggaccatggcagctggctgtggtggtagtagtagcact

SEQ ID NO: 70553 - DNA, 227 bp, Triticum aestivum
  unsure (1)..(227): unsure at all n locations
  Clone ID: PAT_TA_70553
gcaacaatatctnaacacnaacataagttagacaagtttgtcttaagaagactagcacaaacatcaacatggattgaaaaggcgaggcctcctgcttgggagcctcctaactactcctggtcgtcagcggtctccacgtagtagttgtctccgttgggatagtagtagtcgnnggcagtagcattttntttntgggctccaccatctgtaagctctgctgacaaggg

SEQ ID NO: 70554 - DNA, 611 bp, Triticum aestivum
  unsure (1)..(611): unsure at all n locations
  Clone ID: PAT_TA_70554
gcgaatttaggctttatttgcataggagcaactgaaaatgtcagctgagttttgtcaactttccaagaacaaattaggagctattgcttgatacatgcccttatggttggtgcttgatacaacactagattttggtggaaggaggctcacaaattaatttgtcattgccaggctcatgctatcccttatcctccgaccatcaggattaacttctagtgcattcatcaatacaaaatacctttaactccaagtttctcttgcgaagcccgccgcaatcttcttggccgcctgaatctcctggagggccttctgggcttcggctttggcgtcttgcgcactctggagggccttagcaagctcggactcttgagtcttagagtcacgctccaaggactcgtatttctggacgaaatcctggagcttgtgctggacctcgttgacccgggcctcctgcttctcatgctcggcgcgttccttggccgctttgtcttcggcctcggccaacgccttcttaagggccgccacttcggtcgtggccccttgactttcctcgagctgcctcttcacgaggccgagctctccctcggtccgctctaggtcctgctntagtc

SEQ ID NO: 70555 - DNA, 659 bp, Triticum aestivum
  Clone ID: PAT_TA_70555
ataatggtacaaaaacaacatagtagcatcagctccagataaaatctacaactgcaaccactaaaaaaaatacttcagagcataatgatgataccctaaattccggcaatgaaaacagtacgtagcaatggtatccatatcagaaacatgttcaataacaaccatcatgacctgcaggcatatcgccccatataacgcccaagccattcgaaatcatgttcagaacacaagcaattcgtgcacaattcatgtaatggaaatttccaacatacagtgtactgaaacataacaggggataactgcacagactaaaagaaggaatcaatatctgtgaacctctgtcaccgttgtgcgaatcatgaaaaggctaaccagtttgagtttcatcagcagagattgcagtgtccaaaccagaaccatcagggaaactcaagctcggggaaccattggcaggtaccgtccttctgctgcttccgaaggaactcagggaggatgaggctctctttgagcacatgtggagtaattctgaggccccgagcaaaacagttgacagatccctgaagtttatccatcttatcataatgcgacagcttgccagggctttcaaacaccagcatatccgattccagcaccagcacatcccccccttgatacaggac

SEQ ID NO: 70556 - DNA, 228 bp, Triticum aestivum
  Clone ID: PAT_TA_70556
tctacagaagatagcaaacagcagcgagatactgcgattacatcaacgaccacgaaccctagacactctaatctggcggtgatggtggcctagcctccgaatccgtagagggtgcgtccctggcgcttgagggcgtagacgacgtccatggcggtgacggtcttgcggcgggcgtgctcggtgtaggtgacggcgtcgcggatgacgttctcgaggaagatcttgagc

SEQ ID NO: 70557 - DNA, 694 bp, Triticum aestivum
  Clone ID: PAT_TA_70557
ggttttgataaatgaacaactatcgagtccaaatggaaaaggataagtgccaggtctctcgtctcccaaatgtttgggaaattgaagtttggaaacaacggaaataaacacgacatgcgattggttgaagcaattatacaatttagatgacagtatgacactgcacggctacggcaatgagagaatgataaatattaaagcttcattgagctactccacaacttcttcgatctcacttgtcccgttgcagctagcagtggcctccctctgatgaaggcctccctcttgtgtgtcttcttcttcttcttttacaatctcagtcatcttactggaactagcaactctgttctcttgaaaaacctcagtcttcatgttgcagataccatttttctcctcttcagcaatgcacagagtgagctcgttctggtgctccttacactcacttttcacagcttcagttgtctccttgacgcccttgttggttgcataccatttgaagtaccggagagtgaccttttgaaggtttaggaggtggctgatgcccatatgttcttcactggctgatccagcgtacagcttgagctcaacatgttccagctttggcatagctccttcctcaaagaccaccctaggtattcggaaatcaacgtagaacctctcaagttttgcaaaccccacatacctgatgtgtatc

SEQ ID NO: 70558 - DNA, 233 bp, Triticum aestivum
  unsure (1)..(233): unsure at all n locations
  Clone ID: PAT_TA_70558
atgaaaaagcaaacngncggacctaggggncggggatcctagcgcgaagatggncagncntaggaacaggaacaaagtgctgctcccgatactctctgtatttggcatccgcgtgctcaatgtcctgcaaaatcttgtcccaggccttggccaccttgcgatctctgacggctggcgtgtacctcccacttttcttgaggcagnacgccagtagcctgctctgccctataccc

SEQ ID NO: 70559 - DNA, 727 bp, Triticum aestivum
  Clone ID: PAT_TA_70559
ttctgcaggccctaccatctggtacggagccgagtaggtttcacaaaaggcagctgctgctgctgctactagcctgcaaccctttcatgcctaataatcaaccgacaaaaaatgcatcccgtcgtagtatcagacttcaggcgaagaacccgccgcggtcggcgtgggctggcgactggggctcaggcgagttgccctccagcggcacagtccggctgcagtgggacctggacgtgctggacgacgatggcaggcaccgcggctcgccgctgaactggatcacgtctccgccgccatcccgcggccgctgctgccactctttcgccttcctcccgctctgcccgccgtagtagtacccctgctcgacctccacggcgcgcgcgaacccgccggacagcgggtccagccgctcgtagaggatccggaggacctgcttcatcgacggccgcgccccgccgtccttgtgggtgcaccagtggatcacgtccgccatcacctgcagctcgtccaggtcgaacgtgtccgccaccgccgggtccaccagctcgtggaggcggtagtcggtgccgatgagctcgcgggaccactccacgaggctccggtcgtcctgcaccacgggcctcccggttacgagctccagcagcagcacgccgtagctgtacacgtcgctcttggccgtcagctcctgggtcaccacgtactcggggtctacgtaccctgcacggag

SEQ ID NO: 70560 - DNA, 135 bp, Triticum aestivum
  Clone ID: PAT_TA_70560
atagtccttgaggtttggcacagcaattgacgggaggttgaggttgcgctggtttaactcgcagtcgtctagccatgatccatgttgggtgcagttgacgaacttgatatagtctcctgcatccacgtcatagac

SEQ ID NO: 70561 - DNA, 609 bp, Triticum aestivum
  Clone ID: PAT_TA_70561
tattgcttacaaaggtgatggcaattgtcattgataaatgggtaggggctatcaaccaagcaccaaaatttggttgactacccgcaaagctaaaagttaactcaatttacagcatggggctcttgcagtgatatttgttcagactatctggtggaagtatgaacatgtgaagctacaaagcaaaagaaatctcaactgtaaacctctcttcgaaacacatgtagccctcaatgtagtagaaaaagcaatggacataatttctcgataccgactgcagggcaggtgtcctgaatgtagtaggccaggggagagctacatacatcaagcatgaactattactgataagaattctgaccacccatcgattccatagcacctacaattctctgcttatttgtcagttatgttctaagagtcgtccatcttagggtcttgcttcttcatcttcctccacgtatatttggtgataagatctatcttctccagcttgttccttttcaggaccttccccttaccccttctcagaatcatctcttgtggtacccctcaaacagattgtgtgcaccgtaatgcaggatcaacagcaaccaaacatgtgcctgtctggcg

SEQ ID NO: 70562 - DNA, 649 bp, Triticum aestivum
  Clone ID: PAT_TA_70562
tcacgcagcagtcaccgcgcggtaggcctagtgagcaatcttcaaatcattcaaaagtcgttacccagctttctctggaagaaaatgttgggttaaagcacctttttctggataaaagggttttcgaggtcattttatacacagtttgacagacgagcacagcagcatcaaagtagtgatcaatcatcatacatactctagttcgacgggcgagcacagtaaaaccaaagttacgcccaggctagatcgccgaggcccgaaggtacacttatggaaagggcccggctttcttgtgcatgatctttcgctgataggccatgatctataaacaagacaaccacggttatatcatcgtggaaatgcctgcgaacgccactctcgatcttcatgatatctttcaaagtaagctctcgtttcttccccgcttcctggagagctgcttctataagccttctcgcaattccagtacgcccatgtttgtgaacaatcttgacggctgtctcattactcaagtgttcccacagaccgtcggaggcaaatatgatgaaacggtcacttggttgaagactgtgtgacatgatagatgggttggcactcaatataggccggctgaatggttcccgaagcctgaacttactatggagcggtt

SEQ ID NO: 70563 - DNA, 208 bp, Triticum aestivum
  unsure (1)..(208): unsure at all n locations
  Clone ID: PAT_TA_70563
gaacacacgcgacaggggcatacaggaactacggaacacgaacggnggttgtattttattcagcgcgcgcgcgcgcgagcgcatgcggnggntggngatgatacgctgggtggtggtgaactggtggtgatggngcttgcttgcttgtcctnctcatcctcgngctcgcctctgncggccggcctcctgggcgccggctcagttgcag

SEQ ID NO: 70564 - DNA, 102 bp, Triticum aestivum
  unsure (1)..(102): unsure at all n locations
  Clone ID: PAT_TA_70564
aaagcggnnagaaatccgaaaatatttgctctcattattgcggcaacggtagagtacaggcatgcggatgcagagcaagctgcgagctagatcgagcttatg

SEQ ID NO: 70565 - DNA, 635 bp, Triticum aestivum
  unsure (1)..(635): unsure at all n locations
  Clone ID: PAT_TA_70565
ctttcactgtttcatatattctctcaaatcagcaaacatttgcaaaccatcttgtttgaaaattacctaaggtgcccaatacataagaggctggttgtaactaaaatggaaagcagataatgaatggttgggattgagcggtgacgcccacctgcaataatatgatgaaacaagnaaacctgaagtcatttagtcataagcagttttactaacagtttatgctgcctctttggtgggaatggaaaatttgtaagaatagaaaactcctgaagcaacatttcaggtcaagtgtggaaatggaaattttgtaagaacataaaactgatttggctctgaaagttagcttcacaggttttttgaagacagtatgaaaacaaattagagagctgaaagttatctatattaagggctcattcagcttgcaggatttctaaatcaaaggaataggaaaagtaaaggattgggatgctctctccactttaatccttatgaattttccatgaggtctcacctaatgctaagaatcattaggaattaagccaatatggacacaatcctaaggaatctagtaccttcattcttgtgaaacgaatgtcatacatagggaaaaaatcctatgggaatcctccaaaaat

SEQ ID NO: 70566 - DNA, 365 bp, Triticum aestivum
  unsure (1)..(365): unsure at all n locations
  Clone ID: PAT_TA_70566
agtaaaatacaacgacaaaacaagnaacagtctacttcgaactgaagtatcctcaagcacacccatccatacaccccagctacagcctaactacgcaaggaacctaagccttcttgggggacttggcggtcttcttgggcgacttgggctccttgggggacttctcggccgtcttcttggggagcagcaccgggttgatgttgggaatcacgccgccgtgcgcgatggtgatgccggcgagcagcttgccgagctcctcgtcgttcctgatggcgagcagcaggtggggggggatgatccggcttttcttgttgtccttggcggcgttgcccgcgagctccagcagctcggcggcgaggtactcg

SEQ ID NO: 70567 - DNA, 605 bp, Triticum aestivum
  unsure (1)..(605): unsure at all n locations
  Clone ID: PAT_TA_70567
cacaacaaaagtgaaaaaccagggnataaaggaaattcagnaacagccatcacaccgtcgctctcgtaaccacttgtagtactggtgattttatgttgttggcgaataaataataaagtttggtttgctgatcgatcatgcaatggttgacaatgggacgctgtagaggacgagtgtctcgacagtgaggccggggccaaagccgaagaggacaccccactccttaccctctccagtggttgcttggccatcctgggaagaggtcttacgcatcacgtcaaggacgaagaggacacatgcgctggacatattgccgtactccgacaggacctctcggctcgcgcgcatgcgttccttgtcaaggccaactttctcctcaaccatgtccaggatcgccggcccgccagggtgtgcaatccagaagatggagttccagtcgtggatgcccagaggcttgaatgcgtcctcgagcgcctgctcgatgttcttggagatgagcccgggaacgtccttgagaaggtggatggtgagccctgcctccgtaaggtggccgttgatggcaccctcggagtcgggcaggatggtctggctcgctgataccagct

SEQ ID NO: 70568 - DNA, 200 bp, Triticum aestivum
  Clone ID: PAT_TA_70568
ttccacgtagtgttagttaattcagctagctagctaataatccttagctttaggtcacagattagttacaataatattcctcaccattggttatgcgaggaaaataataattagttagtactgttgataaaatatttgtactccatctttttagttagtatctatgaaaggagtagctcgttttggactaaaaaaaaaaa

SEQ ID NO: 70569 - DNA, 308 bp, Triticum aestivum
  unsure (1)..(308): unsure at all n locations
  Clone ID: PAT_TA_70569
ttccacgtacttaggtangtanaaaagcggntgtgctaactgtnttggaagaactgagcaaagtgggttgggtgtagaaattttggcaccgggttttcgtatcttacgaagccactgtacgtangtggcgtgctaacacgtttgcttatttattttttgcaagacttcgggtcttgtgttcatacgtacgtagattactgctcaggtgtgtggaattagttcggngctcattttcgnnttanatggatggaaagagatgtaaataatgtttttgaaactatgcctcatgtgttgcanaaaaaaaaaaa

SEQ ID NO: 70570 - DNA, 400 bp, Triticum aestivum
  Clone ID: PAT_TA_70570
ccacaagctccgcctctactccatcgccagcagcgccctcgggacttcggcgacgcaagaccgtctcgctgtgcgtcaagcggctcgtctacaccaacgacgccggggaggtcgtcaagggcgtctgctccaatttcctgtgcgacctgaagcccggtgccgatgtcaacataacagggccggtaggaaagaaatgctcatgcctaaagacccaaatgctactatcatcatgctcgcgacagggaccggtatcgcgccattccggtcattcttgtggaagatgttctttgagaagtatgaagactacaagttcaatggcctagcctggctcttcttgggaggccgaccagcagctctctgctctacccagaggagtttgggaagatgaaggcgaaggcgc

SEQ ID NO: 70571 - DNA, 431 bp, Triticum aestivum
  Clone ID: PAT_TA_70571
gtctccatcggccaggacccctgatcagcgctgtcgcgggaccatctcgctctggtacatccctgtcatgttcgccaacgtcttcagcttcactctccagatgtacctgcaggcacagagcaagaacatggtcatcacctaccttgcatttgtcaccctcggtctccatgtgttcctgccgtggctcttcaccgtcagctgcaccttgggctcgctggggccatgacctccatggtcattgccatgtggattcctgtgtttgggcagctcatcttcgtcttctttggtggctgccctctcacatggaccgggttctccttcacagcactcaccgaccttgtccctatctcagtatctcatctctgtgtatgctctgttggattgtgtacagcacatattggtgtccttaccgggtacatgagatgcagagt

SEQ ID NO: 70572 - DNA, 374 bp, Triticum aestivum
  Clone ID: PAT_TA_70572
ttttttttttttttacaataccatgtttgctattgctaagcacaaccaaaatccatcaatacagaacaacacttgtaccaccagctcacagcgatccaaggcatattttacatgctgaggcagtggcagattaagtgttttccttgagcaacatgttttttcttctcaagtggagcacacgtcactgctatcatttggtcgatcttgaggaacaacctccgacacgtctacgacaccaactaatgttccacccctttcattcttaacatattgaaagaacaagtagttatcctctaaaacgccgcaaactctggtcaagcagggcaccacaagttctaccttgatggtgattcgttacttgtgccagattttta

SEQ ID NO: 70573 - DNA, 339 bp, Triticum aestivum
  Clone ID: PAT_TA_70573
ccctgcagtttcaaataatctttttgtgcttaatttctcatctttatcgtgctacatggtcgaaaatgcttgtagtatttgtccttcgaaagatggaggggaaacaatcttttccatcatccactctcctcagggacgtacaaaaaacaccatatcttctaatatagggccatatgggttcatctgctgcggacattgaccatctgccagaaggtccctctcatggatgcgtctgtgaaatcatcatcggcttcgcgtctccctccacgctgccggtttgaggcggcgtgagctctgatagccatgttgaggctgttcacgtcggagtagtccagcccg

SEQ ID NO: 70574 - DNA, 346 bp, Triticum aestivum
  Clone ID: PAT_TA_70574
tttttttttttttttttttttttttttttttttttttttttttttttttttaaggtttggttgggggttcccccagactgcatcttggatgtaatttcggatgacattccgagctacacttagttaataaagcggcgatctttcccctcaaaaaaaaaaaaagatcacgccgtggccgttgagaaggctcacgacgcgtagcaccagcgcgtgctcatttggagggctcagtcgtgaactatactgctgcagccgcatgcccacctggtgaccacgtcctggacgcatgcaccagccggcatccatcacctccagcgaacctccaccggctgcctggcttctttgc

SEQ ID NO: 70575 - DNA, 323 bp, Triticum aestivum
  Clone ID: PAT_TA_70575
atcctcgacgtctgcggcgtcaacggagcgctctacacccacgccgacaccatcatcagcaacgcctacctgacagccatccaactagcctcggcccaccttgcgtacaaggttgctcgaaccaaaagttcggcatcatcaagggaaccatgaccacaacccactgcccacaccggtgaccagaggctgctggacgcgagccacacgcgacctgcgcacgtgcccgtgccgccgcgctcaacatcgtgcccacctacaccggcgcggccaaggccgtggcgctggtgctgcccaacctcaagggcacagctcaacgggatcgc

SEQ ID NO: 70576 - DNA, 471 bp, Triticum aestivum
  Clone ID: PAT_TA_70576
cttttcttgtttgtgtgtggtggttgagggggatgggatcttgacttgttcgaagttagatggggtcatctgcgtatccgtggtacatcttcaattacattagaatccagtttatgatttgctaaagcagagtagggactgagaagaagccatgcttagtccgtgtcattctttcgtttgggtagtattttcacatgacggcgtggacaactgggtatagacattacaacttaggagattaatcaaaattgagacgatgattaaccaccgcaccggttcatttgaccttttttccatggtagctctcataaatattaggcacagaagatgattagtaacctttggttgcagcttatggcactgttaaattacatggtgcatatttgatggatgcctctgggatgcgaggcttaggtattcctatgtttgatgaagttaaaaatgtggatgaacccagcaacaatctaattc

SEQ ID NO: 70577 - DNA, 274 bp, Triticum aestivum
  Clone ID: PAT_TA_70577
tttttttttttttttttttaaatatacctcctgattccattatcactaataccaaacatccagcaagcacaactctaataccaaacatccagcaagcacaaatcttacagcttggtaagatgagaggaagagtactgggccatgccctaccacaccagacagacatggtgcaacaaccaccaccctaaaaaccactgtaactcagcgaaccataacactcagtccatgagaggtccctcattgggtgatatttggcacccctaggtcttgtgag

SEQ ID NO: 70578 - DNA, 274 bp, Triticum aestivum
  Clone ID: PAT_TA_70578
tttttttttttttttttttttttatttttttttttacacaagcttcaaataacaattgcgcgagagttgaataaacagcgcgagagtttagctacatctcactgacccattgttacccacaaccacaatggcacaaacacaccattaaaatattgtacgtagcaggctaatgaattcggtgaccggctgatcgagtggtcaggtggcagacatggatgcgacgatggcgtgcgcgacgatggccatggagctgaaccggtcgttctccttgggc

SEQ ID NO: 70579 - DNA, 481 bp, Triticum aestivum
  Clone ID: PAT_TA_70579
ttttttttttttttttttttttttatgcctgtaatcaaagcttgtattcaatagatattgagagaggcatctggttccttacaggatcctaaacacatttgttgttgaatttacctttgggagtcaggcaataaatatcacgttgcaggccctgtcaggcgtgcaattaagagacgagcatgtgaagcaacggtttacctgcttaaattggttgaggggctcgtcgctacgaccgtgtagagcagactaaatccgctcagcatcgagaaaattcaaggaccattagtgcatgtagactacgaatgctgcatcgtgggcggcggcggcgactgtgccagcggccatgagtgcccagtcgaggccatcgacgaagttgaatagcctccaaaaggagatcgcgccgggaaggggctcgacctcgtcctcatccacatcctcgtcggcggacctgtacagtttgagcctactgataagtgataaa

SEQ ID NO: 70580 - DNA, 527 bp, Triticum aestivum
  Clone ID: PAT_TA_70580
ttttttttttttttttttttgatctaaacgctcttatatttctttacggagggagtacaaattactatctgaaccaaacggctttattttgccatgcatgcatgcgtacttacatgttgcgcatgtgtacttaacactgtaacacgtacatacaatgggcagatggatgttggatcagctgttgacgaccctgcagttacgcctaatctgggtgggtgttccgctgggcggggtgaggctcgccatcttgatcatggccgtcaccaagtcggaggcgaagagcgtcgggttggcggcatactgccgcactagcgcgtcctgggagccgccgatgaagagcacctggtcggagttgagcaggccgcgcttggccaccaagttgcgatagtaggcgttgtcgaagaagagcggcgtctgcacgtctaacggcgccaggttggtgtcgccgttaggggccagggcggggcaggcgcccttgcgcagcgcggcgaacgccgggtcgatgttggtgccattgtagatgtggt

SEQ ID NO: 70581 - DNA, 310 bp, Triticum aestivum
  Clone ID: PAT_TA_70581
ttttttttttttttttttaagcatatccccgtaatactactatgcactctcacagccaaacaagtacaatctgtaacagcaggtccaagaatttgtagcaacatagatggcctactcatgtgtgcctttcaaaaagaaccagctttccttcctttcttgtggagacagtgccacaagaaggtggcatattctgcctacatccacaaacttctctatctacactagctttcatctcatggaccagagcagagcatcctcacaagtcacaaccaccaatggcaggctgtagcttcaaggttttgaggctgtg

SEQ ID NO: 70582 - DNA, 577 bp, Triticum aestivum
  unsure (1)..(577): unsure at all n locations
  Clone ID: PAT_TA_70582
tttttttttttttttttttaacacaaacaaattattgaataattgaagccaatttttgcaatgtaaattgacaaaaataaaagattaacgacatgtccatataacaaactgagtgatgttccaactaaacatctattacaaaactatcactatctagatgatgcgcttaagatattcattagtagaacgcccgtgcgttgctatgggcatacaaatgattaaggtcgtctacgaggtcgaaactcatttctccctcatacgtccgggtgtgttcggacatcacacgggcacccagcggcctccccaaaattcaacatcgacagttcaggctcatccaaatctaacccatgtgtggggggagaaaatgtgactgtccagactatcccatgttatccccaaacgcggtcncaacacaaaaaccccatcccacgaagcacccttcacttttcctgccggaccctccacttcctgctcggtttctcgctgtacgggacatttctcgctggagccctcgccttgaaaaccggatgacaccacctcaccttggccatgtcgctctctctccttcacaccgcac

SEQ ID NO: 70583 - DNA, 490 bp, Triticum aestivum
  Clone ID: PAT_TA_70583
ttttttttttttgggcacttcacataattgactaggttttgaaacacacaagcacatcgtgcagttcacacacgagccgtgcaacccgcaagcagtgtccaaacggactgcatctattttttacaaaaaataaatacatttgactgaagtggaccacagtactcctcgaagtgatatgtttgtttgtcttgagcccgaatgagcttcaagagagttcaaagcgaacagccaaccgcagtccacttgactcttttcttaaaataaaaacacaattaggccatagattatttctgggctgcacgcgcaggtggacagaactgcatcacagtgcccgttgggctctcatcgacagtggacaacaacacttttcttgctctttttcgacgcacttttcctctcctgtaaaaagagagtaaacgcccaaaatcagatgagcaaactggaaagggcaaacttcacctcacccatgtttgcatgttcatcagtgggg

SEQ ID NO: 70584 - DNA, 378 bp, Triticum aestivum
  Clone ID: PAT_TA_70584
ttttttttttttttttttttccccccgaaaatgaactatttaatgcttgttgaaataaacttcccaacaaatagtttttacacacaatacatcatatcccaaccggatacatttgacagacaaaaaaatccacaaactgcatgcctgcttgctccgagctgcacgctgtacacacccgcatggcaccacaacaaatgacgacatgcaacgccaaggcgtccaagctaccatgtagatgtgaacctcatgccggcgccagccgaactacactgagagaattaacaagtttcattagaaactgaattcactcaaatcaacagcaataatctggaaaaataacaaaaaatgttctgtaaactgcaagcccttttgtcggga

SEQ ID NO: 70585 - DNA, 432 bp, Triticum aestivum
  Clone ID: PAT_TA_70585
ttttttttttttttttttttcaaaaaaccaatgcattattcgattcacgggtacatatgtttaagaattatataagcaccaaataaagaatgatgaaccagggttctatacttgtactattacagatggtaaataaagaagcgacagacattccggttgctaaacaaggtgaagcggaatggccctattgtgctctcctagatgcagaaggcatgcaggactctagtccaaccccttgtggtggccaaccgccaatcatgtagtttgagaggtaatcttgagtaaactgcttcaggatccacatcctgcagttcactgttgtcttgcataaagtgtaaacaaatagtttgattgacatcttttaacccattttaataacaatctttatcagtttcctcacttgatgatgtttcatgaatatctcattggccc

SEQ ID NO: 70586 - DNA, 509 bp, Triticum aestivum
  Clone ID: PAT_TA_70586
gggtacgggcccccatcgaggaattacctgggaggcatccgtgcctttcttcattttgcccttgatttttggtgtctccacactctgcagaatgtttctattctctgcttcaattgaagtaaaatatttctgttttagacaaaatgcatgtactagcatactcgaacttcagagatgcccattttgtttcggcaccctgctggtatgccattcaacttcgccacctcgagcaccctgtcgggccgccgttcaactataccaactggtgtcattcaactaaatcacctaacgccgctcatctatattttttcttctcagccagcaacgaaaacggcggcgatcgagccatctcctcgagatgctccgcgtgcagccgccggcttctcgcacgccatcgaccccttccatccccgcgtgtgctttcttcctcctgtgcacgatggacttccccccgcgcagcctgtgaccttctgactcctgtgcggctgctagccagcacttgcgttctc

SEQ ID NO: 70587 - DNA, 435 bp, Triticum aestivum
  Clone ID: PAT_TA_70587
ttttttttttttttttttttataagcattcgaaggcaggctatgtagacataaatcaacatcatcaatatagtagttcatagattcaaatatagaccagatatgttctccttatagacaccaccagtaaatacatagtgcacgacttagttagtctcatacggtataatggacaaaagatagtacttggtgtacataaggaccttgatcgccttcatgccttcctattgcctttgacttaatcaaatggttgataattagcatgaacatgtggcaagaggtgacagctcacagcatggagcataaaaaattattaggagctcttcctttcttgtagtatgaaaatgacgcggctgcattgcaccttgatgcgccgccactgccaccagcaaattaacaggaggtatctatgtgtatctgcagcaacacatgttgt

SEQ ID NO: 70588 - DNA, 384 bp, Triticum aestivum
  Clone ID: PAT_TA_70588
tttttttttttttgcaaaagggaagtatgtttattcaatataatggaccgtgcacaaaaatacatagcggcaacttgccgacgcattggattttccagcccctagctagatatgcactgtgcatcccaatgtcaacagatttgttaaagtaacattaagatgcacctgggcgaaatcttcccttcaagatactttttagcagttctatggaccaggtcaataaccgttttcgcatcctttttatgaccttctaggagatatttttctgattgatctaaagttaaaccttccaatgcaggggcattttccaccatatgcataaggaactcaacttggccagtgcatgctttaaatcctgtaacatgcaaactcttcaagttgttg

SEQ ID NO: 70589 - DNA, 441 bp, Triticum aestivum
  Clone ID: PAT_TA_70589
tttttttttttttttttttttttttttttttttttaaaaaaacacagcacaaatctcatagcagaatcaacggcctcaatcgagtgacccaaaatttaaaatccaggcaacttagaaaaatatagaacagaagtgttgtatattactatctctgtttttacgaacagagggtgcatgtcctatacaagctgcgaggcagagtacctgcataccctggcctctgaaaacacaagccccgttccgcagtagtacccttgccccgggctgcagtgtctgtcctcagagcagacgcatcgcccgtccagcgcgcacccatcgtccttactgagctccttgccgccgacgacgtcttcggaccacgggctgtcgaacagtccccgcgggtccagctgccgcttggccgcggcgaacctggcccatcccgggtacttcccctgcacg

SEQ ID NO: 70590 - DNA, 496 bp, Triticum aestivum
  Clone ID: PAT_TA_70590
tttttttttttttttttttttttttttttttaacacgaaaaattatccatattttcataaaccttccttgtaagagtagtcttacccaaaccacccatgccgacaacacacactacttgagcagggctatctatggcatgaacatctatgagatttatcaactcttgttttggcttggagaaccccacaagttcagcttcatcaatgttgttggcagattggttgcgaatatcttccatgcaagaatccttctcatcagtggctctagcgaatttgttcttctcaatcaggttgtatcgtgtgttcctattgctcacttcttcaacccttgatttgagatcacgaatttgtatcgcgattcgatggcgatctttgagcttcatcaacttccttgacaagctttgacttgcgacatgcaccatgaattcaccaaggcaatcttcaatattgtatgataggtcccttacttgctctgcccacaccttcagtagtatgt

SEQ ID NO: 70591 - DNA, 321 bp, Triticum aestivum
  Clone ID: PAT_TA_70591
tttttttttttttttttattttttttttttttctctgggtagatatcagataaccatatattgcatgcagctcaagttatcacaaggcatgaaatagcttcaggttgttttttgttacagtactggcccccgagaatgaacgatctgaagaaacaaggttgagaaccaaattttaccagattacaacttgtaaaccgctttagttcgggcagatccaaccatttcacgatctaatgccaaaaatgcaattgaacattgcataccactctagatgacataagttatccaccgtggtgacttcctactgtcagaagcggagca

SEQ ID NO: 70592 - DNA, 498 bp, Triticum aestivum
  Clone ID: PAT_TA_70592
ttttttttttttttttttggaatttgagtaacagtcaaatttacagcgcgccacttcaacaaaataccaacgcttttttgtacatctcgctggaagcagctacagtgaccgcaccttgcccttgtagaacatttatatgggcaaaaccagtgtcacagacttacagtcgattgccattaccgaaccaagaccgaaaagcctccaggcgtacggcgtgcagcagaaaaaacaatatacgagaagcagctacagtctacagaggcttggtaacaggctgagtgacagctatgatccggcaggcggcttgttgctcgagagcctgcgcttgtatcgcttgagcacagaagcaaggttttccttccctttaggccatgttcggttacacctcttctcaagaggattggaggggatttgggtggatttttacttgtaggggattatatcacctcaatccctgccaaatcccttctaaatccctgtcaaccgaacaagtcatta

SEQ ID NO: 70593 - DNA, 322 bp, Triticum aestivum
  Clone ID: PAT_TA_70593
tttttttttatttttttttttttttttttttttaacaagccgcaccttttctttcttttttccctttttaatgagaggtaatgatgtacatggagagcactatgcatgcttgtatatattatgttcctgtatactatgcaactcttatgattttgcaatgacctaattaaccataatgcaaactcatcttgaaaaatatgctgtacctttgttcccccaagtgcttcctgagatctcgtgcaatatctgaggtgctgccaccaggctgatcatcgtcctggtggcccttctgtttgaaagtatcccacaggctgccaatggc

SEQ ID NO: 70594 - DNA, 554 bp, Triticum aestivum
  Clone ID: PAT_TA_70594
tgtttattaaataaactttacacatttcaaaaaaaaaaaacatttacacagcaatgcattccataaatactcaggttcatgtcaacaacaacaaattcgataaacagcatgttccagagtctctcaacaccaggcttcagactctgccagtacaattgaacatttggccaaaaagtatgcaccgttgcactagggccaaatcgcacacacactcgcacaacacagtctaggaggacctgccctccactcttttcctgaagatcatcctgcccagcaagcccggaccccgcttcttcttccgaggatcagcagcagcctcatgctccttgaccaacggctgaacaacggcttgcgccgctgacgccttcccgtcggcgtcaggaatctgctcttgtgccgtgctctttcgtgctgccgcgtcgtcaggctcgccatgttctttctcgggagagttctgaccctcggctgtgctggcgccctcgtcggcaaggatgcttccaagtgactggggcttgtagtcagccgagctcggccgcgggctgtgcgttgagatg

SEQ ID NO: 70595 - DNA, 319 bp, Triticum aestivum
  Clone ID: PAT_TA_70595
gcctgtaacttgatattgtgtcatttaacttcgaggatgaaatgcattctttttccaactcaattgtgaattgtcaatttactacacgtctgtggttggggtatccatgtcaacaatattagttagaatttacaggaagtgaggtagtcttccttctgctgaatgaatcacgtgcaccaattcagggatgcatgatcagctaagccttcagttaggtccaacgattggccatgcttcatatcaaccacacacctggcgaaccacatggcacaggtgtgtggtcatctcaagataaccacacacctgacgaagctcttcc

SEQ ID NO: 70596 - DNA, 592 bp, Triticum aestivum
  Clone ID: PAT_TA_70596
gtcagttctacttcttcctatcggaagcagtcaagtataattttaccgccccccattgtataaacaatggtagatcagatcacttggtatcagcttacaaaattccatcagcttcatgctacaataaggcctgctagctgaagactgtttggtttggtcagttaatagcggtagcaccggttacctctgtacaattattttgccggtcaccattacgcgcggttcaggtgtggtgtcgccgcttgctcaacgctgtagtttgcatataccctgctcttgttctcttcccaccagcactgagctgccttctcgccaaaatgcttccgactgaatcttatccgccttatgtctttccttccacctggggatacagcaagtgtcacatacacccctcgctcaatctgctcaatcacaccgtcgacaggagcatccacggaatctgcttccgtggtgtagccatcacggtcgaatgttctggcgatattccggtgactgaatgatccatctgctggcaccgcggcacctggtgacggtgcttgttctgcgacgctattacgtgtcatctttgagttctctggttgctgaccaaccg

SEQ ID NO: 70597 - DNA, 298 bp, Triticum aestivum
  unsure (1)..(298): unsure at all n locations
  Clone ID: PAT_TA_70597
aacattttacatagtgccaatattcaagcacgctaaatcttacaagtataacattgcagatacagcctatacagccccctgatcttttcttttccgcaggagaggaaatggctgccgataataatagtaattagttacagttaaaccaaacaaatgaatgacgctnaagcttagtactagtgcactactcctgcagtacgccgaagtcagtcagaggcattttatttttcatgtacatatcatcctcctgctgctgggttttagtcgtcggcccactcggccgggttggggtgggcgg

SEQ ID NO: 70598 - DNA, 215 bp, Triticum aestivum
  Clone ID: PAT_TA_70598
tttttttttttttttttttttttttggagggaaaaatcaaaaaccctctgttactgatggatggattcgatttacacaggcaggcaccaccgttggtgaaaaaaaaaacaataagcaaatccatacatacatatatatatatatatatatagagaaaaatcatcatatttagcgtggcaacaacgtggtaaatatccttgatgaggccatctgtt

SEQ ID NO: 70599 - DNA, 702 bp, Triticum aestivum
  Clone ID: PAT_TA_70599
ttttttttttctttttttttggctgcttatctgagagctcgttacacacaactatttgacaaagtccatccaaggatgtgatgaattgaaacaaacctagtgccccttaggtaaaggcgaccaggtcaccttcactgagattaacgcaaaatcagtctctatctttcgagcattagacccgtgattgccagcaatgaaggaacaatcatgttcagcggaactggacgactccaggccaaccttaaacttcaggtgtatcgaagaacctgtcactacagcaaccacagacctttttaagctttgtgtctcaccaatgacgccatcgaagagtcggatttcttcactcaacccactggtcaaacagccgagaaacaaactaaaactgttttgcacttctgatatgaaaacttctacggtcgcctcaactgcattttcaagacgtgaaaaagttacatcaactgcgccagaatcgccatggatgcgatttgtgaacacatgacaattccgtaagcccatgtcgcctatcattgacgcaccatcgatcaactgtagatcatccttttcttctttagcagtcctgctccacgatgatgggatcatccctgctatatttgatgatataattaagcaatggatccagatcatcccgcactgctatgtatccatataacgctactggtccaccatccacgtcaagtttag

SEQ ID NO: 70600 - DNA, 510 bp, Triticum aestivum
  Clone ID: PAT_TA_70600
gggccccccctccgagactagaagcatcatgatggtctccaacccgtagcgatcttgatccatctgtagagttgtaaccagaatgaaaataagaccaatgatacataggcgacatactatgctggcaacattcttggcatatgaaatgaggatgagtcggtaccatattcattttgtgcttcaaatgtgccagaattcactgttagattacttggagccgacaacgaagcatcatgatggtctccaacctgtagcgatcttgatccatctgtagagttataagcaggatgaaaataagaccaatgatacataggcgacaaactatgcaggcaacattctcaccaatcttcatacaatcttatacctggaaccgtcgtgtaagtatcgtcaaaattttcagctacgggtatgatgcttgcattatattcttaatcatttcccccgctcgtaagggctgcaatacattatgcataaagcttgtcactgccagaaatgaactgaacgcatgtg

SEQ ID NO: 70601 - DNA, 450 bp, Triticum aestivum
  Clone ID: PAT_TA_70601
ttatgatgagtttttcccaaagagaaaatttctttttatatatgttattggacttgtttaacctctcaagaaaaactttccttttatcaatataactaattaactaatttaattgcttgatctttactttcttgaaaatagtatttcaaggttaaatggccatatttgaactacaaccatttgatagattcacttaaaatttccacaaaaatttggagatgtcatatgatgtttttaaatcactgttgtgcagcaatatatttaattcatgtaatatcttgagccctacactcaaatttttcttctctggtccagagtgcattttgcactgcaacccatttacatatttctttaaaacttctaccaaaattaggggaggtcagtaggagcatattattcaactttgtgcaaaaatccagggttgttctttgaaattattgagtgaatcaa

SEQ ID NO: 70602 - DNA, 334 bp, Triticum aestivum
  Clone ID: PAT_TA_70602
taagattcagaacgggaacaccatgatcacatacacacacacacacacacacactacactagtatatatggttgttgggggcacttatccaacactaatttctcaagatagtgcgtatcaaaactgttggacattgcaggcatgagatcagtgcgggagtactctgtgtgtacgaagttgagattgtgtgccggagtatatggtgagatgagacatgatgatgggcttcctgacgcgcgtgaggctccttgcagcacgcgagtgctcttcatacagtttcctggttgccaaattcatgacttgaattggatcggtggctaattgcaatcatacc

SEQ ID NO: 70603 - DNA, 481 bp, Triticum aestivum
  Clone ID: PAT_TA_70603
ttttttttttttttttttttttttttttttaacccaaaggttttggaaaaataatcacactcatcactgactgactgactgtttgaatagcaaaattacaagtgtgagtaatactagaatttttccgggggggctttgctaccttaacaattcagttggtacagactagactagactagactagactagactagactggactggaggagaaaaagcagaggggaagcaaccaaggcaaaggatgtgttctccggcggagagatctccggtttggtgggggccggcggaggtggtgcaggaaagggtgacctcggggtcgctgaagcagccgtgctgctgggcgatagcccctgccgggggcctccaactggaagctggagttggggctgccgctgctgaaaaggaggcaccaaaagccgccggggtcgacgccggcgcccacctgcgcgtgctccctgccgcggaccacgggggcgttggc

SEQ ID NO: 70604 - DNA, 419 bp, Triticum aestivum
  Clone ID: PAT_TA_70604
ttttttttttttttttttgacacgaatattagatggagtctgcttcttacgaccgggggaagcaaaacattccactcgaaagttaaatatagcgactcagtaattatactgggaaaagaattgttgggtgacgaactggttaatcagcaaaaattctgcatggtaaactcatactggacagtcccattagtagcatgttaatgaattcttctagattccattataacttgacatctaccgtgcatcttgccggtgatcccttttccgatgatacactagcaacattgcaagaactactcgtacacatgacaaattactgacgtaaatgattccgaactctgaagaagagcaagcatcatcgtcgtcgtggcataaaacaccagtcgtactgtagataagatgttcgaggtccactacaa

SEQ ID NO: 70605 - DNA, 451 bp, Triticum aestivum
  Clone ID: PAT_TA_70605
ttttttttttaaattttactttatgcttccagacataaaattgcaaagatgagtaataagctgctagtagaaatacccggtccttagttagtttgtaagtccatatatatggaaggacatgtactctttcattgcaagacaagcaataaggatctaagtagtagcatatgtgtagtgcatacactttgttatctgttcttcttatgttccaaacttccactcacgtgagcaaaaagtatttcactgccttatgccagtagttcagtgcaaaatttgctgctcgttcgtgattgcaacagtatgcacgtcggtatcatccagcgtcattggtgcaatgtccgagagccgaacctccttggttccacctgagtttgatcagacaccgttggcacctctggtgtagccgcctcaggcgatggacagctcatcgggtgttcttctgccggcgaac

SEQ ID NO: 70606 - DNA, 456 bp, Triticum aestivum
  Clone ID: PAT_TA_70606
ctataaaatacagctaaatatacacataactagctccagtgagctaaaacgcattctgggtgtggtttttctttgggattcgtcttcctacagctcatgtacacccaacttttgaagaatgaaggccagcatctgcaaataataaattataaaaagggagaaaaataatcaagtgaatccatgaatacagaattctcataacgatgaaaatttgttgcaaaactttagatttaacaggaaaccatgcatataaaaaaattgttgcagaattttagatttaacaagaaaccatgcatataacattctcataacagcaaaatgtgagatattattttgcaaacgataagtaccagcacagtacaaattaacagacattacaagctaacagtgatttttccaatgattttccactttagaacaaggcacatgcatcaattttatagttaggaacaaaga

SEQ ID NO: 70607 - DNA, 441 bp, Triticum aestivum
  Clone ID: PAT_TA_70607
ttttttttttttttttttttttagaaactaaaccaaatgttgatctcctgaaccaacaactcactaaatatttgtgcccgctaacaacatggcatgacctcaccataaaaaaatcttaactcaataaaccgacaatcatttacgtctactaaaacattgtcctgagtcgtggtgctcccatgggccatgctagtgaacaatcaattatagagataggggcagggagaacagtagtagcatctggtatacctggatgcattacggagacgatttgggagtgacgtcttctgcatgccgaggaggcggtgacgctgacactgctgacgccgatggtgcttctcgctgtagtagcatccggtatactggatgcattacggagacgatttgggagtgacgtcttttgcatgccgaggaggcggtgacgctgacactgctgacgcc

SEQ ID NO: 70608 - DNA, 371 bp, Triticum aestivum
  Clone ID: PAT_TA_70608
tgtagggttccatgctacacacggagtccttctctctggatggtgtatgtgaacgaatgtttgcattgttccttcgaaagagtacatgggaaacaacaaaaattgccacatgtcactgctttgaggttcgcacacgagatcaaatataccagagagcattccctagaaaaagaacacttctagaaaacgtcagctgattagctttccggttttctcgtggaattctgtttgaaccccttggaaaatttcgccggaggtagagaaaaaacaaatgcgactggttcatcaggtagcaaaaaataccatatgcagtggaaagaatcaaggaaacatagctttttgttttgtcaagcaccaccagcagaacggat

SEQ ID NO: 70609 - DNA, 480 bp, Triticum aestivum
  Clone ID: PAT_TA_70609
ttttttttttttttttttttaaaatccacatgtttggatgcgcatgtgtttctggtggcattgttctctctgaaatgattagtgaactgctgcctcgtgtaaggagcctgctatggattcactcctcacgaacaccaattcgagttacaagaactgataaaggggaattgctcaagaatgaggaggaagaagccagaagcaggaggagaaggggagccgccgccgttcgtgccgtgatccactggatggtctcgacgtcgcctcctcccaggctcttatcgccctggtggttccggaacgggccaggcccccttagctggcccaaagggccagcgcaaacacgtgatggtaggagggctcctaacatccccccctccttgaaatgcggcttgaccccaagccgacaccaccgagaaccgccgggatctcattgcactcgatgttccttgactaggtcgaagtcatgatggtagtcgacgt

SEQ ID NO: 70610 - DNA, 136 bp, Triticum aestivum
  Clone ID: PAT_TA_70610
gcaatcacctagacgatcatttgcacgatgcagtatccaagcttcacagcgaagtccgcctccgagtggttgaagagcacgacacccacctggttgggggagaccccgtcgatcacccttgttgcacgagacgtga

SEQ ID NO: 70611 - DNA, 343 bp, Triticum aestivum
  Clone ID: PAT_TA_70611
gggatacttgaccaaaataataatatagtgtacgaaaatcatgtccctaccactaatataatcacgtagactccctttggacatgtattcgaagcaaagcaatctttgccgtacatctgccatgactaattttccgttgtagctcaacatattcccttgtgtgtcagcacaatatcccaaaaaccgtactatgtttttgtgccttgccttcatcaaacattgaacctctccatggaatttcttctcatccatacacatatcgctcaatctcttcacagcgactgtaccactctcaagtactcccgatttgtcgatcgttagagaaatcgtttgtgatgtcttt

SEQ ID NO: 70612 - DNA, 543 bp, Triticum aestivum
  Clone ID: PAT_TA_70612
ttttttttttttttttttttttttttttttttttgaagtggaaaaaaatattatatgaacttacggttataggatggattgtatgaacaaaggaattaattaagctatgcacaatcacttgtagtctatatagtttatgctctacacatgcaatgggagagggggttctcccaaaggtcatagtgcgggaaggtggcctcggggaggcctgttcgtgtctggtgagtgatcatcacatcctccacaaaattcgcccatggcatgtatgggttgccgaaaaacttcgacatgagccccttgtccggcttgataaacttgagcctatgtccccccatgtagcggcggaagccgatgatcagcttcgcaaaattgccgccatgggtcatgacgaatacgtccgacttcaggcataccaggaagtccaatgcagcaaggctggttacatgcttcttgaaatgctctatctcctccttgcttgcgagatcttctttggtaaccaaattggggaacatattcctcagcggtgccattctattgtttcca

SEQ ID NO: 70613 - DNA, 546 bp, Triticum aestivum
  Clone ID: PAT_TA_70613
ttttttttttttttttttttttttttttaagaaatcaaaaccttgcttcctgagatcaaaaccaatacatgaactcatggttattggtggccttttctccccaggttaattacatgtcgtctatccgtcgtcatctcaataatttgaacaaattctgatggagtattcactcgaatcattggcagcaattatctcttgaattactcttgtcttgaattattggcaacaaatatttctttgaattactcttgtttatgatcatcaaattgtttactcatatgagcaagtcttagtttatgatcatctgattgcttatgatcatcaaattgatgcagagcgggtactgggcgaggagatgaacctaggccagcagctcctgtgcagcggcgagtacttcagcggcagcagctcctgtgtgcggtgagtgcttcagcggcagcagctccctgggcgcgtgcgggcaccagctcgccttcaacagcagccggcagcagagcagcagctcgactccaccagcggacagcagcacagcaccagctcgcctcc

SEQ ID NO: 70614 - DNA, 256 bp, Triticum aestivum
  Clone ID: PAT_TA_70614
ttttttttttttttttttttttttttttttttaaaacaaaagtaactgtggtatagggatttccacccttatcccccatatggccgtttcatatgaaaacaacagggtttactaaaactctcatccacaaactctttttaaattcttttgcacccatttctgtacaaaaaagcattgacagataaatgaaatgaaggtaaggtctaaaatcatgaaaaccctataatcatccatcttcatcgggcctgcttgaaag

SEQ ID NO: 70615 - DNA, 651 bp, Triticum aestivum
  Clone ID: PAT_TA_70615
ttttttttttttttttttacttgaacggagggttttattggaaggaacaagacatgtattttttttatacgaaattaagcaaacaaccaaacacagatttccaagcttgataagctcactggacgaaaccgcaccatgcaaatgcacaaaatctacacacaaaagacacttcaaaataaagttagcggcggaaaattggagagcaagcactttcagttccaaccaatcagatccattcctttggattgatgcacacgtcgagaagtttccattcttcagtcccttcttgcggtttatgatcatactcccaccgtgcggtcagagggagggaaacaaggatactctcaatccttcctccagttttgaggccaaatgtggtgccacgatcgtagacgaggttgaattccacatagcgacctctccgtagctgctgccatgccctgtggtcttctgtaaatggggtatctttccgacgttctatgatggggatgtatgcaggaattacagaggccgcacactctgtcgcgaagtcaagaagagtttcttgatcatggtcattgagatcatcaaagaatattccgcccaccccacggcgttcaccacgatgcttgatatggaaataatcatcgcaccattttttgaatcttgggt

SEQ ID NO: 70616 - DNA, 373 bp, Triticum aestivum
  unsure (1)..(373): unsure at all n locations
  Clone ID: PAT_TA_70616
ttttttttttttttttttttttnagaaactatcaataggagtacaatatatgaacagtagggacgatatgttttgatccatttttcatgtttcagagagattttgtagcactaccgagtaaaagcgtttctcaaaattcagaacacgacacgattttctcaacccctctgaactaccagcattctccacaaaataacatttcccttccaggacggaatgcaaactccaagctggaaaatgggctactcctatggtggaactaaaccagcgctacgatcggctccatcgaccaatggcttctccaaccctaatcctatcgccagccttgacgcagaagccaaaatccgatgagaccgtcccgtcctccctcgcc

SEQ ID NO: 70617 - DNA, 515 bp, Triticum aestivum
  Clone ID: PAT_TA_70617
ttttttttttttttttttggctcaacaagaacattaatgtcgcgcgaaatcatcaaacgtgcgcggcgtttctgggtgtgtatgaaaaacggaaaagatagccaccgcctatcacctcttcctgctaccgcataccggagagaacaagctaaatctcgtacatccacatggaccaatgcaaggaagcgtcaagatttcgaagacgtggaaaaattcaaaaactgtggcagtctagggctaactctggtgcgctaacatctacgattagccgagtcccagattccgcagctccttcttctgaccggtggtcgagccgccctctttcttgatccgggaaggcctgacgatacggtcgatgatcccgtattcgagggctccttcggcgtcgaagcgcttcgacctggacaagtcctcatgaaccttttcaacagaatggcccgtgtgctctgctagcttgccgttaagatagttcttgattcgattaagttcgtttgactcgttttctatatcatcag

SEQ ID NO: 70618 - DNA, 265 bp, Triticum aestivum
  Clone ID: PAT_TA_70618
tttttttttttttttttatttttttttttttcttcgatcaaatcgttcttttacacgttatcagcacttgcctctgcccaagagcacgcataggcaaatcacgccggcgacagtcgccggaaaagagaaccagaagggaacaaaggaaaaggtgagaggatgcctcgtggtctcctgtccttcttcctgcaccttgttcgtagcggcggtaaacgccgacagggccgtcgccgtcgccatggtgttggcggacttccccgccaat

SEQ ID NO: 70619 - DNA, 458 bp, Triticum aestivum
  unsure (1)..(458): unsure at all n locations
  Clone ID: PAT_TA_70619
ttttttttttttttttcactttcggggaaattctgcgttgtttcacttngaatctgagatcagatgatagtggtagtttcatttacatttctttactccattcctttgaatcaatcaaaagaatgaatagtgccatcaaagggaaatttatattctcgtgtttttcattcactttaccaaatgaatcaagtgagcctcaatgcattagaaacaacaggaatcctataaacactgaaaataccattccacccctcattcagtcattctgcatggtcatggatgatacactgggaagtcatagccagttcatcttttgctgtgccgatgccttcaacccttgaacttggaatgttcccttcgtgttggttattttccaaagtagaggatgcataacactgatgaaggcatcaactggcagagtcctcaagatataatctgctaagccgggtctttctcaa

SEQ ID NO: 70620 - DNA, 503 bp, Triticum aestivum
  Clone ID: PAT_TA_70620
tttttttttttttttttttttttttttttttttttaatttccttcaatcaacaataacaaccacactattcattaatccttgtaactggcaaggcttgtaagactcacaatatcactttccaagttttggaccaagaagaattatctaattgtgtgcaagtgatgttcgttgactctagtcaagtgctccatcaaattgataaaattagttcttcaccgagggaaatacttgtactgcaaacccttgcccttaagggaccatcaactttgtccacaaggcataaagattagcagggaatatcagtaccaatgttctaccaatgtcaggtcatgttgttgatattaattcttttagcggttgcatatagctttctgaagtgcttcagtgatcatcccaggtgcaatggcagcataaccgactgcaaactgcaataatccaacaatgattggtaactgaaaggataatcatggagccttaattgatgctacattatataaattat

SEQ ID NO: 70621 - DNA, 234 bp, Triticum aestivum
  Clone ID: PAT_TA_70621
tttttttttttttttttttttttttcccccgggcaaatcctaacgggggtaaatacaggctgattgagtaatccaaaacaaaagtgtatacaacctaaagatacaatgatgtttcatttgacaaaaggttgaggttctttgtccccccaaaatacaaaagactgcaaatagtctaccctctatatttccaacaacaacggcgaactgaaatgcacggccaaaatttggtgaaac

SEQ ID NO: 70622 - DNA, 367 bp, Triticum aestivum
  Clone ID: PAT_TA_70622
ttttttttttttttttttttggttggacgtacgtatctgtaccacacaatcaaaagaactgggagcaatatacagttacatgcttgtttgctgaactcctgaaagcttcaccgttgagagccttgagactatatttaagcatcaatcgccatgtactccaagacgccaacaattagttccaaccaaaccaattacatgatatcatcggcagaaaactgaaataattggagcatctacagcttaggggcccctgacatttcctcggctctgcagctagcagcaaatatccttcgctggatgtgccttcagttcaagccaaaccatgtcattctgaggaggtacacctggcacctgctcattgggctcc

SEQ ID NO: 70623 - DNA, 411 bp, Triticum aestivum
  Clone ID: PAT_TA_70623
tttttttttttttttttttttttttttttttccaagaatggtattacaacttgcatctcatatttcaagtacatgaatggtagcagaacttggataaaatattacatattctgagatcttcgtgatacatattgtgcccacatttgttgtgctatataatctcgtttttgattcccagcttctctggagtaattaaaagcatgtatatcattgtgatagttgtggtctccacttggcacatcaacaaattgttcttgatcaatctccacagtagtattctcaggccatgaaaaatctccatcatgcaaacgtatgaaattgtgcagcacacaactagcaactgatatgtcaatttgtttggtcaccgagtaatgtgaagccactctcaatatcagaaatctcatttttagt

SEQ ID NO: 70624 - DNA, 441 bp, Triticum aestivum
  Clone ID: PAT_TA_70624
tttttttttttttttttttacaacaagtaaggatacaggcactaggatatcaatttacataccacacacacggcctaggccaagagggaagacgcgaggctcaaggaggccgccgttgagcaagggacgtcaatgtgcgcccagccgttgagcaagagacgtcaatggcttgaacctccctcgtcagagcatggcctcgtcgtggcaggctttaaaggtgagatcaagggaggaggtagcttctctgaagacgacggcaggctttaaaggtgagatcaagggaggaggtagcttctctgaagacgacggcgctccgccttttccacaggtgccagcagcagagaagtgtaaattacaatttgtaattaggggaaaatctccccttgcccgaactgtcgtgcggtttgtcccgcacagacgccttctcgctcccgcctttgg

SEQ ID NO: 70625 - DNA, 567 bp, Triticum aestivum
  unsure (1)..(567): unsure at all n locations
  Clone ID: PAT_TA_70625
tttttttttttttttttttacgacattcaaatgctaacgataaatttcagcaaagctgcatgctctagctttctctcattttcaaaacatccccaagaaaatacatcaggaaggtgctacaaagtcttgctngtgttcccatagggggagaaaaaagatgccacaagatttgtattcaaatgctatgacccaatcttcgagaaatgttggttgttctgtagcaactgtcatctggggtagttcattcaccatcaagcagttaaaacagcaggagattgggatctgtaaatcatcacacccggttatcatttctccatgggcgctgggaccttgtagttacatgattttcaactactttctgttcatcttcactgaacatgaaccacttgtcttggttcttcattgtagcttctttgtcaaattcttggcgcaatatgtttgtattgttattacaatagccatccagcttccagtatgctactcctttgtctaccatgacaggcgtgggactaaggacacatcccagttcctctaattctttcatggctgcctgcttgacttcttttg

SEQ ID NO: 70626 - DNA, 540 bp, Triticum aestivum
  Clone ID: PAT_TA_70626
tttttttttttttttttttttttttttgagaaaaacatcttatgttcagctagttcggttaaccattgatttcctcagaatttaacaaatgaaccgaatttaaaatgttttagtaattctcataccatatagataaccataaacaaaattgaccaataatttaggctccagttgctacttttttttgttctgttttgatatctatagccttagcgccggctgccttctctgtaaggtgctgcctatttgttggctccaatgcaatccatgacaatgattagtatcattcctatttcaagattcctattcctcgagggtccagttgcggcactgacaatgaaccactgcaagggaagccatgtaatcaccagaccttgatccataaggtgtcttgcatgcagcaacaatatgagatttcgccagatctgcgtccttctgagattcatagtaaagcccagcgtataatgatgcatagaagagttaccaccagagctactagaaaaatttgaagctaacttttcagggtccccaccatctttg

SEQ ID NO: 70627 - DNA, 194 bp, Triticum aestivum
  Clone ID: PAT_TA_70627
ttttttttttttatttttttttttttttttttgttttgccgcccaattgattgtttatggttgcagctccatacatgcaacagtgccaacacctcacactcacatgcaagcaaccaacacccagcgggtgctgctcaacagctcaagaaagggacggggaaaaaatcatgcgccagatcaagaaagaacatcgc

SEQ ID NO: 70628 - DNA, 655 bp, Triticum aestivum
  Clone ID: PAT_TA_70628
tttttttttttttttttttttactccgatgaaaaaaaatcaagcatcgttcacagaagtatggcaagtgtcgttcacaaaagtgagaagcggccattgtcagattttgatgattgttgccttgagggactatgaagaataaaagctgaaacaagcaaaaactgctagaggtggaccaacagcgcacaggcacacttgctctcagaatcaagtctgatcgttatgtgtgggcgatcgttgacaactaataaatctgcaacatccaaccaatagagccaatgccactattgttatgatcttcccccttcacccatgtttggaagttcacatatcccctgctctttggcttacctattggaaacattacacaatttagaaaatattgcagtccacctaattatcttggttgaagaagagctcactcgtttcagattcaagaactgctattgctagccgctgctcttgcttcccttcacaatctccacaacaaactaaaaggaaataatggattcacacaccttcaaagtaggcctttcatttaatcgcagacctgcacgtctctttgcattcttggctatttgtgtacctcccatttgtcccgatggtcttctgcatgctgcaaaggtcaccgtgcttggggcatgttggcgcgtttg

SEQ ID NO: 70629 - DNA, 413 bp, Triticum aestivum
  Clone ID: PAT_TA_70629
tttttttttttgggaaacaagtctttatagacccaatatttgaaccgcgcaatgcttaacatatcttaattttctctaaaatatatgtataatattcaatagaatcagttaagatacacatacttagttaccgccctcttctttttcttcgttgagctgttgggggtagattctcagatggcccacaaggaagtattgttcctgtctcttgctctatgcgtctcttcagctctcttaaaattcgaatttggcccaatttttcgggagatagtttttcccaataaatcccttgtggctttgggattgcagtatttgttaagatgacctgagttggggtgcagataatatcaaccggtacatcatgaattagcagcttttcaactggaatgtcatccactaattgcttgtcatgt

SEQ ID NO: 70630 - DNA, 597 bp, Triticum aestivum
  Clone ID: PAT_TA_70630
actactcgatcttcctagtggggtggctggacagcaggccatgagctaaagaagccatcaatcagtttgttatttccaacaattgagagggtgaaaagcgcggcttgtggaattcagttgtccagatatttgctttctctacctgagaaaacgtggcaaagattgagatctaccggcatatttcatgatgcaatcccacatccacatgataggatagggcatcctatgcatgttaaggttgctcagaggcgattccggtctcggttaggtggccattcatttggctggacttattgtggatctcacaatttcagcccagctgcctggggacaaccgttgcgccctccgtccaaagcgaatcctactgatgccaccagaggagctccttctgggtcaaggctgcacatttgcaactatgagctgggcatcattctcattgccccgccgccaggcatgtcaaaggagggcaatggaaggaggcatgggattgatggcatatcccttccatttgtcatccctgcaccacactacaagtacagtgataggcctgcgacaccgctggctatgcgacaagcatggccgaagcttgtattccgc

SEQ ID NO: 70631 - DNA, 406 bp, Triticum aestivum
  Clone ID: PAT_TA_70631
ttttggggcaaagaaaattagatgcaaaaaaccttgctaggttgagatcaacctaattaggcggatccatatgttcgctttagtctgttctctaagtacaaatgcccttttccacacggaaagttgtaatgtgagtatcgcttagcagtaaaattttaaaaaactaattctgaattcaagctgggaattttggagtacttactaatggtaggagttcgacaacacaaaaaatgagggtagcaactaagcagcggccagcagacaccaacatccagaacctcggccactgcagcgagcctcaagcagtgaaagtttgatccacgcactcatccagcctcatgcgtctcccaaggatcaaatccacctccccaaggaattaaaatatgaagaaaatcacctatctgta

SEQ ID NO: 70632 - DNA, 264 bp, Triticum aestivum
  Clone ID: PAT_TA_70632
tttttttttatttttttttttttttttttttttgaagggtacgatattattcattaagcgtggcgcatcaatactgggctgccacaggatgtatacgacatgcatgtgctaagactccagcgggtatcatccattcggaattgcctcaaatacaactcctgaggctcctccattcaaacagttcactgcgacgtgtatgactcccgaaagcaaactgcttacaaaagtgcgtatagcaaagcaccgaccaccgacattccaaag

SEQ ID NO: 70633 - DNA, 475 bp, Triticum aestivum
  unsure (1)..(475): unsure at all n locations
  Clone ID: PAT_TA_70633
tttttttttttttttttttttttttggaaaaaaaaaccacaatatattacacaagaaaagaacatgccattcttggtacataagtgaaccccataaaaaagcaatgccctgagattacttatggtatcatcttcacacccccatagagactccaggttgtggccttgaagataaatatagacaaacccttcaagtgacgccatatatcggatgattgattcggagcggcctacatcggggcagttgggtatccactctttatctgccctacggcatagagctggaataaaaagtaggagctcatcatttcgcatacttgaacatgcccccacaagccaataaacattccattactcctgagaccgtgctgtggaccagccaaaccattcagtgtcnctacaaaagaaaggtaaggatctaacagagcagttccaaccttcactggctcagatctggcacacgctttacgtaggcg

SEQ ID NO: 70634 - DNA, 174 bp, Triticum aestivum
  Clone ID: PAT_TA_70634
tttttttttttttttttttttttttttttttaaaaaaaacccctatttttatttcgatgaatctgaagttactaaaaaatatcatgatctctacagtacaaacctctagggggaaataatggtgccatttttgcaccgggtgtggtctcaaaaatctataccgacattttacat

SEQ ID NO: 70635 - DNA, 340 bp, Triticum aestivum
  Clone ID: PAT_TA_70635
tttttttttttttttttttttttttttttttttaacgatgcattgggttattattacagcacaagatcacttctccatattagttcacgagctagaactcgtgaacaagtgtataattcccagaggccaccctctcccaccttgcagatcacgccccaggtaaaacaaaataattcacatctaggatgcctcaaatctcaccaaaaaatcgcaagatcccacaccagcgccgcgggatcaggccgcaagatcctccttctccttcgccaccaccgcctccgcctgcttcttatcgtcgccctgttcctcctcggccgccgggggcggcggtgaggcgggg

SEQ ID NO: 70636 - DNA, 439 bp, Triticum aestivum
  Clone ID: PAT_TA_70636
ttttttttttttttttttttttttgagaataatcagcaaaacaacagaatggggtggtgaaatgttgggtcactgcttgttcctctagctgataatctctagcttgataccaggctttggaggcatttggaattggcagatgctaggcgtaagccggatgataacaacaacttatcagccgccttgctaatcgtccgatcatacacatcataaccgttcgcttggtgtctcacggattgcacttcccgtcagcattttccctctcgcgcaggcaccatcatgcatcgcccatggtagcgctccaagcacatcttccagctaggcagtagcggctgggacaccaccggagctgcgatgcaacggctgtcggagttgtgatacagcgagcgtcgacgccgccggagctgcgatgcagcggccatcgacgccgccggagctg

SEQ ID NO: 70637 - DNA, 459 bp, Triticum aestivum
  unsure (1)..(459): unsure at all n locations
  Clone ID: PAT_TA_70637
ttttttttttttttttttttggggcctgccagtcaggctgatgtggcaccgcttaacatctcnacttggaacggcaacgtctgggaacgttataatcatgtgtgggcgtatggggtccgcctgtcattggaagattggaagaaaaaagaaaaggaagaacgatatgtggttcgtgctctgttcgtcacccatgaactcgaaccttggctcggggacgcacgcaggttcatggcacccgaggagcaccgtagcccgcaccactgcttcgagagcgcgcttgtggacggggacgcgacctcactgagtgcggtgaggtgggaggacggcgtcagatccgagtggcctcggtctccccccactgcccggcgccagatctgggggacccatccccatccctctggtgcgggccggcggaagaagactccacggccgccgtcgcgcggctcagtcactcgctgg

SEQ ID NO: 70638 - DNA, 699 bp, Triticum aestivum
  unsure (1)..(699): unsure at all n locations
  Clone ID: PAT_TA_70638
aacagccactggaatatgaaatagcctggcatattagactgaaatacaatctctgagtccatataggatcagcacgaactcagacgaaaacatccacaggttgacctcggatgcaggcaggcagccattaggtagttctgattcggatgaattttgggtctgcccgtcaccnagagaatacaactcaacggaaaataaaaggatttgacagcagtagcgcttcatcaagacttcaagaagccacaagcagcagaattaaggtcagtgatggacgtccaattcgccaggtcttgcccttgagtggcgcatcaggcatcagtgagccttgccagcgataacaatctaccacggtcaggagtgtagnaagctcatgtagggtaagacggaaaagtagaccccaggttcatcaaccttcttcagcagccgggacttgagatcaatcgtgaataagccaccctctgtgctaacgaagatgacgccaagaccctctgcaaaaccaaccacatttgctccattgcctttgagggggtttggccatgggcatgattttctgcaggtcaatgaccatgcatggtacccattttgcagctccattcaccttccttgaccagagatgcagactgaaatccttaacgccagcgagccccagtgaattgtcctccatcaccatgagggtaatgaaaccacatacacttctgt

SEQ ID NO: 70639 - DNA, 539 bp, Triticum aestivum
  Clone ID: PAT_TA_70639
cgttacaatccccgatgattccggtgacactgggggttacagtctgctctgtcggacttgatgaacttcagccacttccagttggcgtacgactccgcttcgtcctcgaacgggacggtatcgtcgtagccgccgtcgggcccctcgccagaccgaggcgtcgccggcatttgctcccggtatcttcgcgccatctcttcagcctcggcgaacaccttctctttgttggagagaaacagtccaggctcgctctcaaggtccctaatactaagagcaattctgtctggcgtcgtcgacttgatcacaagcgctttcactctctcgcccacgctgagcgcgtcactgacggatctcagctgaccgtgtgttatctttgagtcatgcagcaaaccacttctgttagtctccccaatcctaatttgtgcaccatatgggaacaacttgcggactgtcccttccaagagagccccttctttaaggtataacattgcccaagcctccttttcactaattattaattcgttagtcctttcgtcaat

SEQ ID NO: 70640 - DNA, 501 bp, Triticum aestivum
  Clone ID: PAT_TA_70640
catatattcttccaacatctcaataaataaataaaactcccaacaagaacttttgatatgtcttacagtactagattgagcagcaggaatcttgcattgaattaacattgcagaccatttttctctacatgttacaacatgcaacacttacccaaaggctcatgaagtcatcatataagaagctagcaagcattgctttcttcccgtcacttttgatacccatccgtataatacaatggctagcaagcagatatgcaagagagagagaaaggaagctgaatatgattcaactttagagccttgtccattggaatgtgaggaatcagaaacacatgctgacttcgttggatgtataggctgagattcagacgtaaacatagattttgggcaatgctacaactgtaaacgaagtggtaacatatcacagtgtttcgcagctgatctgcaatgtctgacaaagtttataggatagcaagcaataaataaaagaagacgcaccat

SEQ ID NO: 70641 - DNA, 146 bp, Triticum aestivum
  Clone ID: PAT_TA_70641
ccgtatgtagtctatataggaatggaatctctaaaaaagacttatatttatgaacggagggagtacaaattaatacgctgaccggtcggtgccagcctccgcgtgtcgttcccctccttagaaggtgtcgctatggtgtgtccgct

SEQ ID NO: 70642 - DNA, 425 bp, Triticum aestivum
  Clone ID: PAT_TA_70642
aatagttgcttagttattctgttaatcttgcttatacaacttatgatagttacgataatcacctaggagtttcaatttttgaaaggaaaaaacaacaacaatcattaggcccttaagaaatcacgacatgagttctgaatctgaccagctacaagatatatccttcctaatattcagatctagtgggaaaaactactacccaacaatatacatacaatataaactactactcaaatttgcactaacagaatagccagcttcttgatttgagctccacggagtttgctcgttcggctcaacttcactgcggagttaatggaagttgagagccggagcattgccgaacaggtccttagtacaaactgttgccaaacttgagagcatcagagtcataaggttcataactgaaagtcaatataacatgt

SEQ ID NO: 70643 - DNA, 522 bp, Triticum aestivum
  Clone ID: PAT_TA_70643
tttttttttttttctttttactacagggcgaaaaatagcgtcacatgtgagattggtgacagggcacataatagcgatacatgtacaacaaggatgatgttgttttctccgttccgacgggatctttctttgtaacggacggcacggagtaattcgtggcacttactcttatatacagccattacaacgcactgttacacactgttaagcaataaattaacaatctagaactaacttgatactaccgggcctcccctgtggctgtgggctgactgcggttttcgtctcgagtctggaactaatgtgtgtaagtagaggtaggacagcctcctcggtctgcagcttcagactgcattgctagtggcattgccaaggaaattctcagagctggaagtggcctataatgtgctgtatgacgtccgctccttcgttcataaacgcatacttgacctggataatgctgtgcgctgcgaaactccgcatgctcctgtggaagctaacatctaccttttcccatgaaac

SEQ ID NO: 70644 - DNA, 580 bp, Triticum aestivum
  Clone ID: PAT_TA_70644
tttttttatcaagaaagcgtcaccgtattcttttgagacggcgaccacaaacgtgtaggtaaatgaagtcagtgtaccaggaacctgtcatcatctactaccctgtggtgttaggttagatgttcccattggtggcctgggaacctgcaatagataatctgctaccaaacattctactactgttaccgcgatacaagttacaacgacaaaaggcagaggagctgctataatttacaacgggctttaaggttttcggaacctcaacatcctcagtttgtgagctgctatacaaaataacactgacaggtccgtcgtcatggtgaatccatgatttttcttgctgacttctcttccatgcaggttgtacaaatagaaaagggcatgggaggtagaaatgaaaaaaaaagagaaatttgggggtacctaacaaaggggaagaaaaagaaaggggggtggggaacaaactgaagatacacatattcacgttacggttacagagaactaatgaatggtgtggttacctctatcttcttagttagacatacaagggattaagttgttcactctgtttcttgtatga

SEQ ID NO: 70645 - DNA, 664 bp, Triticum aestivum
  Clone ID: PAT_TA_70645
ttttttttttatttttagatgtatcatgcgtatatttttttgtggaaaaaccttcaatccattcatcaacaatccatgatagtacaacgaaaaccaaaaaataataaaaactacatctagtttcatagaccatctagtgacgattacacgaacaaagacggatccatgtggacgtactgagacaaagggcgactgaatctcatgagatctgccatataaatctccattagaagcaccactggagcgggaagaaccttattccatctttagagagccgccaccgccttatctccctttgggaatgatagctttggtggagcttcaacaacttaaaccaaatttgaccttttcacgtccagggaattcaagatgagtctcgaccttgccagtcttgcgcttctttttcttctcatccagatgtcttatccttccccgccttgtcctttcccgtcgcatcggcgtcatgcttcccgggagtcctcttcttaggcaacgggcaagacggttagcggaccaacactgacgtcgtactagaggaagtaggagggggtattgaagctccaatttaaccaactgtccagaaccggagctctccattgttgtcacacgagcatagaatctatgttaatttcgggtggaaatctactgatgtcacatgggagga

SEQ ID NO: 70646 - DNA, 170 bp, Triticum aestivum
  Clone ID: PAT_TA_70646
ttttttttttttttttttttttttaaaccagaaggaatctgcacaagtacttcacattcatattataaattctgttcatcaaacatttacaaggttacaatatatgcaattcactgattacatgtgaagaattacatcataatttagtatgtgcagtttcaagacgtcca

SEQ ID NO: 70647 - DNA, 235 bp, Triticum aestivum
  Clone ID: PAT_TA_70647
ttttttttttttttttttttatgtcatatatatttccccttcaataactgatgatttacttattgttcatggtccactggcatgatatagagcctcccgtgaaagagatgtatcctcccggtaaagagatgtacaaattgggagtaaattttacgcatcatgctggatatatgattgatagagtatttgtccaaaacaggctgatatatatatatatacacacacacacacacac

SEQ ID NO: 70648 - DNA, 312 bp, Triticum aestivum
  Clone ID: PAT_TA_70648
ttttttttttttttttttttttttttttttttaaaagcccccaagggtaaattacatgacggtacacaaaatttcaactactacagcttaaaaggaacattgtcctttaccgaaacaaaaataggatgaaatatttcaggaggggaaaacttaaattttgtagggcattgtacattaccaaccagggggaatctgaaccacaaacattgccaaaacgggatttcccttcccccctgaaattaacaaaaaacataacaatccaccccttcccactcatatttccaaactactttcaaaaggcccaaaaacctg

SEQ ID NO: 70649 - DNA, 380 bp, Triticum aestivum
  Clone ID: PAT_TA_70649
ttttttttttttttttttttttcaaaaaattttgcaaataagttcataattcatcactaaatatgtttacatcacaggccaaaaagccctacaaaatagtatcacatgttcctatacaaaactatcaaatcatatgtacaacaaaacagaatacaaaaaatttagttcaacaaaaataaattttcttcctctttcatcttctagaacacaacacctgtcattgaaaggatcgaccattagaagcatatagaatacaagggaaacaatcaaaataaagaaatgaaaggcacacacaatggaaaattatgacaacatcaatattttttatattaccatacaaacagaaatggtatatcattgcttaggatatatggcattat

SEQ ID NO: 70650 - DNA, 455 bp, Triticum aestivum
  Clone ID: PAT_TA_70650
tttttttttttttttttttacaaatcaagcacatcatccattgtgtgcaaattgatcacagtggagaagatgtaaaagaaattgtacacagcgttacttacacaagataccctattaataaggaacaatcatattaattacattgtggaagacaggccacagaaggccacagaacttaggaaactagacgtccacatagcaaagcaaagttttcagctcccagtatgcatgatgctctcgcctctttatttcacgactagtgtgggcaaggtttttagcttccaccaaaaaggcaaaagagaaacaatttgaacagtggcataaaagctaaaaccagtagcaacagtcacaatcctatagccataaacttcgggaaatttccacgcactgaaaaaaggtgcctaatcatgtggggactctgccaattgcaattctgaataccgaaaaacaggtta

SEQ ID NO: 70651 - DNA, 450 bp, Triticum aestivum
  unsure (1)..(450): unsure at all n locations
  Clone ID: PAT_TA_70651
tttttttttttttttttttttttttaattaattcctccgacggtttcatattcacaatnggagtggaatgggaatggacatgttcgaattacaatcgctaaagccctggatttctactacatcgccagctcccctccacaataaaacaggggagagaagcagagggtgacattgcacaaattaaactacgtgccgctgcctctgccatggaaggcatcgcgtccgtttcacaggtctgcgaaccagtcgtcctcgtcctcgtcgttgaggtagtgtcggtagcggtcgaggtcctcgtcggcgaggccgtagcggcggcgccagtactcgagcctcgcctccgtctcccgtatgttgctcatcaccctctggtacgccgcgttgatccgctggaagtccacgccgtcgtcgtcttggtggccgtcccgcacgacgtccgggtggtactgc

SEQ ID NO: 70652 - DNA, 417 bp, Triticum aestivum
  Clone ID: PAT_TA_70652
tttttttttttttttttttttttttttttttttttttttttgccactccatcgaaagcactcacagtttcaccacggcaataattactacagtacacgagagatgaaacaagcttcgttcctattgctgctgctgctgctgctctggtactctgatttttacaggttttttcttctggtaggtcccacctccaagcacttttatactactaagaaaaacaaaagaaaggagaagaaaagcggattgttaatccggcgattagctcgcagtggattcaaaaatgctgctgctggtgctgctgctctggcccgccgcggcttcggagatgctctgcagggacggccgccagtgccggcccctgccgccaccggccggctgcgcgccgccggagccccggtgccggtccttctccccccg

SEQ ID NO: 70653 - DNA, 403 bp, Triticum aestivum
  Clone ID: PAT_TA_70653
tcgagttttttttttttttttttttttatttttttttttttctttttttttagaaaaaacgaaaatgctacttcgcatactcaatgaactactaaaaagaacatcccgtcataaaacaatatacctaatttttatttctcaaacatccaataaaacgaaaccacatcgcatcccgcaacaagttttgacacccgtcctagtatacagtctaaacacatgctgaatctggccaaccttgacctagcgtttggtgactcttgtcctgccttgagtcttctgggtagttggcttcgtcgcagccttggggggtctacccctgcctctggcgacaggctttgcaatcccctttttcttcgacaagggaccattagacgttgaagtgggcttggggttggtcttgggc

SEQ ID NO: 70654 - DNA, 632 bp, Triticum aestivum
  Clone ID: PAT_TA_70654
tttttttttttttttttggaaggatgaaaaacatcaattcacaggtgtacaaattacacttattcaacgacccacgtttggtacccgactccgagacattacatgtcaaaacattatagagtacaagacaaccaactcatactatggtgataatccaactccttccacacaacttgacaagacaaccaaaaacatgtatgcgctttcaaacaaaaaagattatgcacttgacacgttaaggcacatgcaaggttacatgccttcaccatgtaactttcaactccttccacgagttgcagcatttgtggccacaccagagagagacagagcctgagcacatatatcctgttgtgcagatttgtccgaagaatataccattttgcttttgcctttgcttgaatgtgaattctccctctccggcagaagttctggtattccaacagagttgacatgacccaaatgttgggggttgtatgttgcccggaatttttgtgagcttgatgccgagttttcccctctgtacatctggcaaggcatttcctcctcagacatgcctagtcggtagccagactgtgttccgcagctctccgaatatgttgtgacttctttctgcaacatgggactgagcacac

SEQ ID NO: 70655 - DNA, 508 bp, Triticum aestivum
  Clone ID: PAT_TA_70655
tttttttttttttttttttttagatcggacaggcggcagcatgtacgtgtacgtgtatgttctctcgtcttgtacgtactagtacaatgcccgtgcgttgccacaggccttttaatttttgttctgattgtacatatacatgtattattatatataactcaatgatttttggtcccttccaacaacatcgcgtcaacattcttgtcgaacggattccttttgaacatcaacataatacatctttatctctttcatacctaattgatattgtagaagggaaatcaatattctcaaattgaagatatgtggcaagcaccccctacaatctttccatcaccccattggcagccaagctccccttttgcttggttcctcactgttatcagttgtcagcagttgtgcttgtcagcctagtggaggaggtagaggtaggtgacggagcttcttcacctcgggtgattgcaccgccatgttcttacataacataatattcttgcaaatcttatgc

SEQ ID NO: 70656 - DNA, 486 bp, Triticum aestivum
  unsure (1)..(486): unsure at all n locations
  Clone ID: PAT_TA_70656
gaggaacagcctcaacatctcgtcgagctgctgcgtcgtgaggttgtcgacgtcgtccagctcccgccggagctcgtcgccgctngaaatactgcatttttgcaaaatgcacagcagatgagcctctgttttgtgtgatgggactgtcctactctgcaattgatttttgtgcagcaaattgaaccggttgtgaaatatatggattaaaatgagatgggacgtaccctgagcagcccccaagctgaggttacgttgacgatcctgccgtcggaggaggaccggaggagcgggaggagggcttccgtgacgatcttgctgccgtggtagttgatcctcaggcagtcctctgcatcctgggtggtctgcgtcgtccgctgcctcagccattcggctctctccatcccatccttgcctgcaagctgttattaagtgatggacatggatggaaccaaacagcttcagtaactaatgtagtatctaaatgtg

SEQ ID NO: 70657 - DNA, 507 bp, Triticum aestivum
  Clone ID: PAT_TA_70657
tttttttttttttttttttcaaagtctcagagcttctcgctgtggcgtcccaacaaatatccacagttgcaacgacgcatgcttcccaaatatgtacaaagaatcaacgacttccacatcgagtcagtttgtgtaacccttccacgaatatgacccaatggtaacccaataccaaacgcctttctttaccttcgccaaccccagaaacttcctcctgatcccggggacccagcatttgcagatgcgggcttcattgcaacatcgttcacagcggaagccccgtgaccagtaagtaatccgaagactcccccaggaccggattgcgacgccgacgaactatgacctgataccgatcggctcaaaccatgtgatttccgtatcgactccagcttctgccgagcttcctcagcttcttgtttggctactgcctctgccgttttggcctgtaccagctcagcaagtaatgattcatgctcactctgagacggcgctggacctgtcgtggtc

SEQ ID NO: 70658 - DNA, 549 bp, Triticum aestivum
  Clone ID: PAT_TA_70658
ttttttttttttttttttttcgtttccttataatccagtaattagcctcagcaacaaacatagtataattcttaatgttatggtttaacaacgacgggatagagcgggtctttctccatcatcaacgacactggagcaaaacattttggggccaattatcacttgcatgtacgtggttttggggcgatgacgcaaggcgtgatctccaacacgaccttgtagacatgaagcttgatgttgtattcctggtccaggagctcgaagatgcacacgtcccacttctccaggttgttctccatggccaacgcaccccacccagcgctgaaagccgcgcggggacactcgccgccagtgtactcgtaccacaccttccacggcttcccctgtgggtcccaaaacgtcatcttcctactctcttcggggagaaatgttttcacgaacttgtcggggatgatcatgaagtacgatgcataaacatcgttgtgcttcattgtcttgacggtgaagggcctctcggatttgaacctctgtgccctctccatggcgtat

SEQ ID NO: 70659 - DNA, 456 bp, Triticum aestivum
  Clone ID: PAT_TA_70659
ttttttttttttttttttttttttttttttttttttttttttttttttttttttaaccaaccaattgggagttaagttgataatgcgcgccacatacatgacaccaacgtgagtagagtacatctatacatctccacgctacctaatcctgctctgtgatgcccaattacatacgtacatacatacgcctagctacctacataagctctctctacatgtcatgacaggcaatcagtcttctcaaaaatcggacaggagcgccggcggcgggaaaatgccctgcccggtggccaacatggccctcgggtcaaactgggccttgaggcccgcgaaccgcgcccacctctcctccccaaaatgggcctcccactcgggctgtgacttgtggttgggcaggtactgcctggccccgatcccggcctcggcgcaaaagtcgaggatttcccggttctgccg

SEQ ID NO: 70660 - DNA, 392 bp, Triticum aestivum
  Clone ID: PAT_TA_70660
ttttttttttttttttttgagatatgatatgcatggagcttagggttttttctgcaaatctgttttacactggatattagacaaatttgttcaggaaaaaaacaacatgggctgtaactgactgggcccaatggaaaagaaaaagaaaaaaaggagggagcgcagctggcatcaccatgggcctccgcccattcggtggaggagggaggccggcaggggcgcatctgggcctcgggcgctggcaggccggcccactcgggcgctggatggatcgcccctgccgatcccactggatcgaggcagggacgggcgcggtcaacgggcgcattctcctcgctccttcgcgcagcagaggacgcagggggacggcgacatggctggacggcggcaac

SEQ ID NO: 70661 - DNA, 506 bp, Triticum aestivum
  unsure (1)..(506): unsure at all n locations
  Clone ID: PAT_TA_70661
ttttttttttttttacaaaaacagtgaactgcacacgacaaatctcgtcgtcgtgggggtgagccaccggggtggatgcgccatnggaaagagagcaactaaacaaaacttagggagcttcaaaaatattcaaaatgaactgcaatcaggctctggcaggcactgctccacggcggatgaagccgaacagagagaggactcatctgggacaatcgagggctcttctcgtgcactgcgggggaggagaagaactagagagggggtcaggacagagggtggccgcgctatcgggagcagatgccctatagctggtcacaggaggagccgagcactgcaacgcccgcgcaaccgcaccacgggctcggcgctagcgaactgcgcgctgaggtggtaggcggcggcgtcctcccaatggactagtccagcaggctaaagtacggggcctggcacggcgctgtcggcagtgcttctgggacagaggaggggaggtggaagaggaggggaag

SEQ ID NO: 70662 - DNA, 534 bp, Triticum aestivum
  Clone ID: PAT_TA_70662
tttttttttttttttttttttttttttttttttttttttttcaattgtataatatttcttgttgtttgttattagcaactttttgggggtatcttgtagttttgttgtagtctgtctaaaccagatctattatttagattccctcgccatcgtttcgtccccagagtttgactgtgcgatcgtggcctccactgacaatccacttgccgtccctgctgtagtctacactggcaactggacctgtgtggccactgagtgtttgcaccagtgtccagtcatcggccgagaataccttgacgtttctgtcaaagccactcgagatgaagaaagtaccagacttcttgggtagttgtgcgcccttctcgtcgacgccgggcggaacaccagtaagggggtcatcgagacccttgtaccatcgcatatcaaagacagcgctggtgtgcgcaccaacaccacctgttctttgaaccttccgaacgtcccagcacttgatccagccatcagccgacccaaatagcactctatgtccatcgg

SEQ ID NO: 70663 - DNA, 593 bp, Triticum aestivum
  Clone ID: PAT_TA_70663
ttttttttttttttttttaaacatgtcaaacatgaacgaaagttgaatattatgaatctagacaaaattctaaacaagtttcatacaaagtttgttttaatccgatgcacggttggggagttataaaatgcatgatgtttaggggctaaactataaaactggcaaaactctgggaaattagacaaattcgcagcagggaaaaaaatagtcacgggccgaaactacctagcccaaacaaaacacaggagagaggctgtgccctgcaaacatgggccaaggctcggttcggtgctgggctggatgcggtaggcggctgggccggtcgctgtaggctgaggaggctcgctgggccttgtgcaaagaggcccaggcgcgggcgaggtggagatccagcgggagccgatgtaggccgaggcaaggccggcccaggcgaagtcaacgcaggcgggcaaggcgctcgatctgttgtaggggaagcagaggacgtcgatgacgtggacttgcggcggcgccgagctgcagcgaggtcatgggggcgcgggacttggacgcggggctccggggcggcacgtcggcggatccgggtgtgggga

SEQ ID NO: 70664 - DNA, 679 bp, Triticum aestivum
  unsure (1)..(679): unsure at all n locations
  Clone ID: PAT_TA_70664
tttttttttttttttttttttagtactaacatttgaaccaacatttgatcattcggatttcacactcgctttacagctaattgcaaaggcataaacacacacaaaaacttgagcctgttactgcactcgcagcaaaacatgtccactngaaaagaatggactgtggtggaggagacgaaactatgtcatgagttggaacttggaagtgcaaaaaaacgaaatgatccaacgccggctgaactaacatcagaagagatcttacccaagcagagcatgctgcaacccgagggatatcgacattatcacaggacgacgacatctctgaattagtacgatgatatggtcctcactggcatccaatcatgcgcagaaacgggacggaagcttgcccaggatcgtcacgactggccacctcgcactggattgtctgaatcgacgacgactgcccggccactcttgctgtcgaagcacgacctgccgccgggcggcagcctcttcatcggcggcacggagtcgtcctgcaacgcgcgccggttgcggccccgtccgttgccgctgttctccccgcggcaccgccgcgacgtgccggcgccgccggcgaggagcccgctctcnctggctgcgatcagctcgtcctccatggtggactgcagcacgtctgcgatggacatgcggctgt

SEQ ID NO: 70665 - DNA, 423 bp, Triticum aestivum
  Clone ID: PAT_TA_70665
ttttttttttttttttttccgaaaattcttatataccaagaccaatacaaactgtcgcctccagttacattcgttccacaccagtactacatacacctgcggaatttgagaatttcccgaaagtatttggcgataccactcaaacagttggcaagctcagcaacggggggaagccaaagtacggccaccagccgtcgctgacgccgccggagcaccgcgcccggcaaactctctccagctcgaggcgcccgacgtcgatcttaaacagctcgacgtcccggctgtcgtggctcgacgacatgaacggccgcggcgagtcttggttgacttcaatgatcaagcacccgttggccgcgccgcgaatgcaaaacggccggccgtgcgccgtcgaccacggcagcgggatcgtcttctcgagccgcc

SEQ ID NO: 70666 - DNA, 237 bp, Triticum aestivum
  Clone ID: PAT_TA_70666
ttttttttttttttttttaattcaaagagaattcctatttcaccaatatataacagcgatccaaccgcatggtcacccgatttgttgaatacatttaaccttcagatgtgaatgtgcatcttacgatatggtatccttgcaactaaacctctaaacctctagaacatgtatagaaccagatgaattcacgattaaatctagctaataattttgaatgtgccaaaaccaatttataga

SEQ ID NO: 70667 - DNA, 605 bp, Triticum aestivum
  Clone ID: PAT_TA_70667
ttttttttttttttttttagatgcaaaatgtatttttcataatggccttgtataaaggaatggattcttgggtttcccactcacccaagttcagttcaaataaaatggcatgaatagatcaaacacaaggaaatagataatatgatctgacaaacatagacaaagttccacatgtggcacatgccttccttcacttattttgcttctagctcctttcttagacgaatttttctatgatctagaagaatttttctaggacccagatgaccttcacttcaacttgttcaccatcaaattctcttttttgagtcctaattctacggggtaactctagactttcttcactcctaattctacggctgcagtctagacagaatttcaaattcttgtcctcttcttggctgtcacaggttgtgattactcttaggtccacctctatgtggagtttgtacttgctacgatcaggcaatgcaatcatgtgtggtcccagtggaagaatgcacgtggaaccacagggcagggacaagctactgcctcgttcaaaactgaagagattgacgcttttgctcccatagtcaatggcaattgccttgacgctaccatac

SEQ ID NO: 70668 - DNA, 550 bp, Triticum aestivum
  Clone ID: PAT_TA_70668
tttttttttttttttttttttttttttagaaggattgaacaacattagctttaaatagaattagctcgttgaggctgcaagaacaacatacaaagctagcatggctctagaactaacaaagcacatttcaggcaagcacgcctgaccggctacataccatttaatcgctggtgctgaaagagataactgtgaaacgcagacctgcacgcctcctttcgtccttggccatctgtgtacctccctttgtccagatggtgttcttcatgttgcagggggcatctccctcgaggcttgctgacacgtccattagcttctgctcatgctacaccacatctccaaccatgataaaaaaaagcaaatgattcaagttcgagttagtcaaggagtgacctgattctaacggaatcattcaaaagatatgatcccactttgcatatgcaaataacatctttcagcattgtacaattctccttctacaagtactcatgagagttaaaatatgcatacatgcaccgtctctttgcaatagtgacaacaagtggcacctgca

SEQ ID NO: 70669 - DNA, 612 bp, Triticum aestivum
  Clone ID: PAT_TA_70669
gcccccctcgagaaggcgcaggacgaggcctgaaaagaaggaggccgttctcctggccgatcgagagcgagcgctcctcctggactgacagagaggcgatgttgacctctggcttccacgagatcgaagatatcattgatggtacatttctttcatttgttcgggctttcgattatgtgctaggctgatttctgatttttcggcctgcttcttttttgtcttggcagacttcttccctggtcactcgcaggcggttcttctagccatcgaggctgctcgtgaggcgcgaagggcaaacagtgaggagatcgccgctaatgccccccgaaccgtcgatgaacagctcctgagcattgaagcccgtcttcgtccggcccaccggcagatgcgccgcttcagcgtgccggtgcccaggcggttgccgctttgtggacggacatgccggctctgcgcaccgccagtcggaccgccaactggctggaagtcactgccggtcgtcttgaggcctggaagggctcctcggcccgagccggagcgcgccgggccttggagttcgccaagacgtggtatccagggctggacctggaccgtctggccgcattccggtcagaa

SEQ ID NO: 70670 - DNA, 611 bp, Triticum aestivum
  Clone ID: PAT_TA_70670
ttttttttttttttttttttttttttttttttttgagaggctaatgtagtgagatggatatgccttggtgtaaatccaatcctttaagattacatgtgcgagaccaaaagaaggaaaaaaaatggtgagcaaatttaggaagtcatcactacctagaccaaaaaaatctggaaaaccacataataataaataatgtaaaaaggaactatattcgttttacatttaattcaacaaattttgttaattggaagatctatattacccaccaagttcactgaccagctgtacatagttgtgaccttcacaaccaattaagtatgagaaccatgtgttaaaatgcaaaaaatatttaagcgctcgaggtttagctgctaagtggtggctaagtgtaagtatcctacagaatagttctttttcagttatgccgcattttccatggtctacgttcctacacacaggagttgattcaatacaacataggattgtataacccgtcctatacggccggcaaagtttaatcatgaaagaagatataccataagttgaatgtccagcgtgagaactaatacaacaaatatgcataaactggaattcttaaggcataggtgaca

SEQ ID NO: 70671 - DNA, 668 bp, Triticum aestivum
  Clone ID: PAT_TA_70671
ttttttttttttttttttgaaaaatcggcattacagttacattttcttgatgatctagacagaatagacgatttacaggacatgtaagtggtgctcgttgtctatgctaacctagtcagtctctagtgtatctatatatactaatttacaaccatgccgctccaacaccaattagaagatcagcaaatggaggagcacaaacatcatcaaaagtaagctattattgtgccaccacaccacaggaggggagctgctgacgtgcctcaactgggaagcaccggctgggttcttcgtctcctggggagagtagttctcgggcgtggaccgcgacgagttccgtgagttgatggagagagggtttgagctatcggtgtcataacagttgaatctcttccagccaagtatcttcctctctcggtcgaatacaacacggacaccggtcatgaagttttgtccaattatgtttagcttcgtgctcttgacaatcgccaagcaataaacatactcatgttgctgaatggagataacctgccctggatcaatagcagggaacaggctcccacctgctgttctaagacttatactaggagtttgaatccttgcctcgctagagctcagatcgtagcaatattcgaagggaattcttgagtcggcggcatggcgatttg

SEQ ID NO: 70672 - DNA, 461 bp, Triticum aestivum
  Clone ID: PAT_TA_70672
tttttttttttttttttttttttttttgatccagaaaagagggaagctgaaaactactcactgctttatccctttaatttttccttcatcttcttttcatccgaaaaatctcatatcttgtctagtaaataataattcctactaggtaagtacaagaacaatggatgtatgcaatgcgtgcctaccaaagaatcaactacctacctacagtaacaaatcgatccagaaaacccggtgtacacagaaagatttcagtttctttgcaagttggattgtgtggtggtttgagaattgggtttggatgcatggtggtgtgtgttgctagggtgacctcttcttgcggaggacgacctcggtgtccaggccgaaggcgtcgaccttggagaccctgaccacctccgaccgccggaagagcgcgagcaggccgtcgacgtcgagcaggtcgttggccgagtacttgt

SEQ ID NO: 70673 - DNA, 668 bp, Triticum aestivum
  Clone ID: PAT_TA_70673
ttttttttttttttttttgcgcaaagcttgtatagtcaataattttacggaatgcattgtttacattgaacaacctagaggtgaaacgaaaggcttacttctttgtgccaaaactgccacaaatttaatttctcacagattcactccgtggaggtccatttcttctagagaaaacacaaagcttgtacccccaatgcattgacgataggaaataataaatttacaaggctaaaagtagtataacattacaactgaactgaaagtaggagtaaatcatggttactccagtctatatcgaggcactggtcctcctaacttgaagggtatcgctagcatctcccttggactgaaaaattcctttacatgtccgttccatccacacctctcgcggaagaattcctcttggtggccctccttcccacacccaagctccacatcgcttggatgcaaaatcttggattcatctggacacaatgtgcaactgcttctaaaggggcaaaacggtttttctaagatggtgcatgtttcgatgattattgtgctggaacaccggacatagcgtagctcggcgaagaagctctgctcgtcgccgtcatcctttaggcaggccaagaagttgaggtggtaccagagatcttccctgaagccaacacaggctgccttcgcct

SEQ ID NO: 70674 - DNA, 691 bp, Triticum aestivum
  Clone ID: PAT_TA_70674
tttttttttttttttttttttagaaatgtcgtctttagattaagactcaatcagaaacagtaattttcttatttcatattctcacaactctttttatttaagtcatgcgtctcctcaatcatttatatccagtaccggatcttcttcaactcaagtattttcatatatcccagattcaacactcaacgtaaggccagaataaccaccttctccatcttctcttctaccctcctactccacatgcgccaccccatattgctgcagttgaaatggaagacggtcaataagttgtcttgattagatccacctgaggagcttgaaccacaatagatccacccgagcaactttgatatatttgctttgcagctgtcatgtatcctgattttggacctgatctgtattgtagttagaagcatgtatcatctaacaaaatgccaataaatcacaaagtaaacaaactaaattctagaagaaatataaccgggaaactgattaaaagataaagaccattctagttacattgcattgtgtacagcaagcttaagctatttgatctcccactgattgattggagcaaagagcctctgtcacatactaagccatctgatccatgactggaagcactattattgtagagcggagatggttactggaagcactttcaaaattacaaatactggaagcactatta

SEQ ID NO: 70675 - DNA, 712 bp, Triticum aestivum
  Clone ID: PAT_TA_70675
gaggataaggaccgttgaaaatcgggccttaaggttagagctcttcaatacccgtgctgaccactgggccactttgactcggttcgcaccggcggtgcaagctggatattcagatatgcgcgatctctatcctgtgagatctgctctgccagacgtgatggtttggcgtgatgtaggaggcatcaccccacctcgcggtccccgcaggccaccgtttgctggtccaaggcctcatcctagcccctattgaccacaagctccgcgagatcgtctgtttccggatgatcatgttgaaattccgggctatggaggtgacttctacgaggactactacggatcggtctgagttagtagtagtatcactagttcgcactagctgtgtcgtctatcgtcctgcgtgactcgtgggatatgacctagttgtactctttccggagatgtagaaaaataatgtataggagcttggaatgcctccgatgagatgtaatcctcttttcaccgtattagtactttgcttggtcttgtactaaacctgtatggtgtgtatgacgatggaataaagaagcagtttctgtatctaccatgtcatacggatgatcatcttgcatttcgagttattccttacattatgtatcctatgtcggaattttatcattctgactaaatcattgtcttgttttactaggatggtcaacacgcacgctaaccctgc

SEQ ID NO: 70676 - DNA, 242 bp, Triticum aestivum
  Clone ID: PAT_TA_70676
tttttttttttttttttttttttttttttttttttttttttttttttgggccggggaaaaaaatataaaaaattttgagtgataaacatgggaatcgtacatcacgatctacaatcttagacatctaatacaaacacaactaaattttcaatgataaacatttgaataataattctaaaatagccgcaaaataacgcgggttagttattagttacctgaggaacaaaaataaaaataaacca

SEQ ID NO: 70677 - DNA, 614 bp, Triticum aestivum
  Clone ID: PAT_TA_70677
tttttttttttttttttgtcatcgatatgcaagcatttcatagcaagaattgtgctaacaacagttacactttctgaagttctctggaatggcatgtctgcaatgcagcgtgcttcaagattgcaaccaaacgccactgcagaatgacgcattgacgctactccgagcttggttgaaagttgaaacgtactacctgtaagctaatacttttaaacgtagtgatctaaaacgtcttatattaatttacagagggagtaattgctatggctatacatacgatgctttttttgtccggcctgctgcattttgcttctgggtgtgaatgattcgatcttcagtggcgtacagaaatcgtatgtgtggtgttgtacgtgtggcatccttctgaaacttgggacttgcaaacttggcaagaaaaacagtccatgatccgcgggaacttttaccgtttcctgcaggaaatgaccatttaatatgagctttataattgccgcagatcaaatattctctaaaacaaagtcatagtatgacttttgtgatgtttccactccatggtcttacttctatcttttgctgctacactgttatgtgcctctttcctttttcgttgttgt

SEQ ID NO: 70678 - DNA, 618 bp, Triticum aestivum
  Clone ID: PAT_TA_70678
tttttttttttttttttttacaaatctcgtgaccgaatctttgaagcatttcagtgagagaagagcatatacaaagacaaaactccgtgtttggacaagcagttgagcctcaaagttcgaacccggcgtgctcttttcaaattagttgtgccgcattctctggccttgtgagatcaacaaaaatactaacataagtctatttgaaacatagtaatagttcagagttatctatttgaaacatcagcagctgtttctgtttctaaaaacgatacgtgtgcgtcgatccaaacagcgtcccagtggctatcctttcttctttccgttcaagaaccttgtatagcctttctgcctgcctctcaggctgcgtcctcccaaggtcaataacatcaggtgtttcggcaccggctggagtacttgagatggtgtcaacagatcgaatgccttcttctatttcctcgtcctccattggttcctgctccacctcctcctcttcctccaattctccccagtgcttactgcgatcgagaggttcttcctcgccaataggaggatttccccactcccctggtgcatcatcaaaactgtctcctggagatactggggcatttaaacccggga

SEQ ID NO: 70679 - DNA, 502 bp, Triticum aestivum
  Clone ID: PAT_TA_70679
tttttttttttttttttttttttttttcagatcaaaataatacgcaatgcaatgtgcctacgcgtctttcttgtacatgtgtgcaccagaacgtgcagccgtagctacagctaagcagagattgtttagcctccccccaactacactagattagcattagtcaaaccaaatctccctccggtggattagtttacacgtaactctacactcgggttatttcttcttgcccgccggacggcgagctggccagggcagcggctactactctgcaatggcgcctagatccggcacgaagtcgcgccccaggctgggggccctccgcgaccgccggcgggacccacccttcacgccgctcctcgccgcggggggcgccgctggccgagtcggggaacacgagcgggccgtcgtgggtcgccggccagcgcggcgctggcgcggatcgcgagcgcggccatctcctccgcctgcagggcccgccgccgcatcgcgccgggcagcacga

SEQ ID NO: 70680 - DNA, 602 bp, Triticum aestivum
  unsure (1)..(602): unsure at all n locations
  Clone ID: PAT_TA_70680
tttttttttttttttttcgataattggtaattaaaacgggcacacagtctgcccatgaaagacagcagtatgtcaatagctcaaaagtgctaggtatgtagccttctgaatctcgccctatctatccagagaatcatgctaagaaatggaaaagcctgccagtatcacgcccatggcgtatgatgatttcaattgaacgttgaatgaagtagtgagaaatatgttggcccgcatggtaccgcatatctatcagaaataagcgtattanactatcgagggcagagcgctcagtgctaccgatggaagcttgctgagaagcgacgagttgtggatagaatggccagccttctgctcctgcaacagtcctgcaacgacgcgcgcctgttccaagccagcttctctatgtatggcattgaggccctctacagcgtactgcttcgtctcaggggaacagaccgatgacatgccaagcatgtacagcggccaaatgatggtgctgttggttgaagcaaggctcataaaacgagcggcatcgtctgtatgggctgtcgatcttgttgggtcaaacattacagggctactgccgctgctcgaagcatcgt

SEQ ID NO: 70681 - DNA, 565 bp, Triticum aestivum
  Clone ID: PAT_TA_70681
gtgattggtatgacttgcgatagagaatagactatagacacatcggcatatctgtatgtacaatagaccatcacacaaaataaggggtcatactggattgatgttttgaacttgactaggaaatcgtatcccgccttcgtattaaaaaagatattccgtttcatatcattcgaacctccagtagatcctcaattcgttcacgcacgcaatcatgccatgcttcatcccatggactcaaatttacacgcgatccacactggagcgacgtccaccaagaccaattttatccttgccatccatccacggtcgtaggcactctggcacagcgacagtctttgcctcctcatcccatccgttctccaacagagctgctatcacacgaggaacagccagggcagtgccgttggcggtccaggggaaagcgagctttccatcaacgcgagttcttgtgccaaggcggcgagtctggtagtcggtgcacatgctagctgatgtgacctcgccccagttgtcgcgacggctggggaagaaggcttccatgtcgattttgcgagttgctgaagcg

SEQ ID NO: 70682 - DNA, 727 bp, Triticum aestivum
  Clone ID: PAT_TA_70682
ttttttttttttttttttgatcaagctaactatagctaagacgccggtgcaataaacaattgtagtttacaattgacatgcaactgataacgtaaacacattgcgtaacagtacatatccgtattctaccagctagttgacacactatgtttccttacaaaaaaaatccaataattacacgtggtcaaatacacttgaacaatatatatcatatttgacaactatgaccacctaggttccccaaatgttgtgcaaaacacacaatggtatagcgcgtcatatttcaatctgaagagacctcttttcctccaacttgacgaacacacttccatcatatatacctcttacactatccttgtgaagaaaaccatccttatcacttgcaagcttgtatgtcagcccccactcttttacaggcgccagccatgatcgacggtctagtggatctcgatttgctaggatcatctcctccacctccgaggatgtcagcgcatctggtctaacttttgcatgctttatgaatatttcctcaaatttttggggaacaaacctacagcttgacatgttcagtatatgtatagatttgaataaattaataaaaatgtacctgtatcacttccatgtttcttttactttacagtatgcatggtaatatgtaccagatatgcacatacataagtaggtgatttgaattaccttcctttggcatctaatgcacctgtatcac

SEQ ID NO: 70683 - DNA, 625 bp, Triticum aestivum
  Clone ID: PAT_TA_70683
tttttttttttttttttttttttttttttttcagagtgaaaactacttcatgatcgagtccatgaaaacaggcagtcacgtcaaagagaatgtacagacatcgatgccaaactcacattcactgattcacaatgcacagacacattatgcatccatgccattgccatgtccggaccgggcgggactcacttgctagagcgtgtcacggcatgaaacgagcggcaccgttgtcgccggcggtcgccgaggcggaggaggaggacgcctcctccatggcttcgcacttgcggcaccgcttgggctcgggcggcgtcttgcggggcggcgcgtcggcgacgacgacgacgacgacgcggcggcaggacgggcaggaggagtgcgcgcggagccaggcgtcgacgcaggcgacgtggaacgcgtggccgcactgcggcagcacgcggatctcctccttctccgcgaactccgacaggcagatggcgcactccgagaggatcccctcctgcgccgcggcggccgggcccccgcgcgccgcgacggccgccgccacggcgtcctcgtacgccagcttgggcagcgccatgagcgccctcttcttgagccccttgctcgcgccggggccgga

SEQ ID NO: 70684 - DNA, 535 bp, Triticum aestivum
  Clone ID: PAT_TA_70684
aaagcaattcgcaagtaaccagactcggccaacctttaccgcagcgaccatgtacagagaagggtccgaaaaaagaccgaggacgaaaaagaggaaagaactggccagaaaaataaaagaaacgaaacgggtgctaggacacggcggcggttacagggccggagcggccaccgcggcgtcgcctacgcctgcgacggcattggggttggggttcgcgttagcgccgtcgagccaccggtccatgggcgtgcactcggccttgtgcgccatcttccagtgcagcgcctgacatgcgcgagagcagtagttcaccacgccgcatacggagcaccgccggaactcatgccgccgcgtctccggccgaccgcacagcgcgtgcgagcacagccgcaggccaccgccctcctcagctggcgccggcgccggcgctgggctgctctcggcgcccagcggccgcgacgcgaaccactcgacgaggaaccggttggcggcatgcgcctcgccggccgcggcggcggcggcgcggcacccgaag

SEQ ID NO: 70685 - DNA, 677 bp, Triticum aestivum
  Clone ID: PAT_TA_70685
tttttttttttttttttttttttagatgagaataaagataaaggcttacactcgccacaagctacaacatcaatacaataattcttcaatacatagcaatcatcatacagaagagcgggatccgactagggatgaaaccaaacgaaaagaagaacgacatccaccctgctaatcccaagctcccccacccggaacccatcccttgatcgaagaaggagaagcagaagaactccaaaataagcaagcctcgctctcacgtcatctcatcgcattacatgtacctgcaactgttgttgtagtaaactatgagccacgaggactcagcaatcccattaccatggatatcaagactagcaaagcttaatgggtatggaatggataagtagtgaggttgcagcaagcgactaagcattgtatggtggctagcttacgagtacaagagtaagaagagaaactacgcaaacggtcgccaactagtaatgatcaataagtgatcctgaactacttacgttcaaacataaccccaccgtgttctcttctcaaactcactcgaaaagagacggccacggttacgcacacggttggtgtattttaatttagtttagttcaagtccactacaaccagatattaacaaatttccatctgccacataaccgcgggcacggctctcaaaagt

SEQ ID NO: 70686 - DNA, 521 bp, Triticum aestivum
  Clone ID: PAT_TA_70686
tttttttttttttttttttttttggtggagagaggaatctcatgttaattacctgtaatccagtgcaaacgaatgtgcacagcacagagcagaataaatcttagtaatcccctcagaattacaatagagagggggggaaacgatgagagcagaaactattttcttgatttgccctgcatatagacgtgggaatagtttggtctcgaaccatagtttcaatttggttttccagttggcctgctttggttcggttgaaatgggtcgagcctctttcataatgggcagcactgggcgctggtgcgccggccgaaagtttcagcaggtccgcccgtagccatccgatctgattgatgctaaaccgtccgatgcccttcttcaaacgcacgcgtatgaaagattccctgcatctcgttgcttccttgtatctcgccggctgcgcatgctctccggtcgccatcctcgcaggccgtcctcgtcgccggtcatcttcgccggcggtcctcgtcgccggtcgtcctcgc

SEQ ID NO: 70687 - DNA, 643 bp, Triticum aestivum
  unsure (1)..(643): unsure at all n locations
  Clone ID: PAT_TA_70687
ttttttttttttttttttgtggtaattaattaatactattttgagctgaaccaatctaatgcataccaaattatttcatgctaacaactgcacaacataatggaattgcagttggactagctattaactgactggagtactgctagatagccctgctcacaattgacttggaagataaaccgaaaaccaagctgaatataaaacataccttcaaccgaacagatcgacttcgaaagttaaaaattcagtactaactaattctgttactcccaccagcatccagccacataagaattccagaattctggtacaaacaacctcatcatgcagaaagcatgccacagcttgccaggagaaattcatgtccgagtagtcatgcaacacaaagtctagctaggtacctgtactgttgcaacacaagaggctcatcatgatgctactaattaacttacagagatcttttctgctttgtcgtantacttgaggtcaaaagggtcagcacatccaaaatcagaagctagcgggtggctgtaagcaggacctcccccagcagtgagcggggtcttgaagagctgtagtttgcaagttttgctcgtccatttcgcactggccagaggcttcagcttggcattcacattatccc

SEQ ID NO: 70688 - DNA, 691 bp, Triticum aestivum
  Clone ID: PAT_TA_70688
ttttttttttttttttttacacgcagaaagaacaaaaccaagataagaatatgaaggtaaagagaccgcaatgtcaccgtttgtcacatgtgtcctacgaacaaacaaacagaactacagtggctagcaccctgtaaaaagaaaattcgcatcaaacctagatgtaagcacatgtgacacacacgcacacaagaagacatgaggattaaggaatggaaaaaccaccagttgtaaacccaggcatcaacttgcagcacgatcaacacaaatcggacggtcgaagagaatactgcttacttttcctgaaacatcgtttttagggaacctctgttaggcaagctgcaacccctcaaaccacacataactcaccgtcagagaacttaacttttaatcttcctgtaaaggggaaaacttactatgtcagtctcatacatatagtgacaacatgtgaaccccgacaaaaaattgctgtgacaacatgtatgcattattctccaaatgtacagataggaaaaggcggagttcaacagtgccttaatagcattcatggacatcacagttcattggtcagtgcaaaaactgtacagagaacaaaaaggaacaaaacaaagccaggtttttacacctaaatggaattgtcaaatgcagaaataacatgtgtgcatttttctccaaatgtacagaaaggaaa

SEQ ID NO: 70689 - DNA, 502 bp, Triticum aestivum
  Clone ID: PAT_TA_70689
ttttttttttttttttttagtccaaaagtaagccaatacaatggatcacaactaaatagatacaacagttgggtcatgacatagctcaagcgagccagcaagacattgcgagataaatagcgtacttagttatgccaatgtctaatactacttgatagtttgactgggtcatctcgttgctcgactccttacatgccatgatccttatgctcttgtgcttgtatgaagaaagccactaggtgcatacacctcatgctctcgcgcttgactccgcctcctcaaaacatatagtttcttctacggattattgcttctatcagataatctttgtcgtgggaggcgaagaggagggactgcttggtggcgccgtggtcatggtccagcagtagcacctctcagccggtgctgcccctcctgccatagcctgaacatccatgggatggagccacagatcactcaaggatgcaccggagatgcaaatcatgcttgcagcttgtagccg

SEQ ID NO: 70690 - DNA, 562 bp, Triticum aestivum
  Clone ID: PAT_TA_70690
tttttttttttttttttttttttttttcgggagacgtgctcatgatacaaatcgtcatgagcggatttcattattttacagattacatacgtatatcttagcttgtccatacaccaacgataccgtctcgtctgccctcaacaagatacccgtctctaacacgtacacgctccacgatggctggagtcttgccctcctcagctgctgtgatgccagcgccgcattcccattgtcgtccctcaaccttatcgtacaccttgacaacgtcctcgcctgcagcgctgacaattcgtcgagcatcgaacatcatgtctgtgacagggttatcgtatgcgtatgcgtcgtaaatagaccccgttcgaagatcccaaattctaatacttctgtcgacgcttccagtcaccaggtgcacgtcatcgaactgaagacatgttactgcgccggtgtgtcctaccaggctgcgatgaacctgtccgcttcgaagatcccatagacgcaccatgccgtctgcggtaccgcatgcaagggccgtctcgaaaacttgcaaagcgccaacaaagtc

SEQ ID NO: 70691 - DNA, 649 bp, Triticum aestivum
  Clone ID: PAT_TA_70691
ttttttttttttttttttctcgtaaaatatgtatttggcgatacggtacaacgcattagtctgtttctacaggtctgcagtagcgcctcccttctccttctcccaatcttccaaccaagccttggtaaaatcgacgatatcctgctgtgcctgtttgacagcaggaggaggcagtccaatctcctcgctaccaggagccaaaccgttctcgtcccagtggtgaacaccgtacgggatcaggatgaaaggctcgctggttgtagactctctctccggaaagccaatagcgtgaggggtagcagccctccaaggatcatactcgccatcaatgaaggctacacgggggtagctgaagttgaagccgccgagtttgttgatggactcaacgttagggggagtcgtgatgttgaattcttcgcggcagggaattgtgttgtactcgacgtcgatgagacgggacaccatgggaagttggtcctttggtgcaccggatccagtttgccagtatccccattgtgtgcaggtttggtatgtccactggcgcgacatgttgttggggtcaagcttggtatcgttcatttgaccacggatggagtagcattgatctagtgtctttccatcacagcgtcctgatttgtcgctctcaacg

SEQ ID NO: 70692 - DNA, 596 bp, Triticum aestivum
  unsure (1)..(596): unsure at all n locations
  Clone ID: PAT_TA_70692
ttttttttttttttttttacatttgttacaaagtggtaattctaaaatgtcataaaagtggtaagcttacagcttgatgaaattgagtgatgatagtatcaccaaggcgtcatgaaagacaaaaaaatgtacatgtcttactgctcgtttataaaactgcttcagctgttttcagacattgtttacagctgaaggtcttggaagaaactatcactagaccagcaagagaaaaaaagatagctctatcgataaggaaacatttttcccatggaagtattcctttgagttgaatcttgcagtgcaacttcccttgaaggtgacaatattaatgagaccatgtctctgcaggaaagaagttactcagggcagctgaatttcattgtccttgcaagttacaatctcaaaaaggaattttgancgtagagcttgtaaatcatcattagagaacccctccaatccgagacctttgtacttgctaacatactgaagaaggaaaattcctgagtcatacctgtgaaaaataataatagcacaatcagttccatactcaagatggaaattattgtgaatttaaaatacttttaatctcttttttt

SEQ ID NO: 70693 - DNA, 601 bp, Triticum aestivum
  unsure (1)..(601): unsure at all n locations
  Clone ID: PAT_TA_70693
ttttttttttttttttttgtcaaatgttgccttgccataacaaccacatttcacggtgatacgaaccagaactgttaatttttccncggaaatatatacaggggaggggattgctganagggagaaatctagagacctcgaaggcacaaattatgtacaattcataagtacaaatcgagctccccaaacccatggacacagaagaaatcaagaatgaacattcgacaaggtaggagccgaaggcctgtcccggctcaccattgtgcattgaggtgttctactcgggggcgcatgaccatgaggctcccaagcagtcgaccaggacaccatgctgccgcttctcctcatcatccccaaccaatttgcgttggatcatctgctggaaatcaacgcgccatggaagtatctctcggtgctctgctcccccgtggcttttggccagagaaatgcgaatgccggccggccagcacgacggaattctgacttgtcgccggcgcgccgtccgtgcctcagcgacagggacagaccgtacggaaaagcggcgaagcatcggcgggcgggcggacggttttggcatctcacacgtcgctttcgcagccgt

SEQ ID NO: 70694 - DNA, 499 bp, Triticum aestivum
  Clone ID: PAT_TA_70694
tttttttttttttttttttttttttaaaactgcagtttatttgcattctgatcaaaccatggcgcatattgtttatttgcattctgaaccaagaggccacaaaacctcctaaactgaaaaattcgtcaatgagtgagtgacacaaaaggcaagccaactaatgctccatcacaatgtatccatgaaatacatcattaaaaagggtgttctagctagtacctatctgctaacatgggagacaatcaaacaatacattctagaaagctcatgccaacaaagtaacgatcatggggggaagaaggttgatgctccccggtagaaaaaatctgacttgctgctgatgcaaaaactcaaaccatcaacacaccttttttccgagtgaaccaactccgaaatacctcaacctacatgaaggaataaagaccaatagcctcatatccccccaacctgttttctcctgtaattttcagtgattcagatgcatgaagagatatatgca

SEQ ID NO: 70695 - DNA, 369 bp, Triticum aestivum
  Clone ID: PAT_TA_70695
ctaagagttccaacaacatcaaccgcattggaaccaaggctcggggaggcgcctgcatggtggcatgtagatctttctgaagaccagaagcatacaagactaggtgaaaaccagaagacgaagatcctccacaagatcattgccgaggatgcccacgagacccccggcaagacccttgccggggacgcccatgatgccgcggcaagacccttgccggagccccggcaagacttgccgaagacatctgcggggccgcagccaggcccgcacctaccaaggctccaccgtcgcagctgccagcctgccaacaaggcaggcacctgcgtggcgacatgcagcttccaggccaaatcagcaagcacctactac

SEQ ID NO: 70696 - DNA, 592 bp, Triticum aestivum
  Clone ID: PAT_TA_70696
tttttttttttttttttttatccaaacatgatgttgtggttcggataatatagtactaaaatagagtaggcatatgtctcatacataagtacatagtcatttgtctcatacatagaatagacataagtctcacacataaatagatggtaatgtctgtactgatagatagaagcgtcagtgacgacgtctggcctcgaggggaggcggatctggaatcggcgtccatccccatgtgtcaggtgccctaatgggacacggtgcaatctcagactcttcctggtcatgttgtgtatcctgtgtggggcctggtggaggagtcgaaaacatgttcatccagtgggtgtgctgcgatatcggagcctgtatgtgatcctcgggatgatgatcactcccccacgtatcatgtgatgccgacatagacgcatgatatccataggctcctgctggctgaatcatgtccatcattcacggtcattgcagatgagaagtcatgattccaccatgcaggattcgggacctccgctgcattttcttcttcatctgactcgccagaatcatcggcataacccctttcaacatcagtgtcttcttc

SEQ ID NO: 70697 - DNA, 631 bp, Triticum aestivum
  Clone ID: PAT_TA_70697
ttttttttttttttttttgagctctgtagcagacatgctcagattatgttgacggtgacatattttaaatgaaaccagctgcctctagtaaacaattttagacaagtagttcttgcaacgtcattctacccaaattccaatgacggtaagaaaaaactagagccttggttatggtgtcattccacatatattgactagagcagaacagctgaatcatatattgatggctggccttggtaacgatatttgcatactagccaacaattacatcatcctaataacagcaatgatatcagagcagcaggccaatgaggtaatgggtccttctgaatctcttaaggcaagggttcctctgaatctcccagacgtgataagtggaggtaagcatcagttccatatccctccatagaaattatttgcagatccccgccaaaatatcgagcataaagacgactaattgggagcccataaccatacccagccattgtcactccattatggccatctagatcaggtgggtgttctgctgtactgtagagataggtgaatattcttgggaaggcacttcttggtattccacaccttcatcactaatcttgatagttacatcctctgctccatcagcaactat

SEQ ID NO: 70698 - DNA, 467 bp, Triticum aestivum
  Clone ID: PAT_TA_70698
ttttttttttttttttttgtagcaaagctccttaaaattgctcattctcctggtgtaagacagaaaagaaacgagacgcacttacttgtacacgtacgtgtatgtttcatacaaagtgtttttaacaaaattgaccggatgcatgtgttatcgttagctcgggaaccggaagctcgagaggtccatgttgccggccatgtcggagccggcgaggaggctctccatgacgtcgtccgagcagcattccagcagtatgcgtgcgtcgtaaggcgcagtcccgtggacatccttaaagagttccttaaacgacgacgaggcgctctccgtcgcacgggccacgttgtccgcgccgccgtcggtgacgctgctgcgagaagacggtccaggacgatcgctgtacggcgccgccggcgctgcagggaagtttgtcctggcctttctaccgtggatgcgccgcgcctcggcgt

SEQ ID NO: 70699 - DNA, 439 bp, Triticum aestivum
  Clone ID: PAT_TA_70699
tttttttttgccacattgcttacatgaagaactgtctcattacatttataaaattcaacactgggaaaatagattgcatccccaaattcagtgctcaaaattcatcaactctttttctgagtgaggactcggaatattattctcatgataacactatgttaacgttgtaaataacatatcataaggagataacaaattcgttaccacaatgatatcccaaagattcagagcctccatagccgacctaccaaaattcgcaggcaaactggaagtctaagccttcgagagggccaaattttcttggaaaagggggggctaactaattgtaaacgcacagtgccccactatattacacatgttattacagctggggcactttacccaggatacttgtcatcggctctgagaattttaacttacatacttcagtcaaacatcc

SEQ ID NO: 70700 - DNA, 629 bp, Triticum aestivum
  Clone ID: PAT_TA_70700
ttttttttttttttttttttcactagtgaaaagctatgtttatcaacattactctgctatctaacatgtatgggtatcttcaggcacgagtacatgaattcgaattgcagtcgcatagcaaccaggaggctatccgctaaataatatgtgctgccaaacccaaccaaaataaatatcggtctcatttgtgaaaccgtgaatagagaagacgcaattatgcaatcagacattaccaacccttagacgcctgaccatgactcatagttgtagccagatgactgactcccatgatgcatagaagggttgtgcgagttttgaaagtaccagcttggtggttgttgctgctgctgctggttggacgtctgaccttgttggttctgatgtgtagatccagagtatgctggataggttgcctgttgctgttggctataagagttgctgctgccgtgagcatgctgtggctgttgttgatgttgctgctgtgtgcccggacgcatcttaaagttctggccagaagctgataccgacttcgcagctggtgttttcgtatagatgtttggtgtttggtacgaagagttggagccgtatgaacgatcattccgactcgatgaaccggaccactgatttgc

SEQ ID NO: 70701 - DNA, 742 bp, Triticum aestivum
  Clone ID: PAT_TA_70701
tttttttttttttttttgtcaaagcaaggtctgatggaaagcaaattattttataagcacatgtccaacaaacaagctacaaattctaattatacaaatagaccacaagttcatgacattccctggtcacatagttcacacatttacgtccgtctcagctcacccgccttatgacaattgtttcgacggcggcttttaacgccacaattcttgcatcttgccagctttcgtggttgtttcggtacatcaccacgatcaggacaagttgttctcttgtggccttgtcgccgacaaatgctgcagaatctggtccgtttactcaacccttcgtatggtgccttatccatacttgtggtaggcctccctatctgcttgcgcttagctggaggtaataaaacctgcaagcatatttcccaatttatgtgttgaattgttgccaccgttctccatatcaacatgtccacctactattgcagccaacacaacgccttctgactgaacctgattcagaacatctccattctcagccaacctgtcctccagtcctaggccgtccctcatttctgtgtatggtttcatttcagcctcacaatgcttgaacagttttatcatgtgctcatatgcttctacactactgtctcggtgtctcccatccgcacaagctccattgcgtgcatatacatattgaaatgcctgaaactaaacgggttctcctaagcacggccgccgttggtactgagtt

SEQ ID NO: 70702 - DNA, 580 bp, Triticum aestivum
  Clone ID: PAT_TA_70702
tttttttttttttttttttcgctgttaaaggtccattttactttccaaatccttgcagcagagcgtcaccggtcaccacgcgtctgctaaaattcttatgatggtagcagacaaatctaaggagggagccatgagcggctacatcaccatctggtaatgccacgagacaacaataactaagctctgtcccgaagaacacaagggttaaaagtactcctggcccaagactttgccacctgagaagaggttgaggcatagcaggcacgcagccagcagcacgcccgggatccaccagctgccgccctcctccgaaaacatggcgcacatcaccaggcagagcagcagcagcatgtagaaccccagcccgcagccccagcccgtctagtcacccccggccccgctgaagccgccgccgccgccgccgccgccgtaaccgtaaccccggtgaggcgggtagtagtatatcccaaccaggtacaccgccatcatcagcaggagcgcggcaataacgatgttctggatcaggagcatgaccagcaccagcaccgccggcaccatgaccacctccatctggttgctg

SEQ ID NO: 70703 - DNA, 621 bp, Triticum aestivum
  Clone ID: PAT_TA_70703
tttttttttttttttttttttttttccttgcaaatttccaacttcaaatatagtttgtttggttcccgcgaaagaaaaagagttttgtttgggacatatatgcagaaaaaagacgacattgctagtgtaaaaacgccgccgctggatgcaggtggctgatgtagcacgttgactccgccagcacgtggtacgccgtctccagactcatcctgagctggattttgctggtgaacgtcttggagtgctctcggtgcttgatccccgtcgtgacgtccgccgctgcctcatccaccgtcatgcggcgcaataaggtgaaccattttgacggcaccgacttgaccaggtcgttgcgcggcacatacagggacgccatggggatgataacacggccgatgggctcatcccacccggcgccaaccttctcctccaccgtcacaaccaggggatcctcaaatggctcgatgaccacgaacatgaactcctcgttccacgccgggttcgccgacccctgaggttgccccggccgtgtccttcttatttggttgccaatctggatcttggcgatggccgccgccagcggtcggtccttatcagcgccgatgaggtcttgcgccgtgatga

SEQ ID NO: 70704 - DNA, 730 bp, Triticum aestivum
  Clone ID: PAT_TA_70704
tttttttttttttttttgataatgttacagttttacttcattgcaatgcataatacaacaacaggttagtgttactttgaatcggagtatctacagtattgctttctgatggtcacatagcaagagcgaagctactgtttgtcaagctttctgcttgcgtcctcttgaaactcgaacccagcctgaccagcagcattacttttggatatgtcacctgcttgtgtgattcgatccctgcttgattcagcagccttccctttgtacatgttatcaataggctccaaagctatgcaatcgcctccttgtggaattccatctctagctttccctctggcagacgactcagcggtcagatagctggagatcccactttgaaggtaggtttgagtgaagccatatgttctttttccatcaaatttagccactccttgcacgaccttgttcctcatgttcacagcaaacacaactgccctgcggttcatctctttggccttggccatgatgtaaacaacatcatcatcatgcaagctcagagcagggtgacctccttcgagtttctcaaaggcaatccgagtgcactgaccatccagtacatcacgaagcaattcacaataactctggtccactggtatcttgaacatatcgagtgtgcgatccttctgccagttatgccacggctccatcattttccatctggtggcttcaaaatatttggtagtcaaagtggtgt

SEQ ID NO: 70705 - DNA, 738 bp, Triticum aestivum
  Clone ID: PAT_TA_70705
ttttttttttttttttttttttgatggagccgaaccaagacccagttgaacacagccatgaagtaggcaacacgtaacataattaatggtgtttacagtttacatcatatctcatgggagaaaaggttctcatatcacctggatggagacatccttcctaatctcaaacaatatgcatctgagcatgacacaataccactaactagaggcaggcaagactccaatccatcccagattagaaacaagctcaccaactcactgtcatgtcatggcagggcaccacggttagaaccattcggacaacgtattaactaccagtacatagacatattagggcttgagctacacctctatgtctgacttgacttgcggatgaaatagaccgtcatcctgagctttttcgtgctctctccccgttcaaagaggcagatatccccctcccgcactttattctcggtgacaaattgctgccagccacgacgaatccacctctttccgttctgatctatcaccaatctggtgcgctgctcggtacctccctctgcctgaagcatgagatccatttttctgcctaagtgtggaatatgtcttgcaccgtattccatgcggaagcccaattgatcggcattaatccggcttttagtcattactaccacaaagataggaagttcagattgaattgcttgaactttctcctcaactttctccttctccacactacttagacttgtccttcct

SEQ ID NO: 70706 - DNA, 535 bp, Triticum aestivum
  Clone ID: PAT_TA_70706
tttttttttttttttttttttttttttttttaatccaaactgcgatgaagcaaaactttatttgcattatggtcaataggcatgcccaataaacatacctttgaaacatcctcttgttgctgccagtgcacacatgattctcaagtttgggagctaaccgatcatagttctagcgttaggtgctactcccttcccctaaacattagcaagccaacatcatattcttgcctgcaaatagtaaagccagtcctgatccctgcgggaacgggaaggcggccggcgggtgaccccaggcgcggtggcggcgcaaggaaaacgggcaaatccgggcgcggcgttaactggcggctggtgcggcggcttgttccggtgccagcggcgtcctgctcatccaaaaaaggaaaaataagggcctcagggagagaggaaacagaggaagaaaggagaaggagaaggggcgcaaggtgagggagggatctggcgggtggtgcaagggcttgctccggtggcggcggcggccttctcatccaaaaaa

SEQ ID NO: 70707 - DNA, 625 bp, Triticum aestivum
  Clone ID: PAT_TA_70707
gggtacgggcccccctcgagcgcctccctcatgaccttggctacttctgaggacctcccgaggagagcccccgagcccagcctagagaggggcatcgggcgcaccttcctatgcgatgggtgaaggcgccttgtccgtggacgtgaggctcagcgtggcgtccttaggaaaggcttcctcgcgagatccccgacccagctgcaacttctttgtcttgggggcgacctcaggagggagggcaccgctgtcatcttcagggttctcgaccgccgcagcctggaaggcacgctctagggagtacaccgcgtccttttcctggcttgtgaccgtgatgaagccgccgcttccttgcatcttgaggatgttgtagccatggtgcgttgctgccatgaacttggccagtgctgggtaccctaggatggcattgtacggcaggagaatgtcagcgacgtcgaagtcgatgagctcaatgtgatagttgttacgttcaccgaaggtgatagggaggcggaccttctctatcgggtgtgtggaaccatcagtcactcctgaaaatggcttggtgggctgaagttggtaacacgacacttggatcctatcgaacgtttgaacagataggacactg

SEQ ID NO: 70708 - DNA, 494 bp, Triticum aestivum
  Clone ID: PAT_TA_70708
ttttttttttttttttttttaaattccgcgaaaaaatctaaccgggtcaaatccagctaaagtacacaaaaagggttaaaacatgaaatttatccggatcttgccgggctgccagttccacccaacaacggtgatgcttgcagaccgatggcgttgaaaatttcatggtaggatgctgcgtcaaccacagtggtaggcaaggaaaggagataaaagagtacgctgatgcacccttacgagaggggcaggcgggagataattggagaagtgtgacaaatccacctaccgctggtgtgcatgtttgacctcattttcctaaatgctccctccgttgacctctttttactataactagtttcagccatacatttcggcgatttcaaccaacgattctcatatgtggtcatctctgcaagtctcttgggccttgagcaaaaacatgctgaatcgtgtctgctaaggggtgtgttgagcattcgcattgcacaaccatc

SEQ ID NO: 70709 - DNA, 439 bp, Triticum aestivum
  Clone ID: PAT_TA_70709
tttttttttttttttttttaacacgtaaattttcaaacaacatccaaatcatggcaggtactttacaatcacagcagtacaaatcaggtattgaaatataaaatacagctagatattaacatgtccagctccagggagctaaaacacattttgggtgcaagttttctttaggattcttctcctgtagttccttgtacagcaacttttgacgaattaaggccaaaatcatggcacaagagagagatgtccccgacgatgccctgcttatctagttcgcaataaggctcaaccagctccgcggtgtggatgatgccccctccttgctccatccagaaggcaggccacggactatgaagcccttccaaaggagtagcatgatgcgtcgtcggagtgccttcatctggagttgcaggccggagttgtgacctgctgctttgct

SEQ ID NO: 70710 - DNA, 639 bp, Triticum aestivum
  Clone ID: PAT_TA_70710
tttttttttttttttttaaaggttactcgaagatgaatgatcagaaatcttataatgttgttgatcgagaaggaaacttgattacaaatagtagagtaaattgcaaaaaccaccacatttgtggaccctaaatcaaaaaaccaccatgtttccttttttttgcaaaaacccaccggtattgtgccgacagtttgcaaaaaacgctaatgagtcaataagagctgtttgacgcaaaaactgacgagtgggtaccaccggttaggctgatgtggcaccaaattctcccaccgtttgtttagccagtcaaatgacagctagggcccacctgtcatcttctttgcttctgtctcctcttatgcattttatcgagcagtttgtgggcgtacagccagccgccgccattgtgcacaagccccgacacggctgttgcgtgcgccatggccatcgcccaggtcacccatgccgagctgcaccacgccatgccctgacgccgcctgactgacgcgcgacgagtcaaacgcccgagctgcgcccccgccatggccgtcgccaacgtcgcacacgcccgagctgcaacctcccaatgacagttgtcgtgccctcccgcggcacccgcgctgctgccgtcccgagctggag

SEQ ID NO: 70711 - DNA, 485 bp, Triticum aestivum
  Clone ID: PAT_TA_70711
ttttttttttttttttttgaccaccatcgcactgaattgtgattaaacttaacaaagggcaatgttgggtctttactagcaagtaactctggaacatgaaatttataggacctacagaaaaaggatggtcaaaatccaagctctcttactttgcttatggcagctggcacaattggctactatgctgatgacaaacaccacatgatgcactgcacgggacactggcgacagaggtggtggcactgctgccggttgtagcctctaggaggagatggaactggtggatttccatcgggagacagccaactcttcttgcggggtatgtgggatgcccaccggacaaagcaggcagagcagcttgaacccgcttgagcaagtgcgatctgtccagcggcgtttatttggcttggtttgcaaggtcggacagcagcttaggggccagccacgccccacttgcacccatagtgatttgagcacactaacat

SEQ ID NO: 70712 - DNA, 678 bp, Triticum aestivum
  Clone ID: PAT_TA_70712
tttttttttttttttttttttttttttttttaaagaagaaaaggctacattgatgtatattatactgtatgcaaaatctcgctatcactgaactccaaacttatattgtgcccattctgggtatgaatttgcgccgtctttgtaatacgccatatgtcctgttgctcaccaccaaaatcctgcaatttctaatgccataaaatcaatcataaatttgactcttcacaaatcaaagtttggatcgtaccgcctcgaggcggtacttgacgtccttgagagccttgttggtaggtttccagtcatcgaactgtttgagtaactcatctgcctcggcactcaactcagtacggacaaagtcctcttccaacaacccacgcatgatccaaggtaagacgtatgggttctgagacgtcaatgatcctccgcgtggcgagatagtacacggtgctggcgatggaccagcaggtgctgtttcgagagcatgcgcgatggcaagatcatataccgcgtcatcgtagtagaggcgggaatgaccagcacccgaataaagggagccagcgagagggacggatagctcgcgaatcaaaccatggtctgaaacaccaaggttgcgaagcttgagagcgaagccaaccaggtgagcaatgaagtcaggggcatgaacacgtccatcaatga

SEQ ID NO: 70713 - DNA, 626 bp, Triticum aestivum
  unsure (1)..(626): unsure at all n locations
  Clone ID: PAT_TA_70713
ttttttttttttttttttttaataatgaaagagtatgtcgtattgacgctattgctatctaagctaataattgcttttttcgtgtactaataataaacagaaatctaaatacaaaacaggtcgtaataatcgtgataagatatgtcattctaaatatatgcaatggtagcatcctggttccagactcatggaatgctcatgttcatgtccttagtaaggaggaggggcgtagtagggagcagatggcttcacagaagcagtggtgtggagagtctcgactgtctgagtagtctcgatgggcttgggagtgtgcacaggagtctcgtacagcttggtggtagagcggtagaaggtagtcgtctggttaccgtggttgccgatgtaagtggtgggcacggtaggaggaacgttgttggtaggagcgggaggctggtanacgccagagttggaaggttgccactgctggatctgagtagtggctgtggcgtacacggaggaagtgacctgaccgatggggcagtctgtgacctgaggagggcaggcagtgacagtgaagtacttggtagtgtaaagagtggaagtcatgttaccaggacgagggccataggtagctccaggaccgggga

SEQ ID NO: 70714 - DNA, 587 bp, Triticum aestivum
  unsure (1)..(587): unsure at all n locations
  Clone ID: PAT_TA_70714
aatcgaaatacgcagctctcctgcgtctattttttttttaaacgagaagtacatttaggcaaatcgcacatagcgttcatcgtggtagcaagattgaagcgacatgtccgaattaatcaaaggtcgaggcactgaacaattagtgggcgaccaatgtcaaacaaacaaacgaacaaacattcagctagctgagctccacgaagcggcgggccatggggtgcttggcctgggacaggtcggacggcgggagcacctccacgaccacgccgtcgacgacgaggcacaccaggtcggcgatccgctggatctgcctcacgctgtgcgagacgatcaccgccgtcatccccctcgtcttcttcaggcgaacgatcgcctcctcgatgttctgcgtggagatcgggtccagcgcgctcgtcggctcgtccagcaacatcacctcgggctcgttggcgagggtgcgggccanggcgacccgctgcgcctgcccgaccgacagctccgacgccggcctggaggccagggccgggtccaggtccgacaggcccagcagctccttcacctgcgcgtcggtgagcgtctcgccgcgc

SEQ ID NO: 70715 - DNA, 557 bp, Triticum aestivum
  Clone ID: PAT_TA_70715
tttttttttttttttttttttttttttttttttttcaaaagcattgactaatcaaattatcaccatgtaaattaagaatatattatccaggagaagaggaaccaggaaccagtacatcttcacctcacttttacccccaaaaaacccaccaaatcctatacacaaaaacaacataaataagaccatggcaacactaccagtcttaccagcaggacggatttttttctcaaaacatcaaagccaaggaaccaaaaaacattgcgacacaaagagcaggagcaacctgtcagattcttaggacaaaattacacactgagcaaggatcaaaatactaaacatgaggacggggcatccacccgttggctgggcagctggggtacctgccaccccacccgaattcaagcccggcttggacacgcagtgctcgcggagtttctcctataaaaaaatgccaacaagggttagcctttgggttggtctcatttaaaaaaaaaatactaaacatggaggaaggatccaaactaaccattccaacgattcaaaatgtcgcaattact

SEQ ID NO: 70716 - DNA, 680 bp, Triticum aestivum
  Clone ID: PAT_TA_70716
ttttttttttttttttttagtgtcaaaacgttcttatattatggaacagagggagtacaaaattatagggggaacttggtatgtacagcccagccgtaacaaactcaatctcagtatcacagaatggtgctccgtatgctaactcgctcttttgctttgcctgacaaatgggaagctgtgtgagtagaaccgtactcaacacagttcatgactgtaagctctggccgagcaatctattccgtctgttggctgtacagatctcaatgtgaaatctgggagggcagtttcccattatttcgccgtgaacttcaggtcagcatccacttggcggtgaagtcggctcttgtgctgagaggataccatcaccgttttcggttgctagtggtgactgatcgtgcatcagcctcgccgcttcttccagggacgcgtgtagctcatcgtgcataatagatctctggaaggtgaaggtggcgccatttatacatggactagaccgtggtatcaccttgtcctcgagtatccgtctgacagcctgcaacatcttgggatggaaggtgggaacgccgacttgggagacagcagctgcgccgaagaagttaccaagcagcgcagcgtccgtagctgagagccccaaagcagaccggccgcgaaaccggcgagatagctgtctccggcactgt

SEQ ID NO: 70717 - DNA, 599 bp, Triticum aestivum
  Clone ID: PAT_TA_70717
ttttttttttttttttttttttttttttttttagagccaatctctctcgatcgtcttcttggggaactccgcatttacatgaccacatccatccgtcctctcaaatccatctcgctcgctcaatcaagtaaaaataacaagaaatggaaaaagaataagaatactagcatccagtttcggtttcggtttcagttccagttgagttgtggtggtaatggttgtgggctctgaggaaacgcccatgctcctccgtgatctcgcctggttcggtggaccgatcttcgccatggatggtggatgaacgcggtgcgcggtggtggagctggcaagcttaggtgggtctggccagggagtggaagccgttcttctggagccagctctgcgcctgcgcggcgatgtagggtgggaatcgtgatgatgctgcagctgctgctgcggcggcggcagcgttgttcggcggcggacccgcctggtggtgcggcggcggctgaggcggctgccagctcctgccgggcacgacgttgccccagccgtgcatcctctgctgctgctgcggaggcgggcggcggcggcggcggctggtattggtggtgcggagg

SEQ ID NO: 70718 - DNA, 647 bp, Triticum aestivum
  Clone ID: PAT_TA_70718
tttttttttttttttttttttgcaatggttcagtcttcaggtcacctgaaccaagccatttttaggctgtactatacagttttatccagcattccgctgcttcgaacccttcattgccatttgaccaacttccccgtcacaactgcaatggtaggttttgcaaaaggagaaggacatgaagatgattttgatgtagatgccctttgggaagcgcctgccttggaaacgatgtagtcaacgaccagctccataaaggggttgctagtatttggaaggaaccatctgctcatcttctggcagagagacattttggtcgccatctatcagcatctgaaagagcgcgttgggcaatcgcaggcgagagtgattcgagtattacatctctcatatgcgaggcggcactttctccatggcgtgttgccagctctagatacatgagagacctgaccttgtctcctgtcgcacagagtttaataccagactcataaagagcctttctgtgaccacaatcagcagctagttgcagccacttctttgcacgcactggatcctgtgtaaacccttcaccaaagctgtaacacaaggaaacattatacatggctcgtacattccctccttctgcagctcgtaagtaccactttgcagct

SEQ ID NO: 70719 - DNA, 707 bp, Triticum aestivum
  Clone ID: PAT_TA_70719
tttttttttttttttttttttgtgtacttcaagtacgttagctttatttttagcaagcaccaaatctatttctgcatcattcatgccgtcaggcataatattactttccgattcgaacaacttgttgttaatttggttctgggcgatgagtgctttaagtaagaggcaatcattctctttcctcttcactctctgggcgcgcttcctcgcggttgcagcctttttgcccgcttccttcttggtacttgaagcacttatggtccaaggtctggatggctgaaagggagactgcagagcagacggtaaagctttgacgaactgcttagcagacggtttagctatgccggactactaggctggcagtgttgctatgacagactttgggctgtaggagtagaggcatcggactgctgaccatgcgttgaagctatgtcgggtttctacgcaagtggtgccaacttgtcggtgtgccaaggaggtcgtgccaacacattggtttgcagagcaggcagtgctgaagcattgatatgctgatcacgcggctgcgggccgatgcactgatgtgcagtcggttctggacctatagactgctcagcaggcggttctgaagcatcagactacttagtagtccgttccaccaggttggtgtgctgagcatgtgttgcagctaggtctccccttgctgcttcagcggccggcatctgaac

SEQ ID NO: 70720 - DNA, 487 bp, Triticum aestivum
  Clone ID: PAT_TA_70720
ttttttttttttttttttttttttttttttttgcaagatgttaaggtgcatatatgtaactttctgcaacagcacttacaaaattattttagaggcacactgtctcatgcacaggtgcgcctcactattcctattatatagttgtcaaaatgatcaacataccttacaattgggtctcctttaggacctatgtacagggtacgcgtagtcgctggtcaccgtcagcttccgcgctcctagccgcttccattttctgtgaactcattcttcaccaccgcttctttgtcatctttcttttcctctacctgcacactttcagccttgatctcatcgccaccgtccacctccatactctctgtcttgatctcattggcgtctttcttctcttctgcctgcttacttccagtcttgatctcatcaccatctttcttctcttccgcctgcttacttccagtcttgatctcagtggcctctttcttcttaaact

SEQ ID NO: 70721 - DNA, 649 bp, Triticum aestivum
  Clone ID: PAT_TA_70721
ttttttttttttttttttttcgaaattaaatcgtgctagtacaaacaagtcataacataccatgcagcttaaaaacacactagcagctcgtacaacataaatgatgattcaaaagagagcttcagatagatgttataacaaatcaaattctagaagtgcattacaaatttgataagcatcagcaactcatcaaccatgatgtgtttactgaactcggtgccaactgtgcacataggatgaaataaccaggtggaagttttgcgtcattgagtatcacatcactaacatgaatcctgctgtaggccccgcttctcctcccaggacacagttagacgaatcagatcatcgtatcaaccgcagaaaggtcaaccaccatgccaacagcaggcctttgctcatgaacagtagcacaactgttgcctagtgattttgacatttgtggctttaaaggctggagctaaaaatcacaattcgcactgctacattccacttcatcgcatactcgaaccttctgagtcaaagagataccaaagattttgcagccatttgtgtgaacatccttgtcatttggttcatgctctgcactgccgatggagggcaactttttagttccagcacaactagctactgctttgcctgaaacaagacg

SEQ ID NO: 70722 - DNA, 607 bp, Triticum aestivum
  Clone ID: PAT_TA_70722
tttttttttttttttttttgaaagagaaagctacttaaaacgcttaattagattgagcacatacataactggaagggaaatgatttttccttagacaatgaaatttcattataagatgaaacaacagaagataactatctggctaacaataattggttcgctcatatatgtagctatttcgataccccttaaaaagaaaaacagcaatagaaggtttctgacagggatctccataacctggaacatgcaaaatcgtcagaagttaactttgcaaatagttttctgtgtaaaagttaattttgcaatgcagtgaacattatgggctagtaaattcaagcaactctaaagtgaaacaaatagatagatcatcaaatttgcataatttgttaccaactacaatctaaatatccttgcacaaggatcatcttagtagattgctgaactaacagaagttgtagtacaccagtacacttaaatatattttagagcagattaatcttagataggcaaccagagaacggccgcttgactccacagccgtagataggcacataaggagctacctgcataatggtctgtaacttgttgcgcacatcacagagctcac

SEQ ID NO: 70723 - DNA, 539 bp, Triticum aestivum
  Clone ID: PAT_TA_70723
ttttttttttttttttttatgtacacacacatgcaaaccaagtgtgcatgtacttttcttaagcaaacacacaatccgatacaagaaaagtaaatcaaccacatcacaaccaaagctgtatgtatatcaaatatttagaccacggcgtgaagatgaagtaatttggatgtctaagtccatcttcgcgttcgtacgccgtacgtcgtcgacgtttcccgatcacttgaactgcatgttacttgagaaggtctggccgaacctccagctgggcggcacaacgtcggcgaagacgagcgtctggccgtcggtgatggtgaccctgaaggagagcccctggccgttgaggtaggcgagcgagtgccagttggcgccccagttgtgcgccatcgccatccagtcgccggacttggagcccctgacgtccatggccctgatggagccggccgccgccacgttggtcggcagcaccagctcgaagtagtcgtggccgctgatggtgaaccgcaccccgcccttcttcacgcacggcaccctttggt

SEQ ID NO: 70724 - DNA, 704 bp, Triticum aestivum
  Clone ID: PAT_TA_70724
tttttttttttttttttttaacatcgatttacttatgacaaagccactatgtatgtacgtcattccaagtatttgttttctttcgcgttcaaagaaaacataaggggggggggggggggattaaacctagaaaaacaaacgctatatgttaatttacatccagacagaagttaaaaataaaataaaactttgaagaggttgctaagctcatgttgcatacgcgctgcccagatcggtatagcctacttcatgctcttatacatttcgtcaatgatgccctgataatatttgaggagctgcggccgcttcttcttgtaagtcggggtgatgaggtcgcgctccatgtcaaagagcaccggctccagatgaacagccctgatcatctcaaagcctttgagcttcttctctttgccagttttgctcagttcttccaagatgaactctttcgctttagcatctccgcatatcgaggcaaagtctccgctaaccccgttcgactcagcccatcgttccaaaccttgcttgttggggttgatcaccgcaaccaggcatgattcgaagctgtttccgtacacccaaatcgaatcgacattaggagcttgaccaaatatgttctctagattctcaaccgcgacgtattctccttgggaaagcttgaagatgttcttcttgcggtcgatgatcttcatgcttccatcatgctg

SEQ ID NO: 70725 - DNA, 567 bp, Triticum aestivum
  unsure (1)..(567): unsure at all n locations
  Clone ID: PAT_TA_70725
ttttttttttttttttttgaataaggaaacaatgttatttgatccgacagaatccttaaaattttggagatatactcgatgggaaacaaatcaaacacaatccaatgcagcaggagggaccgatcgaccaaatcaagctagcactatggctccggctatcatgaggcacgccaagaaaccgccccgcgaggctgacgcggacgatggcgaactcggcggtggcgacaccgtaccattcgttaccggcggcggcgctattgctggaggtggcgacgtggaagaattccccgcagccggcggcgctagcgccggaggcggcgaagtggaagaatttcccgcagccggcggcgcaagcgctggtggtggcgacgtggaagaatttcccgcagccggcggcgctagcgccggtggtggcgacgtanaagaatccccgcagctgccggagcgggaggcggcgacgaggggggtgacttgggtggtggcggcggtgttgaaggagcaggcgaaggggtacgcacggcgaggacgacgacgatgaggcgctcgccggcctgacagcgtccggcg

SEQ ID NO: 70726 - DNA, 639 bp, Triticum aestivum
  Clone ID: PAT_TA_70726
ttttttttttttttttttttcggtatgatagttattcattatgactgtaaaagctcaaagtacattgtccatcccaatcctcctctaagacttcataacctcagacaagcggacaacactagcgctaacagtgttcttaccacctgctggtggcaagatgccagcgcccataatcatgagcagatccggatccttctggaaagtgaggagagaacgggtataggcagttggctgaggaacgtcccacttcttccaagcagatgcgtcaccaagagcctggttggtgaagatctcagatcgagtaccacagctaacaacaatggtaccattcttgccaccataaggagtccataccacgtacggagagccagcaggggtggttccgtcgttggaaacaatctggtggtgagccttgttgaggaacttctggggatccttggaaagacggtagtagacggggaaccagtactcgctgccagcaggagggttagggccaccaccgtactcgtagacgtagatgtactcgttgttgggcagcttggcgacagtaagcataccgggacgggcgtactactcggcatacttaatgtcgtcaacaaccttggaccacttcttgagatcggtggtggtttggtggac

SEQ ID NO: 70727 - DNA, 629 bp, Triticum aestivum
  unsure (1)..(629): unsure at all n locations
  Clone ID: PAT_TA_70727
tttttttttttttttttttttttttttttttttttttttttttttttgacgcatcatcaatcagcaatgcattatgagcgtctgtctagtcgaggtgcaatgcacacgcttagtcgaagagaccgaagcccatgtcatcgtcctcctcctcctcggactcggccttcttctcctcagcgggagcgtcggcagaggcggcaggagcggagccagcagccggggcggcggcagcgtaggcatcggggttggcgatgcggtccttgagctcgtgaatggcctcccactcgtactcggtctcgatggcgacagcgatggcgttcttgtaggagttgacaacgctgtgcatgacggagggcaaagtcgggtagttgacagccagggagatgcaggcgatggtgttgatggccgaggagaaggccttgaggagctgagactcctcgatgtcaaaaacatcgctggcgaaggtctgaccgtggtcgtanatctgctggacagtcataccgtaggtgaacggagagatgttcagcaagttaaggagggtggcctcggaggctccgaccttggtgccggcctcaatgagcttgaggtcggcggtgatctcaatggtaccacgggcaatcttggtgggg

SEQ ID NO: 70728 - DNA, 634 bp, Triticum aestivum
  Clone ID: PAT_TA_70728
ttttttttttttttttttcattaaacaattttagatacaacacaaagataaagccaccaggacagttatatacttcctccgtcctaaaataagtcactcgactttgtactaaccttagtacaaagttagtaaaaagttgagtcacttaatttgggacggagggagtagtacctagctataacttaattagatacaaatgcactgagactgccataagtgtcacatatttagatgttttaatcagcttgccctattggctttcccacagtgtcacatatttagatgttttaatcagcttgccctattggctttcccacagtagtgccacataggaagtagaactggcaaccgaagcaggcactggaatcgtctggaagcatcactattcaccagaactgaaatgaatgacggttctttcgagagggagactagaacctactcttatgcattttaggttttcctttcaaccgtgtcattttggtgcaaacctgcagcactatctgaagtaggaccactaacatgataagaataggactggcatactatgtacctgaaagtgcatccttcagagattcagcatacagacgtcacgttttcagttagagggtcaggttccgcaaggcgtgcatccatg

SEQ ID NO: 70729 - DNA, 622 bp, Triticum aestivum
  Clone ID: PAT_TA_70729
ttttttttttttttttttattttcaatttgtacatggtttcaaatgggtctctgcgacatttggcgcaacgagtcatctagtgtcatgaacgcttacagaggcgtgaacatggtgcccagcatagagggacatgagaaactcgacccaagcaaagaaaaacatagctaaactcgccgaccagagaaacaatccgaccaacaacaagacgaccgacatctccgaagtcagcaccgaggaagctgcgagcaaacaagacaacgccttcacgaaggagaacgacaacaagacgccgccgccgctgtccgatccggaaaaccggatctagggtttcccctgaagctcaaagaggggcacagatcacggctatgacagcaccttcaagaagggaacgacacccacaagtatcgccgctgccagcatagaatgcaggatttcgccttggccaaattctgagcaaccccaagctgtgcgactataggaaggggagccatgcccgacgccgaaggaggcaccgggcgccgctctggaggagggtaaggatgcatggctgagcggagtgaatggcggtaggatgtgacggtggccgcagccccggacaagctaggatctggaaagagcgca

SEQ ID NO: 70730 - DNA, 546 bp, Triticum aestivum
  Clone ID: PAT_TA_70730
ttttttttttttttttttttttgcacaatgatcacaaatatgacactgacttattcaaagttgtagcaacgtacatagagcatgggccagggcagatagatggaacatttagggtcattcttgacatccccactaactactaagaatgccctttctatacttcacaaattttcctgtgtctccttatcttcttccagtcctttctctgataaaatggcagctacgatgcttccttgctcttcccccagagcagaagatagaggcctccaatgacaagagcagcacctaccacacttcccacgtaaagctgttcatgaaggacgaggagatcaaggactccagcaatgatctgaatgagaggcaagaagcctgcagtgaacaccggccctctcttctcgatgcaccaggtcatcagcacataccctatccccgatactcccactcccgcgaaaagaacggttgcaatctgtatgcttcctcggagcagccaaactgagaggtgcctttgggtggtgactgccattgcccctgcttgcagtgagctga

SEQ ID NO: 70731 - DNA, 409 bp, Triticum aestivum
  unsure (1)..(409): unsure at all n locations
  Clone ID: PAT_TA_70731
ttttttttttttttttttttaatcatgcagcgttattttcctcaaaaatttaaacgtataaagagagaaacaaaaatcagcgcatagaaaggaatcggcgtgccgaatcacattgttattatatgaacatgcacgaagtcaaacatgagattatttatcatcaccttactttggcaataacactcgtctctaattgctcagccttcaacatggtgatctgctcaacatcataaatccatctgcaattacaacagccaagcataggcatccgaataggtggaggaagtaaatgtntgatatttcagatagagggcagccggtagtaaagacagtctctaatcagccttccaacacatgcatgtatatgctctgtaggacagggaaagttcaggtagtggaagatacatat

SEQ ID NO: 70732 - DNA, 481 bp, Triticum aestivum
  Clone ID: PAT_TA_70732
tttttttttttttttttgcagttttgtaatgctacatatattgatcattatgttatttacagcattttctaaaatgtcacacaggaacgttatggagaggattctccttgctgcagtctacaccgtactaattgtggctactttttatcctcggtaataactccagaacttccgtaagtttctccaatattcgatcgacaaaattaggatagagttataaactgatctatccatgttttactgtgtgcgtgtgtgtgcgttttctttttcagtttctttctcacacgtatattcctaggataacttcctttggatcagtctctatcatccatgaaggcttgttcatcacgaagtttgttgttccttgggacgcacgctccagaagcagcttccttgattcaattgctattccctctggctcttccggaaaccaaacacctggttgtgtgcttccctccagaactgcttgaacaaatgcagc

SEQ ID NO: 70733 - DNA, 403 bp, Triticum aestivum
  Clone ID: PAT_TA_70733
ttttttttttttttttttaaaatatctctctgctttatttattgaggggtcaggccctttatatagcagacaagacttgacaagtcagtaattttattcaaacagttttgctaaagcacatctagatgtgtcataagcattgcacatctaaatcctatgtcattgacttatgcagagatttctgtgggtatctttattcaaactctcataggatctttaaactggactcttttctaagagacatgcttaatcaactgggactctaggtaagggataagctccacatttgatgggctggcccatacaactgaaggcatatcatggtccataacagagttcagcctaacatggtatacagtggtctgatttgaaacgcacacaacacagctcacgatcagtagac

SEQ ID NO: 70734 - DNA, 307 bp, Triticum aestivum
  Clone ID: PAT_TA_70734
ttttttttttttttttttttgtatatactctctcaagtgcttttatttcactctttctgaatgctgaggaccagcatgttttcagagccaaaactgttaagagtaaatctagtttgttgtagtgtgcaaatgtgttttgctggcacagtggggtgggttgatggtggactgtgcctgttgcagccatcagttcacgcagtgggtgtactgaagatgaaaagagaggagccggcgtgtgttgctggttcagtcttgactgaaaaaaaaaggacggcatttgttgcctggatcacaactgagtcatcct

SEQ ID NO: 70735 - DNA, 493 bp, Triticum aestivum
  Clone ID: PAT_TA_70735
tttttttttttttttttaatgtcaaaaaataacgtttttatcttttaaatatttttaaatttagtttcaacgggtagatgagcatgagctcagacgtcaattaccgcaactcctatttcctccccatatgttcggatggacgaaaatagcttggataagggagaaagaaaaatgccatccaactagagctattggaccaattgtacacttgacaggctagaggtttgaagctcggccaacatttgaagtttacgacgacggagctgaagctcctcctgttcaccggctgaagctctgctagcagcagatgtttatagtgacgcaagagatgttgtctttgctcctcttgttcaccggctgctcctcggatcctttgcagctgcctgtccacccctctcgtgtcattgatctcatcaacctctccttagttggtcatcactcaaacatgctatcctgagacaatttctctgcgctgctgcctggttgtcaaccg

SEQ ID NO: 70736 - DNA, 476 bp, Triticum aestivum
  Clone ID: PAT_TA_70736
ttttttttttttttttttttttagcctaaaacatatatttcacatgtccatacatcatccattttcatacatcatctaacataaggctgtgatgttgcacaaattagtaggggctgccaagtctggcatattacaaccaaaaacataaggcaataattggtgccatgttgcacacaaagtaatgggtgccaagtctgacatactacaaccaaaagcatagagaacatagaagatgatgcacaacactagatcttccttctcttcggggtcaacttcctagctttcgaggttgaggccatgtcatatgccatcgtggtgtccttcacaattggggtaggttgctgcgatgcctcatcagccaatgccatagccaacatccttctagtcacaggattgggactaccttgaagattcagtggcatagtgatcgtgtgcctattgggagtcacaacaacttcaagttgtggtgctgcatg

SEQ ID NO: 70737 - DNA, 377 bp, Triticum aestivum
  Clone ID: PAT_TA_70737
ttttttttttttttttttgggggaaaaagggaagtggctctgattaccagtttgtaacgaacccagggttgctaggatcgaaacaagggtgcatcgggaaaatagatcgagttcagcttgttgcttgagaaagaaggtgaggtacaggagaaggaggtgagatacagagaaggttaggtgagatacagagttcactcaatacacacatgccctctctctgcctaccacgcacacttaagtaaccacacacacacagctctgcccgtgggcctacatgtctggcgagtgggtccactctttccttgtccactgcatcatcagtgggatgcaggtgtgacaaccactcacgaaaagaaagcaaaatttcgcgtcaatgg

SEQ ID NO: 70738 - DNA, 506 bp, Triticum aestivum
  Clone ID: PAT_TA_70738
ttttttttttttttttttttgcgcataatgaaaatcgtttttaaaagaacctttacatggtcctctcataccttacataccagagtttggtaaccaaaaaaaggttgacaaaatatatctacttgcactcacagatgctttcacttcctcaccacttatacactatgatgcttacatggacagccagcttatcaatcagattgggtatttgtcactttatgcacctgtctattcattagcaaggaatccgaaatcctggagcaacttgaatgtcaatcttatgaaagaatgaacaacaaaagagagtgtaagtttgcagtgcaccgtattcgaatgctcaatagcttggtctgtttggtccatttgttttattccagaatgaatgagttgttgatttcacatttctggtcattactagcatcgaatagttcaatcctcttattgcaaggctacttggtaactgcaacatcatggcgaccgaatagcacatctattagcaccaagag

SEQ ID NO: 70739 - DNA, 453 bp, Triticum aestivum
  Clone ID: PAT_TA_70739
ttttttttttttttttttttttttttagagagaaagggcacccgcccctgtccatttcatagaaatgcaacgaacagtagtattcgaagtgcctgcgcagcaaggcctgcaggatttactcaagaaaaaaacggaaaggcctccaggggcaataactgagcagaaatgtgccagtacgagtattatctcagaacaaacaccacagggctccgtcccaaacaggcagagcatgtcatttataggctacaccataaacatgggggctaacgatatacgcagatgacaggcgcaccgcgtttaggctcaagctcgagaacccagcttccttgatgttttcagctgttttcctggtgaggtggcacccgtcagcgacaaattgctgcagaggatcaagggcaccttgcaccaacaggaggaaggaaccatctgctgcagcaacatgctcaatgaata

SEQ ID NO: 70740 - DNA, 428 bp, Triticum aestivum
  Clone ID: PAT_TA_70740
tttttttttttttttttttttttttttttttttccacattgaaaacatctgcgtttttcagtgactttgtgtttgagcaaaaaaaataagcttttgtttaaaaatacgacaccaacattacaaccatagaccagagcaaaaaattaacacttgaccacttccagctcatgaccgaagtacaggaaagtcggctcaacaactccttccttgtaggcaaacaccaacgtgacatcatgatgcatgctctcgcccacaaagctgactgaatcagatcatcgccagcaatcaaggtgtgatcaccttcaaccaaagtggagtcgtaattaatgtgatcaataatcattgcttccgggtcctaggaccaatcaaatagaggtagttgagatcgaaaaaaatgcaagcaatggtattgaataaacatgagtaag

SEQ ID NO: 70741 - DNA, 357 bp, Triticum aestivum
  Clone ID: PAT_TA_70741
ttttttttttttttttttttttttatttttcaaacaaaagcaatgccactgcatcccaatcgctcgcccaaaaagcacaaggttatttacaaacccatgtaggtaggaatagttccatttccatatgttgctacaaatctactcatgatatgatagacaccaacaggggagggatttcgaccgccccgccgcggtaaaaatagataggaggggggcagccagccaaactaacaggcaaaatgtgacaccctttcgaaaaaagccgcaaaaactggcagaaaccggatggtgttcatcacctgctggtggcgactatggggctgaatgtcacgggccacgcccctcgccggttggtct

SEQ ID NO: 70742 - DNA, 353 bp, Triticum aestivum
  Clone ID: PAT_TA_70742
ttttttttttttttttttttttggaaaacttcaaataataacagccagaatcagtatggagctcttgctctaccaataacacgtaatacaattggaatcacaatattacaagctctacaagtgtgatagctggctacagtaatttacaactccacaattgtcttcaatcttcttcagaatggagctcctgtcaatagcgatcacaaactgggcacatgctcctgtcatatgaaccatatgccatactcactagatgaccatagtcaggattaggctatgaccttccattacaaacaacaatatgaacttccatcccttccacggtcacccattgcgcaatggatttatcaaca

SEQ ID NO: 70743 - DNA, 584 bp, Triticum aestivum
  Clone ID: PAT_TA_70743
ttttttttttttttttttacactgttttgaaacgctgccgtggcagcgtttttttgccatgagacatgttttcgctgccatggcaccgtttgttgaccatcattagctggttttgagccggttcgcatggtgtatgggccattttttcccggactctcgtacccgttcacgggtccgtgtacgggtccgtgtacgcggcgtgtgccacgtacatggttttgcccagttttccatggcgcgcgtcaacttccgttcacgacggccgtcgggcacttttttcccgtgtccacgtacagcccgttcacgggtccgtgtaagggtccgtgtacgcggcgtgtgccacgtacgtggttttgcccagttttccatggcgcgcgtcaacttccgtccacgacggccgtcgggcacttttttcccgtgtccacgtaccgcccgttcacgggtccgtgtaagggtccgtgtacgcggcgtgtgccacgtacgtggttttgcccagttttccatggcgcgcgtccacttccgtccacgacggccgtcgggcacttttttcccgtgtccacgtacagcccgttcacgcctccgtg

SEQ ID NO: 70744 - DNA, 601 bp, Triticum aestivum
  Clone ID: PAT_TA_70744
ttttttttttttttttcaagccaaacatcaagctcactctctcactgaacatactgaaatgaaattcagtcgtcacagccattaatgatcaatggttagcagagtgaaattaacccaaaaggaaagaaagaagaagaaagaaagaaagaaagaaagaagaagaagaagaagaagaagaagaagatcttttttcacaggtatttcaggctcagttcttccgggtgctccatgccccagtcgtgcctcccaagcgatatctccaggttgggcgcgaaggtgtcgtccgcgagcagctcgaagcttgcaagagatggggacgagctcgcagggcttgaacagtagttcccaaagactgccccctccacgcccccatgtacccccagcggcaggtgaccggccgcctcctctttagcttcctgaggagtatcttggagcgctgctgagtaatcaagcttctgacaccggtgcaatgggtcaacaatggcgacgcctttctcgagcgccactgctgcgtggtcagctctcctgtagtcgagaaataagggcgccttgtcattgaatgcaggatgtatgcacgagtaaatggaatcagaaatgcagg

SEQ ID NO: 70745 - DNA, 657 bp, Triticum aestivum
  Clone ID: PAT_TA_70745
ttttttttttttttttttttttttgcacatctaaaatttatcagtaatagatgttcagtttctgatccagaagctgggagcttgaaagtacttacttactcaaccaataaagcctttcagaccatgatgcgcattttgactctctaaaagactgcatttgatccttcgcgctgccatctacaaccgtgcgacctgcctccttgttgacaccgctgtcgtccatcaattttctcatcttctccgactccaaccattctccagctgaagcatagatgtttgaaaggagcacataatccccactgtcatcgctcctcgcctttagcagatgtctgttagcatgctcagccagttcgatctcaccatggaccctacaagccccaagaagcgtcctccagatgacagaattaggctccaccttcatggtgtcaatgaactcaaatgcttctttcagaagcccggcacgacccagcatatcaaccatgcaaccatagtgcttgacattgggctcaatcctgtactgctgttgcatcaacttgaagtactcacgccccttgtcaaccttaccgccatggctgcatgcgataaggactgcgacgaaggtgatctcatcaggcctgactctctctttcaacattttcttgaacacgtttatggagt

SEQ ID NO: 70746 - DNA, 336 bp, Triticum aestivum
  Clone ID: PAT_TA_70746
aatcaatcacgttcataatcaataccatatcagtacaggacaggctatttggtaatcacgtccaagagaatgagttgcaaaaatatgaacaccgctgaccaaaggaatgcagtgccgcatctttttattagactttcaccatcacatgcagttcctaacgctaattgtgatgccatcactttgtctgtaactagatgataccccgcgcgttgctgctggaattgcttgtaacatagttcagtgagatttagttacacgaaatgtgaatagttgaattaatagtatgagaactaaaacttgccaatcaactaactgggaggtgcacattaaggaaag

SEQ ID NO: 70747 - DNA, 450 bp, Triticum aestivum
  Clone ID: PAT_TA_70747
ttttttttttttttttttacaaattagatattaatagtttctcaaaacaaattacatataggaataaccacagttaagataacacggtgcaaaactccctaatagagaaccataactccctccaggatcaggatacagcatgtggtaaaacagatgccagggattacagaaacttgagcaagatagcattccacaaagatctattcctaataatccaaaggcgatgacggcactcgctagtgatggtgctgaagagatccttcgtcttgctgggccgaagaagcatccattgtgtgaaggggagcacctgagacattgatcaccttaccgaagcgctcggaggtaagttgcgcccactcacagacccctggtaaaattttgtgcaggtcagtattatcacccagatatcttgtgcctgtgattcttggttctattgtcagtttctcaaga

SEQ ID NO: 70748 - DNA, 535 bp, Triticum aestivum
  unsure (1)..(535): unsure at all n locations
  Clone ID: PAT_TA_70748
ttttttttttttttttttgatgataactaatttaacaattaaagagaattacatgccagatttactctactttcggaagctacatatatgcaacagatgcaagtctgccttaaataagtgaaagttttgcattcggtgggagtgtcttaaggaggggagctctaaccatatcaagagcagcactatctagtctaggaattggttcatctggatcccaagcatcagttagcctttgagctgtatctacagtcacgacctctattgcaggagcattttcaaccacgtgcataaggaattcagcttggccgcgtgcccctctgaatcctgtagctcgaacgtccttcagattaacaaatttatcttcacacggtggcatttcttgtctcaaaggtccatcggatgcaaaccgcanagtgccaatatcatgaaaatgtacttccaacttttcaatgaacggagcaaccttcaaaaagaaacaagtagaggattttgtcatattcttcataatgtataatcaacagtatttgcacatgcc

SEQ ID NO: 70749 - DNA, 402 bp, Triticum aestivum
  Clone ID: PAT_TA_70749
tttttttttttttttttggtagaaatgactaattttgtggcaagcagtagaaattgttcacaacatacacaaggaaatgaagttcggtacctgcctaatagagacaaagcgatctcgttgtgttacaatgtataaaaccccaatgcttagctactccgcaattgtttaaacatgatttacgaggcgttccatacactctttcaaacttccgaactagcacttcccattttaatatgactcaatctcctgcattactttaactaactgactgaaagaaacatcataacataacaaaaaatcataaatttggaaatattaattatacccctacattaactgattgaaatcagacactttagactgatatatcaactgaatccaataaaatgcttcgcttggcac

SEQ ID NO: 70750 - DNA, 631 bp, Triticum aestivum
  Clone ID: PAT_TA_70750
ttttttttttttttttttttttttgaacatgatatttaatgtttcatatatactcgtgccacccatccacccactcgtcgggctttagatccaagtcccgagccacgagttcaatatgtaattacattgattgcatgtatgcactaagcaaagctaaaaatgaaaaattacataggcgacattggattggtacgatagcatctcgaccgcgcgatctccctactatgcccgttgcttgtatgagacggaagcctgacgaaactcgataataatggtgagatcctgacaatcttgaacagcttgcagtcgatgacaacaatgccatctcgatcagcattcttcacgcctgtagcgttcagtctgatgaagaacagcacagcacttctacggtacatgatcctccatctagcaacgtccgtccatgaggtgtgttcgctttggtcttcggagttcacatacagtacttaccacgcattcagctgctaatcttgcagaactgggcgcgacgcgccaattcaaaataccagtagtagcccatgcgctgtaacatgactacatgtgactcaccaatgagcagcagaccgattgctgcactcaatgcttcaaagcatctcaaaagaatggtggcaat

SEQ ID NO: 70751 - DNA, 516 bp, Triticum aestivum
  Clone ID: PAT_TA_70751
ttttttttttttttttttctcaaacttagcaccgaggcattgtcgtacaatgtttagcgacacaacatgcaacttagtttcttggagacacacaatggcaggacaagcctgattgaccacctggaagaccgcattccgacgagcaggtgcatttagccctcggacattccacaccatgatcctcaaaggttgctcattcatttcaatcaccaaccgagccaccaacgcgtgcattagcacacctccaccccatccagaggctcaaccggcgattcccacccgaacaaggcgagtacagcggcaatgtgcacgtccgaaagcggacgggaaaataggtcgacgtacatcctaagtgcttcttccgaaattgtctccccttcatgcgccaggcagagctttctaatgagcactttctgttgcttggaggccccttgcttcgccagtcttgcactccttcttggcgttacgtccagtcttcttttcttccttgggttgcgcgtttgccccgccggcgcg

SEQ ID NO: 70752 - DNA, 349 bp, Triticum aestivum
  Clone ID: PAT_TA_70752
tttttttttttttttttttttttttaaaaaaagagacaatcctatataacatttacaatcttgcttcagactttacacagtgggctggtgtaaagagggtgcaatacatagcaaaccacatcatctacttaactgctcctgcttggttgctttctcggaaaattgcaaaccatataacccactgcccgcacatatttatcattaccttaatgacaaaactaagttgggggacataaaacatggcatgatccaaaatacaattttcttaaagcacggtagaccatcgagtattttatagtataataggctataggagagcaagattgtccattatcatgatgaggcgacg

SEQ ID NO: 70753 - DNA, 599 bp, Triticum aestivum
  unsure (1)..(599): unsure at all n locations
  Clone ID: PAT_TA_70753
tctgtttctgttttacagaaaaaaagaaaggacaaaactctgtttgggtggcgcaatattgacatacaattataatttaaaacagacctgataagtgccacacgtgtggcacaaacacatagcaaccccaaacattttttatgataagtttaaggccactgctaggcgccggcgcaccggcccaactttcggccggtcgccaagcagccgttggattcaggcaaaagtagccgcatgatttcctctctatccttccacacatcatgcctcctcccacaacgagtcaccacactcagccaaccgcccccaccccgcggccttgccgcacaaagcttgcgcaccccgcggcagccgccatcgccatgggttgcaggtcgccacctctctccgcagctcgccgttgctgttgtcgcacaccctccacatctcgtcgtcgatccagcaacaccctcctgctgcatgcagctcccgtcgatggccggatgcagctcggacagcaaaaactcatgcctcncatcgtagcacggcgtcgccgtctctacgggcctccattgtcgatgtgcatcgtacctaaagaaatctggtggtcggttgaagca

SEQ ID NO: 70754 - DNA, 549 bp, Triticum aestivum
  unsure (1)..(549): unsure at all n locations
  Clone ID: PAT_TA_70754
ggagtgcataaatggcgcatgcatcttcaccaaattacaggtttaaatggcgcatgcatcttcacaatatgacacctacgtttcaacaacatcaacctccngaaagatcaacgccagggacaccttcagggcagaggatcgccagcactgtgaccttcttgtactgcggtatccgagtaatcttgaaccggtcttcgtcggtcagttcccagtcaaagatttcgaggttctcctgaagcctctcctttttcatgctcttggctaccatgctcgctccttgctcgaagatccatctcagtgagatctgagctactgattttcctctagcttcggcaatctctttcagaatttcagactgtagcactgcattgactttggatgtcctgctttggcctcccaggggagaataagcagtcacatgaattcccttctctttgcagaattcaatcagttttttctgctgccaagctggattcaactcaacctgattcactgctgggggggatttctgcaattgcaagtagctcctgcaatttcttcgttgtgaaa

SEQ ID NO: 70755 - DNA, 492 bp, Triticum aestivum
  Clone ID: PAT_TA_70755
cttgagacggatatttaaagtgacttggttgcattatgaggtggtcgtagatggattgcaaaaggggaaaccagggtgtgctccaaattgatgaatttccatctaaaatatgtatggaagagttggaaatcaaaatatgacgtaattttataatggaagaccaaaatgcagattttggggttttagtgctggctctcaataaataagtgttgggataatatttggatgttaggactttagaaaggaaactttctggatcatatctgcaattctccaagctcctgatagaatgagacccctgttcattgcttgaatgtttctgattcctaagccatcctcacattttggtatgcatatgtccttccatgcccagagatagagagttttagttgtaggctcttcattaattcttgtccaccagaagttccttatgatagctgtaagttctgcaatcaacttccttgaaaaaaggatgttagacatatgatatac

SEQ ID NO: 70756 - DNA, 499 bp, Triticum aestivum
  Clone ID: PAT_TA_70756
ataaatattcaaatcacaagcgacaacctggaccacaaacaacacgtacttcactgacggttattattacaacaagagtcttccggttaaagttaacagctacagagccctcaacaacacagaacaaaaacaatgaatctaaatgaagtcgccggcaaattgcatttggctctaaggtagcattttcaacaacatggagttcaaccctaggcttgctgcaggtatttttcctgtgaccactgacgccacaattcgagcattttgccgctttcctttctttttgaggaagatcacctcattgtggacatgtggtgatcttgtgccctggttctcaacatatactggagaagcgagttcgtttacttgtcccgcatccatttccagcttgtgcatttgctgtcagtatgtacttcttgctttttgcaccacgatcatcatacggaggtttatccctgcaagtgattggtcgaccgggcttttgttttcgttctggagcttt

SEQ ID NO: 70757 - DNA, 222 bp, Triticum aestivum
  Clone ID: PAT_TA_70757
ttttttttttttttttttttttaatgttgccaaagacatttgcactatatgtttcatattgtgaaaacagagcccagaataaaaaaaagataagacgtttgatatatctaattcatgtcacatgcactatgtaggaagctagtatatgtcgaaaacaccggcagactacgcaaacaaacagacggtggaacacatcgttcgacgaccatcacgggtcaccgt

SEQ ID NO: 70758 - DNA, 527 bp, Triticum aestivum
  Clone ID: PAT_TA_70758
ttttttttttttttttttgtggacaccatctaaatttatataaaattaggaacaacttaagcacatacaaggatgttacatgtgtttatcaaatgaatcgatgtaatttatatacaaagtagtggatcaattaatgtaattgagcaccaccacacaaataaattaaattgaacaatattgctacaatatacgtatgatggtacgttcattaaccaatcatattctaaagtgatcaccggagaaatgatcacttgaactgttgtttgcttgcatatgtttgtccgaacttccatccaccgggcacaatattctttaactcgattgtctgtccatctgtgtcaatcagcctgaatgagagcattttaccagtaagatttgctagagagtgtcagttggcaccccagttacgggacattggcatccaatcatttgaatcagagctcttgacatccatcgatttaattgagccggcagctgcgacgttcatcacagtaactagattgaagtaatcatgaccatcgattttc

SEQ ID NO: 70759 - DNA, 352 bp, Triticum aestivum
  Clone ID: PAT_TA_70759
tcgtcaatatcgtcttcggcagcatctgctccttgcaaaaagcgatcactgtagacaaacgaacatcatccaactatgaaactggcaaaatcagaagtaggagtatcaattatagtgctgaaccgatgaaacccaagccacatactccctagaaggtgaccgtgtcgagcatcatgcccagcgtctgcacgatgttgcccgacatggcggcctcggctctctccccaagctgcttcttggcgtccggcctgcccgccctcaccacgggcagcctctccggcggggtcacgtcctcctccctgacctgcgcgtcgtactgcaccgcgaggtcccggatcccgctcacggggcc

SEQ ID NO: 70760 - DNA, 422 bp, Triticum aestivum
  Clone ID: PAT_TA_70760
ttttttttttttttttttattaaatttaaagaagatgtggaaacattattttctcagaagctcaagtatagccacacaacaaccattcaatacatccatcttaagtccccatgctccattttgtatatatttaggcacttatctacggatatctaaggactagctgatacattataaaatacaaaccattttacaagcttctgtagatatctcacaagtcacaaactcacacaatattatcacgcgcctaaaggaccattttcttatgtcaaaccaggagcctgtaggactgacctcaccaattcaaattcttgtacacatgggttcagttcaggcattatgtgtggacgcctgaagaatccattgcgaatctgactggcaatgtctgcaacagcacctgggccatgcgggatgaaaactgc

SEQ ID NO: 70761 - DNA, 189 bp, Triticum aestivum
  Clone ID: PAT_TA_70761
ttttttattttttgtttttttttttttttttttttttttttttttttttttgaaaaaataaaaaacaactgcctggccccgaatcaagggtgtattgatccacaaaacaaaaatttgtaatccgttttttcacggggattatttttccaaacatacacacgtcatctatacatgacatatttattcttc

SEQ ID NO: 70762 - DNA, 390 bp, Triticum aestivum
  Clone ID: PAT_TA_70762
ttttttttttttttttttaaaaagaaaaaatccgccctttgtaataatcttgatcttgtatatctatacacaattatccccgggaaagaaaaaaatctatacacaattacacatcaataaagaatctccagcccaatgaaacaaccaaagagaagtatccaaaaaaaataaccaaagagtaaagaacaagtgcaggcgtgcacgcctcaaggaaaataaacaaagaaaaagtaagaaagaatggaaacgtatgcctccttttttccatggtgccgtgtcttctcgtctcattttgccccggttcacctgcacgcacgcacgacgaacggaaaccggtgggacgtcgctgtggagttgttaacgagtgatcgctgctccttgattttgact

SEQ ID NO: 70763 - DNA, 487 bp, Triticum aestivum
  Clone ID: PAT_TA_70763
tttttttttttttttattttttttttttttggaaaaaaaaaagcaactgcatatacgtacatctttcctcagaaacttacagcacgtgtataacgcagaaagaacagagagaacatagagcatgtctgtaaacagcaggcaggcaggcaggcaggcagcttgtctttgacccacggcattaacagtttcaggttaatcttcaaggcacacattcatgacagtgcatccacatttttagcaatgttctcatcacaccatgccacattgccacccaccctttgcaggacatgccattgcaagccttcagacactcttcaagtatcatctttgcaactgagcgcctgtccgctcatcttggttccttcggactgcctcaagggtgcacttctgtcctggttaagactttatccaactatgaggttctctctttcgcttccagctactgccctaggggcatgtttgttatccaaagtgcatcttgaatgtc

SEQ ID NO: 70764 - DNA, 590 bp, Triticum aestivum
  Clone ID: PAT_TA_70764
ttttttttttttttttttgaatttaaactctcatcgaattatacagaatccaaatgcccatgcattcaggaattaaacatcgaatcaaacaacaacaacacatcaactcacatcgaatcatacacgaatgacacaaatccacatgcccatgcatgcatgcaactcacctcacaaagaaaaaaacagcaccaacatcactccttgatccttatcggcggcacacgcgtacgtccgcgtgttataaccatgcatcttgataacttaccccgatcagacgtagcactcgtagagcttgatatccatctttaggcggaagtagaacaacccctcggtggcgtcggtgcggatcgtggcgacgccgcgcgccatgaataagtcgccggtgcccccgacgacggaaaagtcacgcgtctccgcgtccatgggatcggcgcccataagattgagggtgccccttcatgcctttgagttgaacacgagcgagaaggagaaccagccgctgtacgactccttcttgtcgtagaagtagaaccctgcgcgcgcgcagccggctcctcgtccccgacgggcagcgccgtcccctccgtcac

SEQ ID NO: 70765 - DNA, 403 bp, Triticum aestivum
  Clone ID: PAT_TA_70765
tttttttttttttttttttttttttttttttttaaaaaaagttggcatatatatatttgagtgcatgttgacgaatatatacaagttgaaaaaacaaggaggtgaagacacaggaggcatagtactatagtataccagcttgattgcatgactgagggaaggggaatagtgcgagtgcaatttaaggttgagtcatcccctcttgactgaaggaaaaaaaaatagtggcaacatcaatgcctgcctcttctttgtttgcagtagtgcggtgcactacctctcgacctgccttctggtcggacgtatttctctctttctaccttgagcttgggataattgggatgatgtttggcggcgatcatcagcgctgcctccagtatctccacattcccactgttagcgc

SEQ ID NO: 70766 - DNA, 554 bp, Triticum aestivum
  Clone ID: PAT_TA_70766
ttttttttttttttttttgtataagtatataagtagtttagaaaagataaccaaaacaagtgaattaataaacccaaaaaggcaagcaacatttcgctcctgaaccaagaaattaaccgagatgcgcatgctgtttcgccgacgtatgtggatcgatcagtagttgacggcggagcacttggatcgaacctcgccctcgctgccggtgaggacctgcacgttgccgagccagcgcatggactcggcgaattggcgcttgaattcctcgggctctcgggccatttcctggacgaagctcctggtccgggagtcatggagcatcttctggtccgtctccaggagtcccatcctgcgctccaggttcttgtagtagccgttatcgaacgccgtgggcctgacgccgtcaagctccactcgctcgtgctccgcgtcgccgcggcggcacttgcgcctcaggaagtcgccgtacttgccgtccagcgtctccggcttgctcttgcacagacgcggcttcacggcggcacagctggccttgccgatggtgtgcgcgccgg

SEQ ID NO: 70767 - DNA, 385 bp, Triticum aestivum
  Clone ID: PAT_TA_70767
ttttttttttttttttttgttgcaacagtatcatcattggcttggctcttcgacgaagctttcaggttacagcgcaagcagcctccaaattttgcaaatatgtcctgtatgcatgcgtatacagaaatatgcaggtggttttcttctgcagttcgttatgctgaagatgtcaccacaatatcttccctatttggcccatttgactcagctttgacggcataatcattggcagcctccaaaatcttgcaaacttctctcctgtactcctcagttgctccagattttatttttgattgcaaaatgcaccacttcttcatgttcacaccaatctttatatccacttgacatgttgaactagaggttgtccttagagacacctgcagtg

SEQ ID NO: 70768 - DNA, 417 bp, Triticum aestivum
  Clone ID: PAT_TA_70768
tttttttttttttttttatttaagaaaaaacacaggattctgatgtcaagacatctcctgttgtattgggaaacaaatctcaggaattaagataaacagcctttggctgcaccacaggaaaggtacaagaattctagaatttgagtttagggtttccaaacttctagtagtgcctagcatattcaagttcatcaaattacgctgatggaccatctgcatgttagaggcgggctctgagattgcaaaagagtttgatggcggccgccgaacatattagtgccaagctccgaaggtttattgaacatgtcatttcacacatgggatccagttcttgtttcctgactccatgaatgaatataatttcaggtttagatttctcctgattgattagttgcattaggaacttcatggctgtcg

SEQ ID NO: 70769 - DNA, 343 bp, Triticum aestivum
  Clone ID: PAT_TA_70769
tttttttttttttttattttttttttttttctttttttttttccaaccataataagaatcaacaaagtcccatacacaaatgatagaatgtttaaggctctcttatgatgggccacaacaaacaatcatcccaatttaaataggtttgccacgaattgcttaaataaaattctgaaaacatgttttgaactacatgatgcttctcaactcgcgatgatttacaaagcacaacagtttggtttactttcaatttgagtgaattactgtctcaaggattatcctgggtgccttggctttggtcttcttccctgcattctccatctcgcctgctatcttctttgtc

SEQ ID NO: 70770 - DNA, 554 bp, Triticum aestivum
  unsure (1)..(554): unsure at all n locations
  Clone ID: PAT_TA_70770
ttttttttttttttttttttttgtcaaaaggacatattaacgagttgctcttaatcgccacaagaagcgcggtaccaacggtgaccggcgaatcctgatcgaataatagaacactagtactacaacattactgctgcattgccaggtcacaaagctagctgctaccactagcttcgtttaggtacgataagactacggctactgctaatactaatgctaatgtctctgtttatactcaaccgctactacagcatagccaatttcttgatgttgatggggtacgcttcccgcggcgactcggagccgaatcccttgcgcgcgatcctggcgttcaccacgtctgtcgggtggagcccgtcgaagaagacgtacttggtccggtccctgcagatgggccctcccttcctacacagcaccccgngatgaacccagctcactgcagcaagcccgatacgtctccctgatgccatgtttccttgggtggtctagcaggtccttgatgatcttgtaggagtcgacgacggagaagctcgcgccgggcatgcgcggtccgc

SEQ ID NO: 70771 - DNA, 385 bp, Triticum aestivum
  Clone ID: PAT_TA_70771
ttttttttttttttttttaagttcaaatggatacgacactgtaaattatgtatatcttttttctactagtactatctttcacaaatcctgcgaatcaaataaatcagtaatatacatccgcaagatcgtgcgttgcacgggcactggttgcttcaccaaaaaaagggattattgaaccgttggacatacggagggctgcagatcgatcgaccggttactcgggtggaaacgaggtctaagttgtcagccagaggcaaacagcttgggagccaggtcgagcagggcgtcgagcgcctcgggcttgaacttgcgcgcgaacacggcgcacacctccgccaccccgccgttgtagtagcagtcgccgtatccccgcctcatctcctcg

SEQ ID NO: 70772 - DNA, 503 bp, Triticum aestivum
  Clone ID: PAT_TA_70772
ttttttttttttttttttgaagatgaactgcttccatgcgatcatcgaatacaatttgtttcataaaattacaagaagctgagagaaagcatcgactttgctttcagctctgcctgattgaactagcagaaacagaatcaacccatggacaaacaaaacaaaacgttggtgcaatgcggctgctgaaccctactttccgatcttggagaaaagagtttcaaaagccccaacaagggacttgaccctgctcttcctgctcttggccagcctgctcgccgtctcctcgatcaggttgttggacagcctccggctcttcttcctctccagcgtcttttggtgcctcagcgtcacctctggcaccatgaagcctgttgcgctgcctgagatgccgctccctcgcctccgcaggctcctggccctgagctggatgccgccgctggacccctcgccggctgctctcccctttctgaatctgagccgcgtgggcttgtcttgttcggatg

SEQ ID NO: 70773 - DNA, 443 bp, Triticum aestivum
  Clone ID: PAT_TA_70773
ttttttttttttttttttttttatgcaacttatgtttccaggaggccataggccagtatatatacatgtacatgtgtggaatatatgcagtaaaccccttatacaatagggtaaatacgaaaagattacatggctatgtatataactctaacattagtaaatgattaagagatgtggcattcggccatgtattctggatgcattggcgcgctcaaccatgtatatttccctccagtttaaatgttgtcctagtattacgagaacaatcggtattcctgatagtattacaatttgttttttcaaggaaaaacacgtttggagaggggaaagggagacaaccgtccaatgctcattaagtaggtgtggagcacggatgggagcaaaaccaatgagcatgcaagccatgtccagcgttgtccttaatttcctttccagtgaatgac

SEQ ID NO: 70774 - DNA, 411 bp, Triticum aestivum
  Clone ID: PAT_TA_70774
tttttttttttttttttttttttttttttttttggccccccccccttttgccatttcttgtttatatacagcacagtttttacaaagccaacaggaagcactgtgaacaccagcgtcaaacaaggtacttcattcaggtacaaaacgtccaacaccgcaacagcccgggggtaatcagaatggaacaagtcctcatctttggatgcttcgctgacttaaatcagagtggagctcgtccactcgtccgtgatcgtttaacttgatccagcggccattggaaaaagcaaccacatcggttcactcattgttgctgccaatggactcccgcataggcatagccaccgagcggcacattgcctcgtgcgcggcgttgaacggagcctccatccccaaccaagtactgcgcggggc

SEQ ID NO: 70775 - DNA, 453 bp, Triticum aestivum
  Clone ID: PAT_TA_70775
tttttttttttttttttttttttttttttttgaccaaaatatatatttatttagggataacctccggaaagtatcataggcctaattagttgcatccaaattacattgaccattatgatccatcttaaaattgtcaaatacaaaacaaagtagtaacttgtacaaagattttacataagctaaattttccacaaactttagaacttctctttgttgcattacttgaagagaacgtcgagtttatcaccgtcatcgccctagttatcatattgctcattgccacatggatcatcatcaccctccacatagatgtcatctgccactttgccactctccagtcttgcatcacattcccttgctttgctactgcaagatctgaagagaaactacagagtggggtttcaaccttgctgcaagccaattaacctacaagagattattcatacaagatac

SEQ ID NO: 70776 - DNA, 491 bp, Triticum aestivum
  Clone ID: PAT_TA_70776
ttttttttttttttttttttttttttttaaaagtccttatctaattttagcatataatttcaaaaaaaaatatctctactacatctccataactattcttcagtcttggacaacatattcatttagttggaggatgcagccatgcggggataatagtttttcacccattgcaacgcacgggcatatttgctagtaaatatcaagtctttggtcaatttcttcttaacaagtcagctttcaacatgccggacagcccgtgctacaactgaggtaatttcttctcaacaagtcagctttccacatcgccggacagcccgtgctacaactgaggtacgcatgatctcatcccaagtaaaattcaaatgatccttcatatgtgtcttcaaatatagctgtcatcatcattaccttgccgtgtacggacaatctgcactctttacatgccaagttaaatgttattcaaatagtatgatatgggcagcgtactaact

SEQ ID NO: 70777 - DNA, 475 bp, Triticum aestivum
  Clone ID: PAT_TA_70777
tttttttttttttttttttttttttgttgaacctatttctatttataaatgtggccgtatgcatcataatgcagaggccggggagtccccttttgaaaaaaaatggtgtttcaaattataagaggtctacttgccctccccacgagctgagcaccacttcagaatctcctccatcttgtaggcatccgcaacatactcggcctcggacccgacctccactgaccagggctccgggggtggacgctcaggagtcaggagtgccatggacgatgatgccaaggtcggcgttcggaagctgcaccctcacactagccagtacccgcatagcgccctcatacgctgcagagtactgctagtccagaagctgatcaggtgccttctcccgcagcttgacgacaccgtccaaggtgtcgtcgaggtccttctcgccgcggtatagcgttcacacggcatgcctagcgtcgtgcacatccgt

SEQ ID NO: 70778 - DNA, 542 bp, Triticum aestivum
  Clone ID: PAT_TA_70778
ttttttttttttttttttttttttaaaaaaaacccataaaaggtcttttattaattggataaactgttacacacacatgtaaaagaggatttatgtcacatttggatggagtctgttttggcatggagattgtaattgtcaatcacaatttagttcaccaataattctgtaataacaacaaccttcaaggtcacctcatcgacctctttacccgactcctcattgaacatgtctatgttgatatcctcagcaccgaggccctcattcacggagacgcaccgcataatgaagaactcgtccttgcacaccgtcgcatgtggcgccctcttttgcgcttgcagtgttaccatgatattgcacttggatcgtggcggcacaacacatttctccagctctatgcagtattgcagtgagcctgtcatttcgacatcaaaggcaacataatcattggttatgttggttagctgaagtgaacacggtatcggcttgtttatctcgaagggaaaatcagctcaagcctatcaaactcaagcagctcccac

SEQ ID NO: 70779 - DNA, 624 bp, Triticum aestivum
  Clone ID: PAT_TA_70779
ttttttttttttttttttgaaaactctggcctctgcatcattgtgatgcacaccgccatttttattaaagttgatgcaaggtaagaagacaaatacatcaaagagaagagtacaaaacatggacaactagggcttcaccattacaaatatatgaaattaacaccaacgactaagtcagacttgttccggagcaacgtcttcaagaagagataaacgcccttgcgccatcgtcaccacgtccgttcagggatgggcaggacaaggatcttcatccaggatgccgagaccaaccagtgaacacatcaacaagaagacaacgccttcaacaagaaaatgacgcaagtacgtcgttgctgagcccgaccaataaacatcagaacaaaagttttcaccacggatgtgaagcggtgtttcagtcaccatcttgaagacggatctaccgatagcgcaccagcttgtactccatgctaggccgtcatggcgctagcggaagggtggggcaacctgtccatggcctcctgttgtgcaaccagacctgtgctgcttccggagtcactctagcacatcgtctgcctttgttggcaccacgcatactgctgtccctctccttacttcccggcatcc

SEQ ID NO: 70780 - DNA, 502 bp, Triticum aestivum
  Clone ID: PAT_TA_70780
ttttttttttttttttttgaaaaagtgaacaacttgtacatgaattcctctatgtactatggtatagaactacagatcaagaactaggacgagaaagacatccgcgtgacaaatagtacaacgagcacacaccaacaccagccggcgaaggaattcacgctcaccttccgacaaaccaataagcactgcctgtccccggcaacgtggcgcctgccttgctggccagtgaccgcacccattcaattacttcgttcgtggccgtgtctcccaagcccgcggcggagctgtaaaacagagcgacggcggccaccaaggcgcgctagctagaatgcggcggccctgtccttgacgacgacgtcctcgacctcccgccgcatgagcttctcctcgtgttgccgccggcagaacacacccaggcgttcacctccagcgccacgcagccgccgacgagcgtcgccagcgccatgcagtagccgagcttccagtaggaggcgccgagcct

SEQ ID NO: 70781 - DNA, 192 bp, Triticum aestivum
  unsure (1)..(192): unsure at all n locations
  Clone ID: PAT_TA_70781
tttttttttttttttttttttttttttttttnaaaactgacccggatgccgcaactgctttaatggaggtttcttctcttcaaaacttcaacccaattctcatggttatcatggggctgcggccgttcttttacaaggacaggtacaaggaagggtggaatttaaatgcctggctaggcctctctttgggag

SEQ ID NO: 70782 - DNA, 210 bp, Triticum aestivum
  Clone ID: PAT_TA_70782
ttttttttttaacccccaaacaaatgatttcgtgtgagtggggggggtatccaaatttcctgcaacccacaaaatcaaatctaaatggcatacgtgagtgcccaataaaactaaatgacatgtgggaaataccccacaaaccccatggagtccagcggggtttttttcttgattcccttccacggccaaagggggaaaaccccatgctct

SEQ ID NO: 70783 - DNA, 195 bp, Triticum aestivum
  Clone ID: PAT_TA_70783
tttttttttttttttttttaataggggcacaatccatgtgaatcatataaaaggtaccagtaaaaatggattgctggtgtttttatagagtctgtagtaccatcacaatcaaagttcgtactgacataagctccgattgtgctccggccagaaaaagatacataagtacactgtggccaaagtatttcaaactga

SEQ ID NO: 70784 - DNA, 280 bp, Triticum aestivum
  Clone ID: PAT_TA_70784
ttttttttttttttttttttttttttttgggcccggaagatcaaccaggtcaaaaatttccaagtacattcccccgaccatcaatcaaatgccaaaaatattttacggcccctcatgggaaacatacccgtaaagtacaaaaattgttgacggttacaatgctttcttgcggtaaattacaaaaccccctatccctacgggattacgggtgtatcaaaaacctttacggatgttgaaaatttcttcagggacccattcattttgccccggcctttggggt

SEQ ID NO: 70785 - DNA, 434 bp, Triticum aestivum
  Clone ID: PAT_TA_70785
ttttttttttttttttttttatagaaaatgatttaaactttaaactcgtgtcaagtgtccactattcagggtgaagaattgtcttctctctacaccgcacggagtagtgcacaaactgcgcaaggttgagtaagctcagagcagccatcatccagaagaaatagtccagatgcccttcgttcaggttgtccgggatccacccaggcgccccgccacgcgtggtgaccaccgcgacgacaccaagcacaaccgtgttgaagtaaaacccggacgcgatcgagagctgcgcgagcgccgcacagaggctcttcatggcgtacggggcctggtcgtagaagaatccgtcatgccgatgcccgcgaagaccccgccgcgccgtgcaggacgtgcgacggcgcctgccacaggatgctcatcgggcacggcacgttctg

SEQ ID NO: 70786 - DNA, 450 bp, Triticum aestivum
  Clone ID: PAT_TA_70786
ttttttttttttttttttaagtgatgatgtactgcatttgtttttccttttcaaattacaattcaacagagcaatcaaaagaattagccaaatccaattacagttacaacatttaccatacccctcacgctcacatccttgtgcccttccgtttgaaaccaaaaagagcaaaggaagggccctccagtagttacacaagttaacacaaccaaactacttatcaaacagctgtagacatggtagtttccaaaacatttggccaccaaacaacaagtcacaatcagtggtatgcaatctgtatgcagtatttctgtgagctcaggttaagcatgacatccttctcctgtgctgatgcaggggagctctctgcaccggcctggaaacaaagctctcccttggccgagggcgaggcgccgacgccgccgtcgaatcgatgctgttgctgcttac

SEQ ID NO: 70787 - DNA, 444 bp, Triticum aestivum
  Clone ID: PAT_TA_70787
tttttttttttttttttagcctttaatgtcagctctccaaatagtattaacacattatttgagggagctattttacggtatcttggtactcccaaaacatgtgctggagtaccgaacagatcttgccgttcgttgtgaagggtaacttagttattttcccacgggtacttccgatattctccctgtgatctcgcatggatgccaaatacagctcccaaaagaaaaacaaaaactccagattgagtgccagaaaaagctcccgttcgttcggccggaaatcccgatcgctcggtgcctagcaatggagtggccgcgccacctcaaacctgatccttcgctaccgcaagccgccctgctgcgccgcccgtcgagccgccaccggccaacccctgtactgcgccatggttgcggaaacgagtcctcgatcagcttcacggcatagat

SEQ ID NO: 70788 - DNA, 346 bp, Triticum aestivum
  Clone ID: PAT_TA_70788
tttttttttttttttttttttttatttttttttcttagcattattatttgtattatataattacatatacatggtaaattcataaacgagtaacaaacagcggctacaacaagacgattgaaaggagaacacctaaaacctaacagcgcgagcacacgggatccgcaaatactaacaactcatgcgagcacacaaaatccacaaaaaactacacgagccacgaagcagaaccaactgctaaatactcaaataggaacaaaatctacaacacaaacgcacgaacacactactaccaacaaaccccagacctggatctggaagctgcacaatcacaatcatgaaaaat

SEQ ID NO: 70789 - DNA, 369 bp, Triticum aestivum
  Clone ID: PAT_TA_70789
ttttttttttttattttttttttttttttttttgacaacaatttaacagcataacaaaacaatatattcattcaaggttcactgcccagatgtctgtattgtttcgacttcaaaggatctacctctgcacaagtgcaatcactaagaatgcatgcagtttattaacatagcctgagtagtgagtaacacattattatgcagtaaaagaaaggcaatagatagatagatagatagatagatagatacactccatactaacgctcacataactatcggtcacaaatatagaaggtgcaaaataacagcagaagctaacgatactgatcgatggcagcatatgatcagaaataataccagataacatctgac

SEQ ID NO: 70790 - DNA, 408 bp, Triticum aestivum
  Clone ID: PAT_TA_70790
tttttttttttttttttttttttttttttttttttcagagaagagaaataaattagaatttcataaagaacatctatgatgattccttgtgcattcacatcatctcgcactgtagctagtcccaagacatacacattcagaacagaacactgcaatactatccatatcggcccatcaacaccacacgcagccaagctgacactaggaatacaagagaaaacatcggtgatccggcagagtcagtctagatccagatcagtttgtctcatctcctggattccatatcggcccatctccatctttgttgtgcgaactgggaagatcgacgcttgtgctgtgcaccatctggataagggcagtgaacgttgctgcaacctcacacattggtctgcgaccaacagtaactga

SEQ ID NO: 70791 - DNA, 395 bp, Triticum aestivum
  Clone ID: PAT_TA_70791
ttttttttttttttttttttttttttttttttttagacacctttttgtcagatatcacttggtgaaaacaaaattcttcaaatacaaccatggatttaaatctgattgaagaagctaattagtcaagttgctgatttcttcactaattacatgaagcaacatgcttacattcggaaactaaatcaggtaggagattttcccaaattaagtattcagtgttcttcagtcatcttgtctcataagatgccgcagcatctcaaacgaattcagggagtgaagtgacattcgcaatatgtttcgaccatctatcggctcctacgtgcagctatggtgcagagaaagacatcgatcaatctttgaagatgacagtgtctgcgatgaccatgagcgggcca

SEQ ID NO: 70792 - DNA, 329 bp, Triticum aestivum
  Clone ID: PAT_TA_70792
tttttttttttttttgccagtccaacttttaattcatgtttttgcggcatcgcttcactttagctgtcgtacacaattctgaattcctgtactgtacccactaaactatacccacttgccaaggtacacaattctagccgtatcacaaagcagagcagagtatagcagagcaatcaactgaaagaatataaatcacaaatagctatggcctttggtgcagttcttacaagcactctagttgtcaatgacacataatttggtgcagttctgcttcagcatcacttcagcctttggatccattatcatgcgccttctcctttcctcactct

SEQ ID NO: 70793 - DNA, 441 bp, Triticum aestivum
  Clone ID: PAT_TA_70793
tttttttttttttttttttgtcttgcaagtaaccataccattcataaccagaattttgtagacatcaagtggagtcaaaaagtgctttcaatgctaaccgtcggaggaagacagtattcagcatgtctcctaagaacatagaaaccatcgcaggtacttgtatccgaggttgctattgtcctgcagaaggaatgtatgatgactttctcgagttcttgtggtttaggacccaagcttgtgagctcaccttactaattaagggggttcaaacgggataattaatgaacgtacatgtaaacagaaatatggaacattactaacaaagaagactgctacatgaaacagaactaaacaggaccaccggaccatctcgtagaacatctgacacagcttgcgacaaatatcatgttaactcaaataatcaggtgaacctgcaaaacg

SEQ ID NO: 70794 - DNA, 393 bp, Triticum aestivum
  Clone ID: PAT_TA_70794
tttttttttttttttttttggggtgaaattttcgtgtggaatagtataaatgaatcctaagggacaaaatcatatggattgtaatctttcgaatcaaacaacgcacgtaggaaaaatcccaaggttagaatcctaaaatgcttttgacaatcctttgaatcgaagagcccttagagatgttggaagcgaaaaactttgacactgtacacgctgttaagttgttccatcattatgccgtcgttttagctcatcaaaagcacccaagctctgagcagtgaacccgcctgatgaacccggaacgcgaacctgacaccctgatggagcagcacttcactgttctgctctttcagacgtttgaagaatgctgtttccctggtgtgatctttgttgatg

SEQ ID NO: 70795 - DNA, 380 bp, Triticum aestivum
  Clone ID: PAT_TA_70795
tttttttttttttttttttaaatgcactttgccatattttctaaggtatggaaattatttcgctcagacagccataactgaacatatcaacccaaataaccatcacccactcttaaacctcacttttataataaaatccactaactcgtgttcaaattgaaccagtaatcgacgccgccttggcaggccatcaacaaaggacaagggcggaaatgaccttcctatcttagtgctagtaccacctgcttatatactggacccacccttcatgccgggctctaccacaatggcggcacataaaatatatcagaataatgtaccaccatttatgttcttcaagcatggcggtgtgagcttttcagtggagccagacacggtga

SEQ ID NO: 70796 - DNA, 469 bp, Triticum aestivum
  Clone ID: PAT_TA_70796
ttttttttttttttttttttttttttttgttaaacatatatataatgcagatcatctttgatggcaaggctatgcaaatgttcaaccatcattcagacatttagtcgtcacatcaggcatcaagaatttcttcagacattaaactgctacagcattaacgggataacatctactatcaactcctcacaggaagagaatatcctgataaagattgttcttaacagctgactgagaaaaatcaaattaatggcacacatacgccatagaaggtacaatagcatagatgttttgcctcatttatttcacatggaatagaaagcgcaaaatattgtatgacgaaatggggagactggatattacatggactgcggacagaataatggatagagtaaaactcgagtgataaggaggatctgctatggcgtaacattgattctgctaaaagctcagaactttgtgcccagtgaac

SEQ ID NO: 70797 - DNA, 376 bp, Triticum aestivum
  Clone ID: PAT_TA_70797
ttttttttttttttttttggcaaccaaccccgtcataatctattttggctacccgtggtgcctttatataataataagctcatattacaaatgtttgactcaaacacctaaatctcttgtgtagcctaactgtagtcctatacacatattcaacaaaattttaacacttccaaaaaaaacctattcatgtactaccactggacccaagattctgaaaaacttgtccctatgacactttggtgttctgcttctgcacatctctctacatttacaagctacagataaaagaaccacatatctgtcatgctaaaaatgttgaaaccatcccattggctgaatgcctaaaaccatgcaaatgctggcaacactatacacc

SEQ ID NO: 70798 - DNA, 188 bp, Triticum aestivum
  Clone ID: PAT_TA_70798
tttttttttttttgttttttttttgttttttttgcggcaacgtatgtcttaaaggtattgagttgcatggcacccgtgcatagcaagcaagaattcgacatccacttacttcggatcacatttgttccactaggtttttgaagatattatcaagatatccacctactcgctccgggttcatgtataaa

SEQ ID NO: 70799 - DNA, 302 bp, Triticum aestivum
  Clone ID: PAT_TA_70799
ttttttttttttttttttttttatttttttttttccatcatgaatagacaaggaaacgatgcttcctcaagaaatccaattcattaacacttaacaatgttctgaattttaccattgcgtatgcaatgtaacttttatgcctcataccaaactaacgaacacacacacaaggtaagctgggatcaaaccccatgggtcgacggggattcaaagccccgatcccggtctgggagggggtaaaccgaacagagccccaacgagaatacccacctgggtcggatccattccgctccttggttctg

SEQ ID NO: 70800 - DNA, 434 bp, Triticum aestivum
  Clone ID: PAT_TA_70800
ttttttttttttttttttttgaaaccagaaacaatctaatgaaccgggcaacaatgtagattgtacaaccaaagccagagatctgcatatactggcaacagagcacacaatagattcacatgaatacaacatcttgctgcttacaacaaggattacaatagtccatttcaaggaattgaaaatagcagaggtaagctagcctagctaacgcgatccatacctagaatgcaaactcaatgggcacccagaaaatagaaaattccttcaaaatggcagataagatgctaacaaaaatacgtacaaacaacgtatcagaaaggcgaggcagaagtccctctcaacttttggctaagaacacatcaagatgactcatcctactacgccctgccagagaccgtgaagaatcatcgcgattgatccttctgtagctgtat

SEQ ID NO: 70801 - DNA, 427 bp, Triticum aestivum
  Clone ID: PAT_TA_70801
ttttttttttttttttgagaaatgatgagatgtgttcgagttgttgtttacctactgaagccatccagatcgttcattccacaaacgccgacgccccacgtctaattaggcgcaccagtacccctcggcctgtgcgacacagcacggtgcttctgcggctcatccttgtacttctgaacgatcctcgcaatagaatccagccccttctccaacacatccatcctcggtccataactcaacctaacaaagtgatggcaaggcgagtcaaacagatccctacgcctactcgggttcaaatcgaagaagatacccggcacaacaataaccttttcctcgagacaagcctggaagaagttcaatccatcgttgatgccctcgggtagattgctcaaatcgagccacaggtaaaacgtcgagttaggcatgt

SEQ ID NO: 70802 - DNA, 446 bp, Triticum aestivum
  unsure (1)..(446): unsure at all n locations
  Clone ID: PAT_TA_70802
ttcttgaacgtcacattaatttaattttctcagttgtgcatcgaaaaattggagccagagttgtccattttctnntggctgagagattattatttttaattggctgagagaaattttggaccaacttgttgtgcctttgacgtgtgggacctagccagcagagagttaacaaaagccataccgtttctgttttcatgtgcggcccaatgctcagtcccctaccagtgatgattaatgcaccccgaatcttcttccccaaacacaccaatagcgacaaccggtgtcgagccacgcaccactcagcacgtagcattgccgccacgcctcgtacgaagcgatggtggtcgccaacttcaggctggttgtaatgctaatatcatagctagtatcatgcataccaactaggcaattttgatgacgtgtcataaattaaatgaagaaagaga

SEQ ID NO: 70803 - DNA, 473 bp, Triticum aestivum
  Clone ID: PAT_TA_70803
gatagacatggttaattgttgctcattgttccatatgctacaaagaatgaataattccactctttttgtgacatggatttgggagggtgaagaaattattcccaacccaacccaaccaacaaaaattgggagaaaagaccaacctatctaggaaagaatgatgatttacatggcacaacgggactgcagggcagaagggaaaccctaggttgaatttacaacattgatgcggaagaatacagagatctgctggcgcagttcacagaatatgtccaagggaacgaacagaccgcatcttggagtgctcgaccagcttttcaagaattgggagagggccctgtcaacttttcaagaattggaaggcagacattgcgacgagttctgatggtggggccacgttttgaaattccttaacatccatggaatctgctatctcctcaagtgatatcggcatgcttatttcatcatccagt

SEQ ID NO: 70804 - DNA, 461 bp, Triticum aestivum
  Clone ID: PAT_TA_70804
ggggcctgaattatgtatttgaattatcacttggcaccgagatcttcaggattgttaggataatctcataggcgatttgaattattattttacatcacaggaccagctgctgcacacgtctagtcttctaatctgatccgcctgccacaccaactggcaggagaaagctgacagttgccggcacaacgttgaatctctgaaattcattttcatacatgaccatctcaaactgtcagcttcgcccgcacagcttctgcaagccattcaggtggccaagagaatgccgaaaccccacactgcaagttgctcactgttgttaaagatcagattcattccaaagtccacaagcaaaagtggtcactgctggatacaatcaaaaggcaccatccagactatcgagccgttgttcctgattagtcaaattaatcacagctctgcaatcttttctgtgtaagcattct

SEQ ID NO: 70805 - DNA, 168 bp, Triticum aestivum
  Clone ID: PAT_TA_70805
tttttttttttttttttttttttttttcacccgcatacacaaaaaaaaatgatgggatgtccagttcccttgttgatccctgtaacaacactatacaagcacaacccccacacctcgagggcattgctgacggtccagtagggaattccccaattacaattttgcccc

SEQ ID NO: 70806 - DNA, 277 bp, Triticum aestivum
  Clone ID: PAT_TA_70806
cctgaccgttacatcgaagtgattggaaacaaagataaaccttagaggcgagctactagcctactagtacttggaacaacatttgacatcgaaatggaacatccacagtgtgcgagattacaagcacagcacctttatggtctctccctggcatctctgctccatccctgcccgtcatatggactaactcactggatgcacaccacgcatacatccatgacaggcctgcctagacttgctcgacttgggttgccttgtcaacgctgacccctatggt

SEQ ID NO: 70807 - DNA, 298 bp, Triticum aestivum
  Clone ID: PAT_TA_70807
tttttttttttttttttttttttttttttggaaacggggcaaaacaagatttattttagttcaaatcatgtttacattttgaacgggccgtgtccatcacagcctgcaaacaccacttctttacaggccatcaaacatcatagatacaagctgacaatgaagatgtttgaaagaagactatacagctagactaacctgtaattctgtttgacgagtacatcacccgttcgagggcagcttattcttttttccttgggcagggatgactgagtattaccaaacatgcctggttgcactt

SEQ ID NO: 70808 - DNA, 390 bp, Triticum aestivum
  Clone ID: PAT_TA_70808
tttttttttttttttttttttttttttttttttgaacagggaaactgcattctcattacgagtacactaataaccgcacataattaagtgacaatggcattacagccctgcaggccaagtacaatcgccacaccacacagtacatggcagtagcaaagatgccggccagagcaaaccaaaagctatggccatgcatgcacacacgcgcacggccacgctgggttattaaggatttaaggtagtgggctacttcactaagcatgaccgagctggttcgttcgacggtcccacgttgcgcttgatcggtcgctcatagcctggtcatcggcacctgcacccggggcacggtggtcgccgccggtgcagtcgccggccgcggccgaccctccc

SEQ ID NO: 70809 - DNA, 431 bp, Triticum aestivum
  Clone ID: PAT_TA_70809
ttttttttttttttttttaattaaccatacaacttttgccttcaatatcagattcagatgtgaagctgccaaatcttacacattaagcaagcgtgaatgtactggctagcattggcatcatcgatcagttggtccgtggtcatggaacaaaatcatgatcggaacactgggaataaaaaaaaaacaattctaccataccaatttaatctacagaggagaaacaaaaaatgctcaagtcgtgcgacgctggtgctgaatcccaataaccacctcgcaccttggcaccgtttggatcttggaatgctctgctctgctctgttagctgccgctgcatccacaaattaaagcccacttctttaaatgaaggaacgacatcccactgcgaagcatcacttacgtcaatatttgatctttcagcatatcaagacaga

SEQ ID NO: 70810 - DNA, 230 bp, Triticum aestivum
  Clone ID: PAT_TA_70810
ttttttttttttttttttttttttttttttttccaaaaaaacaaaggcttcacctttgaatgtgtgatgacttacagcttgggacacaccgcccaaaaaaaacattcaaatgcacaaaagggaaattcctgcacaaaccaccaacacctaattttgtccacccatacaattcccggggaggaaaaaggaaggaaaattttcccccccctatattttacatttacattaca

SEQ ID NO: 70811 - DNA, 204 bp, Triticum aestivum
  Clone ID: PAT_TA_70811
ttttttttttttttttttttttattttttagaagcaacatttcacctctatatggccttgcaagttgcaagatattgaagacaagtaacatttcgtccgcaataattcgacacatcatatatctatctttctacttgctttcatgaaaataatttgaactccgccgcgcagcattccctgtgaagagaagaataacatcccagg

SEQ ID NO: 70812 - DNA, 452 bp, Triticum aestivum
  Clone ID: PAT_TA_70812
ttttttttttttttttttttaatgtacatatgttacattgctgcggttctatctacgcagttcattcagctgtggcggacagactaactacccatcgcacacgctagcacccccatccaaattccagttacatcttcgcgtcttctccagccaccgtcagcaaacgtcatcaatgcgatcatcatcgcagacgagttactgcgtccagcatcacgaagaacatggatatacatcctgtaacaatttccttcctcctctttacatctcgacatttattgtcgtgacgtagatccgttggtctgacccaaatccattaccgttccccgtgacaatagagacgatggccagatgtatgccttccaacagcgcagtttccagattggagactatcagcttgcggagacttgatacagattgctgtacagttgctcatagaagagaacgtgagtctg

SEQ ID NO: 70813 - DNA, 494 bp, Triticum aestivum
  Clone ID: PAT_TA_70813
ttttttttttttttttttttttttttttaagaggaaaccatcatcatctcttggcgacagaaatcaccagctctaaagcatcatcaatgttctctgttttggctcaaagctatgagagcagactgtagagcttttacaatggcaagacaaagctagtgtccgtggtacattttcaagccaattaaaaaactaagaacataactgatgctgcaagaaattggaggttcattacgagataactcattagcctgcttacacacaccgttaacgtgcggaaaacctcgagcttgcagacaaaatccaacaacactatgagaaaataatcaccactgcattaaaacggcttccaaatactgacactggtcgcaagacccatgtcgccttcaaataaacatttctcatgttgcctcctgcccttaagcatattcaatcatctgttgtcaatgccttgcagggcctcacccttgtcgattgtagaagctcatgtatggaat

SEQ ID NO: 70814 - DNA, 374 bp, Triticum aestivum
  Clone ID: PAT_TA_70814
tttttttttttttttttttttttttttttttttttccacgaagcacaatgattcacacacagaacctgttgttacatataggctcaactataaaatggatgtacaagccaatttacaaaccacagcccatagatttagcataagtacatgatcatgaactcgccccgcttcttgttttgaatactaaggattatgaggcttccttggcgttacggatcttccttccgccgtctgcagcccctgcttcagatggaacacctcgacctgtagctggaacgtccgcgactgctctcccgccaaaactctgcgggtggaatgcatctcctttcgggtctcatccgcgatggccttgaggaacgccacttcccgctcga

SEQ ID NO: 70815 - DNA, 322 bp, Triticum aestivum
  Clone ID: PAT_TA_70815
ttttttttttttttttttttttttttttttggagtcatctttccatcttagtacttacttacaagcaacagtggcgacaagcggacaatcaatcagtaattaacgagtgcgcttaacttgtagtacaactgctagtactactatctggttacccagcagcgcactccgaagcccctgctctgctgcttgccggccttctcgccgcagtcgcagagcaggtggctcagcatgttcaccacgctggtgccgatggacgtcacgttcagcaccgggctcacccggaccccgccgccgcctcgtccgaatcctgcagcccggggga

SEQ ID NO: 70816 - DNA, 308 bp, Triticum aestivum
  Clone ID: PAT_TA_70816
tttttcagcaaaaaatgggatataaaacagttgacagtggagatttgatgcatttcacactcgaatgaagagaagaaaattagcaaaatacgatagaacatggcgacgcaaatcaggcagcatcttcctcccagctagcacgacactggcctcgtacattttacttactagtacttctagaccatagcactatactcatggctgacagcatgttaattcatcatacatcaatgggtcacaggttagatagcaagataaaatgctgaaactttctacacctaacaggtccagcaaaatataaatccagc

SEQ ID NO: 70817 - DNA, 479 bp, Triticum aestivum
  Clone ID: PAT_TA_70817
ttttttttttttttttttttttttcgcagaaagacagcatgccataccgcccaggcttcaacaagatcaatgttacagacgttctcaaaagagtagcgagcagtgacagcccgtccaaaaataaaatctgccatgatcacgcacaacaacaccggcgcccacacgacggcgacccaggttcaggtctgatgggctaaaacatctaggtgacgtagcagatgggggttttgatccggtgcagcgagataaatgtttgttacttacagactatgcatataccaaagtccaaaggtattggattaaccgctattatgtacagctccggcaacagatttcttgttccccttgcctactgatttcttattccgactctcggcctaattaacaggtgctgataattgagttacaccagctcccaaagactttgatgccttccacccttatgtcgcaaccatgtccgtaggtagtactgcatatgt

SEQ ID NO: 70818 - DNA, 520 bp, Triticum aestivum
  Clone ID: PAT_TA_70818
ttttttttttttttttttttttgcagcagacatttcatgtttctgcatcaaacctgtttctaagatacgcggtaactagctgccactagagctaatataattgcaaaagcatcactaaaatcaacaaaaggcttgcgcactgccgcacgagcacattctacagatcctagtgtaatacagcataactttacaggatgttagatggagccgtcgtcttcttcagaacaagcggaagcgtgtctctcggggcagttgcggaagtcgtggtcgacatattccttacagaacctgcacagccttcgggttttttgtggctttgcggtcttcttatagtactcattctcagctttcaactcttcaagctgcttcttcagaaactcattctcctttttcataaaatgcaattctagctcgagtctccgaatctgttcagcctcaagctctttcgtcttgcgaacaagctgcagcctcagcatctgattctcagctctcagacactcaccataagcatttttcttcc

SEQ ID NO: 70819 - DNA, 453 bp, Triticum aestivum
  Clone ID: PAT_TA_70819
tttttttttttttttttttttttttttgactcaagtcaagtgcatatagatagagacaagcttaaatagtatacacagagtcttggtgcaggcaggcccaggccgggattaatattttgctcactacatacaaaatgtgtaattagctgctaaaactaagataaatattttaaaacaagttagatttgtgacagcaaacaaacggtaccaggcagggggaaatttacattacaaccaaaatcaaatcgcattcgcattcacacaagtgctgctgtccaagaaactagccaacacacacatagcactcgtccagatattgtttgctcccatgctactccctcatctacctccgggagtagttacttagcatgaacattgttcatttgctctagtctagaggatacactggatctcatccctggtaaacttgtagagcttggacttgtgcttgac

SEQ ID NO: 70820 - DNA, 419 bp, Triticum aestivum
  Clone ID: PAT_TA_70820
ggccccccctcgtgccgagcaaaacgcctcgtcgtcgcctcccaggtccgcgactccctcatctccgacgacttccccgacgatctcctacactacttcgactcctacggcgggcccgacctcctgtacgagctccgcttcctcaacgcccgccagcgcatcgtcgccaccaagcacaccatcgagaggcgcctcgagtccaagggcgtgcgcgagctcgcgcgctccatgaaggacttcccgcagcgccgcggcgacgaaggatgggacgccttcgacaggcactccgccggcgactgcctcgcgtacgcgcgcttccggctgtcgcgggaggccatcgccaacgaggaccgcatccccgagctggagcgctcgctcgacgtggtcgagaccgagtcggccagggcgcgggtggagct

SEQ ID NO: 70821 - DNA, 193 bp, Triticum aestivum
  Clone ID: PAT_TA_70821
accgaaagaggacacgaaaacaaacagagcgcagacagctcttccacagacacgtactaggaggcgcgctcgcggcgcgcttatcatcacagacgccccgtcaccggagaaggggcggcagccgcaggtgggttcccctttgattcttgcatcgcctcaccggggcttgtgtgcgccaccgctgtggctgtgg

SEQ ID NO: 70822 - DNA, 660 bp, Triticum aestivum
  Clone ID: PAT_TA_70822
tttttttttttttttttttttcgccagattggacgttttcaagtacccatcaggtgaaatggatcaaggccgacaagggtactatgagctatatggacctttcacaagacctacaactctacagataaattatctacaacaacaatacaaggtatgaaacactgttctttcatcttccatgttgcaattttgtaagagcatgtgctgcagtactaacttgatgtgtcaacctccttcccatgatcttcatttattgttcttcggaaccttcgtaaccatatttcatagtccattgggtacggggtcccacaaaggctgtcaacataatctgcaaatgctttcaaaactgctgcaacatcacccagcttctgttgtataactctccttgaccatgatgcctctctccattgaagtgcaccttcaaccgagtcaagctctgggcagactccaccacacgagaaatataaaaggtatattaaactttcagcatcagatgcggcacatagcttcccttcctgaagagcaaaagtagatgaaaagaatagattcatcaaaggtcgatccctatcttctaggatagcatgaccccatccaataagtacaaaatgtggttgccttgaaccattgctgacacggatcacattttctggccggatatca

SEQ ID NO: 70823 - DNA, 406 bp, Triticum aestivum
  Clone ID: PAT_TA_70823
ttttttttttttttttttttttaaaaaaacccgagagaaactatctattagtcctcataaatcaaaacacaacatgttcaggctttctcagtcaacagtctactcaaatgtaattaatatatagccgatcaatgacaaagacacgtgccaaaacatgccgaccaaaataaagaggtataaagcctattttaaatccatgaatggttacaaagttgcatcaatctactacattaaatatataatggcagttctggatgttgcttaacatggagcatagtttgatggtgcagtgcaacctcataaactctgcatacaacaacctgtaaagaaatgtgaaccaaaataaagtgtcattgcttcaaatgatataaaataccagaacgccatttcttcatatcccatctct

SEQ ID NO: 70824 - DNA, 410 bp, Triticum aestivum
  Clone ID: PAT_TA_70824
cccctttttttgcacactaaaaacttgaaacaacattattgatacagacacgaatacaacattatcctagaataaaagctgcatgcttatacaagtacagatacaaacatccattctatcaggtagagaaaccagtaagcaagtgtaccttgcccattgtaggtcagaatcaggttggcatctgaatctgatatcctttgctaatggggcagttggagagtggaacagactctcctctatcactaaaaacatgattgccaagcaacgcagttgttgcgaattacaatgtttgtcaggctgctatctgtaatttggtgaaaatatcaggtggacaacatggcatgatcctcaaccggtcaacctcctttatttagagagagcagcctcaggtatcccgccttgggaatgaa

SEQ ID NO: 70825 - DNA, 462 bp, Triticum aestivum
  Clone ID: PAT_TA_70825
tttttttttttttttttttttttttaatgcagtgcagtaaataaactgaggaaattttgaaaccaaaaggtatcaggttcccatcctgcacactgtaattattattttcagcgctagcactaatcctggaaaattcctagctctttgcaacgctctcataaaacaagatgtacccatgatcgctgttgccaaaatattcgcgagaagaaccatagaacgtttgcagggttgactcctgaattttgtcaacactgtcatcgtcaaatgacagccagtggtcgccgcttttaatctggcttacataatgtccgtggttggcagcgttcccaacgtggactaccacagcaaagagtgagtattcgcaatccacatcatcagaggcactgctcagcttcagctccatggggtataccactcggtatgacagtttcttgtgctgactcagctgttcaatgaacttga

SEQ ID NO: 70826 - DNA, 380 bp, Triticum aestivum
  Clone ID: PAT_TA_70826
ttttttttttttttttttgttgcaaaagcgcgttcaatgaaggacggtatacgagccctcactgaacacgtgtcatgcattggaggtggcggacgctgccgctgtgaacctcaccctttgtcgaaaaaagatagatgacacatcttatttttttttaacgcatccaagcagtaaccgtacggcacgcacgcacgtaccgccggtacctcacacgaacggcgcctcctcgcccatggcgaaatacgcgccggtcggcccgccgtcaggcagcagcgccaccttcaccaagttacgtgcgccctcctccggcgtcaggaccccggaccccatgctcatgtcggtcttgacgaagccagggtgcgcgcagttgacgcgcagct

SEQ ID NO: 70827 - DNA, 391 bp, Triticum aestivum
  Clone ID: PAT_TA_70827
tttttttttaattttttttttttttcttttttttttggaaaaggtattttatccttgatacacacaatctatgagtcaaaacaacggtatacacatggcacaggggaaagcaacaacaagtcaagaaagtcaacaagtcaagaaagttaatctaatctaacatccactatggtgccatggggggcagtcgctaaacaagtacctctttactggagctccaagcacccctactctatgtgggtggaacacggcaacacaggccgtgaaacacaatatagcagccactgccacagttgcgacaagtcgcgttctcatcataccacttgggaaaggagcaaccaaggcgggattaagccatctagcattcatctcaggggcgcggcactgcctg

SEQ ID NO: 70828 - DNA, 287 bp, Triticum aestivum
  Clone ID: PAT_TA_70828
ttttttttttttttttttgatccaaaggcacaggtgtgcatcaagctacttagtgcattcatacatgacattcgttccacttaggtcttaatcggtacttaggttttacataccattcgttggaaactacacctatagatcactcaaatcatgctaggtttttgcagtccattagattatattcgaaccaaaacgatacggcggcgcactcattgcgaatttagttctaccacgttcacatccaaaaggtcttctcagtctgcgttcgctcttccttagtcacacaa

SEQ ID NO: 70829 - DNA, 401 bp, Triticum aestivum
  unsure (1)..(401): unsure at all n locations
  Clone ID: PAT_TA_70829
tttttttttttttttttttaatccagttacacacacgcatccgacattgtttcatattcaaatcaggaaaactcaatgtcgaattcagatcatccatcatatcacatcacataagacatctcccngggtttagataacataacaaaatcatctcaggaatacatttccttacacaggaattatggcacatcttctactatcctaacatgtacgtatatgcatgtgtgcttgcttgaccggcgcatgcatcactttagcagcctcgcaagtatgcatcgttgacttctactcatagctttcctcgcaccagagaaagatcaaaacaaaaaatattagtaactttaaatcagaaagtatatccacatcatcataaaatagtcgcagaccatcacacagaaggc

SEQ ID NO: 70830 - DNA, 200 bp, Triticum aestivum
  Clone ID: PAT_TA_70830
tttttttttttttttttttttgcccgttcaaaattactatgtttacttcgaaattaccattgacaagagcaaaatattaatctccctatattacaagggtcgaatgacattacatgaacattcgtatcatttaatcgtcgtaatcatcgttatccctgcggttgaggaaccgccggacggcgcccacaaccgccccgccc

SEQ ID NO: 70831 - DNA, 470 bp, Triticum aestivum
  Clone ID: PAT_TA_70831
tttttttttttttttttcagaaaaagcaactataggtatacaatttcttatacaactctagcacatatacatttcaacaactgaaacgaaggagatatatacatcatcatgtaaaacaagcctttggccaacaacgaagaattaatcgaagagaaacaatgaacaaagcaattataaagagacgaaagcactttttttttggcgaaaggagacggaatcaaatttaacgaggagctggaaccaaagttgcatcaagcacacgagtgaaaagaattcatcgatttcaatttttgcattcgagaaactaagttgcgtgtgatgcaacatttggattaatcccaagcctaagctctagatctaccagtccttgcttcttgaggaacagatctacttctccttgatccacgtggggattaagactagaactactagggtttgcgattgtttccataattaccttggaatgatca

SEQ ID NO: 70832 - DNA, 378 bp, Triticum aestivum
  Clone ID: PAT_TA_70832
ttttttttttttattttttttttttttctttttttttttaccggaatgaaaatataatcaaaattggaactagagaaaattgattatagtggatacactagaagcatttacaggaatagaagctcatgctttcgagctgactaaacttattcctagagactagagtgaaaaaaaattggggcgtaggagggaacaaggtaatatataccacttatcaccaatgaaccaagaaaatgctaaagcaaaaaaaaaaaaactatgacaatgcccattgacatctactctaacctaattcatgaatttccgacagtcagcattctggcacaggcaaggaactttgcaatcatcagcctcatcagggtcaaacaggtaatcata

SEQ ID NO: 70833 - DNA, 384 bp, Triticum aestivum
  unsure (1)..(384): unsure at all n locations
  Clone ID: PAT_TA_70833
tttttttttttttttattttttttttttttgcttaatatttaatttatgtcgtcattatttcgcaggatgaaccaagggtgctaggccacactacaccatgcccttattgtccaacagaagaattcagcagggaagaaacaaatgagatttttgcagagaaacaagaaacagtagagttctacaacaccagtaggctcagattatgtgcccccagccagccttacaacatcacagcctaactaatcttcctttcctgtgccccctaggttgttgggactgctanctattcggctggctctgcaagtgactgccttgcttcagctcagacgtgaaccgcgcactggcttcgccgcgactcgccgcaccatttctcgtcctcaaac

SEQ ID NO: 70834 - DNA, 387 bp, Triticum aestivum
  Clone ID: PAT_TA_70834
tgccccccctcgagacagttcctcttgtgtatgctgtatatctatctactccccaagcacgtacaaacactctccacacagctagccaacaggtacaacagacacaaggatgaagctcagagtaaaaggcttcggcctcctgcttctccttgtcttgcttgctctatgctccaccattgatgtctgtgacgcgaggagaggcaagcattggaggccaaggagctcgccgagctcctctctgctcaagaagaaagggaaggcaaagaagggcagctcccaccggtcagcacgggggcaaccggcgaagcccgccaccagccccccctggtgttggcaaaggacaccagacgccataccagccaagccccaatgtacctgtaagtccga

SEQ ID NO: 70835 - DNA, 287 bp, Triticum aestivum
  Clone ID: PAT_TA_70835
tttttttttttttttttttttttaagtaattatttaattaccaggatctctctgaattttcttacaaccttcttccgcccgtaaattaacaacctaccttattatacagcttggcatgagaatttcacatagccatggcagaaggaagcacacatgctacaaagaacaacaccttatttatgtatatgatgagaccaaactcataatttaccatggccaccaacccaggagaggagaggaggagagaagcaagcagactgtgagaattctccaggagatcaatcgac

SEQ ID NO: 70836 - DNA, 520 bp, Triticum aestivum
  Clone ID: PAT_TA_70836
tttttttttttttttttttaacaaaatccacacaattttttttatctcagtcaaagaactatcttacaaagacactgccaatgacaatgagggctgccctgagacggggcaaccaatccgacaacaagatgttgaacatgagacaccagcaacacacacacacacacactcaagaatgcagcaccaagacactgaaaaacaccctagagagagcttgaaaattggctcttcatctcttcctggagttccacgaacaccgtgcgtttacgccttggcggccttcaactcggcgcctggggctttccgatcatccaactgcttcgatgccgtcgtcttctgcgcgccgcagggctttcgcttcgccttgatggactccgtcaagctcatgtagttcggcctcgacctgacgccgctgccattgttggtcttctctggtgtgagcaaggtggagaacgacaatggcgtcgacgcaaagcatgacgacgacgacgccgagctctcgtcgttgtgcagctcggtg

SEQ ID NO: 70837 - DNA, 362 bp, Triticum aestivum
  Clone ID: PAT_TA_70837
agcagccgactgctcttccgcccctcgaggttaaagttgctatgctccttccgacgtggtataatctttttcctcgccatactcatcgctttatcctcagatctgagcagtgcgctgcggagccggcgttcaccacgccagatctcgacttggtgcgctgcggagccggcgttcatccacgccagatctcgacttggtgcgctgcggagccggcgttcatccacgccagatctcaacttagtgcgctgcggagccggcgtccctttgctggagatgcgtcccagcatccccgcgtccccgctggcaatcctcaagtcatcgacgtaaaagaggcagaagaagtgcaaggatgtggttgcacg

SEQ ID NO: 70838 - DNA, 399 bp, Triticum aestivum
  Clone ID: PAT_TA_70838
tttttttttttttttttttttttaatgaaaaatgtgacttcttgctgccaattactactactaaacaatactgaatatgacaatagaacagagtcaaacctaaacttgctaaagaaaatacagtcagtagacagactcgagtcacaacctgggtgaggactacccctatctggacactcttgacctcttccctctccatggactcggtgaccagctgcgtgtacttgtggaagagcgcgtcgacgatgtccgggccgaagtggtggctgagcatggactcctggatggccctgatcgccatggacaccgtcctgccgtcctccttggcgtcgccgctgctgctcaggttgatctcgtacgtctgcacgtagtcgaggctgaaggacccctccagccgca

SEQ ID NO: 70839 - DNA, 431 bp, Triticum aestivum
  Clone ID: PAT_TA_70839
ttttttttttttttttgggactactagtagattccatttagtgccgatgatatctttcgtgggggcatcagcatgaatcacatttaaatgaagcaggtaacacgttgctcgagaaatcgagaagcgtttacctatcctgacaggtggggcaactatgtgctggtgaatcctggcaggcgggcccctctcttccaacaaccatggtgccacctccgacaccgacatgccttggcgacacttgacacttgtcattatctttctgggatcttcctactatgcagtatgaacctaggcttctgaagcccttcaaaatcatctaagggtgctgtggtggtgcaaccgccctacagttcagaacactcgggacacacctagaactagcacactagaaatctagaaccgcaccttctagtcctataatacatctagct

SEQ ID NO: 70840 - DNA, 269 bp, Triticum aestivum
  Clone ID: PAT_TA_70840
ttttttttttttttttttttttttgggcggaaaatcaaccatattttgaaaagtaaacagctaaacgtcaccaggaaagacgggtaattttcagatttcaaggcctgcacccctgctaaatgccgccagcaaaaaaggacagttttttccaatgtatctagtccccgctgagcaaaagtattaagtgccaacattttaaaaaaatacagtcggactaaatgccaaggaaaagcagtacaacttaagacaaactaaaatgatagttgaac

SEQ ID NO: 70841 - DNA, 267 bp, Triticum aestivum
  Clone ID: PAT_TA_70841
ttttttttttttttttttttttttttttggttcacgatttcaagcagttaaaaggaaaagacatataatgcggtgcagctgaccatcacattaaaagagaacagacgctgacgttaggggatgtttatctactgattacaaaatagagctgcatttcttgtttccttttggtgcacaaagtaacgtgtcaatttacatggtttagtgtgtggcctatctacaatgactctaaaaatatccaggaataggtgcaggtgggatcctgag

SEQ ID NO: 70842 - DNA, 160 bp, Triticum aestivum
  Clone ID: PAT_TA_70842
ttttttttttttttttttttttttttttccgcaacattttcaaactgcttgactatactaaaacacaaattacatcatctgtttggttcaaaccctgggggctataacatcccatacccataatatatcattaggtacatttgggcaattcaggcggacc

SEQ ID NO: 70843 - DNA, 411 bp, Triticum aestivum
  unsure (1)..(411): unsure at all n locations
  Clone ID: PAT_TA_70843
tttttttttttttttttttttaatgcgatggcgggaaaacaacttaaattttcattcattcactcactcattcattgggagggcttacaaacgcagcagcgtcacatcgccgtaattactactcctagcaacagtagtactcgtaacagtaataattgtatacagaaggaggaggagtacaagagtgagaactaagaagactaaaaaacatccattattttcctgttaatgatagatattctagttgtaatgctctgctctgatcgtggtttggatttggattagacatgggagtggtggagtgatcagaaggccancttccggcgcgggaggcggaggcggtctgcctcggcgagctcgcagatggcgtcggccaccaggtccttgaacagcagccgctcgatctgcagc

SEQ ID NO: 70844 - DNA, 613 bp, Triticum aestivum
  Clone ID: PAT_TA_70844
tttttttttttttttttaaaccatggtctctatatagttttataaaaagttggtaacaattacctggtggtccagatatattcatatgtataatttgctacttttacaactgcgaggtgatacatcaccgtgaaaagataaaaagaaaagaaaaaacaatggtaaatttatcccttgaagggcttggaaaaaaccaagttgtggcacgttgggttgcacggatatttgcaatctagttccttcacctctctcctgtcaaagaaccagtctccaactgcttctgccatggtcttgttgttgactctaggagaagatggagagtgccaagtcacagagttcaacgtctgacagtgtataaagcaggagtcaatgaaaataccccagtcctttttctgcttgatttctctcatcgcgtcatgcagttcttccctaaaaccttggagtatttgaagttgctcgggactgcacttgctaatatccaacctacagtcttgccatgaatgttggggatccgatgcttctggtgccaacacatgttgtacctgccaggcatcatatgctggattaagaacaaatactggtgtcctgatgtctttaacaacttcacgaggaa

SEQ ID NO: 70845 - DNA, 508 bp, Triticum aestivum
  Clone ID: PAT_TA_70845
ttttttttttttttttttagagaaatggtgatagtcatagaaacgagagaataataggtacacaacatttacccgcaaacaagaaaaaaaaatctacacaacagactacggcgatgtacgaactaggagaaagtagaaccaaagcctcttcctcttgagctagatgctcggaattggttgttcaccaggtgaagcttatagactggaaatgcagattgctcgccagcccagacgagcagatagtcgcgacctcctcaagcatccccgacggaccgctggccatcaccccaacgttttcgtcgtgaatccccagcagcatcctcttgagatctggacggtggccgaaatgcacattggtagcctgcgcaagaggctgcgcaggcaagctctccagctccctctccacgccgcctccacctgtccagtggagcaacgacaccggcgacatcgccggcgtcggcccgtccacgctctttatcttcttggcctccctggcgctcctccgctt

SEQ ID NO: 70846 - DNA, 296 bp, Triticum aestivum
  Clone ID: PAT_TA_70846
tttttttttttttttttttgaagagcggtgcatgttagacaaaaatactatatcatatcgtgtggatcagcattagctagaccctaattaaattatgtgtaatagtgcaagagaatcagatctcgcaaaaccgtcagcaactaatcaagctcacatattcatctcagcaactgaatccgcctctaaactgaaccaaaatatgatatgtattcagattgcaagtatcatccgtatttggggtaaagtggggagaggctcgccacgctatgaggtaaggaggatgcagccatcattga

SEQ ID NO: 70847 - DNA, 248 bp, Triticum aestivum
  Clone ID: PAT_TA_70847
tatatatggatggagtaggaatattacgtaaagagcaattccctaaaaaaaacataaagagcacagcatttacgtaggtgtagcattttttgccttctttaactgcaaaaatttgccaaagtctgctggagctacttgtgtccctccattatttgcatgggccgtttagtcatgcatctctccgatcttaaaggtcgcctcaaagttccatcccaatggaaaccaacaccaacatccttccccgggag

SEQ ID NO: 70848 - DNA, 432 bp, Triticum aestivum
  Clone ID: PAT_TA_70848
tttttttttttttttttttttaaagatagttaataatttcaaatacaggaagcatttaattgtttccttttcaaagaggacatacacttgatagttcagaatacagacatagaattcagagatagatctcacaaactagagcatatacatgttcaacttgagaagaaattaacgtggtcactgcaaagcacgcgtacaattttttttgaaaatgggcagtgaaagtacataaatgacaattttgaacattcaaattcgattatactgcaaatgagatatgtcatcctttccaatcggctccgagctcttgtattttgttgctttcatctgtttcgttctgagcaagctgttgaccatttgtggtcaattgctgccccggaattggacctcattttttggtcttgttcttgcagtgctccatttgatggatcc

SEQ ID NO: 70849 - DNA, 609 bp, Triticum aestivum
  Clone ID: PAT_TA_70849
tttttttttttttttttttttaatgcgctggggacttcaccagtccaacagctttgatcattcaacctttgaattcataggctacaagctacaccaaccatccatgcttcagacacagcaccagccaacaagaaggagcagtttgacatgtcagtttcctatagcacaattagaaagaaaaaaaaaacaccataaccacaagctgaaacacagccacacgtcggttttcaaactaaaaacttaattagcacacttgacactaccagctttcaactcacttcatctcccttgcttgccgttcgtaagtattcttcctatgcccttcaccactgcatttactgcatttggatttcttcctcggttgcggaatatcccctctctccggtgaagttgttcttttgtggcactgggatttgcaaatgctgcaaaacctacttctcttggtcatcccgtcatatgacgccttgtctcaggcattgctgatctgccagcgtttccgttcttgcttggtgccactaatccaaaacttcatgctgcatgacattctgtcgtcttcacacacttctcccagctcactccccgtcggtatctgccacattgttgttatcc

SEQ ID NO: 70850 - DNA, 628 bp, Triticum aestivum
  unsure (1)..(628): unsure at all n locations
  Clone ID: PAT_TA_70850
tttttttttttttttttttttttttttttttttttttttttcaagctaagtgcatgtttttatagcaacttccacatatgtacaaataggttacaatcacaaatccccccatcaaatatgtatgtacacacgccttcatgctcaatggttcccatttccagagtagccacacctaaaaagaatcagcacccagcaggcccccaaaccaagagaaaggtaaataagaagctaaccgatggatgagcttatgcaccggctaatttccctcaacacacttttcccttggccttttgcccagagtgcgcacgccactaatgccgagctacagcgacgtcagcggcacagcggcaccgccttgaggagcgcgtcgaggccgccgggccgcgcgccgcaacgtccgctccgctcgccgcgcggcagctcggcgacgagcacccgccggcaggacgggcaggaggagtgcgagcgcanccaggcgtcaacgcaggccgcgtggaacgcgtggctgcactgcggcagcacccgcatgtgctggccgtcctcgaactcggcgaggcagatggcgcactcatccgcctccgacgcctcgccgccgtcggcggcgtacctgacggtgggcagcgcgcgc

SEQ ID NO: 70851 - DNA, 611 bp, Triticum aestivum
  Clone ID: PAT_TA_70851
tttttttttttttttttttaatacaaacgagaaatgctagaatttctgccataaatcggcgacgcccacaatgctacttgatgtcatcaagaaaagaggcatcactttggactactaccagcgcgaagcattcgagacaaataatgctgagagcataaaacgtaaaacctactccattgtagcacttaaacttttcgcaaaccttgtataaactgcttaattaatgagattatcgttttttgtacaaattatatgttcttctgaataaaaggacaacgcttctgccgattgttcaagaaaaaaaggtgtggtgctttccaaaaatactcccccctaaaataatatatttcgttttagcaattcaatttgaactgttaaaacgacatatatattatggtacagagggagtgtataagaaacaaaaatgctttttttccaaaaaattctgcatcagggaacgaaactagtgcagagctgtttgttgtcgtctccggtgtaaccgggggaaccatcttcagcgtccatcttcttctctagctcagcaagagctttggtgagagactcacgtccaaagcttcgcccaatgcaccattcggaatcatacttctcca

SEQ ID NO: 70852 - DNA, 392 bp, Triticum aestivum
  Clone ID: PAT_TA_70852
tttttttttttttttttaagtctctagacgttgatagttcaattgttttccctgctcgagatgcaaactgttggactaactaactactcatccgatgccgctcccctgctcgagaattctgcacttcgtccgctcaggccggcgatcacacgagtctgaatctaaatacagctgcagtgctgcgaatacactacacagtacgatgctggctgcagcaagcacctacaggttcttaacctcggacagattcaggaaccactcgtccagttgactcccgaaccacatgtcagccccgaggcctccgccggcagcgtaaccgtagccgtagccgccgtcaagctcgcacacggaggggtagcagtcgccaacgttgccggccggcggggaaagga

SEQ ID NO: 70853 - DNA, 449 bp, Triticum aestivum
  Clone ID: PAT_TA_70853
tttttttttttttttttgttctctcgttgctctcgtttacaattcaacacgttatcagcacgctctccggcgagagcaatcccgacgacaagacaaggagaacagggaaaaggtgagaaacggaaccatgcctcgagttccgatgtccctgtttcttcgcctccttcgcgtcggtgggcgtggacgccgcttccagcatcgtgtgcgcgacctccgccgctttcggcgtggaggttgggaccagcgccgccaggacctccgtcgcaaccaccggaacggcgcgggaccgtcaaatcagtccgtcgcaaccaccggaacggcgcaggatcgtcaaaccagcccgtgcagcgcgatgtgcccgcccggcttctggccggtccggctgcaccaaggctcgaagccgatgggggcatcgagccatcgacccggcgctcggtgcatggctgggt

SEQ ID NO: 70854 - DNA, 693 bp, Triticum aestivum
  unsure (1)..(693): unsure at all n locations
  Clone ID: PAT_TA_70854
tttttttttttttttttttttttgcttccaaactgaaagatatatgtacaaccgtgtcgaaaatgaatttcctgagctagacaaacttgctccaaaaagaattaactaaacaaacaccaaatataagaatcagtcgccatcgccaacgccaagccatttccggaatccagcaagaattgcactcttccacaatggacaacgacgtcaaattgaacaccagaactacaaatcagagaagctgatgccggagctgctggttttcccttctcagttgctgcacttccttggtcaggccttccagcttctccaggaccaaattcataacgccagatgtttccatctcctgcatgtgaaactgtctcagaagttcaatgtggagatttctcacatcctcatgtatagacttgtgaacagatcctagagattcctcgagcatgcgctgaacatactgaagggagaacgaagaagctccctgttgatcagctgacgaacctgaggtgggcaattgaggtggcacacccgttngcttgctagaaggcttccagacgaaaaggtcattggtgcctcctttcttgataatagactagtaagcagttcatcttttgtttctgctccagtcttctttgattttggcgaacaaatgctgaagctaatccttcactaaaaacagaggatgtgctcaatctatcagtc

SEQ ID NO: 70855 - DNA, 442 bp, Triticum aestivum
  Clone ID: PAT_TA_70855
gctgaatgtgcagtatgctaaatttgggtaccaattgaaaaagattggatttttatttacactagtaaaatgcccgtgcgttgctacgggctatgatgcatgacttaaatcaagtgtatatttctcgctcagatgagcagacgtgttcggacgtccggacatcaaatgggcgcccgtcgcggtgattgccttatcgccgttggtgcggaccgctcgaggccgccatcaccactcaccagtcaccactcctagtctccgccagctccccgtcgctggttgcgtcggacaagcaccagcatctgattgcgtcagacaaacatcagcatcttcgtcctgcttccccatctctgtttgccatcttgcatatgattagttttatttttcccaggtgcatacttaacccgggcaagatgaaaaacatatttagtatctttcgctttct

SEQ ID NO: 70856 - DNA, 554 bp, Triticum aestivum
  Clone ID: PAT_TA_70856
cgaaaccgccccatgcaccaaattttcttaaccacgcaattacatacagtaatcccaaaggatgaacaactgacaggcaccaacgagtagtagttaatgccgtgcaaattcagaaaaagaaaaccgagattgcataagtttcattcgatttagataccctgctgatcacttcctcctcttgagcggattcagtttcctcccattacattagaaccattctccacatcacatcagaatcgccgccgtcctgctactggtagacctcagcgctggcagctggatcatgatcgcccaacccttccttcctcaccggaatcttggccggctttatcgcccacctcctcgtcccccacttggcctccttctgccggcaggcagacgtaagcgccccacgccgactccatgtaagcagaggcagatgactgttagaccatggagagcatccgcaccaacagagtttccagcactaatgaattgatcagcttcactatatgcaggcaggtgcttccccggtggaaagatagacgcgatgaaggaggagcttgatgcacttc

SEQ ID NO: 70857 - DNA, 478 bp, Triticum aestivum
  Clone ID: PAT_TA_70857
cttcctatcagttcaatattttgtcccccatttaactatttggcttcgtagttttcactgaatagcattgtttttaaggcgtccctaaggcgtcgcttaggcgtcagggcgcccccaggctacaaggcgtcggccttgccttacgtgcatgcctaaggcgtccgccttagtccatagggcgtccaaggcgtccacctaggcgccattcttcccgccttaggcaaatgaagacgccttagacagggcaggtgagttcaggcgggaaacagagctctgggcgggaagagaagggcgggaaacagagtctgggcgccaacagttactagcagggggagagagagccctaaccagtttcagttttcccccaaccccacctctggcggctggatctgagcttctccccctcctctccagcaacttctccccctcctctccggctgcttctccccctcttctccagcagatccgccttcccctc

SEQ ID NO: 70858 - DNA, 500 bp, Triticum aestivum
  Clone ID: PAT_TA_70858
gcatccacagcatacatacttcaaaatactaaatgtacattttgaagtttgacagcacaacccccaaaaaaatattatggtgcgatcagcccgtttgactgaacaggtgttctccctggcttagcagcatcatttatataatgggcaaattttacgtcccatcgtggatcaaaatagattgaatcctcttcaggcaaccagcccataaactcacttctgcgcatcccatggtagataagttcatcaatggtgagtccatatccatcagaagcaatttcttcaaactctgcatcacacccatggtatgttccagaagaaggatgcacaagtctggtccctctatactcacagtggtaacaacggccatcatcagttgatggatctaccacaaaacaacgcagcacattttcatcttcatcaacattgctacattcaacgaaaaacagagttggggctgtgccagcttcagaaggtgaaccctttggtgctgcatagaagtt

SEQ ID NO: 70859 - DNA, 407 bp, Triticum aestivum
  Clone ID: PAT_TA_70859
tttttttttttttttttttttttttttttttttttttttaaaaccccacctatcctcaggtttacaaaaacacgatggtacaaaaatgggcaaaaattctaatcaactcccccccaaaaaaaacctacctcggcagttcagggtttaataaatgtaaacatggtttatgcgtcttaaccaagcttccttgaaagggcatcaaaatggtcatcgcaacacgacatccatagcgatatacatgtgactatttgccgtgcatgccttgtggattgaccacaattatggtttcaggtttcgatatgatgcagtaccccttcatataagcaactgcactgaaggcatcccatcattctcttgatctctccaactccctgatacaatcctatgatagcatggttgaatgaatc

SEQ ID NO: 70860 - DNA, 684 bp, Triticum aestivum
  unsure (1)..(684): unsure at all n locations
  Clone ID: PAT_TA_70860
ttttttttttttttttttagtagcaacatatagtaggtgccaatttcattattcaaatacatcgtctttcaaggcgtggtaaacaatgggcagtacatacaaagtgaagataacattcacacaagtcgtgtcatgatgcttggtctatacctgggagcaaattaattttgactggatccttcttagtcgtgtcatgatgcgccttgcaatgctcacacgcgcccgtgcggggtgggcaccagcacgagcggcgtcttgaggaggggggataaccttgccttgctcctccacactcaccatcgtcccatccgggagcgcccactcgaagcagcacaacaggttcgccagcgtgaactccacggtggccacactcatggacagggcgggacacatgcgccgccctgcgccgaacggtatcagctcgaaattcgcgcccttgaagtctatctcgctcgcctcgaacctatctggcttaaactcttccgggtcatctggccagctcatcgggtctctgccaatggcccaggcnttgacatagatccttgtctttgctggcacgtcgtagccaccaatctggnatgtcccgcatggcctccctaggcaacaaatcgtcgccggcgggtgcagccgcagtgtctctttgaccacatcttgaggtatcctatcttgggcatgtcgttcggt

SEQ ID NO: 70861 - DNA, 602 bp, Triticum aestivum
  Clone ID: PAT_TA_70861
ttttttttttttttttttttgaaggagacaaataattttcataaaaagacgactgctcggaagcgctagccagcagccgtttgctcgctagacgcgtctaaaaaagaaataaccgcaacatgcaacgctgccacgcaacctgatatagttgtctcgcaacacgcaacgctgccgcgccacaggttcagatccagtctgacggtagaaaagtcatggtggttgatgcagctaccaccgctgcaccgccggcaacaacttcacgtacgacacgcctgagccgtacgacaggctagctagccggagaacgactcctgtaggctgtaggctctgaccggccggcaagccctgcctgccgccggtccgatcgacgtgacaagacaaaacacgtcgcttgccctgccacgatcgacgctgaaagcaagcagggcagcgcatccccgcatgcatgcatgcatgagacgtacgacacgacatgcacgacgctttggccggccctaacgtacacgggatcgcccaggacgaaacaattaataataataaccaatgataataatggaactacaggactcgcgtctcagctaacgatcatttctcccgagcac

SEQ ID NO: 70862 - DNA, 489 bp, Triticum aestivum
  unsure (1)..(489): unsure at all n locations
  Clone ID: PAT_TA_70862
tttttttttttttttttttttttgaaaaacataaaagtataaaaccaacaccggagactgagtgtcaatgttaactttgcaagatagaacagcgaaagaccccacatggtagcctagctcagtgaaacattaaccaaacagcaactgaaacatcaaatacgccccgcatatttgatgcttctacaaactttaggcctatataaggatcagcacaaattcgactaaaacatccacgattgacccccgtagctctgggacgcccctctcagttcattttccttctacatttcttactttgaaatcaggactanctagttggcttggatggatgaattttgggtcgacctgtgaccagaggatacaaaacctgcagccctcgcatatcataacgacctgcaccagtcatgcttcaactactcaagaaaataaataaaggacctcccaagacttcaggaagccaccagcagcagaattaagttcggtgagtga

SEQ ID NO: 70863 - DNA, 570 bp, Triticum aestivum
  Clone ID: PAT_TA_70863
ttttttttttttttttttgaaacaacataacttcctattcaccagtttaagagatagaacaaaaaaatggacaaatgagaggaataaaatttcacgctacaaattgtaaggagatatggagtgtaatacatcacaagcggtacatcctacatggtcagccaattataactaatattagagtgatgtattgcacggttcacttccaactgttgatccaatatctgcaaagcaaaaagaattgtatgaatgaataaacttgatgactttttcgccccattgagactggcagagaaagattttgtagcaacacataacttcaccgccataggcaatcatttacaattgctaatttgctaggctggtatagacgactaaatcacaagcaatggattttgtgatttcagatcatagaaagagaataccttatggaaggggttgaactggtgaattgaaattttatgacatggcactgaaattacaattgaatggtcattgtaaatgatacatctgtcaacattttgtgtgactggaacaatgactcctcaaaactgataatgggacatatctctg

SEQ ID NO: 70864 - DNA, 470 bp, Triticum aestivum
  Clone ID: PAT_TA_70864
tttttttttttttttttttttttttttttttttttttgcctgtaccaaaaataacagtctaacattgttatttaaaataccaagcagtgaataatcgtgtttttctctcgttttgccactaacaaaaaggaaaatcaagatgtttgtccacaaaaaaaatggagaatatcgtttaaacttatgggtgcatttgctttaaaaaaatggaataaagtgccgactacggctcagatgccatcttcttttcactatatagttcctcagtaccgataaaacatcccaaactatatgaatgcacgcatgatgatgagagcgcttcttagatagataaatttccatgtgtcaccaaaagtttaattgtcaactggacttggtgaagatcctacagaagcaacccaaccgtggagaattactaataactacaccaaaccaagatgatttgacggtctgaattttatctaattgagtgg

SEQ ID NO: 70865 - DNA, 541 bp, Triticum aestivum
  Clone ID: PAT_TA_70865
tttttttttttttttttttttttccaaaggtatattgtttgtgtctgttataacgctacatcttcgattctggtttcatagcctcttccctgctaatgaccgccactcttctgggcccttctttcttgaagtcaaccaatacacagtcttctgaatggcctcgtctgccagacttagcggcctcgagctctggtcctggtcgttccaggcctagcacgacacgaccgtcttccctacgctttcctccacagtggaggctgtaccgtgggactgatgcacttctccgtccatggcgggtctccagacttgataaagcccaccaaactcttccttctagcttccaattcctcgcgagggacagtttcgcgcgtgatgctaccgtatgcggtaggcgagatcaggttatcgagatgctgagcagcttggtgcagcaagaagaactgtggcgggaacaagataatgcgcccttcttgtgctagtcgtagccatgcagacgcaggcaagaagcgagcagttggtgtgttccaggccgccgtccgtg

SEQ ID NO: 70866 - DNA, 572 bp, Triticum aestivum
  unsure (1)..(572): unsure at all n locations
  Clone ID: PAT_TA_70866
tttttttttttttttttttttttgacaacttcagatcacgatcattagaatgcagaatctcatggctaccccattgatggaaagtgtatatacaaagatcccctntagttcgaggtcgaagacttacgaccagggaccaagatctcaactaacccatcatcttctccgtcgctgctgtcattctgctcttcttcgtagttagagctcacggctcgggctcggcggaagttgttataccgaccgggtcccgacaggttggagtaaccaagggattcattgatgatggcttcatcctcgtcgtcggagtccatcatgccaatgctgctgggtcctaccatttcacccatctcgtcgtcatcttcgtcttcaacctccaggggaacgcggacctggcgtcgcacggactccgggcggccgtcattttcgtcgtccgacgagttggtggaaagggaatccggggggctgaagccggattcggggaaggttggggagtgtttggtgttgggagcaaagtcactgttggggaacgccgagttggttccttcggcgtcatcgtcgacgcctgcaatcac

SEQ ID NO: 70867 - DNA, 466 bp, Triticum aestivum
  Clone ID: PAT_TA_70867
ttttttttttttttttttttttttttttttgaatggaatggagtgtttcatatcgagaacgcttgctgatacgacatcaagtattcccaccgaatttcctcaacaaaatgcactacatgctagtcctagatggtacactcacataaacaaagccaagatagttctacccagcagcaaattacatcggcaaacggttgcgggagcaagcttatcaaaatgtgacaatgaccttggccctggtagacgccctcggcagagctaatagcttggcaagaaccatgctacattccatttcacccttccagtctatcttcagttcttctaaagctggtgcccagcttagtagctttgccacgaaatcaacttcgcagtccagacccccgaaatggttcacactagccattacgagatggtccatttgcaattgcaggttaagtccttgaatgccacctgatcctcatcccga

SEQ ID NO: 70868 - DNA, 462 bp, Triticum aestivum
  Clone ID: PAT_TA_70868
tttttttttttttttttttttttttttttttttttttttttacagaagcatgcaagcactttattgctgcctttgtggcatctgtcccctaagtttttacaactataggttacaagcattttatttctctttgaccctacccaaagtggtagtagttggcaagccttgtaaatgtgtacattgttctttgattcattaatacatatttttcaatcaaggcttccaataccattttcatcaaaaataaataacattttgttatacagattagaaattgaaaaaaaatcatatgtataatcttacctcaaaaaaatattgttaggatattttattttccttttttgttacatgctacctccatcttaaaatataagatgtttttgtaggctaaaacatcgtgttaatattttgagaccgaggtacagtatagaaacctccaaaacgtcgtgtttttgcgataca

SEQ ID NO: 70869 - DNA, 526 bp, Triticum aestivum
  Clone ID: PAT_TA_70869
tttttttttttttttcccacaaaagtatttcccccgctctttttatttacttctgtataagtttgtaggcactaatacatcgggtattggggtgttagcgcactgctgttcgcgcgtgtcacgtctccgtcagctacgaaacggtaacgactaagctgctacgctccacgcagctttgccggaagatggtcaacaaaaacgcccgatcctccaactcagttagctagccgagcccgacattgccgaggctatctccttgccggccacctcgaggacttccttggccctgtgggccagcttgtcgcagatgttcctggcgatccgcttctggaacttgctgctcttgagccactcgatgcccaccagcacctcgcaccggcagctcggcggctccgacgacgccacgctccgtacgtcgtacctcagatgcacccggaagtagtcgccgaaggggacgttgcgcagcgtcatgacgtcgtacaccgtccacccgtcgccgtcctccgagggcgatttcagctgggtg

SEQ ID NO: 70870 - DNA, 522 bp, Triticum aestivum
  Clone ID: PAT_TA_70870
tttttttttttttttttttttttattctgcgacctttgtctatatattgagatggctcaaaaccctgctgccctccccacatgtcacattggcgttttcggcagattgaacatcaatacgaaagaggaaagatctcaaatactaggttgaaaaaatcattttcccccgtgcggactaacaccagaccaaccttggaattccaaggttgctcctaagcttctcactccttgaaccaagggtcatccaaaacttgtcctgctgacgcccttgcggacggctcgaactgcaacaacgttccaatgaattgcccaagtctcgctacatcctccctggtaagatcagggctctgcgggtgataaaagtacacctcctcgagccattcctgcaagttgggcccggcctcttctgcagttgcgtggtcccctgcgcgcatcttaatccatttgtcgtgccatctttcaggtagattataacctgccatctcgcgcatttgcccaacgagtatcctaggcgttatcaaaa

SEQ ID NO: 70871 - DNA, 503 bp, Triticum aestivum
  unsure (1)..(503): unsure at all n locations
  Clone ID: PAT_TA_70871
ttttttttttttttttttttcctgcatgaaacaattcggagaatcgatgttcttgaggagtatattgcgagcattgaaaggagtgactgtctcgacaaagactccggacttctacgcctgtgctatcgaagttccacacgaccacagctttttgtgcgcttgtttgcttaggaaacagtcatggaagcagagccggatccagagaatgcctcgacagccaggacctggtagttgaagtcgctgttaccaaagccgttcttggcccaagcctcgaagtggttggaggtggtgacggttccggaagtacgcttgttttggcgaaccgaccagtactgagtgaaagtggaagttccagtgatagacggctggttggtcctcgtgtcggtgcagagggtgtagtccgagccatcagaagccacggtaccgagctgcgtcacgccgngaagagcaagggtcaaagccgccgtaggactcgacgatgtagtactccgcctgggggctgt

SEQ ID NO: 70872 - DNA, 553 bp, Triticum aestivum
  Clone ID: PAT_TA_70872
ttttttttttttttttttttgattccaactttattaaattggtgaacacgggaaacaagcatggaagggaggagtcaggaatgcttcattgggcatttgtctaggtcctgacaagttacaacctccacgaggtgagctaatttagaaaccaaagtggcgacagatggccacgtagaaattaaactacagcttagaaagatacatcagggtcgccttgacaatggcacacgattagtaatccctggtcccgggcttgtacgtgctggtgtccttggcggggacgtcggtgctgccgttggtgccgccgcccattccgatcgtgttcatcacggcgtccttcgcccccaccgccgcgcccttcaccgtctcccctgcctgcacgaggaggctgccggtcttgtccttgccggcgacggcggtgtccatggcatactgcgcggccgcgccggccttctgcttggcggcctcggccgtctgctcgatgtagctcccggtctgctcggtgccggcacgggccgtgtccatggtgtactgggcggcgccggccgccttc

SEQ ID NO: 70873 - DNA, 615 bp, Triticum aestivum
  Clone ID: PAT_TA_70873
tttttttttttttttttgtgcggaattcatactgaatttttcttttattatagaatgacacaaactttcgtttacttcagacctcgttgcttgagctctgcacaggaacaagaacaaagagaaagatgtgtctaaaaccttgcggacgcaataccaccggacattagcagttcagagatgttgggagagacagaagagcacaccaaatatctgaacaccgggcacattatgacagcagaacacataatgtacacttgttggcgaatcaagctcccatccaataaacatccagcttcaccagatttcagccaacctttaaactttgaacaatcgcaagcacatgcttctgcgtgatggatagggatattggctcaaaactcgtccactgaacagtctatacgaagcaattaccgacgatcttctgaagcataacaggcacagtctttcccatatttatttgtagcatccaaccaagtttcagatgcgatcaaattctccaaaagattagagaagcaggcattaaaaaaatgcttaacttaccgataccctctcccctgattttcatcaggatgttgccacctcaagcccataacattaattcgatatgataagact

SEQ ID NO: 70874 - DNA, 553 bp, Triticum aestivum
  Clone ID: PAT_TA_70874
tttttttttttttttttttttttttttttggcggatctcagtttatatatcgggtgtattagtacatacatacatatagccatatcagaaaagtactgccactgtcttgctattcatgtatataccattcctctctagaaaaaaaaagatagaatcactaccgacggttttacataaacaggaaaaaggaaaccatctccaacaaattgtttgacaaatggtgcatctattgtactaattcatcaccatagaagatcaatattttttgtaaataaaattcattgtcatccacagattcggctatactggctgatatctgcaaacattttctagaatacagtatttagaagcttggttttgaagcaggtcgcccaacccttcctttttccgcatatttacacatgcaagcctgttgtcacttctcattaagtgctggacaatgcagaacaaaagttggcggcttgtgagtgaaaaatcaagctgttctatgaaaagatcagaaatgctcgcggacaatgtacctggttatctttccaagaatctgttagtatct

SEQ ID NO: 70875 - DNA, 663 bp, Triticum aestivum
  Clone ID: PAT_TA_70875
ttttttttttttttttttttttaaggctttttgacatgaacttcttaacaaatattttttatacaaaatacatcttataccaacttgatacattcgatagacacacaaaaaacccacaaacaacaacacctataacggtgcttgacctgactgatttccctaggaaatctgccggatgatttgtagcagtcgcccttataaaatgcactgaaccccacgtattaacatagcgagaatgcaaatactttgcgtcgccgaaccgcacacactcgccgcattgcacgcacgcgattgcttgaactgcacggaggcgttgcccatgcactataccagcaagcgagctacaaaacaaactttcagcgagctgtaaaataaacttcaatgggctgcaaagagggccccctcgccctggagaaccagagccattgccaacctggacccgtaatccatccactccagtgtcgttgaggagcccgcgacaacggcaaggagctcaccgcacttcttacatcggcacttccaccggactgcacgaacgcgtgcaccgcactgcatgacacatgccggagaccgtgagggctcaccctcaatgaactgcatcaacacactggaaaatatactcaacggaagcttctgaacagcactgcacccaattcacttatc

SEQ ID NO: 70876 - DNA, 472 bp, Triticum aestivum
  Clone ID: PAT_TA_70876
acaaacttttcataccatacggatcaacatcaacacaagcgtacttcacgtaaaattaaaacggcaaccgcacgtacaattaaaaccgcaaccactttggaaaaaactacattgcaagactagtagaacatatccatacagatacaacactaccaggtctgtcatgggcacgcctgcagtttaacagcctccgcattagtgcaggtgttccgcctgtgaccggcaacaccgcagttgctgcatttagcttctttcctcggtttttttggaagatcacctctttccgggcaagtcgtcttcttgtgcccttttccgcggcaaatgctgcaatacctggttctcttactcaactcttcatacggcgccttttctctgctgctcgttggtcgaccaagtttcctcctcctctctggtgcatcgaggccagccaaagtatccacattcatttctcctccatggccagccatttccg

SEQ ID NO: 70877 - DNA, 465 bp, Triticum aestivum
  Clone ID: PAT_TA_70877
tttttttttttttttttttttttttatttttattttttcactattttattgtctggcaataagcagatgcagattctccatttagtcaaagagaccaaagcccatgtcatcatcttcctcctcactctcttccttcttttcctccttcttggcagccttgggagactcagcagcaggtgctgcagcaactgcaactgcagcgaacttggaaggatccttcaagaactccttgacagttgtagcttccttgaactcgacatcagtgacagcagccactgccaacaggttcttaaatccgttgacaacggagtgaggcactgaagcgacagttgggtagccaatggatagacacacagcagcaaggcggctcacaccctccatgaacttgacacggagatcctcaggcttaatgtcaaggatcttgggctcgaaaatggtgccagagtcatagaccatctcgacaat

SEQ ID NO: 70878 - DNA, 404 bp, Triticum aestivum
  Clone ID: PAT_TA_70878
tttttttttttttttttttgtcataaatactcttattttgcaaaataatttatatggtacaagctagagaggtcatcaagttaccttacatcatgattcttacttggatgcactaaacctatgtctacccagcagtattggatcataagtataaaattgtttgtacaaattcaattacaaatccgaacaataaattttgtttcttatacaacaccattggtagcgtttgccgacaaaaatcttctaaactttgtgcagaacccagcatgaatttcgcaaaagcagcaccttgggtggaaaaattgtctgcaaccaattaagcacctagttacacatactgcgcgttaattagcctgtactatgccagcttggcttgctcaagcatcttggcgacttgcaccatg

SEQ ID NO: 70879 - DNA, 288 bp, Triticum aestivum
  Clone ID: PAT_TA_70879
caaacacgatactgtattgaaacctcaggacgataccgtgagccaattcaatatacatccaaacaaccggatttgtattcatgtccattacagtttcctggctgaattggaattgaaaccaatacaatacagaggcctccaatacagacatccaaatgcagcgttatctctattgcatagcccaaggggaatatatacatagctaaaggtcctcatatggtagtagaccatgggccaccctatcagagcctcagccacccatcccatggctcaagatccgtgcaaaaa

SEQ ID NO: 70880 - DNA, 266 bp, Triticum aestivum
  Clone ID: PAT_TA_70880
tattaaagctatggatgtgaaggaaaagattgctatgaacagccaaataaagtgcacgattaaaagcaaagggcgtgagccaggattgaatcaaaacaataacatcagtcttctttctccgaggtgccacacagcacagttaagatacaggaaaagagtgatggacagggatctaactactcaaaacaagatcaagagccaaaaaaccaatcattccttcccaggatcggtaacagtccacatcttcgcgtcaaagccagcccggc

SEQ ID NO: 70881 - DNA, 187 bp, Triticum aestivum
  Clone ID: PAT_TA_70881
actatgaccatgaccacacacacacacacacacataagtatatagcctgcagtatatacgtaacgcacggaagctagtctctgtcaggcggctggtcgctggctagttctcgaagctgcagaggcggtcggtggcgagcctgcccttgtgggtgctgctcttgtactccttccaggtgaactccctg

SEQ ID NO: 70882 - DNA, 215 bp, Triticum aestivum
  Clone ID: PAT_TA_70882
attttcttttcattcaattaaagttccgattaaaataattaatattaacgcaaatgatgaaaaaattcacatttttaggctagttgaaaaaaatgttgttaacaatggtaaaattaaagcaatttcaacgtcaaaaataatggaataagattgcgattaaaaaaaatcgaattgaaaatggtatttgtgcggaattgaaaaaattaaacccacat

SEQ ID NO: 70883 - DNA, 552 bp, Triticum aestivum
  Clone ID: PAT_TA_70883
ttttttttttttttttttgttggggcagaaatatcaacaaaagattcacagccaggaatatatgttcttccccttgagttgctctgtctaccgataccacatccatagcaccactacaacatgccacgactcacaaaataaaaagctacaaaggccacaggtctattccatgtcaaactactctctgaacctacactaggtcatcagccaatgtacttcttgtccatcagccaccatcagcatcgaaccccacctctcttcggcatcactcatcatccatatctctcaagtgacggtagtgtgccatgatcggccgaaggaatttcttcatcttcattgacggaccactgaacagatcagtgaatatctctccaagaacatcgttgttttttgatgagtacgcctccgcctgaaacatgccacttagcggccttgtaccagctttagcagccaagtggctgtgcaaatgcacatccaaatggcgtttgaaggctagctttcctttcttgtttcgcttgaacttagttttctcagtcactgcactagacctta

SEQ ID NO: 70884 - DNA, 532 bp, Triticum aestivum
  Clone ID: PAT_TA_70884
tttttttttttttttttttttttttttttgagcaggccaaatacttggaatgatatgcttacaactggtatagaagaagcacatttgcatttcagactctcaggttgccaaattttcagtttttgtatttcatcgtccttctccttaaccaaggactgcatttccagtagcttaccctcaagagtcagtaccatttttaatgcattagcagcttctgctcgcaatctacagttttcatcatccttatttcatacttctacttgcagcacatctacattctgctgaaacttttttactgcctccacttcttttatgttaaggatccccgcttctgcttgcaatctgccaatctcaatatccttatttcggactgccacttgcagttcctctacattttgctgaagcttttgtgctgactccacttgttttatcttaaggtgccccacttctgctcccaatttgccaatctcatcatctttatttctgactgccacttgcacctcctctacattctgctgaagcatttgcacac

SEQ ID NO: 70885 - DNA, 322 bp, Triticum aestivum
  Clone ID: PAT_TA_70885
ttttttttttttttttttttttccaccttaaaaaacttcaattgcctcatcccgacaaatcacaaacaacatgatatgacaaatcacaaaagggttgggctacggctccattcccggtatatttctcttcctgacaaaaacagcaaatgtacatggctacccaaatacggcccgtcgtcttttgaccactacatataacaaatttctataccaatggaaaaaattacagtgggacaagggaatcaacacacataaaaaaattgtcacactgctatgaaaactgaatcaaaaagatttttatacaccaaaaatactgggtgga

SEQ ID NO: 70886 - DNA, 445 bp, Triticum aestivum
  Clone ID: PAT_TA_70886
ttttttttttttttttttgagggtaaaaaagctgattttcatcaatatgtgctgcatcaacatccatataggacatgaaaaacatgtcgaacccatgccaaatgggcgtgtctaaacagaagtacaacaagagggtatgcatccattacactgagcctacattcttgtttgcagcaaaagttgtgaactacaacccacgaaatagtttaggacagacacaaaagctccccgggaagaacgaactccatccaccccccttgatgttgatgatgaaaaatgatcttcaatcttcaagtcaaagatccagcaacttcttcaactggtctgcggggtatagtgtattgctggggatgcttgataagatctgctgcaatgcgtttccggaggtttgggatgcaactctcatcgaaatgcttcatgacaacaccatcaaagtttttgaaat

SEQ ID NO: 70887 - DNA, 541 bp, Triticum aestivum
  Clone ID: PAT_TA_70887
tttttttttttttttttttaaaacaatatttatatttaaaagataacaaatttataaagtgtttacaccacccattatgttcactggacgtcccttatatttcttcgaaatatcttcttcaatctgactctgcagtacttttgttttagaaataactaagtcaagcttgggacgcagatctcttgccaattctccatgttccacccgtttttcacgaactcgaccctgcagagcaatgctcttgtcaactagactcagcttctgcttcagtgtgacagcaagattatctacatatcgtggagaatgtctaatattgtgcaaatgatacaatgttggatcatttattttggtgatcatagtctgaacagtggtgagcattttttgaacactgtcagtagtctgaacttgcagaaatgattcagcattctgaagttgtgccaaagacaacagatcatttccaccagacttcatttcatggagacgcattttcaggaaagattcaacctctaataggtcattgacaaagcttattcttgtgaca

SEQ ID NO: 70888 - DNA, 676 bp, Triticum aestivum
  Clone ID: PAT_TA_70888
ttttttttttttttttttttttcaataacaatgacaattcagaatctgattcaaattcaacattctgatataactagcaggatatagaacgccgaaattggcaaacgttatggaaaacacagagagtgcgtaggatgcagaataagttctcgtcttgttatgcttccctttaccaaaagagctttgcttagacccagaagcatttacaaccacatactactactacacatagggttaatttcaacggcaaccatgtcagcggacagtgtcgtagcaactcctattgaaatctggatacctgttcaaccaacatagcacattatttgcagatctaatgtgttcacaggtccagaacagcccgtctccagccaacacccttacctgcagtaaagaaatttctgtatggatagtggatcttggtaccccaacgtgagcttttagaaagagttctgaactgcatcgagtcaagttcaagcatgaacacgccaaaatccatagccagaacaagtgcatttgattcctcatcgtatcccaccagatctgcctcatatcccaccagatattcctcttggagcttgctacgcattcccttctgatagagcctctccaattgaaagtttttctgaagcagcacccattcaacaacgccatcatagtttgatttcctttcccacag

SEQ ID NO: 70889 - DNA, 271 bp, Triticum aestivum
  Clone ID: PAT_TA_70889
tttttttttttttttttttttttttttttaaaaaaaaacaacttcctgttggttgcctttttcttttcttgattgatcgaaccaactagagcaccgacaatgatctaaagtacagcgtgtttgttcaacacccaccatccatctagtacacaaacccaaaaaaagccgccccaccctcaataacacagcgaaaaattaattcccgttgagtacagctcatacctctcaaaccgccatcggtgtgggggtacataaagcgacgggcaccagc

SEQ ID NO: 70890 - DNA, 496 bp, Triticum aestivum
  Clone ID: PAT_TA_70890
tttttttttttttttttttttggaaaaacatatcagtacattgcatgcaaggatagaagattgtgcagcagtcaggtcctcactgtcagcacggcccataatcatacaacacctgtgttgtgcagtaaggaaaaatgagagctaatctatctttgacagagttgaagttttcggcgctttcgaccaggacccaagaacaagaaagaacggatcaagaccaaggcctacccacagaccaacaaccgcagcaacacatccgacggttccggccaggacccagactcacgggattcccttggcttgatttccgtctggtgttcctcctatcgatggcgacaatgcgctctagcgctcctcctggaagcatctacgcaagcagcagcctccactcgtcccgatgatggcaacacagcgagcccgacgcggcctcctccatgatctgcctaaatcaagcaacagaatttagtaaacgaacatcagattacttgatcccaag

SEQ ID NO: 70891 - DNA, 404 bp, Triticum aestivum
  Clone ID: PAT_TA_70891
ttttttttttttttttttgttttttttttttttaacaagagggctaattggacactgatgaattgttatcgtttcgacgacagaacttttaaacgatataaaaaagcaatgaaagaaaccatgagagaacccctccatatttacacgccctagtcagctagtctgcagcacagagacaggctcgaacactaccaagtttgatctaacagagtacacacacacgcacacatatcatatctcagtttcttgggtagctccatccttcctcgtactcgcacgccatcttactgaagtctacgagatatccatccacaaacttctgagcaatctccatggatgttaggagattgtgcagaagtttcctggttacatcgggagaagttccacatccaaccctttagggg

SEQ ID NO: 70892 - DNA, 500 bp, Triticum aestivum
  Clone ID: PAT_TA_70892
ttttttttttttttttttagagcaaccagatcacataatacattggcaacaacagtactctatccatgccaatacatatgaccatgtgtaatacagtactttacaagctctacaagtgtaacgagctctacaagtgtgatacagtactactttacaagaaaatgacaacatggcggactcgtcggacgaccagtcggggctgggaacaaacaaaatggcaacatggcttcctgtcaccctgctgggagcggtgcgtggtcgtggtcgggcttgaattgtcgagctcaggcagggcagcttgattgccttggaagcagaggagcagaccccttgttgcgggacagggccggtgcctaggtgcgtccctcttcctcgagcaggacaaggccatgttctcggctagaactggcgtcctcctatcgtcgtcgccgtccacgccatgggcgatctagaaaacacgtcggcaagttacagataactgatcaatgatagacacagac

SEQ ID NO: 70893 - DNA, 647 bp, Triticum aestivum
  Clone ID: PAT_TA_70893
tttttttttttttttttataaattagatctttttattgatcaatactgtgacagaaagagcatatttaagagaatcataaatctgaagttcaaactgtggtccctttcctatatacaagattctgttaaaacctatttgtcagtttaaaaaatcctaaaacatatacatcaaaagtttcagcaaagtcggagttattaccaagtctacaatcaatgtcaaatttcattaacaaatcacatagctagaagtttatgttatcatgaatattatgtgtatcattagaatccttcgaatgtcagaagaggcgcttttcataagagaaaaggctgtgaacattaccttctgcttgggcagaatttgaacgcctctctagtttgagctctccggagtacatcattgaccgtaaggctgatagacttcgtgaaccgatatcttggcaaccatgtctgattccacaagcaaggtaagggaaggaaactccgtactgagcccttatccacaattgctccactgacaccttgtgccacctttaacttatccatttcattgtggaaataacgatccattgcagctcccttggcatctttgcgattcatggcctcaaggctacccatacctctatattttttcaatctcacaccatctg

SEQ ID NO: 70894 - DNA, 491 bp, Triticum aestivum
  Clone ID: PAT_TA_70894
tttttttttttttttttttgaaggaaattaaactacgtaggggatgagtcacgtagggatgcagagtgatcacgatatcacgaattcacgagaatactcgtgtatagctagcttccgatgttgcgcgtgcgtccttgatgatgcacgtagggaagcagagtgatcacagtctggacgatggtgcccagcacggccatggagcccaagacccacgccacggcgagccacgggttgcggaagcggtgccgcatgacccaggcacgccaccggtttgaggcgcgaccggtggtgcgaccgcagcctcacgcccaccgtgctcaggtagtgcccgccggacgggtcgaagacgagcccctgcgccagcccccggaacagcgcgcacacctcggcgtcgtcgcccaggtggtgctcaatgaccccgtgccgcgacagcagggccacgtcctccggcccgcccagcagctgcgacatgaacatcacatacgccgtca

SEQ ID NO: 70895 - DNA, 634 bp, Triticum aestivum
  unsure (1)..(634): unsure at all n locations
  Clone ID: PAT_TA_70895
tttttttttttttttttttttttttttttaatattacaagcacaccaactggataatcccaaaggaaagtggaacaaatcaagcagcaacaatgatacttcagaaggagtagcaagctttccaatcacggccacaaaacaaacaaaataacgagatagcacaaaaaaaagaagcttcggaagatctgcagtcccacctgagccacaagcaggcctgccatagtagagccgtagtgccgcctgagtaacaaaaccagcggtggaggggcacgatgatgtcgacgaggtcgagaagcggagcccctgcatcttctcctgtccgcaccaagcaggtacggcgccaccaccttgtatagtgccttcatagatatcaggcttgccaacatgtngaagagatgcagtgataaacaacatttgctcctctgatggacatgctatgtttagtggtggatcttctgttcttatcatacttctcaaatgatcacgttcttcttgactacagtttcttccttttaatggggatatccaagtctgcaatgcaacgaagcgttaagttaataaattcctgatttgcagagctgctcggagaccttgatcatatcataccccaccaccacgcatagggtcacattctg

SEQ ID NO: 70896 - DNA, 526 bp, Triticum aestivum
  Clone ID: PAT_TA_70896
ttttttttttttttttttgacataacaaaggaagaagagcatttcacaacatgattaacacgaagcataatatcctccaatttgaatacagtacccaacaatgacattaaagatgaactgcatctactaattaacatcacccaaatagtttcagatgcaactccaaaataagcacgaactgccttgaatgcaccgtttgtttcccatcagcagcagtggacctaatcacaccaatgcgtcggaccaaggggagagcttatcgatgcggatgtacaggggaacttccatggatgccctgtctcctgctgctggcaccaggtacattggcggcactgtcaggaatgtgggctcgcccgcagcgaccacggcgccgggcgatgagctgctcctcatgtgcatgtccacgagcaccatgtcctccttgccacagttcgccactactgccgggggtgtctccaggttgacccacatcttgcacgtgaaccgcggccgcgtcaccgctctcgccctggcgcacaccacagat

SEQ ID NO: 70897 - DNA, 246 bp, Triticum aestivum
  Clone ID: PAT_TA_70897
ttttttttttttttttttttgaatttctgttaatgatgcatcagatattgatagacataagttgaaagtgtcaaataataaacaactgattccggataataatttcatagtctaccagtgtgcaatgaaaatttctgaagtctgtcagaaagattattcgcaaccagctcgaccccaataccactgccaccccttctcttactttaaaaaaaaattacacgcacataaacacgcgcgggcctagat

SEQ ID NO: 70898 - DNA, 427 bp, Triticum aestivum
  Clone ID: PAT_TA_70898
ttttttttttttttttttttttttttaaagatggcggggctcttcgcaaatgaagcgccgaaaaattaatgcccaacatatcatattttcttattaaagagcgtttgataatcaggtcaaatgctgacacatagcgagaacactagtgatttcactcccatcgccaaaaagaactgcataaacccattgccagtatcaaacaaagaaggtaccccaaagttgagtgcttggaaaaaaatgccccacgccagcaacaagaccgaggtgtgacaaactgagcgctcaggaaaacaaaacgatggaccgagcttgttttcttgtttcaatcaaaataatggcccagtcaaagtccagtttggaaaaaacatgtagagaaatccacccaggcatttcccatcacgacttcagttgatcaaacgtcttgaaa

SEQ ID NO: 70899 - DNA, 418 bp, Triticum aestivum
  Clone ID: PAT_TA_70899
tttttttttttttttttttttttttttttttggagtaagtgaatctatcttgtaaactccattgtagaccatgcatatacacattattctccaaaagaaccggtgcagattatttaaaggagcttgatatcccatagaccatagtcctcgtgtagtcttgcattgaaagatataggtatgtaagacagttagcttggaatgaaatagataattaaatgaaaaagagattaactgaaatgaggtagaacttctagtagggtcacatttcattactcagactaaccaaaagtttcagaaccgagttcttggagctctttgtctttgagatcatcattctttataatctaaaacgtgaacatttggttggtaaagaacattacgtgttaaatatgacatgttatagcaagcctaatatcag

SEQ ID NO: 70900 - DNA, 262 bp, Triticum aestivum
  Clone ID: PAT_TA_70900
tttttttttttttttttttttttgacccaaacatcttgcaagcatttttttttcatttgttaattaccctgcgttgtagctggggcaaaaatattctaagggcaatactgggccccggccaaaattttcggccggtcccaccctacccgccaaatgccactagccctggccgttgggtatataaaaaaaaaaaacgatttgccccaaacattatctccctcctgacgcatctccccctcgcgcaggtctctgtatttaaccg

SEQ ID NO: 70901 - DNA, 396 bp, Triticum aestivum
  Clone ID: PAT_TA_70901
ttttttttttttttttttatcttggaagataatcagatggctgttgtgtcgcacatggtgattcatctgaacctaacccgtaaaatgccaaagacaggtctcagatcagagtacatcaaaagtattgaggaaggtactattttttgaatacatctttactcttcatagtcgcgtttgcgttttccaaataaacctttgcgagcaccgcacagctcacttgctgtttgatagcccaacatatggtttaatgatctgatatatggagcattacatcctagagccgaggcaaggtttatttagtataccttgccatgtctagctttggaggtgtcgtctgctgttggttgttgtgctttgcatgtccgtggacaagggaggagaggctgccgttggggt

SEQ ID NO: 70902 - DNA, 457 bp, Triticum aestivum
  Clone ID: PAT_TA_70902
ttttttttttttttttttttttcaccaactcaagcccatattcttgctgaatgatctgtacagttttcacacaatcaaagggcatagtatcactacccagaaccagaagactaggaaggtagccacgcatagagtgtgtagtttaagcactgctaaaacatctagccttcaaataatgttagcttaacactggagcaggagacctaggcaggggatacaagctgctaaaacatcttgcctccattagtaggagagtgttttacaaggcactgcatcacaatgtaaaaagtcctaaacaatggccccttcatcattcatcagtgcaccttggtttcggatacgggttgttgagtgctgcctttttgattcgttcgatcagcttcttgtcaagatgcagatagcaacttttttctgcatctccctgcaatttgagaaaatgcaagagataaaaatcagt

SEQ ID NO: 70903 - DNA, 534 bp, Triticum aestivum
  Clone ID: PAT_TA_70903
tttttttttttttttttttttttagggaaaatggcaaattgattcaacagtacgggtatcagttcagccaataagttatcataagtttacttcctagtggttttaagtcgtggcatacattattcacccttctacctatacagatgtctccttcactctaaaatcacagtgcagaaacaaacgtgacaatgaagagcgcgcccaaggaactgatgtcacgcatccattcaactggcctggctctatttggctcaggatctcacgttctaattcacgacggcgaagcattagtctcttgagagtcatcagagtctgggaatgggttgaaattgacattaaatattttctctgggatgtgctcaatcttttgccaatatggatgcccaactgtttgacagaactccataaactcataatcgcaatcaataagaataaacttcacaagagactggggaagtgttggaagcgaccggatattgtcgcaatatacgatctccagtctcttgagtgatgtgaggcgctccatattgtcag

SEQ ID NO: 70904 - DNA, 418 bp, Triticum aestivum
  Clone ID: PAT_TA_70904
tttttttttttttttttttttttttggcgagactaactggacatgaattgaatgctgctcatctactaccatcggtccagcattttccttcgcgcacataccagcaactccggcgtttctcaccatacactcgctctagctctatacagattacaggcaaacatgacagacacgcacgtatccgcccgaagacagtcatggcggcagaaagggacggcgatggtcatcgtgaggcggccaacgcacgccttctctcgtgcaaggaagcaggagaggcgccggctgcgcgagaaacgtcgggtaccgctgccccggcatcaccaccgtcaggtccgccgccgccaccaccgcctccatcttgggcggaggcgcgagcttctccggcgagccgtggtcgcgcgggtgccggccggggtgc

SEQ ID NO: 70905 - DNA, 332 bp, Triticum aestivum
  Clone ID: PAT_TA_70905
ttttttttttttttttttttaaaaaaacagaccaatggtttaccttaaaagaagcaagtaccacatattttcgactgtttgaaacatacttagtgttcacaccacatctccacacaggaagacttggtgaccctagcgccagctgccatgttcttgacaaatgatgaggtcaaaccagagtcctggtacaccacagtacatatgatgaagtacaaatacataatgtgtggtacaaagcagaccatccatcagctttgatcagcagggtcatatgggtagattgggtagggtaggaaagaggcaaaagcaatggcaagtctgttccatgtatc

SEQ ID NO: 70906 - DNA, 430 bp, Triticum aestivum
  Clone ID: PAT_TA_70906
ttttttttttttttttttttaaaaaaataatacaccttactattgaggaaacggagggagtactagtacacaggacgaatttccatccagcttaagaaatcatacatcttaagaaagagttcaggtctgtggacgaagatccaccctcttggatggcactgcgagaagcgtccctccacagaagcgctctgctcctcaccccattgctctgtggcagatcagaggagctcatcagcgtctcgacggcccgcgcaatcgcctccctcgtgatgatgccgtcaggttgcatcttctctttaagactgtacccaatcttccacacgtcgacgaccaggcggctgttggtcggctggtccatgcctatgggaagagtgagcatcggaacgccggcaaacaccgcctccagcacggagttcatgccacagtgcgt

SEQ ID NO: 70907 - DNA, 319 bp, Triticum aestivum
  Clone ID: PAT_TA_70907
ttttttttttttttttttttttttttttggcaaaaaccacaggccacaaaaacatttttcatcattcaggggacccaaaccatcgggcaaaacttggaaattcaaagtacatcacttaaacaactacctaaaccggcagctaaacacaagctattttccaaaagtcaaatttcaaccacccagacctaaagctggcacacaggtgcacagcaaggtttacatacacacaacttgatttcggcccccaaaaaaaaaagctctatttcattgaacacccatacaccacaaagacccctgttacggatccttcattgcccga

SEQ ID NO: 70908 - DNA, 426 bp, Triticum aestivum
  Clone ID: PAT_TA_70908
ttttttttcccccaggcgaagctagcccatatatagtcaagtttgtgatttgagcttgcatctcgtgactgcctttttctaaaggatccttcttacacttacttcacacgcaatgctttgactggtaattatacatgtgatcatacaagtactaaaacatcgtatgattgatcaagggtgctagtttcattaggtattaggaagtagatgaagtcaatgttgcgcacaccacgccacacccccctcacatggaatccttgctgccgccgcctttaaacatgccattgcaccatcatcagcgcggtcgggccgccatcgccatggccgtcgcaacatcattgacatagtcatgcccgtcgtctcaacacagccatgaccttgacacatgttgtcacggcatcatcgatgcaatcgggcctcggtcgt

SEQ ID NO: 70909 - DNA, 479 bp, Triticum aestivum
  unsure (1)..(479): unsure at all n locations
  Clone ID: PAT_TA_70909
tttttttttttttttttttaacaatcacgggagaaagcaggaggcctgtngaagcgctatggtatattagatagtactacagagtagaagctgttcatcagagcgtacgtccagtcatattttataggcacgtacacgtaaatgacagcaacacatgcatccatgctgtgttagatcgatagctccggttcaggcactgcattagcgctgaactagcattaactgaagcaagtttgatactactacacatcacacgacatgcatgtccgtctctttattcagaacagcaacaaagctagaaagaagcagaagcgctcctgaagtacagtacgtagtactctccatcatcttgctacggccggctcgagatcctgcgcacctgagtaagtgggcgatcctccgttactctgcagccaccatgctgctgggcttgggagtggggttcatcttccacagcgacagtgcagcacgaacataca

SEQ ID NO: 70910 - DNA, 483 bp, Triticum aestivum
  Clone ID: PAT_TA_70910
ttttttttttttttttttgtgtaaaagagaattaatagaaatagtagtcaattacatcatataatttggttctatactcttttgttcatgtgtattagttggcttgggctgcgaatgaagcatgaaaccaaaaataaataaacgaaaatcatcttgcttatgagcctgtatacctagagctacaaaaaaaagcccatttcttcagcaacctacacccctcgcagccactgccaaggggaccgctgtttctgccaagcctccaaggcaattcatctactggtccacagctgtaattcctcccgaagcacaaacaataaacaaatctagtcctgatctccatagttctagcaaaagtgtacaataaccattgttcaggcaaatgatgagtgattcatgagaagccaagtgccacctgatataatagagaaaaaaaataatctgcttctgccaagcctccatggaaattcatctacaaaacaatac

SEQ ID NO: 70911 - DNA, 165 bp, Triticum aestivum
  Clone ID: PAT_TA_70911
ttttttttttttattttttttttttttttttttgtcccgcagtaacgggcgaggtatcatctagtagttattgatatgcttgtgcatcccattgcacgaatcctaccaggtaggctattcttaaggactattaaaggtgccattaacatttttgtaggaaatgtg

SEQ ID NO: 70912 - DNA, 354 bp, Triticum aestivum
  Clone ID: PAT_TA_70912
ttttttttttttttttttttttaaacagaggaaggtgctattcaaacataaaaacacaggacaggaataaactaaataattagttttcaactcattacctccatccagaaagtaacactaacaaaataagatagcggaacactggctaggaatgtcgacagaagtactcaagaaatcagccatcaaaactgactacaaagttcacgacacccaggtggcacatatatcatcttctagatatgaagcagcaaaatagcaacttctatcctctactcagcagcagcaacctcctctgctccaggaatcacctcatctccatcagcaggcctgtcaagcttcacaccaacatcctcc

SEQ ID NO: 70913 - DNA, 468 bp, Triticum aestivum
  Clone ID: PAT_TA_70913
ttttttttttttttttttttttttttttaagtgaaatcagtctcttaattacaccaccaagcttatagtacaatatagggaactcagaagcagctgttaacatagcagctccttgatcaattagtgcagcgccaacaccggctccaaactactagcagtatgtagtggatcattcagcatcatcatcataaactctatacctaaacaaactgaccaaaacttatcccaacaaccactccttgcacagccatgtagtgtagttgatcttagcgcatgcagcctctcccaacaacttacagtagccatgtgatctgtgatgggacggatcaaagatgctggaggctcatcaaacatcatcttcttgagcaggcctcggtcacgggttgaggatcggcctcctgtcggcgcaccggcacttccagttgagcggcttgtagttggtggagccctcgtcgtcgtcgccgccga

SEQ ID NO: 70914 - DNA, 420 bp, Triticum aestivum
  Clone ID: PAT_TA_70914
ttttttttttttttttttaccactgcgccaaggctccccttcaattagaggaacaacatggatgacatatgttgagaaaatgagaaacggaaagcaagtttgaaagatgaaatataaccaaattaggaacaacatgcagaatatcggttggttcgggacatgaagtatggcgcttccattctccaagatgtacacgacggatgaaatgaatgacgattgtcctgtaaatttgttggatttggattgagcaagtccaaaatctgcccattacatatctccaggaatgagcatctgcgagtaaaactgagtatttttcctcttctttcttccttttccttctggattcttaagaacagatgctcagacactcgaggcaccataccacagttctcattgtgcgggtctagcagtaacaatcta

SEQ ID NO: 70915 - DNA, 182 bp, Triticum aestivum
  Clone ID: PAT_TA_70915
tttttttttttttttttgtcggggccaatttttatttttattcatttacaagcggtccactacagctacatgattcaatcacaaaaagaaacatcctaaaaattccaactatcaaagatggggcagaggggtgtccgcaaacggcccgtccaacacaccgtcggaaacaatcttgtacgctt

SEQ ID NO: 70916 - DNA, 449 bp, Triticum aestivum
  Clone ID: PAT_TA_70916
ttttttttttttttttttttttttttacagaaacaaccgctttattgatgctagcggattacataagtcttatattacatcgacatacgaggccaagcagcacactcggtgcggctgaacagtatgtacattatttaatgaacatgacgagggtctcgatcacacgaactacgcggcagcggaagacgacaaagtggaaactccatagcacagggacaccggcgtggacacggcctagacgcaagatgcgctccgatgcgaaccaacttgcctgaaagcttagtgtagaggaggatcacacccctcttggtttgcttcaagacaagcttctccttcggttctcaatcttctggagaaaatgattttagcaagttgctatcgacttcattatagtgatgatgttctctacaggacctcaaccaccgagcaagatcacaacatgctgatat

SEQ ID NO: 70917 - DNA, 363 bp, Triticum aestivum
  Clone ID: PAT_TA_70917
ttttttttttttttttttttttttttttacacataacatggcaaattaaatgcatacatcatggcagattaagtacccataacatggcaactgcatttaaccattcaatgaattttcccttgcacttctgatgcccctgaagagttattcccccaattgttttaaaaaagaattctcaacatctagggtacaaaacaaaatgtccacaacgccacaatttttgctcatggattggccgcccctttcttcgttttcttgtgttttgcttggatctccaatcccgacttataccttatctctcttggatgaccctttgtgatggaacggggtgggttcctgacctggatctgtgtgcttgctgtt

SEQ ID NO: 70918 - DNA, 515 bp, Triticum aestivum
  Clone ID: PAT_TA_70918
ttttttttttttttttttttttcacggtcttacacggctaaccgaaataacaacacaaattgtgcagagtaccaagacaaggctccaacagtgagcacaaatagataagtagggcaagataaatgaagctggcgataattagggcaatctgatttgcaaatacctactcatctttgttcccaggaaactaatcaagtaggtaggatctaaccatggcggtgactagctctgtggtggccttgccaaggcacaacttgatcgccccggtgcaaatcaccttggacttgatgtcggtgacgatgggttcctaccgagcggcaatgtggcgtctgcgacgaaccttgtcggcggagtccttgaccctcttggcacgcccacggtgcttgctcagctcgtactcgcccatgtaggtaaagttggattcctccttaagttgagattcctgttccaactctctcctatatagcttctcatcttcaaatagagattctaattcgtttccagaaaacttgccc

SEQ ID NO: 70919 - DNA, 395 bp, Triticum aestivum
  unsure (1)..(395): unsure at all n locations
  Clone ID: PAT_TA_70919
ttttttttttttttttttattttacaaatcaatcaattataattaaatcaaccaagcaatcacattnggatgagtggacacgcacaagaaatttatgagggcagatacatcgatcactggacaatctttttctcacccaagatatccacaacagctatatctagttctagagaagatacatgtatagagagagttatacttgcacataaagtttatttggcgagttaattaatcaattgtgatctccatcgatcaccagaaccgcgagtaaatccatgcatgtcaaccaaagtatgcatcatgctcacttgtgtcgagggagctgtagtcggtgctcgatggctgtccggcagcgtacgccgtggccgtcgacggcattgtgtccacttcttggc

SEQ ID NO: 70920 - DNA, 482 bp, Triticum aestivum
  Clone ID: PAT_TA_70920
tttttttttttttttttcgctgaaatttatcataattctcccatgatatagataatgcttttgagttggtaaactgctcagtccagacccttagccccgtccttgtatggccgcaagtcgtattcatcggggtatgtttccaagatgcgcttgagctcattcatctgctcgcgctgctcctcggtgatttcttcatagacatccttgaatgcctctcgaagaggtggcttcttctcacgttccgcttcaccgaactccttcaacacagccttcctcatctgatcccgcgtctccttctccttatcctcattccacaatccctggttctccagccacttgcgaagtcgaatgatgggattatctctgcgcttccaatcctcaacctcgacgcgcgcacggtaggcaaagctgtcgtcactggtgctgtggtgggaaacacgataactcatggcttctatcaagacaggtcgtcccccgtccgt

SEQ ID NO: 70921 - DNA, 148 bp, Triticum aestivum
  Clone ID: PAT_TA_70921
tttttttaatttttttttggtttctttttttttcatgaagtgatctgacttcagtttacattaaaccagtacaaattcttacatgggaaaactagttggaacttatgtgctctatgtaaatagtgttattatttgcatatcacttctc

SEQ ID NO: 70922 - DNA, 456 bp, Triticum aestivum
  Clone ID: PAT_TA_70922
tttttttttttttttttttttttgaaacgtaatcagcatcggcgcccttcaatgatgctacactcttacttaatctaccattctttgagctttcacaacccttcgatctgttatgagcttttttgcttggcataaagtcatcgtcgccgctctcactttcttctacggccacccctgtcagatgcaacatgagccttgcctcagtcctgacctcgtttgcttggcataaagtcatcgccgtcttcactcactttctttgagcttgcgccactcctcaccgatgctgcactctatcgtggtgctcgctcagctggtatagggctccagagagacttcatccaccaaaagttgaagatattcttgttaaaaaattccgtgtccttcaggtatctcttaacatggtcatcatattgcttctgctgaaattttatttttggacactcggtaagaacaggt

SEQ ID NO: 70923 - DNA, 161 bp, Triticum aestivum
  Clone ID: PAT_TA_70923
ttttttttttttttttttttttaatttgatctcggtacccataattggttgcatctccaaaatctattgtgttgaatatcagaccataactaagacactgaaattataatgaaattactctcatgatgttacaatgaagttaattttgcaatctttctcgc

SEQ ID NO: 70924 - DNA, 406 bp, Triticum aestivum
  Clone ID: PAT_TA_70924
tttttttaagaaaaacgccacactccattgttgctatgatccatgattatttgcccgcagtaattactaggcactcgaataagaagaaacatcacacgtttccctcagaaaaggaaaaagaaacatcacacgttgggcaacaccacagctcctccgaggagatcctcggacaacctcttcaccgaagcgcaagaggacccaccatggtccactgccttgcggcacaccaccatcatttccatggccttctccttcgccttcctcccttcctcgccaccgcccatcagggacctcaccgctcgctccagctccgccgcctccacgaagttgtcccgtttcctgtccaccttcagcggcacggccacgcccatgtcgcagaccaacgtgaaggcgttgaaatgctgct

SEQ ID NO: 70925 - DNA, 272 bp, Triticum aestivum
  Clone ID: PAT_TA_70925
tttttttttttttttttttttttttccagggggggaacccctaaggcccaccaaacaaacttcattgtttttttttcccacgggggtatacaccaaaaccactgaaatgaacttctatatcccaggataaattgcaaaaaaggacataaaatgaaaattaatattacccggtctgtttggacaaaaatttcgggtggacaacccctgaccactgtcaccacccaccatggccaaacaccatccccccaactggccaactgtcacccgtgggg

SEQ ID NO: 70926 - DNA, 302 bp, Triticum aestivum
  Clone ID: PAT_TA_70926
ttttttttttttttttttttatatcaagaaacaaaaataataattatcatgaatagtacgtcatccatattttccccctgaataataaactgagctgcacacgatataactttttctagcctatttctctttttcatggttagcccgaaatgcacatcctcacagcaccagcagcagataactgcggtaaaaatatacaatgattatacagcaagtagcagctctgaggatcaaaacacaaattttacaggcgagattggaccgcaactcgcatcttgcatcttatttggttggccggtagc

SEQ ID NO: 70927 - DNA, 346 bp, Triticum aestivum
  Clone ID: PAT_TA_70927
tttttttttttttgaacgtacgtacccatgctaaaaagcggtaaagtggtggtggtactggtagcagtacgagtgcgtgtcagtgcacattcaaacgaaaaagtatgtgctggccctggatgaacaagggacaccaggtggattcgtgttatcagccgagatcgtctcgacgatttcttggaagcaatctacattgtacgaatcgaccactacacgccccacgccgggggaggcaaaggttgccggcggcggggcggcgtcctctgccggggcgccgtcggcctggcggccggccccggctcgcggccggccgtggcggcggcggcgggggcaaacacctcgtccc

SEQ ID NO: 70928 - DNA, 416 bp, Triticum aestivum
  Clone ID: PAT_TA_70928
tttttttttttttttttttttttttttttccccgacgacatagctatatagatatagatacccaatccgacactttgtgcaccacacaagcaatccagtcaacagcaaccatccttcctcgattggaagttcttaggcggacattattcgattaaaaagttcacaacgaaatgcacagggaagcgaaagaactacactcccagattcatcttgtcgtcatgtgcttcatttgcagcttcactgtttggggcagcctccgcatcccccatctcaacatctgccattgaatagctgcgggtgctagtaggtgcgtctagtaagggagcaaccccattgtcagtgttgacactcatcatcatgggtggattttgggctgtctggtgcattggtcgacggcataccttgctcagtggaac

SEQ ID NO: 70929 - DNA, 404 bp, Triticum aestivum
  Clone ID: PAT_TA_70929
ttttttttttttttttttttttatatttcatccctgttacaatgcacgggcatttgttctagtaataataaagagaatagggtttcggtcgtccgtcgtcgtggcagtttttcaaaaaagcccctcggtttacataaaatcaacccgcaatccgcacctaagtaaaataacgattcgctagcgaaaacaccagccgcacgtcccttctttatcctgtcctctcaaccgccacaatcgcgccccatcacccgacggaccgtgccgcgggtcctcctcctccccctccctctccggcaagtcgacagtcaccacctcgcccctctccggcaagccgacgaccaccacaaaccaaatcagtccgccgctcggcctccgccggtcctacccttgctgggaggatggcg

SEQ ID NO: 70930 - DNA, 411 bp, Triticum aestivum
  Clone ID: PAT_TA_70930
tttttttttttttttttttttttttttccccgcccgcacaacctcaaagtcgggttgcttccctgcgccggttgcaaacaaccccgtcgccatctgactacaggccacgagcacacacactaaacacaaacgcacacacgccatgctgctgcgtcccgctcgtcccgcgcgtaaccgacgtgcccgatgagcccgacaagcccgagggaaccattgcgtcccgcccatcccgggggaatccgtcacccccaacgagcccgaccaaacacgccgtggtttattccaaaaaacaccccctaagccacggcctctcggaacggcctgccaaaaggggcctgccccgtcttcgtcccctcgtccccatgtacccctccaccgcgtctccggaaaaaaccgccgctcgctgccgtt

SEQ ID NO: 70931 - DNA, 528 bp, Triticum aestivum
  Clone ID: PAT_TA_70931
ttttttttttttttttttagtagcggaaattgagatcataaagtgattagaagacacaagaattgtgctgtcatttccttacatactggcaatacaaacattggttataaagcagggaataaccttaatagtttaaaagtaccatacataacgacgattgcacggaatgaacattgttcatttcagatgaaactagtacatcatatgaaataacttgcagtacgtagcgaaggctacataggcaacaacatggtggaggaatcagtctgttgttgtcttcacggcggatgctatcttcttaatctcaggcctccttggattgagatcattgaagcggtggtaaacaaggatatagcatatttccttcctgaagacatccattgcccattgtttgtttgttttccagtagaacaatacttcattgggaaatcagtaaatgcgaaggcactcttgtggagacaatcattcaatgatttttggagaatgctggccatgttctccaacataaccctgtgcgggtgttcacct

SEQ ID NO: 70932 - DNA, 538 bp, Triticum aestivum
  unsure (1)..(538): unsure at all n locations
  Clone ID: PAT_TA_70932
ttttttttttttttttttttttccgcgaagcaaatgcaacggtacttcaacatgaaggaaattatccttcggctcattcagacatgagaggaactggatctactcttaaggctgaaacaatagagaatttagttcacctcnggaagcaatcaagcgaaccatccatatttcagaattgcaacaacatgagaattcggcacctgccgaccctatgcctgtgaatatttgcatcgataatattgctttgtgacatactcggacatccaatagctccaaagtgcataaagaattgtaattgtagactataggttgtccattgacaagttctttattgttttatggcacggcaaaaatgaggagcattgtaatgtcacaaattggtacagaaaaagactactacaataataaaaagagaattataacacaattttaacaaactgaacaatttgcttatgcataacaacaaatagttcaagagctcaattagaaccgagagttatgtggttataaccaagtgaactaattacattatcgagta

SEQ ID NO: 70933 - DNA, 488 bp, Triticum aestivum
  Clone ID: PAT_TA_70933
tttttttttttttttttttttatttttttttttttttttttacccaaaagcaaactgcatctcttgcattttcatttcagcactgtcacagtgcagttccgcggaattacacaggggggatgggatgggatggaaataggtcacaccacttgatgtgtccccaaaaaaaaagcatcctagtttgtttgctgcacaagaagtgcctagatggcacacagataataactactctcaagttgcatttaaacaaaaatgaaatactgccgccaaaatgcagttctaatcttctgtatactgaacggccatgtcgcccaaaatatttattgtctgcggcggagaccgaagctgcgcgcacactgctaccacggcgcggtcgctaacagctgcatcatctcatccactatcttcacgctggactccagctcctccatctccatgtcaatctcctccagagtgtccttcacactcgaaatcctggacgaccgcct

SEQ ID NO: 70934 - DNA, 533 bp, Triticum aestivum
  Clone ID: PAT_TA_70934
ttttttttttttttttttttttttggcaaaacagatggagcattgggttcatatcaggtcctaattaaacccacaaacagtagttccacataacctaagagtcaagtttgtttcttagcaaggtactagaaagaaaggcaaaccatttcatagccaaaagttagttggcgccctgctgtagcggcagttaagaatcccgggcattgatgctgtagctggaaaaaagttggatgatggtgaaagggcggtgggcggcgaagataaacaactcgtgcagcttcacgaaatctacagcgccagctgagatcctctcgtctttctcgtccttgagattgtacatgcagatgtacgcagacgaacccaggcgctcaacgtagtagacacagttggactcaacagatggaaacttatcggtgtcaacagccaggcacctgtgatgaccgatgaagatggcatggctgccgatgctctccacaggcacaatgctaccgatgtccatcttgaaaaccttgacgcatggctgcagcttgatg

SEQ ID NO: 70935 - DNA, 380 bp, Triticum aestivum
  Clone ID: PAT_TA_70935
tttttttttttttttttttaaagcgcaaaattaatatatattttttctgatcacctctcaatagcaagcacacttattcgtacaattaccccatgtgagtaatactaatcattatggtaattattgtaggatgagttaattaattaacttccactaggttggctgccaccggcgccatcttggcatcctcctgttcactctgctccttcttcaccaccttgtgctcctcctcgccggcgaccagcggctccgtggcctcctccttctcctcctcctcgccggcgaccggcggcttcttaataacctccttctcctcctcttgagcgacaacgggcggcatcttaacaacctcctcctcctgttgatcattcgtcttcttg

SEQ ID NO: 70936 - DNA, 498 bp, Triticum aestivum
  Clone ID: PAT_TA_70936
ttttttttttttttttttttttttttttgagaaacaaatgatcagagtgcttgtaattgtaaataacaacagagcagagtatcaaggagcagagtatttcaggccgtgtcatttattcagttcagtcgatcaattttgatccactagttaagagtcataaacatttcaattttgatgatgcaaaactatctcccatttcttgatgaatgtgctagaaaattataaactttgccaaaaacaggagatatttcaggtagagaggcaaaatgcatgctgcgaaggaaaacaacatgtgcatgcatatgcatcaaacatgaatcaatcaaaatttacctgttgtggatagggtctggccccttgggaatcctcctcttgctgcttcggtacgcgtcctcgccggcttgtccgccacctggcttctgcaccggggagctcttcgtactcactctgccaccgggttgagctggaccgaagccgacgccagcaccactcgtcgtc

SEQ ID NO: 70937 - DNA, 240 bp, Triticum aestivum
  Clone ID: PAT_TA_70937
ataagggagcacaatatataaatagtgagaaacacattattagtgccagaacatgagcacatacatcgtctgtagtgaagttctatatatctagccaaatgaacctatatatatatatcaggggaaaacaaaccagctgctcaatgggacttgtgatgctcgtgcgccgcaagggcgtgcttaaccgggcgcgcctctactcctccaccctcgcggctcaggaccgtgaagggcatgtac

SEQ ID NO: 70938 - DNA, 644 bp, Triticum aestivum
  Clone ID: PAT_TA_70938
ggtggtggtctaataacttgcatttaattaataaggacaacaaaaatatatttacaaaacaatattattaagttaaaattttagttggttacaccacagaaaatctgaaaaccatggtttgttgtttaaacaaggtcgtccatagcacaattgaaaacggcacaagcagcagtcagaagtctgaaattgtcaaaaaagaaaacctcacttccattgctacaaggagagttgtacaaaaaaattacaagtttgaaacaaaataatattgatttctgaagtatgttttccaattgtattttaatttttcaattttttcatgtactgtagtgctttgggaaatattcgtggaaagcagtgtaaagttcaaagcactacatttctcacatgtgccacgtaccaatgtttatctttttatcacaagttgaagtagcaactgttctaatatatgttctagcttttatacagtaacaattgttataagttagtgtgttagctagaatatcatcaaaaagacaataatgaaaccaaataaccatagagacaaatcagtaagacactttctcctttgaaactcctattcctaatacaggatgggtgattcgcggcatgatgccgtgcgagtgtgcaacccgtccgcacgcaag

SEQ ID NO: 70939 - DNA, 587 bp, Triticum aestivum
  Clone ID: PAT_TA_70939
tttgctattcctcctgatatgaaactacttattagcagccacatgggatagttcaatgtgctcatcaacgcctggccgatagatgtggatcatccaaccatcagatgaacacgacacacatcatgatgatgagatgatgcatcgacgcaccaatcatacaaacagaccaatgatactacatctcattcagacctttcagttctccaatcgaacaacacatcgacaacacacatcagcaagcattgaacatgccagcttagcagacatcgtgtggtaaaactgcatgacggtgatctgagctacagcacgatgaccccggactggctttggaagacctcaatctccaaacgcactgatgcccagacttggctgcatcgctcgagcttcccgttcacgcgagctagaaatgacttggcccatggttcttcctcgcgtttcatgctgatgtcacacggaactgaaaaactcaacagttcctcttctgattgcttagaatctgaatggcgatttctgaccacatatatcctgtagatatgaagagagtgcttggagagattctgagtggccgtctcaccactttcattgcg

SEQ ID NO: 70940 - DNA, 559 bp, Triticum aestivum
  Clone ID: PAT_TA_70940
catttccattcctattttttttcgaccatagttttatccgatacagcaaagatgtatggaaaaaagagataaacggaacatgcttccgttgtcatagcatcggcctgcaaaagagtgactaatttggtcaacaaacccaataatcaaggtacataattcaaaaaactacctatttgtacattgactggttcatcactgtaaaactgggtgttatccatatgggacttgggcagctgcaccaaagcggggacacaatttcctccctactggcatcttcaaggttgagaacacctatatcccggggattcgtcttatacatccaattatattgctcatcatctgcgaaatagacacaatttgccttcagttgcggatattcttcagcactaaggcatataggctggttacgcccaagaaacaacacgttatgatgcaagctatttatttccacgagctcttctgcttccatatcaactttgtgtaaccagactttattagttttaactatgagctcctcataacccgcatctatgagttcagccttcctgcaaacttgcag

SEQ ID NO: 70941 - DNA, 558 bp, Triticum aestivum
  unsure (1)..(558): unsure at all n locations
  Clone ID: PAT_TA_70941
gatacataaagctagcgcatcatcgcgacaaggaaaaatgcaagacagctccagagcaaaaaataggttaattgccaaaagaaaagccaaagaaaaagctttaacagctcctcccacacttcggcggcaacctggccatggcgaacagagttcatggccactccgccgaggtccttctcgtcttcactggtttagtgttggggcttcccttactttcttgtccggctcgatcagtcaatgagcagtccagggagctcacgtcctcagaagggtatagcgagcgccatcttttcaccggcctagagaggcgaggccagacgaccttttatcatgcagatgatcttaatgtcgctgatgccaagctcccaattggcaggtagcggctgtttctcctggtgggggtgcgataacaagtcaaggagaaggctcttcatatcgcttttcagaaactcaaatgaaagcttgcatcncgattctgttgtacaacgctttggcaagtgtcctaaccagacatccagatacatgagctgctgctggactgctgcatcgttagcgtcc

SEQ ID NO: 70942 - DNA, 440 bp, Triticum aestivum
  Clone ID: PAT_TA_70942
ttacacgcagaacccaatgccctccattttagttcaaccaggggccgattcaggttagcgcaaaactagtgatgttacaagcaagtgattttacaaatttgcagagaaaccaggccttcggcaaactaagattttctttcgacagccaagatcctggcatacctcacgaggcccgcttaacctgattcaccagcagaaccataagaaaaatgtaaaatgtagccaggcaaagaaaaacaggaaaccgtgccccctgcaagatacatgactcactcacttgcctgaggttgcagtaattttgcactttgtgaacacgaatctctagcatattttgttgctccattcttgcaaaacaatctgaacaccaaatttatattcactgtgctttgtaattgccttcagcagttgccataagacatttcagattgattatgtcctgt

SEQ ID NO: 70943 - DNA, 678 bp, Triticum aestivum
  Clone ID: PAT_TA_70943
cgaatgcatcaaagattgaatacatatgttgaaacttcaacaatggcattaaacgaacatggcattaaacaaacacctaatgatcttacaatgtcaacttacaatctttagcacttggtcagcggcaacctataaaactgtctattaagtatttggactctaccagttcacttcacaatgggggcatatcttgacacaggaacctgcaagtgttggtgcctactggcttcatcagatgcagaggtgcagtcctcatggtcggcgaccttatgtgaattcaatgaaccatggcagaaactgatgtcatgcacgtcaagggaagcggccattaaggtaaaagatgaattttagtccccagataagcaccgttggcaacggcactggaagccaaatccttcagtgagaatcttctgcctggcgttcacatccatgcttgcatcaatgtagcagatacgcagctcttcaccttcgtcaatatcacgaagggtcgtcaatttagcgtctgcattttccagccaaactatgtgagtatttggatcacagtcatggttgtagaacgaggggaggatatatacagcattgccaactgatgcatcacatgctaccgaggctactgctgaggatagaagatcctcatatgaacttgcaaccaattcaatacggaatgcattgacacgt

SEQ ID NO: 70944 - DNA, 369 bp, Triticum aestivum
  Clone ID: PAT_TA_70944
tttttttaagtgttaacatcatatatctcactttatagtctctgataatttaagaagcaagacaaaattcatcgttcttcatacggcttaacggtgaaacaaccttgttgctacaccatttacgatctcatcacattattcagttgaatatgccatccaatcgtagctaattagtttccatttttgggaggaatgtatgtgcactgctggcacttgcacgcccccgcaacacactcgccatatccgccgacccacacacggtcgatgcatgcctgattgcagctattgttatcacatggctttggcgacgggataatgcttgtcgtacaagggattcctccaacgcccgctgacgccctcgttatcaca

SEQ ID NO: 70945 - DNA, 537 bp, Triticum aestivum
  unsure (1)..(537): unsure at all n locations
  Clone ID: PAT_TA_70945
aagcgcacaattatcaatagtggcttaaccaggaatcaggaaactcttctcttcaattgagcagcaaaggaatccgcgtccctgatggcttctccgaatcttgcatccctgacgacttctccgaggagtgttccagggaaccaggacactgacgaacaatctcatgcaccaaaagtaagatatctcattcggttctgacgatgaatctgcggcaaattctctaatttctttgttttgaaccattgcgggagacttctcatccagcagtgcacacaaatatgtttgcctaaaagatccactttccatcaactgtgacacgatccagagtgttggccgggaaaaagcagtgtgctgcacccttgtagaacttctacaggaatctgtgaccgcattttatagtaggcctgaaacagatgtggttgtgatgcncgtatgaagattagccttagagatggattttattatgtgtatgaattcgaggcgtcgcataaccacactcttgctaatggactcatggcccaatactgtgtcctgtgt

SEQ ID NO: 70946 - DNA, 574 bp, Triticum aestivum
  Clone ID: PAT_TA_70946
gatgctgctatatctcctttaagatacttagtaatatgtcttgatacatctacttcactgacaagtatttcctgaaagaggaagtattttgtaactagggagtactagtatattatagagatatttttaggccccaaaagagagaaaacttgactatatatctggatggacattcttccagcacaaaacgagtgagctgctgctaattcatccatttaattaattactgcgaataaatccaccaggctttatttatcacaaatcaatgcttgaaagtacggtacggcgcagcactaaacatacagcaacgcagcaatggagggggtgggggcagccgaatcaaccaatcacacggtgtaatgctggttgttgatgtcgtccaggtcgatgcccttgagcatggcggcgttctccaccttccccttgagagtgtgcaccgccctcagcctcgtgatctccgcgcgccgcttggtctcctccgccatgtggcccagctccatggacgccgccttctcccgcccgccgactccagccgtgcagcgtgcgctgctcgtgcgcccagccgcctgcgacg

SEQ ID NO: 70947 - DNA, 571 bp, Triticum aestivum
  Clone ID: PAT_TA_70947
ttcaaggctaccaataccagaattagaattgcgaggtcacactgcaaaagtattctcaggttaccaataactagaaattagaattacaaccgacccacagtcattgctcaagctgctgcaagcctgcgagcattatgagaccactgcactccctgaccatatccgtcaacagataattatctccacggatgaggatgatccatgtgtgagttgacctgcatgggctttcaccgtacagcttgattttcaacaaccccacagctcgttccatgacaagccttatatagtttgtcaccttgccttcttcctcgcacccgaagatccgcagcaccttcaagttcaggtgcttcaaatccttagatggctcccacaccacgttggtcttctcggcactgtccttgggcgtcttggtacatgaatgtcgagacaatgtcatatcatatagggcaggtgcagcttcaaggataaacagtgtccagctcagatcacactcactaaagatacgcaaaagaagcatagaggtcaggtttctgaatatagcaatgagctgcttcggaggttctggctgaat

SEQ ID NO: 70948 - DNA, 521 bp, Triticum aestivum
  Clone ID: PAT_TA_70948
aaaggaaaataattgcgatggatggatgccgttataattcgacaatactgcgattgcgtgcggcctaaactgtactagtggcccttaagtatgtgcacgcatagagagcataaagttacatttctcgcttcttcagtttaaccatgagcccattcttcacctctagtatacaagacggcttgggttgaatgctctgcccttccaccgcttgcacatcgaagttccacaacattgtggcgacgccagtcttcatctgcataatcgcgatgtcctttccgaggcacattctcgagcctgagttaaaggctaaaaacttgtgagatggtacatacttgaggttgttgccatcatccgagagccacctatctgggttatagtcgaggcagtctttaccccacaagccctccattctacccatggagtggagagaaataaagatggtgtcgccggcttgcacctggtggccacttggcatgatatcatcgccggacaccgtcttgcgctcgattggcgctggtggg

SEQ ID NO: 70949 - DNA, 180 bp, Triticum aestivum
  Clone ID: PAT_TA_70949
catatttacaggtaagatgaaagaattaaaatgagcttagcctcaaggaatgaagtcctaaattgtttgagaacagtataaaatgcaaagtggcagcattaagctgcatctatgtaacatgaccagaatatggtctttttcctgaatctaccagcttacgttctacacaagtatattctg

SEQ ID NO: 70950 - DNA, 326 bp, Triticum aestivum
  Clone ID: PAT_TA_70950
gtgagcctcttggctaggtgatcgtcaatagcgttattatctatgtcaatggggtagggcaccgtctcattttgtatgagttctttcaaagtctgggaaataaacatagaagggatttaaaaatcttgtcagatacaatacaagtgtctaaatcatgaaagaagtagggtatttgacaaagcagtgcgtaaatcataaagtatagtcttgcttaagcctctgtatgtatgtttctctcggtaatgctctcgaatgttcatgcatagagctagatgtctgtattcttccattcttggtaggagtaccatgtcaaagctcattcatcc

SEQ ID NO: 70951 - DNA, 509 bp, Triticum aestivum
  Clone ID: PAT_TA_70951
aattgatagccgattgatcacatcagactcttaccagttggtatcatgcaagaagttcattcaggaaactgtcaattcacttccatccaagccaaaatggcattcactcagataactgaaatacctagtttcctctgtagcctgaagcctttcatgccagaaaatgatttaaatacctactttccttcgtagcctgaagcctttcaggccagaaaagggttccaggtgcttccagttaggaaaatgtgcattttgcattaatgttcatgctgtgcaagcctgggcactctcaatctcgggcatggactgcaaccaggtagacccaggcagcttcatgacttctctgtcccccatgagccctctcgaccttccggcgccgccccaatcgtgccgacccgcgagcgtcctcgacagcagcaagtacatcgacgggtcttccttctcgagcgcaagaacgcgctctgcagcccgctttgctgcggcctcattgccatggagctgacaagcag

SEQ ID NO: 70952 - DNA, 416 bp, Triticum aestivum
  Clone ID: PAT_TA_70952
accatatttatataaaaaaatacaacatctaccatgttaaagttatacagtatgaaactttaagtcatgacgcatctgctggtattgactagtgcaaatgcccgtgcgttgcaccgggcaacaaaagaggcacaacctacttaagatctagctcgagagattttcacactgcaactatgccaatatgatgttaatatgcccgcagtttattgtgcctctgttgtgatcctctttccaaccaacataaatgagcattgtagaacactgattttgatggataaaggggatgcatcaaccagataaagaaatcatatactccctccatccggaaataagtgacattgttttagattttgaattaaaacagcttcacttatttccgcaaggagggagtaatagttaatgttctgtacatt

SEQ ID NO: 70953 - DNA, 328 bp, Triticum aestivum
  Clone ID: PAT_TA_70953
atctatggaaacaaagaatcaaatcaaatgaccagataatagcctagctcaagcatatagtacacatctattcagaataaataaatgacgttagatggcattctctcaattcctataacaaccatgtgcctgacgccgggtatgaaggttgttatcctcttgatcaaagataccaacaccataattaggtatttaggtagttgcacgtggactcattgcactttcatcttgctggggagcttttgtcttcatctttgcatgcacgtctcatggatcgctgatccctgagtcgtatgtgttccatgtatacaccagatattgccttgga

SEQ ID NO: 70954 - DNA, 638 bp, Triticum aestivum
  unsure (1)..(638): unsure at all n locations
  Clone ID: PAT_TA_70954
gcatttcacaaggtttctcaaacttcctttacaggaaaagaaagaaaaagttcaaccaagactcaaccagtttaatttttggtcgcatcgctatcaacngaaaagatgttccaccttcccttcacccattcatctaactctctgcaccactcttgctattgtaaacttctcacacatgtaccaagtcatataactactccaaacaaaagtatcaggaaacttgacgcagccggtcctagcactttagcttctttgtcgaggcggagtagccactagcaccttccacgagccgttttgcgaggttgctgctggtactgctgccgctgttcatccaactacccttaggatcagccaccttgagatcttcagcgtcgtacctgataatgttggtcacaaacgcgtgtatagatgtctcggctcttggcagactctccctttcaagaatcgattgctgcccggcacgagactggcgctctgcagtgcacttcaactcctgcaggactaggcttctatctctaacanaactctccttttgcttctggaaattaacatggcattcaattgacgagcttgagcagccacaaccatcactgaacttcaatgtcagcaacatggaaaatatgctagtcattgatgtt

SEQ ID NO: 70955 - DNA, 435 bp, Triticum aestivum
  Clone ID: PAT_TA_70955
agtttttttcttctaccttagcttgctgacagatttgacacttgttgacaaaagattccactgattgaaagattcctgtccaagcaaatagtgccttgatgcggtgataagtagcagtaatgccagagtgggcaccaataccactggcatgaagtgcttgcaagatgttttttttcatttagaagtttgcaccaacccatactcttcctctatatcgaatgaccccattatgcaatgaatatttgctattcttgtgagtgctcaggactgccaattcagatagtcaattctgggtgaatgtgtctttgctgtaccctgcaacaatatcagtgagccattgtggttgacaggaagtaatggcattgagttcatctggctcatgtaatctagatagtggtgcatcagctgccctattctctgagccttttattggat

SEQ ID NO: 70956 - DNA, 567 bp, Triticum aestivum
  Clone ID: PAT_TA_70956
tcggacgaggttggggagtcttagacgttgagtgcctatacttgatggagagttctttcatgaatggaaaattgagatgcttgagatttttaatgaatatcatttgaacaagtacattactagcccatgtgcaccccatgttgatcctttgcatcctacccttgatgattctattgacatgatccgcaaccttagtactgttaatcttattactagatgtttgcctagaaacttgattgcttgcttgcctactcttgattgtgcctacactatatggagatttcttgagtaacgatttccaaactattccttgcaaaacttagatgagattcttcataagtctattgccttgagtaagatgaattcccatgatcctaagtttggtgattatctatttgagcttactaacctcatgcgtgccaaaggagatgttggaataattagcaatatcatctccgaagccattagaattcataaagatgaatattgtgatgatcatttatctaatgaatcactctctctaggaattgatccatcacaagatgatgttgaacatggatactatga

SEQ ID NO: 70957 - DNA, 559 bp, Triticum aestivum
  Clone ID: PAT_TA_70957
tcgaattcggcacgaggatgacttactgtagcaaataccgatcgaaggatgcagaaacacatacatgactagcaattattgtacctattgttacacttacaagctacggtggtcgatctatcagaattgccctttgccctcgaagctctggccgatcgtccagcttgccggcacgacgccgtcgaggacgacggagcggccgtcgcttgcgaccacacggaacgagagcccctgaccgacgagattttggacatgtccgtcccagatctgcccccagttcctcttcatgttccgccactgcccgtccttggcccctttcacggccaacaccttgacttcgccgggtccggcgacgttgaagacgagcacgccgacccagtactggttgcccgtcatctctatcctgatgccgcccttcttggcgcaaggcacgcggcggtactgcacggggatgatgccgacgtggaagtcggtgacgaggcgaaggaacatgggcttggagaggtcgaagtgcttcagcggcgggttgcaccagttctcctagggcttggagtagctg

SEQ ID NO: 70958 - DNA, 374 bp, Triticum aestivum
  Clone ID: PAT_TA_70958
cgattcggacgagctttgcctgatcatcctcttaagaaacctgaaatacttgatatattttataatggactaaccgatgcttccagagattacctggatagttgtgctggttctcttttcagggaaagaacaccggatgaagctgaaattctattgaataatatgttgacaaatgaaaataattgggcacctcctgagccatctcctgctccaattactgaacctattcttaaaccaactccgaagaagagaggtgttttatttctcagtcccgagatatgcaagaggcaaagaaatctaagaaagaaaaaggtattaaagctgaagacgttaagaatttacctcctattgaagaaatacatggtcttaattca

SEQ ID NO: 70959 - DNA, 622 bp, Triticum aestivum
  Clone ID: PAT_TA_70959
ttcggacgagcacaatcgttcggcggcgaggaatcaggcgatcccacccatggccgataagaagggttccactagtaggcagcgacgagcaaccggcgaggcgaccggcggtttttcgctgaggccgtgcaccaccaccaaacaacatatggcggcggcgaccggcggaaagggcgatctttcgctcaggccgtgcacctctataaagcatcatattgtggtggaggacgcggcggctgacgcgccggaggatgaggtgaccggcgggaaagttccgctgaaggcatgccccgccaaaaggaagtcggccggggtatgcgaggcgttgaacatgttcccggcgcaggcggcggcgtcctcggggcggcggagggctgtcgattgggcgggccgacccaccctggcggtcgacctagtagaagacgaagcagagctgcggcggagaatcaaagcaaccctgctaaccttcccggagtcgaaggcgttgactgcacagcagatggaattggcaattgacaggatcgtggaggagtccaagcccgaggcggcttccgtcgccgccccaggcatgggtcggatgagtgacttcgacatacgcttcttcttgtccctcccgatggtc

SEQ ID NO: 70960 - DNA, 657 bp, Triticum aestivum
  Clone ID: PAT_TA_70960
ttcggacgagttttttagcttctaatgagcatctactaaatgatcaaccatggaataatcagcgttacaccatcaccgaaaaagtcagtatcaaccggatttaaacattattacagcactaatcagcatccacttgtgcacacttacaccaaggctaaaatagcaaataggatatcattctctcttgccttccatctaagaaaaagataactcaggctactccaacaccgacaaaggagctgactttgaaaactaggcgccactgatcattcttcatagtcgtctacacttaatatggttgaccacacaactcgcaccgagaccaacgctccattgctaaaccgatacatttgctcctcttcgccatgcttggacgccacaaacgaaagcgcgtcttggccctcctccatgaagtctatccgcagcgtgtcccctagattcacggctgcaacgaatttttgaatgtgcttcccgctagatggtataaaaccaactgtgtcacggcagtgctcatcaatgaaggagtaggagccttgagaaaggacagtgttgccacgcatgcgcacaagaaagccatctgcaggcacctccacaaaatccaggtctatagtagcctccatgcctctaggaacaacacatgtttccagtgtaatcttg

SEQ ID NO: 70961 - DNA, 606 bp, Triticum aestivum
  unsure (1)..(606): unsure at all n locations
  Clone ID: PAT_TA_70961
cggcacgagcggagggcaagatcgtcgcctggaacgccgccgagggggaccgcctcgccaagggcgaccctgttgttgttgtggagtctgataaggccgacatggacgtcgagaccttccacaacgggttcctcgccgccgtactcgtccccgcaggagagtccgcgcccgtcggctccgccatcgcgctcctcgccgagtccgaggaggagatcccgctcgcccggtcccaggctgccaacttctcctcctccgccgccgcttcgccgccggctccccaggaaaccgtagcccaagaagcgtcccctgctccgccgccgccgcctcctccggggcccgtagcagtctctgctccagcaccgccctcaccggcaacacagggcggggcngcgcgtggttgcctcgccgtacgccaagaagctcgcaaaggagctcagcgttgatctattcgcagtcactggctctggccagggggggggagagttgtggcaaaggacgtagaggctgcggcagctgcccccaagaaagctgcgccagtgccagctgctcgacaagatgttccattgggatccacggtgccattcaccacaatgcagggcgctgtga

SEQ ID NO: 70962 - DNA, 609 bp, Triticum aestivum
  Clone ID: PAT_TA_70962
cgattcggacgaggcaaccgccgccaacaccactcctcgagagtcctcgccgccggagaagtagcacgcaggatggccggaaggaagggcggcgacaggaagaaggcggtgacccgctccgtgaaggccgggctccagttccccgtcggccgcatcgggcgctacctcaagaagggccgctacgcccagcgcgtcggctccggcgcccccgtctacctcgccgccgtcctcgagtacctcgccgccgaggtcctggagctcgccggcaacgcggccaaggacaacaagaagacccgcatcatcccgcgccacctgctgctcgccgtccgcaacgaccaggagctcggcaggctgctcgccggcgtcaccatcgcccatggcggcgtgatccccaacatcaactccgtgctgctccccaagaagtcccccgccgccgccgagaaggaggccaagtcgcccaagaagaagacgtccaccaagtcccccaagaagaagaccgccgccaccaaggagtaaccgcccccatagcctagccagtgttgcttagatccatttctcatggactaagatgagaccctgtatgtaatgcctgctagtctgtgatttcgt

SEQ ID NO: 70963 - DNA, 418 bp, Triticum aestivum
  Clone ID: PAT_TA_70963
tcgaattcggcacgagagccgatgctgtcgtcgggcgcccgcgagcccaacctcatctccgacctgtcgctccctgctcccgatgtcaccctctctctccgcagctccgcggaggagcttcacaactccgttggcgagcaacagccaacgttcaaggaggagaagcaagaaccaaggatgaaggagaaggtgatgccgccgccgagcgcccttggtcgcatcctctggaccatctctcctcatgctgccaccctctcgcaccacagttcttcggaggaacctcacaccgccgccagcgagaagcagccaggggcgaaggaggagaagcagcagccagcgcccaaaggggagcgtaagaagcagcagcagccgcagcgtcaggagtcgatcaaggcgacagaggagcagaaagggaagg

SEQ ID NO: 70964 - DNA, 149 bp, Triticum aestivum
  Clone ID: PAT_TA_70964
agttttgttacttgaaagatattctaaacatgggccgatgattctctacatatcaagttggctcaagtatttgcagcaacaagtctgcttttcggatgcactctcccactaccaatctgcactaaggataaacccacacaatgaagcag

SEQ ID NO: 70965 - DNA, 535 bp, Triticum aestivum
  Clone ID: PAT_TA_70965
tcgtgctgtccgcctccctgaagccgccgccctccctcgcggcgctctccccgtcctcccgcgcccccgcgccgcccgccgcctccttccctgccccccgccgcagctgcctccgcctctccgcggcggccgcgtccgagggcgccaccgtcagccaggaggacgccgcgtccgtctccgccgcgttcgaggaggcgcgcctggcccagttcgcggcggactggaaggctgtgcgcgcggacaaggaccaggggaagatcctcacgctgcccgtgctgcgctcaaacaccggcgggctcatcctcaagtacaactccatgcagggcttcgtgcccaaccctctcctcagccccgcccattggtctaaagatcctaagaggccaattcaagatgttacaaaggacctagtaggttcctctgtttctgtcaaggtagttgaagcaaatgaggcggaaaagaagcttgtattctctgagaaggatgccagttggtcaatgtactcttctcaagtaaagattggcggtacctatgatgg

SEQ ID NO: 70966 - DNA, 493 bp, Triticum aestivum
  unsure (1)..(493): unsure at all n locations
  Clone ID: PAT_TA_70966
atattcaaaatctcactacaaattttcttgaagaacgacactactacgacccgacatgacaactcacactcagacaccagatgtttctcccgaacaaaagcaaaaacacactaataactctccatctagaagaccaaaattaccctatcaagatgctcgctggcctcgagcaggagtagtaacccatggctagcgatagcttccttcaatggctaacggatcggccgcgcaaagacggagctagctagccgtccatgcatggagatgaccaaaaagcagtagtaccactagaccctggcaagctagcctccaacggctagccaataaatactaggcaataaagcaagtaacgctgccgccgccgacaggctaggtaacgtagacggcggcggtagcatgcaggtgcagctctccctggccctagcgagccacggccctgcnacaccagcggcgtggccatctccagcgacatcttgaggcgctctgacaggtc

SEQ ID NO: 70967 - DNA, 154 bp, Triticum aestivum
  Clone ID: PAT_TA_70967
ttttttttttttttaacaagcgaaaatgattccctttattcttatccatatatgtagcacatagcaccacacatgatgagcgcgcggagctcgtcctatatgcatatatgcatgtcacacatgtatggtcgcaacatgcttatttattcatgct

SEQ ID NO: 70968 - DNA, 230 bp, Triticum aestivum
  Clone ID: PAT_TA_70968
gattcggcacgagcttcatccctgattttatttctcatcttcttgtaaaggacatgtcaattatttgaggaatagagtctattaactgtcaaaaaaaaatttacaaaagtaaaacctctatgctaaactgccaatttagaggatagtagccatgggttaggaccacaaaagtttaaggaggatgggattttgggggaaggttccctcgctgatccataaaatgataacac

SEQ ID NO: 70969 - DNA, 505 bp, Triticum aestivum
  Clone ID: PAT_TA_70969
gattcggccgagtcgaggtactacatggtcctcttgcgagcgcgattttcctcccctgccgtcaccgccagctgctctcccccgtcgtccgatcccatgggcgcgccctggtctaggcgtgtcgacggcgatgctgcgtctgtcgtgtcgccggagtacctgcggcgccgcggagaggcccgacaaccgcagcttccgcttcgccgccgccgaccaactctcgagcttcagccgaccccaacgtgagaaccttcaggttgctgtgtgcgcatccaaagccgtcgtgcagccacaacagggaccagagctcaccccgccggtggggtcatgcgacgagccggggcgaagaacaccttcatcgacatgatggcatcccccaatcaatctagtacatcgggtgctctgagcaaactccttctacatttctgcttcgtctccaagggtgcaggttgtgggatagcggcccgtgtgcaactaccataagagcacactgacagtgagcatc

SEQ ID NO: 70970 - DNA, 151 bp, Triticum aestivum
  Clone ID: PAT_TA_70970
ccatcccagcgctccccgcgcatcgctcgcgatgcggccatgaccgtctagttcgtgccatcccacgatcgggtcagggccgcggagaaacctaacaaactacgaccaagacgcagctcggattatttgaactgaaaacaagtttctctga

SEQ ID NO: 70971 - DNA, 220 bp, Triticum aestivum
  Clone ID: PAT_TA_70971
gcctcttcctccatgagcaaggagtcgacgagctacgacatggcagatttcgatcaaacggcaatatttctctacctagatggtcatgatccacagtcgattcaggaacaacgacaaactctgaacatcttcccctcgcagcccatgcatgccgccgagccgcttaaccctactgcaaagattaatggcggcgcagtcatggcggccatgcttgctaatg

SEQ ID NO: 70972 - DNA, 459 bp, Triticum aestivum
  Clone ID: PAT_TA_70972
cgattcggacgagctggattcgggagccttcgtcattttcagtcggagctcggctcgttcatcgatccggcggcgcaaaaccgtggtttcctcggcgctccggtgatccgttcgaacccccggctcgcccaagtcgccaagcgcgacactggtcgtttaggcggctggtcgagttctttgacggagtcggcggcgagctaggttccctttgggtttgggcaggaggaaaggtaattgtgtggagagatggggcgatatatgatacagcaggatggagggtaggaaagaaagggggagattaaggaattttgtccggcgcatggcaatggagtgcctttgctctggagagcagctgaaaggggcagatgacaccatccggtcatcggactctatgtttaccaaagatttctcagcaagtgggtactcttccaggaatggagaggttgagcaataccttga

SEQ ID NO: 70973 - DNA, 375 bp, Triticum aestivum
  Clone ID: PAT_TA_70973
atgttggagcaatttttcctaaatatggcagcgattgttgcttaatactgaggcaaattatcctagagcaagctaatatggtgtgttagcagcttacaaggagacatagtagatacaatagtacaataacattgcagagtatggtttacaataaactatggaatctaggtttatgctactcaaactttgaactattcaactgataatttgaaatgttcattaacgaaatttccactatttccccaaatcccttggaaactttgagcatgtccttgaacttttcctgctcaagtgtggcctagaacacctttagtagcaccttgtagctcatgatcaacatgtggattgatttgataaggatattgatcatcccct

SEQ ID NO: 70974 - DNA, 219 bp, Triticum aestivum
  Clone ID: PAT_TA_70974
gattcggcacgaggaagatccatatccatccttcctagctagccatggagagcgtcgaccaccacgacgaagccgccacccgcctgtccctttccactccccgtccgccggcaccgctctccctgacgccatcgcccaactcgggggcgctggtgaacgcgcgctgggtgccgacaagggagcagctggccgggctggaggggctgtaccggacaggga

SEQ ID NO: 70975 - DNA, 205 bp, Triticum aestivum
  Clone ID: PAT_TA_70975
cgattcggcacgaggcctcgcacacgacgataaacgccgagatgttgaggacgaagtttggggccagatcatggaaatccaggccatagtagaacatgagcccccgaacaaatgggtggagagggaagcccagtccacggaggaaatgggggaggaacaccaccctctcatggggcccgggggtggggatgagctgcccctcttc

SEQ ID NO: 70976 - DNA, 398 bp, Triticum aestivum
  Clone ID: PAT_TA_70976
gattcggacgagctcgtgccgcgcatgcacagtaacaagtaccaaaatggacatgcactagtgcgctttagacagtagtgtcacctctatgcaatgtacagaaggtcccgacagtggaatagtgcccacttttattactgcatatacaaagatccaacagcgggaaactcaagagcgagccaagtactgtctgtctactcatcagacaaatcacgcaagcactttttcatactcttctccagcatacttccagttcaccaccttccagatgttggtcaggtagtccggcctcacgttcttgtactgcaggtagtacgcatgctcccagacatcaattcccaacaaaggatgcaggtttgaccctttggtcacaagagggtcctgattaggagtagttt

SEQ ID NO: 70977 - DNA, 303 bp, Triticum aestivum
  Clone ID: PAT_TA_70977
cacaatgaaggcatgaacaagctggtccatgcatggttctggctgtaccacaggaacatatgcatatagcccagatgtggtgatttcaagatgaaaggaagagctgagaagcttgagagagctggaggaacaaggagaagctaaaaggatagcagaagatgaggcactggggagctattagacatacaatgttcaaccttggttgctgaggataaatgcaaaagaaaatcatcaaggctatcttgcataccatggctctttgaggttcacgttgaggaacgaagagctcaagattttgttttg

SEQ ID NO: 70978 - DNA, 219 bp, Triticum aestivum
  Clone ID: PAT_TA_70978
aagccagttacgctagctagcgctcgacaccgcggcactgctcggctcggtccccttctccctcgcgggagcacgcggagaggcgaccgaggatcgaccgaccgccggccggcgagcgatgtcgagccacgaggcgtgctgcgggaccatgttctgggtgtacctgctgtcctgcgcggggctggtgatgttcgcggggctcatgtcggggctcaccct

SEQ ID NO: 70979 - DNA, 513 bp, Triticum aestivum
  Clone ID: PAT_TA_70979
attcggcacgagcaagattaaaaattctcattgatatataatctgcaacattatctcttttctctattctctattccctataagcagcagtagcgcacacacaacaaaaaattgcctcatgataaattgtagctagtaatttcagtgtgtaagcatcactgcaagtaggtatcatcctcagcagaccagcatcacaaatagcagttcttccttcatgtccatcttacactcacgcacgcctagagatcggggagccacaacgcctccttctgctttgctctttgtcgccactgcgcccagcgcacgcacagactcgtccaaggcgccgtctgccttctccaccgcatcatccttcctgttctgcatcttgcaattcttgattagtactttgtcaacatagtctgcactctgcacccggagatctcccagccgtggggtcttgttctacattcgcttctgcccactgctgctgctgcccgctgcctctgcttaaaccattgctgctgcttgcca

SEQ ID NO: 70980 - DNA, 335 bp, Triticum aestivum
  Clone ID: PAT_TA_70980
aaaaaggttacaagcccagagcttggaaagttgatggtggataaagactcaaactcctcagtgtcttctgactctggcgtagtacagtttagtgcaaacagggatcttgaagtagataagggtgactacatggatatcgagaaggatgctggggatgattcttctgctctttgtgggatgcgcactgattctgagagtcatcggtgtagctctagaaccccagagcccgcagggtcgccgcataggtgcattaacatgcttcagggttgtaggggtgttgacgagtttgagaggctcaacacaattaatgagggtacatacggtattgtatctag

SEQ ID NO: 70981 - DNA, 654 bp, Triticum aestivum
  Clone ID: PAT_TA_70981
cgattcggacgaggccgccgctctcatatctgcctccaccgcctcccttcagtccaggggagacatgatggcggccttcccgttgctcctgctcgtcctcgtggtggccgcgccgtccccgctcctccgccccgacgccgactcagacaacgacaacggatccgctgcgtcctccgcccccgcgagctcccacccctcctccgcgcactcgccggcgccgtcgtcggccctgcgctccgccgccactccatcccccgccgacaaggaaggcgattacaacaagaagaagaaggagaaggccccgccggcgatggaggtgaaggccggaagtggcagcgcggaggagcagccgcagaaggcggcggacgtggccaagaggcgcgaggagatgaacggcgggacgaaggtgggcatgttccatttttcttcctctcaccactacaaggtacaggagtactgccctttccatgtagattggcccttttgtcgccctttccgaaaaataaaacgccatgcatccgtgtagatgctttgctttgctgctcccggtgatgctacgccatgtttctcgaaaataaaacgccatgcgtccgtccgtgtagaggctttgctactcccggtgatgctacaacatgtttatcatcgtctcttgga

SEQ ID NO: 70982 - DNA, 158 bp, Triticum aestivum
  Clone ID: PAT_TA_70982
ctttcaagcagataatacacaaacattagacatcatacggtgcaaccaaggctctgtttaggttggccagaatgcgcaacccctcgttttcacgaagcagcgcctccgcccctcgcacatctccaagctcattttcgcactctttgattgtctcaccg

SEQ ID NO: 70983 - DNA, 258 bp, Triticum aestivum
  Clone ID: PAT_TA_70983
agcaatctggggatcgagccgcactccgtcgagctcacccccgccggcgacctgctcctgctcgactccatgaacagcaacctctacagggtccagctgcccttgtcccgatatagcaggccaaagcttgtcgctggttcgcttgaaggattatctggtcatgttgatggtaggctccgggaggccaagctgaaccaccctaagggatttacagtcgcacgacaggggcaacatttatgttgcacacgctatgaacat

SEQ ID NO: 70984 - DNA, 274 bp, Triticum aestivum
  Clone ID: PAT_TA_70984
tgaatccaggttgaacaaacctgattaccaactctactcacggtattttcattctgacaacacaaatcgtagctggtctgtgaagggcaataagaataagatagagaaaaggaaaaacgactacctttctgattttcatggcgtggatactaccttcatcagaggaacctatactgtagggagtttcactactgattgccttttgaagcggtatgatgctaaagaaaaaattctttcttcgctactgctgatgaaaacctggagacatccaaat

SEQ ID NO: 70985 - DNA, 196 bp, Triticum aestivum
  Clone ID: PAT_TA_70985
cattcctgcgtctccatactctaggacaacgagcacgcggggcctaccgccgacatctccacccccgccaccggacgcatctcatggaatttcgaggattgcgactccttcgaggaagaggctgatgagggacttcaagcggaatgatgcagtgccctcctgcggacataaacggggctgcagaggacaacaacat

SEQ ID NO: 70986 - DNA, 575 bp, Triticum aestivum
  Clone ID: PAT_TA_70986
cgattcggacgaggccgccactccttctcgtctcttcctcctcgggttcatccccgatccaaatcccctcctcgctttcaccaccacaccaacccgagccaatcacctctccttccacttagcctctccatcgggatccatcccgtccaaccaacgagccccctcctcctgctttgttccccgaagggatcgagagagttgccgccgccttgtcacctcccgcgcctctcgacccccgcctcctctgcacgcatctcaccggagcaagctcaccccgatccagtcgctgccggtgaacagcggcagcaaccgaggagactgccgtcgcgccctctgccatggagctcgcctccatagtcagcaccgcccgagggccccaccgtccccgacctccccgcggcccacctcacctcatcatcctcgtctcctcgcgaccgcgagcctgtcctcggacgcgcctcctctggttcccgaggccgagtcgccccgtgcccgcaaccccgcgtcgacctcctgcctcatctgcgtcgtcggagccccgaggagtttgcgccgtccattcctgcatcccgctc

SEQ ID NO: 70987 - DNA, 519 bp, Triticum aestivum
  Clone ID: PAT_TA_70987
gcggctacgtggagcggctggggcacgggggattcgagtcctcctggaggaaggacgccatggattggatttgcaaggtccattcctactacaattttggaccactgaccctctgcctctcggtgaactacatggataggttcctctcctcgtttgatctcccacatgacaagtcttggatgcaacagttgatgtcagttgcctgcctatctcttgctgtcaagatggaggagaccgtggcccctcttcctgtggaccttcaggtttgcgatgagtactatgcgtttgaaccaaggaacatcaagaggatggagctcattgtgatggagaccctgaaatggaggatgcactctgtgaccccattctctttcctgtgctacttcttggacaagttcaatgaaggaaagccaccgagttacatgctggtgtcacggtgtgccgagctcatagtcgccactgtgaaagactatagattcttatcattcagaccttctgagatcgctgccgcagtggttttat

SEQ ID NO: 70988 - DNA, 456 bp, Triticum aestivum
  Clone ID: PAT_TA_70988
cgaattcggccgagcgtctccctcctctctgtcagagaggaagacgctccaggagagattaggccgcaggagtagcggtgaccgacaggctcatggaggagcagcagcggccaatggcggcagaccagatcagcgcgccgcgggaggggatggggcagctctcatgggccaagcagagcagagtcggcgggccatgccaggaccagcgtgataggtcgcgggcgaagaggggccagggcggcgaagacaccccaggaaaggtgccgccggccacgacctttttcctccttgcccttgttttctccttcccgtctagggttatcgccgccgccgccgccatcgtccccatccttgctcgcggcctcggtctctgcgtctctaatcgtcccaggatcccaaacccgtcgtcgtcttctacttccctctcttattcccctatgccccggcaaggtgtgc

SEQ ID NO: 70989 - DNA, 497 bp, Triticum aestivum
  Clone ID: PAT_TA_70989
aattcggcacgagcttccccacccctacccccacaaagagtgagttttcaccctcctctctctttgccctccctcccttcatcagatccctctcaaatctgagcaagttagttgttttgtttgtggatttctactcctgtgtatccctagagggttcatgtgaatttcatgagcattagtacttagtgaaccgaacaacaactccagaacatagtgatgccttctgccatggctgcgtgcccaaggaaacgccgccactctatggtggttacgtcagatcatgtcatggtggtaccctacaactctccatgggcgtcatcactgcatgccgatttgcttctgctggtagcttggcgccttctggatggtgacttgatggactatgttcgccttcgagctgtgtgcaaaaattggcggtacgccactatttgcccacgcggtcgtggaatcaccgattctcgtttccacccgcgccgttggatgatgttgcccgaggg

SEQ ID NO: 70990 - DNA, 174 bp, Triticum aestivum
  Clone ID: PAT_TA_70990
gttcgattcggacgagggttagggttatttacaagaacaagagctctttgtatctgctacctctgtctttgtgtcttcgtgtcgggggtcatcctccttttcggaaaaaaaacttctgtcttcgtgttttaggagtatgtcatgctatgaaattcaaatttcaaatacagccct

SEQ ID NO: 70991 - DNA, 355 bp, Triticum aestivum
  Clone ID: PAT_TA_70991
cggcacgagaagcatccccagtcagccgagaccgcgtgcgctccacgcagcatccgccgcagcggccgcccagagaagtcgccgccggagaagggggaggatgtcgtggcagacgtacgtcgacgaccacctgtgctgcgagatcgacggccagcacctcacctccgccgccatcctcggccacgacggcagcgtctgggccgagtcccccaacttccccaagttcaagcctgaggagattgctggcatcgttaaagactttgaagaacctggacaccttgcaccaactggtcttttccttggaggcacaaagtacatggtcatccaaggtgaacctggggttgtcatccgagga

SEQ ID NO: 70992 - DNA, 251 bp, Triticum aestivum
  Clone ID: PAT_TA_70992
gattcggcacgagcccaactgtcaaatattgttggcccttgcaagtggcggagaaaccatactcaaaatgccgttcccatgaatgcattggaggatgacacagtgtgccattcttactttccaacactggaatgctgctaatctatcatcatggagggaagtcccatctcatcatctccaaaatataagagcgtttttaacaccagtgtagtgtcaaaaacaaacgcccttatattatgggatggagggag

SEQ ID NO: 70993 - DNA, 240 bp, Triticum aestivum
  Clone ID: PAT_TA_70993
cggcacgaggtcccactccacttcccacgcacgcgcgcgcatggccgtcacggcgtgcgcctacggccacgacggcggccgccggccaccgtctatgggtccgttcgacgacgacaacgaccgaggccgccactgtcccatcttccacgaccagtgttgcatcatccacggcgtcgtcatgccgcctccgcctccccctgccctgcctcctccgccgccgccgctcttcggcctccattc

SEQ ID NO: 70994 - DNA, 428 bp, Triticum aestivum
  Clone ID: PAT_TA_70994
ggaaagaacttcaagaaggaactatgtagtacaaagaagttttgctcaggcaaaactgaaccgcccaatatatttctatctctttattctcttcctcaaattttagaacaaagcaaaacaagcctacacccgattcttcatgtagctggagccattctacatgtactatatgcattatcagctcttgatttctgccgcacacattcgaaaccagctaactgatatcctgagaatacacgccatggagatgccgatcttgatttacacaatactgacctttcgccttttaaccttttagcttggaagtagtagtttctttagttgccttagccagggtagatgacagggcaacctcttcatcccttttatgcactggagcaaggctctcttcaaataaactgaatcttgaaccagggatgaagcatgga

SEQ ID NO: 70995 - DNA, 469 bp, Triticum aestivum
  Clone ID: PAT_TA_70995
gagattctataaaaactagaaactcaaattaaaataatgacgcggtatcattatttatatgaaaaaagcattttccccagtactaacaaataaaattaagaagttcaaatttaaaaaatggtgaagttcgatgtatataaaaattttggatttttcacaaatagatgaatctagaggaagaagttcgcctgcaccaccgtgcacgattcagaatttatattatgggacatccgacctccaattacatgttttaaaatggcaaaaaatgatgtccaaccttcaattgcgtgtagtttgacatatacaaaaaaaatgcaacagaagttcatagtgaaaacaacgagaagttcaagtaccacaaggaatgcatttatgtgagaatagaagtatagaaaaataaaatgttaaaaggtttgcagaaagaagttcaagtgctctatccggggaagttcaaaaattcttgcgagag

SEQ ID NO: 70996 - DNA, 406 bp, Triticum aestivum
  Clone ID: PAT_TA_70996
cgagatgacttgcgacttgcaagatctgtgggaggggagggcgtgatggagaactcggcggcggcggtgggggtggagaaggaggacgagctggtgggggccggcgggggcgactgggggtacctcacgtcggaggcgatggcgacggccgggttcccggcgttcgggttcccctgcggcgccaggggcggcgtcacgcccgcgccgacctcggcgtcgctgctcatgtccatggagcacgccgcactgttcgactacaacgcggccttcccgtcgtcgtcgtcctccgccgccgccgcgcccccggcctaccacgacttcgggtccggcggcaaccccttcagcgtcgacgccccgccgttccttcttgaggccccgccgccgctgacggtggcgccgggagggc

SEQ ID NO: 70997 - DNA, 380 bp, Triticum aestivum
  Clone ID: PAT_TA_70997
gattcggcacgagggttcatgattttgtgtttatcaagagtggagggagagagagccatgttgcatatgtggaagatatgtacgaagatggcagtgctaagaacatggtgctggtacgatggtttgaggaacctgatggtgagcatggtgttgcattgcccccagatctttattgtagggagatcttctttggatatgggctgcaagatctgagggttgaatttgtggagggggtggcagcggtcctaaatccacaacactttgagatgttcaagaaaataaatggagggagcagtagctggcagccctatgtatgtcgtcggtgcatcgatgatggcaccgtcgagccctttgacatcacgcaactccaaggatatgca

SEQ ID NO: 70998 - DNA, 355 bp, Triticum aestivum
  Clone ID: PAT_TA_70998
ttttttttttttttttttttttttttttttttttttttttttttttttttttttttgggacagacaacaaaacattgcattaaactctgataaaaaataaaaaatagggggaggggtttattccacccaaaaaatgggggtggaatgaaccaacgaacactgcccaaaacctcaaaattgtgccgagacaacaatttaacacaccccacaaccaaaccaaatggaaactacggtagacagaaaaatcaaaacccagccgaaacttcacccccccgctaaatgcccctcttcatgccccattgcacccccctatttgtcggggctctccccatcaactgccaatggaactggcaaa

SEQ ID NO: 70999 - DNA, 203 bp, Triticum aestivum
  Clone ID: PAT_TA_70999
tttttttttttttttttttttttttttttggtggaaaagcatattttatattacaaacaattgagggatcgatcccgcccccaacacttgaattcacagggggagcaacgacaaacagaagagctgatgcaaactccaccaatgatccctactaaaagtggcaacattttagcaacatccgaatcactgatcccattgggtgg

SEQ ID NO: 71000 - DNA, 277 bp, Triticum aestivum
  Clone ID: PAT_TA_71000
tttttttcaagcaaaacctcccatccgtgcagccttcattcatcattttttttcccccaattttattaccccaggcctgccgtggatgcatgaaaatattctcaattatgcaccggacaaccatctacaattataccctttgcagtggggcaagaagccagaggacatccatctgaggcattgccccaccagttcaaagtgatgttatctagttccaggcataaatatatcaagacagccatgaatgccagaccaccatcaagggcacctgaaagaa

SEQ ID NO: 71001 - DNA, 356 bp, Triticum aestivum
  Clone ID: PAT_TA_71001
cccccctcgagactattcggcacgtcggcgaagctctgcttcttctccaacaagagcgacgcgggctcggggagagcacgcgcctcggatggatcctcttccctgcaaatcataggtgcagtttggcgacgagatggaccgcggccgcggccgaggcggtggaggcccgccgagaagcatcgacatggggcacgcgccggtggcgcgggagcaggtggagatcgtgcagtcgctgaacggctgggtggcggagaacatgctcccgctgctcaacccggtggagtcctcgtggcagccgcacgacttcctgccgtgctccgccgcggcacccggcgcgtcggaggaggaggccctgt

SEQ ID NO: 71002 - DNA, 356 bp, Triticum aestivum
  Clone ID: PAT_TA_71002
tttttttttttttttttttttttaaagtcccagcttgttggaacacacaaacatgccacgtacatagcacacaccgagtgcctcaacacttctcgaaactaattcacacagacacagacacagacacaaacacacacaaacacatgcacgcacagattattttgtgaccagccacttaacgcgcttcagctactaattttctccattgtgctttcctttagaaagtaaggcactgacgcccttatttagtagttctttttttgcgggtgccttatttagtagttatagcacaccactactctatggataccaaagggtcgccattacatcatttgcagcacaaccttatggataga

SEQ ID NO: 71003 - DNA, 307 bp, Triticum aestivum
  Clone ID: PAT_TA_71003
tttttttttttttttttttttttaggctggccgcgccaatgcactggcccataatttttcaccaaatgctaaacaagcaaggaaacttaacaggatggagaaacctatttttcttggtcctatctctactttctcagatctgcaaatatcatgttcccatccattccatttggatatgctctctctccctctccatatcccactcccactaccaaaaatgcatcagaaaacacatagagaagaatgaagtagttttccacacgatatgggaacaggtttgctgtattcagtgtagttgtgatccttc

SEQ ID NO: 71004 - DNA, 157 bp, Triticum aestivum
  Clone ID: PAT_TA_71004
tttttttttttttttttttttttttttttttaggaggggaatatgatgaagctatcatttatgaataaggatgttcttgaattggcacggatcctcaaggtcgaagttatcgttcaacagctcattcctgcgattcttcagagggttccagtcagtg

SEQ ID NO: 71005 - DNA, 430 bp, Triticum aestivum
  unsure (1)..(430): unsure at all n locations
  Clone ID: PAT_TA_71005
tttttttttttttttttttttcaaggcacaaaagtacttttttattgccatgcatcagtacaatgcctcactaattgttcacatgcacaacataaggtaaacatccagcattattcaactcatcactgacagctactctataaactcagcaggcttcctgtgtaaatgccaatggatttggaacctctcagtttgagtgcataaccataagtgccatttcttggatcataacttagcagaaatccctctccttgctctccatcaccaagtaaaccttgtagaccatccaacccactgaagaaaattgtcccatcatctaacatctgaaaaggatacctataaagcctanaaacatgtgaaggcatgttgtatttcttaacccagatacttttctcagaatctggcaaaaaccacaagtccatagatttgt

SEQ ID NO: 71006 - DNA, 326 bp, Triticum aestivum
  Clone ID: PAT_TA_71006
tttttttttttttttttttttttttgtcaagggtccgataggtggtgctatcgtaaatccacattgatggcgacttcaacccatagagggtaacatttgcgcgagtctatggagggctccacccatgaagaatcaaccttgtcttttccatcatggcttacgcccacgaagtactagcctcactcgggtagattctcatgaagtaggcgatctgcttgcccttacaaactccttgattcaactccacaatatcttgggggctcccaagtgacacctaaccaatctaagagacaccactttgcaaaaggtaatagatggtgttgttc

SEQ ID NO: 71007 - DNA, 395 bp, Triticum aestivum
  unsure (1)..(395): unsure at all n locations
  Clone ID: PAT_TA_71007
ttttttttttttttttttagtcaaaaatgatgtcaaattttaagccaaattccataaaaaaaacacgttgccgcctcaaatttaccaaaaaaaaagaataacttggctcaagtagcaataatacatagttcaaagtacgatcggaacgcacaacataggttcacaaaaaataaaaacaacaaagttcacgctgggggcagcagcacaacaagcccactaacagtatcggggcgtcttttcacaaatatagaagctccatgagtaaagtcgatcccaccactcaagaacatggtgtgaggtgaccttcagcttcaccttcaatcancgaagccagagttgtccgttgccttttcggattaaagccttgcccaacagttgtcagttccatccttgga

SEQ ID NO: 71008 - DNA, 293 bp, Triticum aestivum
  Clone ID: PAT_TA_71008
tttttttttttttttttttttttcgcggagaaatcaacccagaataatatcacatctgctggtaggaaagtacatgacagtggactcatgctatctacgtaccagctgagtagaagcatatgtacatgcgtgcaggctacggggccctggccaatgtttgtaaataaagaatctcaatatcaatcaatatgtctaatactattagatcgtggatgcgtcgacggattctagaagcttctcgtagcacgtcaaaacccggtgtagtggccgccgaacgacaccgtcgcccccct

SEQ ID NO: 71009 - DNA, 394 bp, Triticum aestivum
  Clone ID: PAT_TA_71009
ttttttttttttttttttttttttttgaaacaacacaaggcctgtcaaagaaaattctactacctacaatcaatcttgactgagtggtggccgcgctgatgctgccatccatgacttacaattgccactgctgctgccgctcgttacaaacaaaaacgtaaagcttcgcgtggcaaccggcggcatgtaatatgcgaccggcatcagcgcagggaaactcgggagcggcgcctctgaccgcaacacgttgacggcctgcctgatcggcggtctcattttgaagtcgagctgaaagcaccagagcccaacgatcatcacccgcttcatctcctgcgcatcaaactctccacccaatcgctcgtcgggggggtccaggatcctccccttgccatac

SEQ ID NO: 71010 - DNA, 379 bp, Triticum aestivum
  Clone ID: PAT_TA_71010
ttttttttttttttttttttttttttttttgccaagaagtaatcgagagcaccttcttgtatgtaagaacaggggttaccatgtttagagcaaaaaatgctcaaagcaagcattcagatatgcctcttccataagcttcacaatcatctgaaaaagctagtgctatacatgtgcacacacccaaaacatcatccttccgtttcttccattgctctctagacaccgcgagctcccatgcggcatgaccctcgccggtgcccctcctgaccctgcatcgacctcctccgctctgctctggcggtggcagcaccaccccccgtgcggttgtgctcctcgagcgaccgcgaccgctgcccctatgctcaccgctgcgggcgat

SEQ ID NO: 71011 - DNA, 375 bp, Triticum aestivum
  Clone ID: PAT_TA_71011
tttttttttttttttttttttacaataaaattattacaaacaacctggatatccttcaatacttgcctagtgccttgtcgtttatcgatagtttcttatgcacgttcatgtattttggaggatttggaaactattatctttcagagtggctttaatttataaatattttcagctttccttggattgcctcatctaagaaagtctttcgcttttcctttgaaaattttaattttttggtggattgtgaagctatcgcttagggattatagctgccaggaccaacatctgacatttaaatcgattgaagccttttttattgaggaattttaaaacttccaaaggatgatttgggaagactggcatcataaaatcgat

SEQ ID NO: 71012 - DNA, 291 bp, Triticum aestivum
  Clone ID: PAT_TA_71012
tttttttttttttttttttttttttttttttagcaccagtttgatgtattcttcaaattcatgcatcaaagtgaacattgatggcacgttcagacactactggtataattacctcattacagaacggatgcaggatgagcttgactactaaatggagagatcacaagtgacacgcctaagatcagtgccaatcagaaccacggttatggttccataattacaagataaacggcttcctgtaaatgtcgaatgcttcggacgcgcacagctgaggctcctgtgcgctgctga

SEQ ID NO: 71013 - DNA, 425 bp, Triticum aestivum
  Clone ID: PAT_TA_71013
ttttttttttttttttttttttgatcaatcaagagtatgtaaacatctgtcaaagatatttaagtacatgaaaaaaatcaaaacaccctcttggcctcttcaactacatggccaactggaccatcacaggcactaatgagtgagtacgtgtaagttgaaccatctcaggcacaaggaattctacatatcaaactggactatccctagaacaattgttgagtacatgtcaaactagagcatcccaggcacaacacaagaagatatacataaagttataaataacatgacaggatcaacaaccattgctagcgaaaactgcatcaacgttgctactttgatggtacagaacagttgcctccaaccgtagtgcttcttgctcgagcttcttgtcctgggagacatcaaacataacatcatcactatag

SEQ ID NO: 71014 - DNA, 303 bp, Triticum aestivum
  Clone ID: PAT_TA_71014
tttttttttttttttttttttgtatatggagatcttttactgcatacagagctcatgtacataggtgataaatttgcagctgaagatattgctgctagagataaattatagatacaagcagcctaatattaaactaacttccggaaacagtatggcaaccatctagtgattaatagccaaatcaaaagttgataatctcctatacaaactttgagtacggattggtatttccattgttgggcccttgagactaaaggaacttgcagttaagacatcaatacttgtagcatcttgttgatttgg

SEQ ID NO: 71015 - DNA, 376 bp, Triticum aestivum
  Clone ID: PAT_TA_71015
ttttttttttttttttttaaaaagaatcaaatgtttctgtttcaagccgacagcatgtccagcgagacttcactttgtccttccaattcattatattttaacgaggtctcagtcctcagagagctaagaaacaaaacagtcccaccagcacagtgagaaagaaaaacttgctctagtcctagcacatgagttttccacaaatcaaaatgtttaatgacttgattctcaaacaacactcaatatgaccaactgaatccaaaggatagacaagcagaagcattaagagttaaaaagcaaaagaactagaagaaatagttcggtataggcttccttcagagcttacacacacaaaaatgtcaaacaacaacagttgttg

SEQ ID NO: 71016 - DNA, 425 bp, Triticum aestivum
  unsure (1)..(425): unsure at all n locations
  Clone ID: PAT_TA_71016
ttttttttttttttttttttgaaagacatgaatcataaatcttaattgaatttgcatctatgactcggtacattttttagcaacagaagagaggtgaattttaaccatacacacaaacatgtaccaacagaagagaagttggattgcgatcagtttcgcaaagtctaatgaccccagaaggtcctgatcctagccaaacagattcaactttcctcggttcttctttaatttccttcggggaccccttgtgggcaacctcttcttctccatggtgctccaacaagttcaaggtggttggatctctcggattggtgaccccacagagctcaggttggaggtgatanaacattgcgcatctaggcaacaccaagttttttatgtaaacctgcacaagagtttaaggataaataaagttgttttgttcc

SEQ ID NO: 71017 - DNA, 496 bp, Triticum aestivum
  Clone ID: PAT_TA_71017
tttttttttttttttttttactgcatccttttacatccaatgcttatttctggtcaacaaatttgcacacatacttttatgcaggaaaagacaaggagcatcacactgggtatattcctaattcaaggaaaacatatggcatatcgaagcaggcaatcacaagaatgcgtgccatcttactatgcttctttgcaactccaaaaccaactctgctctctttcagccggtcaactgaagatgatcaataacatagaaaaaaatacaccctaaaccatgtcctaatcggaaaaccaactttgatgaaggcagggtaaaagtacgacgagatcagttcggtaacattctccagaaaatagcacatcactttcatctctacatacctaagcttcgcatcgcaccaatcaatttgagttgccattcaagcatgctgtacctcaagcaacagcgtcttattcgcagccccagaaatcacacgaactgggagacgtactgcgct

SEQ ID NO: 71018 - DNA, 307 bp, Triticum aestivum
  Clone ID: PAT_TA_71018
ttttttttttttttttttttaatcaaaagaaacatatattaaaacaaaaatatgctgaaagctaaagattcattggcgatggagttgactggacgtttatctgaaatcccggatactgtttgtactttgatcatctttatctatgattgggcatccatgttgctcttgggcataagaagatcgcctgtattgggaacgatctcgccctcttaggatcctgagtcagattttccttaggattaatctttttatttaactgggaagaattttaaaatgaagttaatagggataccgatcgctccaaatc

SEQ ID NO: 71019 - DNA, 304 bp, Triticum aestivum
  Clone ID: PAT_TA_71019
ttttttttttttttttttttttttttttacaacgcgatggtacgattgctgcgctgcaaggtacaactccagcacccgtacgcttgtacacttgtgcttaattacggagcattgaagcatgcatactttgtgcttgccacggaatattagggttagggaacgctcgatattacatgcatgaagaagattatttatttaataagagctagcaatagatagaacttagtaagcttgacgaagacgaagctacacgacgaagggcagggacctgctgctcgctagctagtcagctagcctcttttcc

SEQ ID NO: 71020 - DNA, 486 bp, Triticum aestivum
  Clone ID: PAT_TA_71020
tttttttttttttttttttaacaaaggactatagtagtgatgcatatattaaaacttgagcggttacacactaaacctcacataaacaagtgctactttcgagtatttccatcatatctgtatgcatcactactaaagaattgaataaaccaacttcaaatcagatcaacgtcgggtacacacggacaaagatgacatgttggtacctgtcaatagatgtctaatgtcttaaccttccagattcagtttctttgataacctattcttgtagatgcaagctgctgcaccaacagataaagtgacccagaatttcaaataattccaagtaaaataggatttgaacagataaaaaaggtgagggtagaaacacatactgtttagttattttctttgaaagaataaagttgtatacaacagaagacatattctatacataatttccaaaaagaaaaaccgaagcaagcaaaaactaacaatagcagaaat

SEQ ID NO: 71021 - DNA, 441 bp, Triticum aestivum
  unsure (1)..(441): unsure at all n locations
  Clone ID: PAT_TA_71021
tttttttttttttttttttgagaaaaggaggcctgggaattttgcaaaggggtctagctagctagctaggctgcgtgcaggcgcgcgatgatgcacggctaactagctaggagtacatccgtacgtccggctcaagcgatcaacatatgccgtagtcatggaacatgagctccggcttcacggtcaccccggggccggggccagccgccgccgccgcgtccagacggtggctgccgcggatganaacgagctccttctggcggcgcagctccatgaccttgcggtgagagttggagtgctgtgtcagcaggaacgtggggcttgccgccggccggtactccggcaccagccgtccagacttgaaccgcacaccgcacgcgttgcacagcgtcttgggccccaggggccccgttcgccactgcggcgtcttctccgacgcgc

SEQ ID NO: 71022 - DNA, 218 bp, Triticum aestivum
  Clone ID: PAT_TA_71022
ttttttttttttttttttttttgggtcggggaatcaagatctacattacaagtcaaagaaacaacaaatactagggagatatcttctcatgaagctagaaaaaaagctcacgcgaaatctttcaccaagatgggtttctccaaaatctcatcaccctcctccttccggtgctctccgcctctggtcccctcggaacacccctcatcccgtcccagctc

SEQ ID NO: 71023 - DNA, 424 bp, Triticum aestivum
  unsure (1)..(424): unsure at all n locations
  Clone ID: PAT_TA_71023
tttttttttttttttttttagcagagcaagctagcgggtctatatcaactgaagcacatgagacacgttcagcagttgaaatcaaagatgaacatcttccaaaaggtgggtgatcttcaaaagagatgaagagtctgtcggatcatcagaacgcaggcatatcaagtcttagagagagactaaacacgacacatggatcatatgtatagccggtagctgcggtgtacggtggtgcgtctanagataatgcacagtgagagaggcggcttgcactttaaatgaaggcgcaggtgtcacctaacaaatcacctgaaagcagccacatatggtaaaattgttccatatcgaatgcagtgcatggtccatctcaaccctcgatggagaaccaccaagcatacttgaacaaccaagaaacaactgaagc

SEQ ID NO: 71024 - DNA, 323 bp, Triticum aestivum
  unsure (1)..(323): unsure at all n locations
  Clone ID: PAT_TA_71024
tttttttttttttttttttttttttttaaattaacaccatttnggattgataaatcgagtatattgatttcaccgctacatcgcaatgagggtaatgtacacaaacaagaataaatgccagatactaaaatctgcaaggcattaggtcatttaattttcattacccaaacagtattgctaaactaatcactctacgcggtcttgacacactagaatattcactatcaaaatctccttccaacatcataagcataatatgccaaaaaaagagttaagataggatacaattggcccgaactttccaaattatttaatatcattac

SEQ ID NO: 71025 - DNA, 381 bp, Triticum aestivum
  Clone ID: PAT_TA_71025
ttttttttttttttttttttttttttttaacaaacatacgacagcttacttattcaggtagctaataccaacataattgcttcttcaatttcctctgagatatgcatctctgatgccatgtagcttggcaaccacctcttgcatgttggtacgttcatgcggagaaggcttcgtgcaagaaaggccaacgtttagcatagatagcagagagcgtacacctttttccttcaaggctgttggagtttcttggcaaagctccaactcttgtacgagctgaggatcgacaatctccattaccctatcagggaagctgatctctgttaacttcacaatgctcagtccatccttaaacatgtcatcagttggccttctccgaaggaa

SEQ ID NO: 71026 - DNA, 309 bp, Triticum aestivum
  Clone ID: PAT_TA_71026
ttttttttttttttttttttttttttgacctcaagaatttattattacttaagaatggaatgtgagggaatttttttgtaaaaaaaaggcacggaggtctgacttcaagttaataaagtcatcaaccagctaggatactgtggtgctgattacaaaggcaaagacttgccaaaaactgaaaaattacaagccaaattcactacgcccaggggcagcacgaacaaagcaccaggagaaattgcgatcaagctgccggaggtctcgcccagccaaaacagcagggccgaagccacctgacgacatcaattg

SEQ ID NO: 71027 - DNA, 137 bp, Triticum aestivum
  Clone ID: PAT_TA_71027
ttttttttttttttttttttttttttttttagtggaactattactacatcgggaggtacataaatcgcacatatatacattcagatagttgatcaacttgaaagattacaatggctgcaagtcccaggtaaacacat

SEQ ID NO: 71028 - DNA, 313 bp, Triticum aestivum
  Clone ID: PAT_TA_71028
ttttttttttttaaacagagtgcaaagtaccccattttcagttgtcggaaacgacttataaaagcgaacagaggaagtgatagtaatttggaaccgaactttcacgttcacacacccattaatataggggagccagacttgcagttttattcgcagtaataaacgggagttattcctacgaccggatattacacccccggttcagtaaggttgttgcaccaacttgtacagtactgctatgatcacggtcgtccaatccctccattgtacggcggaggggctccggggccgggctgcggacggtaagggtagg

SEQ ID NO: 71029 - DNA, 449 bp, Triticum aestivum
  Clone ID: PAT_TA_71029
ttttttttttttttttttcaaacaaccaaatatggtacattacaatcaaacatagttcacaccacgttttataatcgaacatacttcacatcaggtttacaaccaccaagaacacagccaaatatcaaaatataactatctataaaagtataactagctccaatgagctagaactaaatgcttcttcacttttcatcctggagcttgcgacatgaacaaatgccagcatctacatgttatagaacagaatggttaggaacaaaataaaagcaatcaatgaaacagaacaggactgcaccaataatatcacaggaagttccatatgagctagaatatggccaactgcactatgcactgctcacacatggatatatgcctactaacatcaacatactgatctaatacagagcagaggcatcatgcataccctaaggatatacatacagatg

SEQ ID NO: 71030 - DNA, 327 bp, Triticum aestivum
  unsure (1)..(327): unsure at all n locations
  Clone ID: PAT_TA_71030
ttttttttttttttttttatggatgaaattggatattatgaatatacacaaaattataaccattttcatatataagttatttacaagtgatgcacggtttgagagttacaatatgcatgaggcttaggggttattctgtaaaactgccaactctggaataaataggaaattcgttttgtggaaaaaaaatgaaacgggccaaatctggtcagcccaacagtgcacatggagcagggctgctaacatcgggttgaggcccagtcaaggaagaggcttggcangccgagcgccgctgggcctggcagccgggccggttggtggacctca

SEQ ID NO: 71031 - DNA, 174 bp, Triticum aestivum
  Clone ID: PAT_TA_71031
tttttttttttttttttttttttttttttggaaaccaaagacgcatgatttcaatttttaaattgccacaccagcttctaagggtctaaaaccatattttgtaaaaaaaaagaattcaacatccttttccccgcatggtagttaccccacgaccacatttcagccaaaatcggt

SEQ ID NO: 71032 - DNA, 317 bp, Triticum aestivum
  unsure (1)..(317): unsure at all n locations
  Clone ID: PAT_TA_71032
tttttttttttttttttttcagaatcgtagtacgtaccacgtacgatagagaatggatggatgtaaccacacggcgaccggaccgcaaagcgaggctcgagggccgaggaagaagaagaggaaaaaaggaaaaaaagacgcactggttgcttgctcttctcccctgccgcggccggccgggtgagcaccggccgtgcatgttactacaggctagctagcggcagtagagctancatgcagccgtggccgcgggcccgccgtgctctgacgccatggccgtcgcggcctcctccgtctccgtgctcatctgctctgcc

SEQ ID NO: 71033 - DNA, 631 bp, Triticum aestivum
  Clone ID: PAT_TA_71033
aacttactggtaataacaaatttgcccttgcaatctaattttggaagagcatggaagcactcctcatatcctaatatgatttgcacataaaaaagaaaggatgaaatgtattgtacctttggctttcaaattcaggaaaccaccgggcaaatccaggaaatatccgtatccggcagatagctactcgaatctggatttaactccgaccaaatagtaaattttctttcagcatttcaatttgccctgatttggctccagatcatgtcgaaactatacgcctgtatttcaaccctacgtgcagccctgtctgaaaccatattgtttcttgtcctcccaacagatggcagataagcatataatctgtttagttatactttctctttcctttttattgctgttgttgctgacaatggcatctacccgtccagcactctccgaaatccaatcagaacccttgcccacccagattgcaaaacgggtagtaaacaaacagtgaagggtcaaactttactgtaagtactgagcttttgtacattcagatcacaagagcagaggaggtctattgcatggtatgtcacttgagaatattgcacggacacacaagctgaaggctgtacagcaggtaccaagc

SEQ ID NO: 71034 - DNA, 203 bp, Triticum aestivum
  Clone ID: PAT_TA_71034
ttttttttttttttttttttttatttaaaacaagttgcattccaaacgggaaaatatgttctttattcacattctgcaagtaaacacatataaactgcaatagtacagtgtgtccgcttcagaccacgagactgtaagaccacctgtgatctgccccctgtcaggctcaactaaactccaagcttgatcctagggcatgccag

SEQ ID NO: 71035 - DNA, 379 bp, Triticum aestivum
  Clone ID: PAT_TA_71035
tttttttttttttttttttttttaataaaaccaaagcactagatatatagataaaaaataaaacaaagccctagggggttctcttcagtcttcaccagagtttaagtcaatacccgaaccaccacatcagctagtttaagcagcggcaaattaaaatgcaagcatgcctagcgcgaggttcgttcttgacttaatccctagttcgcatctcgccccgttcatttcctctatgaaatactaattcgatctccacactataatttatttgtatcccaagaagccactatgatgatctgagttctcgcctgaaatcttcttcttcctctagctttgtgatcttcatcttccacgacctgatcgagctagttagacatttgaa

SEQ ID NO: 71036 - DNA, 536 bp, Triticum aestivum
  Clone ID: PAT_TA_71036
tttttttttttttttttttaataatactggatttatttatttcacaatacaacccccgtaatttacagcttttgtgctacaccaagaattctgaaatttgtccgttcttatcggtcggtcggtcacgacacagcaagcaagctagatccctgcctatctgccacagcgggggatcccctcgatctacagcaagttcaaatggaacaatgatgatctcttcgatccaagctctctggttcttcacatgtgcagctgctggctgaggaacggatggatcagcatgccgctgtactgatccgccgggagctgcagctggctgcagtacaagctgccgctggatctcttcctcttcatgccgttatacctatcgccattcatgccgtagtcatctacatgcgcctcgggtagctgaggcacgtcgatggtgtcgttgttcacgtacccgttgttattgttatagtgtaccgtttgttgccatggaggctgcgagtagatgagtgggttttccggcggcagctggtagtctgctccggcgt

SEQ ID NO: 71037 - DNA, 226 bp, Triticum aestivum
  Clone ID: PAT_TA_71037
ttttttttttttttttttttttttttttttttttttttttttttttttgcaacttcctattgattcacacataattctttcaaacaggacgaaacaacaccctacttcacaaagggtcgagggtaaattcaaaaacgtggactctttcaatcaaacctcctaacttgaactttaaatgaaactgctaacttggtaccgaacaaacccaaaataccaaaatgcaaat

SEQ ID NO: 71038 - DNA, 248 bp, Triticum aestivum
  Clone ID: PAT_TA_71038
tttttttttttttttttttttggatcaccccgggaaacactaaggcgggaaaatgaaccaattgaattttgttgcccgttcattgaaatttacaggaaaatgaaattaataatcaagacataaaaaacccctcgcctgattaattaaccctgaaaatcggtgatacatgccccacggaagcaaagccagccaactacctacctaaattggaacttggaaaaaggtctcgtaaaggggaacaaccttgg

SEQ ID NO: 71039 - DNA, 204 bp, Triticum aestivum
  Clone ID: PAT_TA_71039
ttttttttttccacccaaccaaacactgacccgcattaacaaaaataacaactgtccatctctggtaccaaactcgatttttacaaaacttgattccggggagttaggggggaaaacattcgcggggcccgcccgagggagggaccacacctcgcgatggcttttatccatcacccacatcaatcaaggtagggtcaaatgcca

SEQ ID NO: 71040 - DNA, 253 bp, Triticum aestivum
  Clone ID: PAT_TA_71040
ttttttttttttttttttttttattttccagagggaataacacatcaccggtgctgcattttcttctcagggattcaattcagcgtgccaacaaccagcgcttggaaaacgcatgcacgatttattcattcgtgcttttgacgcccacattcaaatcatacattaccaacaaataaacacagcacaggacagcacaccatttcagccgaaatgagcaagtatagactgacagctaaaatagcacaacacgcgc

SEQ ID NO: 71041 - DNA, 176 bp, Triticum aestivum
  Clone ID: PAT_TA_71041
tttttttttttttttttttttttttttttgtgatctcagttatagtagaattcaacgtaccattacaacaacagagtgctatacgaagcaattgtgctgaccacagtgatcatacgagagctgcaaccaacacaacaccggtttaaataaacggcaaggccactatggggggctgc

SEQ ID NO: 71042 - DNA, 348 bp, Triticum aestivum
  unsure (1)..(348): unsure at all n locations
  Clone ID: PAT_TA_71042
ttttttttttttttttttgatttaatgcaccttaaaatttgaacatgtgatgagaacaaccaaattgagcattataaaatagaaaaactaaaattttgagataagacctgtaaaccggaaaggagggagtagtatacggctcggtagttactacgggcgactgccagaaacggccaactactactgcgttaacactgcaacctanctgcagatcggtcggtggtagagcacggcacggcccccctctccgtccggccggttgctggggaggaaccgaattcatcgtacgtaccgcactctacaccgtggtgacacaagaaatctgacccgaacgaaaggcgaaaacaa

SEQ ID NO: 71043 - DNA, 135 bp, Triticum aestivum
  Clone ID: PAT_TA_71043
gacttaactatatatatggaaagcaatatatctggcctgcttccttggacgcatattattttttgcattatgacttatgagtcacatgaataagaacactacggaaacaatatatgactcggcaactcggggggt

SEQ ID NO: 71044 - DNA, 352 bp, Triticum aestivum
  Clone ID: PAT_TA_71044
ttttttttttttttttttttttttttttttttttttttttttggaaaaacaatttacaaaaaatttattacccttcccaaccccagctgggcaaaatattttcaaaatggcattcaccgtgaaagcggtcccaaataaacaataaaaaaggtcatcattacccattacacaccatgatttcttcccccttaaggggccaaacttctcccccgtggaaaaaaaaccaccaccccccaaaaattgcatgccccccccaggttgcaaccgtatcgttgcccttcaaaataaaaccctggggcaacccggaaggcgggggggccttcttgctaggcttccccacaaaaatcccctg

SEQ ID NO: 71045 - DNA, 394 bp, Triticum aestivum
  Clone ID: PAT_TA_71045
ttttttttttttttttttttttttttttttttaaaaaaaaggggcaaattccccccttaaaaaaaaaaagaaaattaacaaaaaaacgggtatgcacaatccttattctacaagttgggcatttgaaacggcaaccacccactaaatccccatgcaaggtccccaataattacttcccaaacaacggggggatgccctgccccttcctgaagtaatcctgaggatccaccttgcccttggaaaaaccaaccctttggaatttgcccttaaattacttccccccccaaaccttgccgctgcaaaaggttgaaatttctttcaccacctctttccggccgaggtcaatgtccctgtatttggcgtacccctgcctggggttcttgcccacgtacgg

SEQ ID NO: 71046 - DNA, 544 bp, Triticum aestivum
  Clone ID: PAT_TA_71046
tttttttttttttttttttttttacggggggagtactagccagcctggctcgtatcctttgcaatctaattcttcttataatctaattcttggcacaagaagagagcaagagtcaaactcaaactcaaactagttcatactagtacaacttgacaacttgtcaatcaaaaggatacgtaatagtctagtcttagatacatcatcatcatcgttacctgctccagccgagccccctacttttaactattcacaccggcccaattactaactgcttgctgataaatagtactgtagtatactcaactgaatcactaatctaaacgctcttatattaatttacagagggagtagtttgcatctactccgattcttctggataatcataataataaagctatgcaatcagctaagccattatccgctccacgcctcctactaaaccctaaacacacagcagcacccacattctgctttatcatcttcaatagtggctagctacctatatttacatcccaaaagcagcagcagccagccaagctgcatt

SEQ ID NO: 71047 - DNA, 180 bp, Triticum aestivum
  Clone ID: PAT_TA_71047
ttttttcctttttttcccagccccccgcaaggcccgagcaagccacggttcatttccagtcacacacatccaacaaatctgtccgtccaaacgagcgacgcaggaacagctctgccgctcaactcagctcaactcaaaatggtctgcactgcattcatgccccagagttttacactacat

SEQ ID NO: 71048 - DNA, 440 bp, Triticum aestivum
  Clone ID: PAT_TA_71048
tttttttttttttttttttgcttgcaagttggaatgacataacaacggaagatgatgcatttcaccacaggattagcaccaagcttaatatcctccgatttaagtaccctacaatgacattaaagttcactactaggtaggactaccatcaaagatgaactgcatcttctaataaacatcacccaaatacttagtttaagctggaactccaagataagcaaccacgaactgccttgagtgctggacctaatcaaaccaatgcgtcggaccaaggggagagcttgtcgatgcggatgtgcagaggaacttccatggacgcagccccatcccctgatgctgctgctgctggcaccaggtacatcggtggcaccgtcaggaacgtgggctcgcccgcggcgaccacggcgccgggcgacgagctgctcctcatgtgcatgtcc

SEQ ID NO: 71049 - DNA, 306 bp, Triticum aestivum
  Clone ID: PAT_TA_71049
ttttttttttttttaaaaaagcatggtatatttactctttaccgcctgtcactttgtactccctcgtcgcggttggcgcacggccgaaagagtacattttcttttctttatactccacaagagaagagagaagaagaaataatcgtggttcgaatagtaggaagggcagcactcgggaatcaatcaatgctgcgagagcgggaacccgatgccgtggcgtgtggtggggaaggtgacgaagagcatgctcccgaccaccccaatggcgatgggcagcacggtgagcacctgcgcggcgtcctcgga

SEQ ID NO: 71050 - DNA, 526 bp, Triticum aestivum
  Clone ID: PAT_TA_71050
ttttttttttttttttactgcaaggaaaatattgtattcttgttacctcatgagtagctaacaacactgaaccttcaaatcagagttaagcatggctatgtgcagtgcctgggtgcatttgtcaagcccacagtgaacatgcgcggtcggaaattttgcatttgacctgatcaagtcattccaactctggtctctttcagtaagtagtacctagccagatagtcagtcattggacaagctgttgtatcacttctgcctctgtgtgttctcgtcctctccttcaccagctatatcctgcttccttcacaacgccagcacagtccatcccctgtctcaacttctgtgcatcagaccacagtcctttagaggcataaatattcgacataagaacagaggggccactgtccataggatccgccaagagtgccatttcagcggcatacgtcccgatttcaacattaccaaacagatggcaggcactcagcaagctcctccaaacaaccgcagctggttcaatcggcatcct

SEQ ID NO: 71051 - DNA, 553 bp, Triticum aestivum
  Clone ID: PAT_TA_71051
ttttttttttttttttttttcagaacttcagaattaaactcatacattaagtagctcatatattgtctgatacatgatagacggaataaggttcacatcctttaccataccatctaggacataaacagccagccatgcaccaaatgcactccatacaaacagtacatgatgcacccaagtttgctgtatatagacaaaatatgcatgatgatgttatccatgctcccactacgtgttaaagcgttcctagccatataaacaaaaggttgccacaaactctatctaaccatgtggcaattcagtgagcagccgcagatccatcattgccaccttcatgaaactgaggctcaaagtagctaatgacccactctcgaagaattgtttcatcggcatagttaagataactacgaaagatatcttggtctggcttggatagataggcaacaatctcaagtttatccttagctgggatggtaagggcattgatccgcttccaaagatttgcataaggatctgcaggtggcattggttgcacagacacaataggggatgc

SEQ ID NO: 71052 - DNA, 477 bp, Triticum aestivum
  unsure (1)..(477): unsure at all n locations
  Clone ID: PAT_TA_71052
ttttttttttttttttttttttttttgggtgacttgctcagtttcaagcctggatttcttttaaatggaagctttaattgcttctggtctccgcataccaagatgcatacaattaaccacacaaatcaatataaagtagcatgcgaatcaagcagggacgttcatttcctacttttccttatcttagagtatataagaagaagaaatgatcacaagaaatggctgaaggttgtgttcatgaggtactcggcgatgatcttgttggcccgctccgtcgggtgcacggcgtcccagaagacgtatcggtttgcgtcggcgcacgtgagcgcgtcccactcgctgcatgtgtaccccatctcatacaaccccgtgccacaacaacccctggccgccttcacgaatccgtanctcgacgggttctgcaggatgccggtgaagaaatcgtacacctcggcgacccggaactgcgcgccggga

SEQ ID NO: 71053 - DNA, 381 bp, Triticum aestivum
  Clone ID: PAT_TA_71053
ttttttttttttttttttttttttttttttaaagacatgggcgagaccatcataaataaataagggtttcgtcctcagataaaaaagcctacgagtatctacatatagctgaaagttaacacagcaacatagggggcttaaattccccatctcaaccatccgaaaattccacaacagaccaagcattcaccaatatgaaattcagactacctcaacataacattcagcaatgatctggaatcaactagcagtaatcctataaaatttagcagtattgccatcaaccaaggtcacctaacctatacagagtcacgctgggggccaagcttacgggtgcacacctccacgttgccatcctcggtgcccggcaggtccttgggg

SEQ ID NO: 71054 - DNA, 362 bp, Triticum aestivum
  Clone ID: PAT_TA_71054
ttttttttttttttttttttttttttttaacgcaaaacgagcagagtctttataaagacaaaacacatacagtacaattcttctacacacacaaaatatgtttcgacaagacgcgatcggcatagctaggacctgcttgcttggagtgctgctgctaatttcacatgaaacagtttgatctctgcttccaagataaaacaaaattacaaaatcctgtggcctaatgtggcagtaccacacacaattcagcctcggcattccagattgtatgtatgtatgtatgtatgtatgtatgtatgcatcctttttgctgcatccttctccctttcatgcattgctcccccttcccccctgcctgcggt

SEQ ID NO: 71055 - DNA, 466 bp, Triticum aestivum
  unsure (1)..(466): unsure at all n locations
  Clone ID: PAT_TA_71055
tttttttttttttttttttttttcgattcaaactagaatgaattgtattcgtatcaaatagcagaacatgcagtaagtaaacccagctctcttgattcgaaagccaagcaaatggctgaacaaatatagttgttgtttacaccctggtgtatcagatcagatagtagcagaacacacagtaacagtaagtaaaccaagctttcaagatcgaaagccgagcacagcaaatcctaaagcaaactaggccagacgttgaggagctgcgactgccggagggcgcanagacacgcgcccatactgctcagaggagtacttcttgtagatggccttgagcttgcactccggagcagccgcgtgcgccatgacgagcaccttggcaggctccaggagctggggttcagcgaatccggtgtggtgcttgagggtttccgtccagatggggcttcttttcagcgtgcaccgagcg

SEQ ID NO: 71056 - DNA, 545 bp, Triticum aestivum
  Clone ID: PAT_TA_71056
ttttttttttttttttttttgagttgcagaaccaatcaaagcatattgatacacactgcatattttaataagaagtcaaatgtgcgcacaaacatcacacttattacatgaaaccgtacacgaatgctaatgatgttcgatacagaggaaatccccacgaattcaaatacaggcatagatacaaccgtttatgctcaatcggagccactagggcactcacgtagagcaagtaaacggacatacttcagttgcaatgcacgctgaacataaacacaaggaaattaacagacaagcagaacacattgcaatccacactagcacacgcaaaccataccatgggatgaaaggaggggcccttccggtgtcaaacctgtttcttccagcaggagaatgttgcagcatcgtcgtcatcctcttctccatctccttttgcttcgttttgagtttccggtccattatgtttaaaactaggcttgtttttatgcttttcaatgggctcactcacctcattggggactttgtcaccgttgaactcaagctccttc

SEQ ID NO: 71057 - DNA, 398 bp, Triticum aestivum
  Clone ID: PAT_TA_71057
ttttttttttttttttttttttccggggaaatgcttgcttccgaccctctagcatttcaagaacagagaaaattcccagaagagaaggcttgcatgaacagtttccaaactagtatgcttatccatttttctgcaacactaaccagtaatccttctctaatgaacaaaaggagcactcacatactggcgctcctcgaaaccagttgctcatatgcagggttagctcacaaacaacaaccaggattaagtacagaaaattaacgccgcaaagcatcataggaggtgactgaatcatccacattttacatgatgacacataaaacgtgaagcacacatgcactgcctggtcagagatagggctctgcagcaacagattgtgaagcagcaccgggacggtg

SEQ ID NO: 71058 - DNA, 554 bp, Triticum aestivum
  Clone ID: PAT_TA_71058
tttttttttttttttttttggtaggcaaacacattattacttgccaacagagtagcgcattgtcgattttgttgtggtctcaacgtttgtttcgagagcatggatattcactcaaagttttaggtgttgagctgagttgtcaggctatatataatggatgtgcttctttctgaattatttgctctcttcgtaaactgagcaatcctctacctcaacgtacagacaagagagcaagactgaacttgatgtactatgtactactattaggctatgtgatgagattaatgcgatttagtttgttatatactctttagttattaggttattatgtgttgtcatttaatttgctagtgtcaatgagataagatactttacagttatgctaagttggcattgtgattccgtttgctacaatattaagttaactttatagtcgccacagcatactcaacaagtgttataaagttatcaaggaattgtgtcgccactgaaacatttggtttaacgtcaataccttgtcatagcctgttgtagctgccacctctccctgctgg

SEQ ID NO: 71059 - DNA, 518 bp, Triticum aestivum
  Clone ID: PAT_TA_71059
tttttttttttttttttgataagtaccacaccaggaacgaaatttacaatagatatagaagtgacagtaaacaagttattcaagatttacaatgaacaacatgatttggcttcttgctctaaaatagaaacaatctgcaacactaagttggtgacaatcccaccaattcaacgacaatggaaatctctacccttcagtcccctttgggacttctagaatcaaaggcaaactatcatcattgtaggaaatcaatgtactccctggaactacatgatattagatccctgacaacgcacataatacctacaaagtagctgatgcgaaaatgacttcaaaatagttctttgtttttctaaacccaaacatagttggggagacctcgagacagacagtttacgggtcggtggaagtggctggtgacaaaattgagacaccacccgtaagcttggtgtgtcaatgttttacagatatgacaaagaaatgagaaatggttgacctggcaatgttgctcagtgttc

SEQ ID NO: 71060 - DNA, 480 bp, Triticum aestivum
  Clone ID: PAT_TA_71060
ttttttttttttttttttggaatgctcaaggtcctgacgacacgattttcagtactgacaaaatataaatagcaccagtaacatctttacatactgcccaatttaacttagaaaaaaaacatactaccccactggaaactgtttcctgagttgtaccagctgccagcacagggccactgttaaaaaggtttggacaaaacaacacaaggcttgaaacaacttttatcactggttcaacacaccaatttagtcttcaccggaccagtagggatcaaaggccctaggtgatacacacacaagatgatagacttctggccttgggatcttcttgaaactgatgttctcagtaagtacaccatttctagtcatgatcttcacaatttggttgaccttatccttgacccttagtttctcttcacattcaatgctgacttcctgaagatgcacacatgaaaatgattgctctattcgaacatgttt

SEQ ID NO: 71061 - DNA, 521 bp, Triticum aestivum
  unsure (1)..(521): unsure at all n locations
  Clone ID: PAT_TA_71061
tttttttttttttttttttaaactctccaaaacatgtttatatttatgaacagagggagagggagtacaatccaacagacatagggagcacgtacgcatgcagcaagtctatatgagtgactataacacaggaaggaggagggagcacgtacgtttgatcttattcctactacgtgctgcatggcgcaggcgtggaagctaccgcggcgtcacccgcgcccggagcgggctcttcatcaccttgaagaacccatccagctccgtgaggtcgacgcctcccctcgccggcggctcccactcgaactcacgtaccagcgccgccacgaagcttttgacatgcatggtggcgagccctccccccgggcacgccctctgccccgcgccgaacggcatcatcttgatctccttgcgcttgggccccggcaccaggcccacgccctccccctcgcccccggngaggaagcgctccggacggaacgcgtccgggtccgtccacgcattcttgtccctgccgatctctc

SEQ ID NO: 71062 - DNA, 574 bp, Triticum aestivum
  unsure (1)..(574): unsure at all n locations
  Clone ID: PAT_TA_71062
tttttttttttttttttgagtaattttcacaatctggcattaaagcaacatgtacacaggggaatacaaaatttcattacacgnggaattgttcaacacgtaggagcacatctggtactgtcctaacaatgtctacataatttgccttatctcactactacataacattgttcaacacgtaggagcacatttggtactgtcctaacaatgtcttcattgctccctttgatgggcaagttctccaggtgcgacaacttgccttccctgaggagctcgccgcgggatcttctccatggacagcccccttctttcacaacaccagattggcctcttcatgaacctgcaaaaataaatgcacacacaaatcagattgtgggagacgagaggaggaataggaggagggatgtgtatgcaagtgtataagcatcaagcatgagatacttttcaaattactatgaacattcttagtttctttgattgaagtaggtgactggggctaggtgtgctcactactangcagtaaaaactcggtatatacaagcattgtgtgcttagttatcggcgacgaatatct

SEQ ID NO: 71063 - DNA, 556 bp, Triticum aestivum
  Clone ID: PAT_TA_71063
ttttttttttttttttttttttttttttttgggactaacataataatgttacaacccaaatagtcttacaagtaaaccagagtacataactaagttcaaactttaaattagtattacatcccaataggcaaaaacaacagcagtagcatctaatgcccatacttgctgttgtatttcctacgcaaccaatctaaacgagcagcactttcagtcatatgcaggaacatctctctctgctctcgcttcacaaatagttcactagcaatgaaatattcatcactgcctactattgcaccacactcaacaaccagatccatcacagaagtaatcgatgaactctcttctttcttcatgtatgactcaaagctggattgggtcctctctgctatatctccaaccctggttatctgttcttgtataacaagagatgtctttggcttcttgttattgccatccacatacctgccaagtctcttcccttttccatcggcatgtgactcacctgtttgggtctcctccagatcaacatcttgtatgtcgtccacaatgaaaactg

SEQ ID NO: 71064 - DNA, 620 bp, Triticum aestivum
  Clone ID: PAT_TA_71064
tttttttttttttttttgaaagcaacgcgatgatttatagcaaccgggtcataatttgtagccccacccgttttgttggtgttacagacatacaatggtcggctgtgtttggacatacatgcgtcatctgcttatttgttaggagatttgaatgtaatccaattagaaatcagtcaaatgttaaatagacattcccttaacaaaacaatgttctatcactcaatgatatccaatgttacaagttacaccaagcgtcgctgcctttcaaaggctcggcagctcagaagtatataaagagcttctcatcgatcttggactgcagcttggcgcactgctgctctagcttggcaagctcatcgtcccatttgagtggaaccaaatctcttagctccactcttcttggtgcgtcgtgcatgttgtcatcggtagctccatgcactgggcttacctcaccattgatgtgtgccagtgcctgaggttcgtcgtatgctggggttggcaacggtggtggcggaggtctcagcgatggaggactgtcagaatcaaggtcacaactcacctcaatgatctcgtctagcgagagcccagatggcacagcgggcatcatgtcatggtcctcc

SEQ ID NO: 71065 - DNA, 449 bp, Triticum aestivum
  Clone ID: PAT_TA_71065
aaatagttacagagaagcggctttgaccgacgtaatttgtaaccaccgtaactaggttatgtaaataacaaactaagcgatcgaatctaaataagcggcgataacaattgttaaagccacaactgtaggcaagggatcataacaccagctctattttacataagccatgcatggagtaaatgtaggccagcggcaggcagacttggttgcagaaatttggaagcacatgttggggtagaaacaatcagcattagagttgcatccaacaccattgtcatgccagtcagcataagtgaccacaccataagaggtcaatccagttttatggaaatacttagttcgttggcagttgagattgccgttggttccttggttaatcttgcagaatgcacttgtagtaccaatatacttgccttgaacaggaacatcagaaccatcattagtcgaac

SEQ ID NO: 71066 - DNA, 542 bp, Triticum aestivum
  Clone ID: PAT_TA_71066
ttttttttttttttttttttttttttttttttttttggcccgaaacatcacttcgttacattaaaataattgcatagtcaaactacgtactaccactggaaaacttaaagaaacatacagcggtgggctgctcaagagcacaacacaaaatttcataattcattacaggccgatacagaaaagttttcctttgctcaccagatacatcacactggtctcatatttcctccaatgttcagcagccaccttgtagtcttagttctgcattggtgcacttgttcctccggtgaacttcgacgccccaggccttcaagactgtttcggaacatccccacgatcggccctgccgatgcacaaattttgcagtcttgccagcttactcaaaccttcatatggcaccttctccttgcttgttgtaggccaccccatcgcaacaatcgaataagagccgggcactcacaatggcatgacctctcatcaccagccttccccgcacactgcagcatgcattttgacagctcgacatttggtctgcctttccc

SEQ ID NO: 71067 - DNA, 451 bp, Triticum aestivum
  Clone ID: PAT_TA_71067
tttttttttttttttttttttttttttaagttaacaaaatcgtgaagttttcatttatccctatagttcacatgattgtcagagataataaaataaatggtgatgtgactaattacaactttcctactgtaaaatactctattctgtcatggcttcctcttgtggctctactgcaaattctttcctgcagacttaaaaaaatgaacttgtcataaatgtaaccgaggagggtgtactcataatctatactttagcatagaaataatcctctggaaaatcaaggaattagcttaaggccctttgtatatgcaccaaacttaaaaattaggcttcttagcaaacaaaatatgacaaagggtacaattccacataaatatagttatctgagtacacgacaaatctaattaaaaaaatggatattgcatgtcaagatgagtgtgaggactgcctc

SEQ ID NO: 71068 - DNA, 561 bp, Triticum aestivum
  unsure (1)..(561): unsure at all n locations
  Clone ID: PAT_TA_71068
tttttttttttttttttttaactctgaaacaaagcagccttaggtcaatagtttgaaattttcatatcaacacaaggataacaaccttgcaaatgcatgtgcattataatggcagactacaatcttgggcaactaaaattgagtcgactcgcttgtcccggtgggccgatggtgacagctctcttgacccaattttcttatgaagccaacccagaagacccatcggccttgaaattatgggctggaccaatgtcccaatgggtaacatcggcccattcccatcgggactctcacacgatctagcttccaccacctccctcatatgccactttggacagaaacgtgaagaaccgaaggaaaccaagatttcaattgttcagttttggatgaaaaattgaagaaccgtangtaactttttttgtaattattgatgaaccttttgtcctctcttggaagttggaaccttttctatttagggtgataactggggcacctctctatgtatggaattgatcaacatgaattttttatatatctggattgaacttctcacctctgtac

SEQ ID NO: 71069 - DNA, 431 bp, Triticum aestivum
  unsure (1)..(431): unsure at all n locations
  Clone ID: PAT_TA_71069
tttttttttttttttttgtacattgcacccatgatgaatagttaaatgaaaaataacatacaaaattgactcactacactttngaatagaaccataacattccattctacttggtttctcgaccaaccacggactaaagaccataagtgcatcagcatgagcatcctctcgcgcacagcagcacaagacgacgggtagaatctagagccaaaaagtttaccctaggtaccaaagcatcagcagggcgcgcgtttctcatgctgtcgaatcggcctcaggagcgctggcgccggacccggacggggacggtgcgccggcagacccgtatgatgcccctgacgatggcgagtcggcagccccggaagatggagcgtccgcgtccgatggggatgccgacggtgcatctgcagctggcccgctggaggcgccgt

SEQ ID NO: 71070 - DNA, 384 bp, Triticum aestivum
  Clone ID: PAT_TA_71070
tttttttttttggatgcacaaaatttggtaactgaacactaaaaaaaaatagcatcactgtttatatacagatatagtaactccagcactgctgcctttgtgcaggcttgcaacctactaagtatatcatcttcatgttgctgttttcttcccccccaagccgaagtatagctacttaaagtcgataatgacacattccttttgttaacatgaaaaccggtccttaatcttcactgcgcagcttgaagttcaatcagcaacaaccccaaccacactcactcatcaaatctgggctgcctttgctttgagcctctgcacctcatcctgtgcacacaaaaaccgccattgtagctccaggacttcattgaccagttccttcccctt

SEQ ID NO: 71071 - DNA, 481 bp, Triticum aestivum
  Clone ID: PAT_TA_71071
tttttttttttttttttttttacccagaatacatgaagtattataccaacaataacaaagatccgagtcacataggagtacgtgctccagttacatagcaatagcatcctgattcctaattaagtaattagttgatcaagtaaaggttataataaagacagttagaacgctatcagtctatcatactagacaagatgcagcccactactgctcttccttgatgctgccctgatcactcacgacatagatagcacccatgagcttcctggtatctttcttcttcacattgcatctcttgcatgatcacgccggagtgcagggaatgtgggatgccagatcatcataaagggatggatatcaccaaaacattgatgctcttccgtctgctcatacaccttacgcagtgtcctacacctggtatccaggtggagcgcacaccggcccatctgcaagagcacaaactcagcatcgttccccgccc

SEQ ID NO: 71072 - DNA, 504 bp, Triticum aestivum
  Clone ID: PAT_TA_71072
tttttttttttttttttaggggaagtacgtttggtcttttaatagtagtatagatacatcaccaccaatgagcatttggcaagaatggtggggggagaacccgccgatctccctctccttccactcttttatcaccacatcaccctctccactatctcctcatatttataagtaatcttgctgggatcttttcaagcactaaaacagaaaagctcccctacgtacactgatacaattcctaatcaatcaaaccactacaagatttaaaaaaattaacgtaagaaggaagaacaaagctcctcatgtcggccgagcttgtacttgtacatgagtgtacaagcatcccacgctctgaaggggccaccaatgaattttctttcatccaccaccttgacatataccagttgatcgctataatatccggccaccctccgttaaagcaataattgtatacggatgttatgtgtctttctcctttcagcagcgcttaaagtctgaagaatc

SEQ ID NO: 71073 - DNA, 522 bp, Triticum aestivum
  Clone ID: PAT_TA_71073
tttttttttttttttttttttttttttaacaggggactaaaagtttgaatttattaagaatatactacaaaaatataaacggaaaagttaactgaccagctcattcacacagcaaaacgaaggaaaaaggaagtcacaactagattttaatagtgaaatatgaccccttaaaagtagaggatcataaatgaatatgtccaaataattaacagtaatatgtagtgtattccagttaacaaaaatactggttccaaacagttaccaccagatatcacagggtacaaagagttctactccctacactaagcaaaaacacttctgatttcaacttaaaaattaaaaatttgtgcctgcaaaaatgtcagccattaaacttatgttacgtctgaactcattcttgcagattattttattcaaattgttcagaggcatttaaattgacaggctctgtaaattacgtaaaatggcactcttgcaacttcaaatgtttaaaataactaaaatattgactgaaaaaaaatg

SEQ ID NO: 71074 - DNA, 472 bp, Triticum aestivum
  Clone ID: PAT_TA_71074
ttttttttttttttagttttttttttttgcttttttgacactagtgtagtgtcagagaacggcttataatataggacggggtagtacaagatagaaaaataacagagcatcattcatagtactgaatattaactgaattcaatataagcacacccaggacgaccacaacatatatatgctaattttagccatttcatcgttgaaaataaataaatgagttgttccaacaaattggtagccgagaaacatttttgcagaaggacaatagcattgactattctttgagatcggggagtccttccaaccacatcgagattaatcttcaactcgaccttctgagcgggacagaatatcaggagaagcaccacattgagattcatcttcacctcgaccttatgagcgggacagaatatcatgagaagttgacgctgacgctgctgtcatcttcttcctcaacaattccacctcctcg

SEQ ID NO: 71075 - DNA, 523 bp, Triticum aestivum
  Clone ID: PAT_TA_71075
tttttttttttttttttagcagtacaacaaagataccaggaaggaaaaaaactagtggtcgtaacaatgctacataaacaaatttgtacgtaatacatcagatgataaaacaagggggcacaacattatttttagccagggatggtgatattcgagagcattgcatttaccaacactagaagtgtttttcaggctttcagcgcattcactatgaatacccagtagggtgctaaatacttcaaaagttgtagcacaagatatgataaatttagggaagtggtcgcaacacataccacttagacactaaaagcaaagcatgctccttggttgcgctaagttttgaaattatccataaatataatttgcagaactaccacaaaacgttatgtggtcgtccacaaaacattaagttgtaaatgtattgtagccttatgacaattgcaaatgaaagtccagtaggagggtttccaactggacttttattcgcaattttaaggttttctgatttcgtacacaacaaaag

SEQ ID NO: 71076 - DNA, 528 bp, Triticum aestivum
  unsure (1)..(528): unsure at all n locations
  Clone ID: PAT_TA_71076
ttttttttttttttttttttttttcatagcaaccggatcatgacaggatagggctcattcagcaaaatcatttaaatgctcggttcaaaaaaaatcatttacatgccctcaacaagagccactgccacactcggcgcaagagattagatgttgctaatgttgctggaatcgacatcaatcaaaagataactgtcttctacacatgtcaggactgcagcagcatgacccaaagaagatggcaccggccgcacaaatgctcgagggtcaccgctgcgattgttgaggtgcgcttctcttactgccggcatgcctacacaagattcctcttggcatcaggactcctctttctctgctatttaccaactcctgttgcgaattctgatttaaatgtgaagagtgcccttanccagctgcaggtcctgaggttccatttgactgatgagatgtctctgttggcttctggccacggggtcgcttccttttaccgtttgctaatgtgtcttgcgcggctccgtttggctgctgagg

SEQ ID NO: 71077 - DNA, 179 bp, Triticum aestivum
  Clone ID: PAT_TA_71077
tttttttttttttttttttttattgccttatattcatctatacatactttctcgaataatatgtccgcgaggattacaccgtttgacacaaactattttacctcgctgggaagccacaaacaagtgttcccaacgctgaacacacgttcccagcaatataggctcaagggaatggaaat

SEQ ID NO: 71078 - DNA, 426 bp, Triticum aestivum
  Clone ID: PAT_TA_71078
ttttttttttttttttttttttcacgcaggcagtgaaatacccaaatccatgcgctcatcttcacaccattacatttattcaatcttagtgacagggcacaccgtccacacctttacatatgctcaatcttatttacatggcacacatttataacaagtagcacagacacacattcagtcgatcgacatacacagataaagaacatatctgtccacgcgtgcactgtgggcacaaacacacaataccaagccatatagcacacacaaaccacaccatcggagggcactcggtcaatgatgaatggatatgataggaagggcatctccggcatcaatcctgtctcttccagcatgatgggaatcttgcggccttgcccatttcttctatgtttcccatttcttggtagtggatttctggtttgttgt

SEQ ID NO: 71079 - DNA, 422 bp, Triticum aestivum
  Clone ID: PAT_TA_71079
tttttttttttttttttttttgaaaagaaaagcatgcatccaaactgcagtacacataatttagctacactcgtgaggttctcagcaatcacgcattgtcaggttatcagtacctagtagtcatacacaatctttagtttttcactccggcagctacattccttgaccagatccatcaacatattattatctccacggatgaggatgacttatgtgtgagtttctccttaatccgacgcctgcgagcttcatccacgtggggtctcctcgacgtcgggtcaatggcatcgcatttattgcatgggttttcaccatgcagctcgattctcttcaaccacacagttcgcttcatgactagccttatgtaatttgtcaccttgtcttcgtcctcgaacccggacatccggagcaacttcaagttc

SEQ ID NO: 71080 - DNA, 247 bp, Triticum aestivum
  Clone ID: PAT_TA_71080
ttttttttttttttttttaaacaaatgcaaaattgggtgtatcaatatcagtatcagtacataggtactcataaagttacaacaattgagtgtgcagcaaaccaagaattgagactgttgagcagctatggcgatgagaccttcttcttctccttctccttcttcttgatgaggatgaaaatggcgacccggttggtgcggaagtcggggtgccactgctcctgctccacgcacccgacctcgaact

SEQ ID NO: 71081 - DNA, 437 bp, Triticum aestivum
  Clone ID: PAT_TA_71081
gagtaaaaggaacaatacaagtacaaagtagtgacttccctgcttgccaccttttctgaactcccaatgaccacatatttcaaactaaaatttcttatcaagtaaaggaacttcatggcaaactagcaacaactcaatccaaaagggagaactgaagcaaacaaaagtagatgcaccttccttttcccaaccaggccaccacaaaatccaagcaaatgcacagccccaccttcacaaaaatgagacagaacaacttcaaaaacaggtccagtacacatggattagccaaattcggattttcaaaatgatgttatatccctggtactctctaacctgattacgttagtaaccccttcgtccaacagaagaacacagaggaaaaataagaagaggcggacaggttttcctgaccagcaatgaatgggtcagccatggct

SEQ ID NO: 71082 - DNA, 542 bp, Triticum aestivum
  Clone ID: PAT_TA_71082
gcccccctcgagcctctgaagattgggaaatgcttcttcctgaaaggtgagggacagtacaccacatgtgtatttgaaacacttgagccctaggaatgccctttttttgaagatgatactttctaacgttggttgccggacatagagtgagaaaacagtgagggcgggcaatcctgtcagtatatccatatcttccatcagcagctcactaacaacaactgtcagaatacagagtttgcggagttgcccaaggcactgcggaagcctggagaagatgcaaatggggggcaacaactcaagtctctgaagaaagaaaggaagagaggacacgctgctccacacatcatggtagattgctgttcctgaggcaccaggagccagagtgatagatttgagattcacaagtttcccaagagaagaggctagagctgccaggtttctcttcagatggtcatctgactcttctgtacagtaagtgaggttaagatcttgcaggttcaacagatcaccaaggctcagtacattgtcttcagagttactgc

SEQ ID NO: 71083 - DNA, 503 bp, Triticum aestivum
  Clone ID: PAT_TA_71083
aacaatgatcatgaataaagaagtgaatttcagtttttaccccctatcttgacatttgtgtcactaattaccctatttagccagatttcatccgttttaccccatttagcaaaaatttcccataatttaccctgtttaaaattttgtatccgttctgactggctggtcccaattatcaggtctagctggcatggcacatggacgatttttttctgtctatttttctccctattgaaccggtcctcctagcttctcccgacaggccaggcccgacatgatcgcaccgtcatcacagacacgccatcaactgagcacagcctgatgattattggaataaaccacgatgtccacgtccgactagggcaggaggcagtcctcacataggatacctataggcttcgtttggctagggttaggtgctatatacatgttactagtctatgttactacctctatagtggggagtaacatatgtgtggtaacatgaagcactttatttatta

SEQ ID NO: 71084 - DNA, 447 bp, Triticum aestivum
  Clone ID: PAT_TA_71084
ttttttttttttttttaggtggctgctaaaaaagatgtattggtactcgttgtgcttacattccacaatcaccattagaagctattacccccaaaactgcaaccatttgtgttagactactgggtctacctttcctcacccattgaagattaaatactcatagacatttcacaatcttgtgatcttggcaaaccgcaaaatgtactcaatgaaatacgaggtgtctactttttacaagcaggcactttggaaatcttatactggcaggaaggttgtgacaagcaaatagttcgactctactgagatagcctcatatgcaatgcctcagctagtcaaccaaatccataaaaaaactgatactttgcaggaagcaatttaatattctcttgatatttcctgctcctcgaaaagagagacaacatcagcgacgtagttgaagcttcaagt

SEQ ID NO: 71085 - DNA, 551 bp, Triticum aestivum
  Clone ID: PAT_TA_71085
attacgcttcgcgtttgcctgagtaaatcttccatggcatcggcgctggtaggctcggagcagacacgcggaacccaaaaaggaggctcctctctactggtggagaaggagcagacctcaagcttcctttggctgttggtgtcgtcccggtcgctggccgttgtacctcctacctgccatctgatgaagtgacatatccgtgttcctccccgccttgccactcaccgtccccacgagcctgacctgcacatcgcaaacccaatcaactgtactgagtgcttcctcactggaaactagcgttgtaagcatgcgtgtaagtagctagcagttggtcagatttcatggccaactgcaagcagtgatttgcggcaagaaagttaagcttctagtttaacaaccaatcaatcagcctttagtagtgcactagtgaaatggggcagtggcttagcacctatgcgaatgccgggggaggacgacgagacgaatcgtggcagcaagaatgaatccccatcatcacgggtggtgcaccttgctgcgcatccatcctcgcc

SEQ ID NO: 71086 - DNA, 479 bp, Triticum aestivum
  Clone ID: PAT_TA_71086
tttttttttttttttttttttaagataagcttggggatactcatggattttgcttgatatgatatatcaagtaacatgacgtaagagatgtgagcaagcgacaatcaagaccatcgagctaatcagagctgctaagctaacaagtgagagatgcaagtgttgtagctagagaaacaaaaaacttagaaagtaatccaagtgtgccacgatcacgacgtacatgaaaagatgatacattggcagctagacatgctatggcgagaagaagggtgtagagtgggaatcatccgcatccagttccagcgtcccaacatcatatgcactctgttcgaactttgagttgtaggttcatcattttccattattcattcataccccactttatcatctgggtcatcacaacttggataatctgcgggaggcggaggaagagtggtgtcggtcgttggtccattctccaccacgaatgccatcgccat

SEQ ID NO: 71087 - DNA, 428 bp, Triticum aestivum
  Clone ID: PAT_TA_71087
ttttttttttttttttttttttaacaccaatccaaccaccggaacagctacaacaaaataattatacagcaaaacatttcaccaacgtatggcactcgacaatacataacaccaaaaccaaaagcttgtgcaaaacattggcaattgcggcaccaagatagtacattcttctgaggcattagcaaggtcaactacgggcggtcagcgtgatcacagtatcttctatgcttctttttctctactcgtccgctgctgcttcagcagctgcgattgctgattccagtagagtatagtaccgttggcttacattcttggccacggatatcatatcaaaaatgacgcttggattcaaccctgcgcctcccctcttggttaacccacatatctggccatggctgttgactgaaacggaaaccgcagaactcatc

SEQ ID NO: 71088 - DNA, 375 bp, Triticum aestivum
  Clone ID: PAT_TA_71088
tttttttttttttttttagtgtggtcacatcccatccgtgtacatgatcgtacgtactggtatttatacagtaaggcgatgaacaccaaaacatttagctacagacagactagacggagacatggacgccatgctgatctatctaaattatgttgaaaccgaagtaccagaaggccggacgccggccctgcccgtcgacgcgcttgcagcggcaccagaaggcggtgccgccgcccttgccctgcgccacggcgacctcctcgtccacgtagaaccacaggaagaaggggtccttggtgctcggctccctgcccacgtcgccgccgccgccgagggggatctccagggagggcagcggcccgagcttgacgcgca

SEQ ID NO: 71089 - DNA, 384 bp, Triticum aestivum
  Clone ID: PAT_TA_71089
tttttttttttttttttttgattgcgaatggatcatcaaaatttgcacgggaacagttacacaacaaaatcaccagtaatccctacaggagcacgcgccatgcttgaaatggtgaaacctattcctatctctcataacaatctccctgtcgaagaccttagatatcatcttggtataatcatggcagtccttgcacactctcaagttcttcacgatcctgatcaccgtgccttctggcaacgtgataagaccgaaggcgagggcaagcttctcactgtgcaaggagatcgcaccttctttctcctcttcctcgatatcgaataatacctcttttgtgtttgcggtgtacccttgcaatctcagcttatggctcatacctgcaag

SEQ ID NO: 71090 - DNA, 423 bp, Triticum aestivum
  Clone ID: PAT_TA_71090
ttttttttttttttttttttttttgaggttaaaatggaatataatgtactgccagagtgccagtatacacaaagaaataaggcactgacaattcatggctgaaactgaagtgtcaattattactttattatacaaccactcactccaagatggggctttgcatagaggtgaaaccaacaccagaccaagaacccttccctctactttgtctaggataatatataaagcaaattgttagccaaagtcaaatagcaagctttaatacctaatcgtgcaaacacgtactgcaaagaagataagcatataggcaccggcggtgacacccatgcacatcacagaccctaaactgaagaaatcaagaacatccgccaactgatacgcgagcttatcaacatatagctcatgtacatctgatggaattgg

SEQ ID NO: 71091 - DNA, 256 bp, Triticum aestivum
  Clone ID: PAT_TA_71091
tttttttttttttttttttggcaaattcggtactggtccccattttggaagataaaaatcccatggccgatccagtaatcacatacatgaacagtgaatggtgagtttctatctgaaccatgaaacccattgactgcatgcaccatcgtcgagtccatttctccacggaagtgccagatcatgaaaccatgaagagaccaaaccagcaacaaatcatggcccagctaaatctttgcgcatgatgttgctatgtgct

SEQ ID NO: 71092 - DNA, 460 bp, Triticum aestivum
  unsure (1)..(460): unsure at all n locations
  Clone ID: PAT_TA_71092
taacaaaattatatatgtctacaatccccaaactcatctgtatgtctnacccctaaaaatccatggggtagaacatacaagctactaagcttcaattaaacatgataatccaagtgctcagcccattcttccaaggtccaaggtagtgcatctctatactaaggaaacacgtcgtaagccactccaagatcttgtttccttcctatgaatcaactccaacagcccattaacttccatcaatcactacataatccatttaattctacaaatccaatggttaaggtgttccacatgatctcctaaggttcctataatccccagatacttgaaagggctaattttgctatagtcagtccaccaatttccattatcatggtcaagtaaactccaaggtcaagcttatatagaaccctaaatcaactccgacaattaatccaatctcctagtttatcgtccaccg

SEQ ID NO: 71093 - DNA, 486 bp, Triticum aestivum
  Clone ID: PAT_TA_71093
tttttttttttttttttttatcaacaaatcaggcattgaacaaaggaatctagacaatagatcagacgactggaatgcacctaatcactaccaaccgatctgacaggaagcaaaccatcagttgtagctgatgcctagcggtgccctttagaaagcatgctgtgtggttagaaagctgattcttcaaggcgtggcaccatgtcttggatgttgcacattcagaatctcagatgcgtgtcaccgtgagcattgtaaagtaggaactgagtggcatgctttcgtatgtggctggtacccttccaaatcgacagtcagtttttcagcagcaagtaaattagtcttgctactactgattccacaccagtggcaaacaacgaccaatgaacggatcccactgttgccgaatgtgggatcagatgccaccagcgtccaccccgtccaccatttgcaactgccaatcaccgcctccctgtcaatccacgatct

SEQ ID NO: 71094 - DNA, 315 bp, Triticum aestivum
  Clone ID: PAT_TA_71094
ttttttacgcaattgaggcattccataggaattcaagaagctcgttcatttgttcaaagagggctacataggaaattttcctgtagggttctagtccttccggcattcccccaaaatccatcaccagagatgatcatggtattgcaatagcagttttacatccatttcctgcacattccccatctctgcatttcccctgctttctgcgtcaaatttctgttcactaaatacccgggtattctgtctaaaacattccatttggaaagcatgattttttccttgaatgaatgtgaccaccacctacccatcatttac

SEQ ID NO: 71095 - DNA, 568 bp, Triticum aestivum
  Clone ID: PAT_TA_71095
tttttttttttttttttaaaatcagaacctttgtataactgacaatggatcatcgtatataacaagatctagtaagtaatgcaagagcatacgcgtacataagagtcacaagactgattagaaggcatgacctacatggatagactgaggtctctgtagtgcaagaattagaaaaatgcaagcaacacaccaaagacaacgacggtggtccatgctctctgcaatcccttgtgggggcagtatgacgccggtagcttatctctgaaggtcaatccctcatagtgggactcagatcctgctgccccacagtatggaaacaaatccttaaaggaagaaagaggtttattctaacacgattactggccccaacttcctcaactttgcgcacaaattgttcgaaggagtaatatgggatcaagtaagagtgccagtttagcgtaaagcttgataagattgcaaaggtgttccaccttggatttctactcgtagatctgggcgtatttcgtgtagctagcaatttgaatgcgcgagattatgtggctgtgccagcgagcctgtcagtcaaaat

SEQ ID NO: 71096 - DNA, 327 bp, Triticum aestivum
  Clone ID: PAT_TA_71096
tttttttttttttttttttttttttggggaaaagtaattagttaaaaacattcatatatcgtagatgtcaaaaaaaaaaaaggaaggactaccctgtacttcaaatcctaaatccgccactgccttcatccattgggtaacatcccctatcataatctgcggatgttgtgcaaatttcccctaaattacaaaatcaaatgttgcaccgttgcatctatttcaaagcttttcaggcaatcggggtgacaaaatgaaacaaattcaggagacgccatgaacacacgagcccaaggaaaccaatctcactgcttccccttccttcctctc

SEQ ID NO: 71097 - DNA, 278 bp, Triticum aestivum
  Clone ID: PAT_TA_71097
tttttttttttttttttttaaaaaaattcgggaacagttgggttcaatctcaagaaaaggtatctgagggttcacataacatgagagaatactatactgcccatgcgttacattctgtcaaagatccatgactctgatgatactgcatggaccaacgcactgctaaagaacgcagaagattaataaggtgaaagaattttgctagggacataccacgttcctcgaactgatcaaatcctaaactacagagaaggttcgctgatccaatcacctgcagc

SEQ ID NO: 71098 - DNA, 274 bp, Triticum aestivum
  Clone ID: PAT_TA_71098
tttttttttttgaaaaaagtaaatatatattaaaatgtactgtaatttatattgatacattgggggggaatctaattacatggtggcgggccatgagggtttccattatctgcatcaggggtgctaaaaatcgccaatacaagagaaaacttaaaaaagaactattgcatgcttccatgcatgggaacaaaatcaataacatcaagtgatcaatctgctggtggtcttgtgcatcgaaggccggacgaggtgccactcatgctgctttgacatc

SEQ ID NO: 71099 - DNA, 479 bp, Triticum aestivum
  Clone ID: PAT_TA_71099
ttttttttttttttttttttttttttttttccctcacattccaatattacacagtaatctcttccccttcctagcatcttcttttgcccttccaatggtacaagtatcgaatctccatacgatgaatcccttccgcacccctgtcctcgcaaacaaaataatccttctcctcggcccaacgtgcagtagccatcacctcgccatggatccaccagttatcttcttgctaccatggcctgccgacgacattgatgtaatggttaatatttggtggattctgtcagttgcaagttggaatatcgccatgatttagtttatgtgtttttagtttggtaagatcgaggattttcaagattgaatagaaatctccctctgtctgtatacaagtttttctactgtgaaaacagagagttgggttccaaagtcagggaaataagataggcatatatcagtacaagtcttcctacagatccgcgctt

SEQ ID NO: 71100 - DNA, 493 bp, Triticum aestivum
  Clone ID: PAT_TA_71100
ttttttttttttttttttttttgacgtaacaaaatctgacattacatatgaccagaaaaaacactgaagctcaagtagatatacgcaaaatacttggcagccgattaaacagggtggctcaaactaaattggcactgcacattttcgtacggaccatctcagactgagatcggaataaagtcaaccaagatgatcttatgttcaataataccctaagaaccagtatgagtaccaaaaactcccttcagactaagaagaggcacagctagctgggattcttcagcctcttccgcttcatatgcttcctcggctcgtgctcaaccaatgatctcagtagtgctcctttcgagatcctaacatcattagcctccaccatctcatcgtagactcgcaagcaagcatgcttattcatcaggacatcatatttaccggcatcattcgccagtcttgctgcctcatctttagaaaccgcacaagaatcgccaacttcttc

SEQ ID NO: 71101 - DNA, 370 bp, Triticum aestivum
  Clone ID: PAT_TA_71101
ttttttttttttttttttttttttttttttcgggaggtaataattccaatggaacagttcatgctaaaaaaaaatatcttctagttacagggggcaaattatatgttcattctgttagacaaacaagcaccatccggaaaacttgggtgtatgccacaaacccttggagagctcatgcccaaaatcgtctaccaaagtgtgtggaaaatgatcctacttcaaataaatattcaatgctgcacgcacgcgatcgacgccgcataaaactgtgtgccaatggaagtgattcccggccatttctcttcgaggcacgatgagttctgtggtgtttcgcaatcatctagggtgtgtcttctaatgggaatttgtg

SEQ ID NO: 71102 - DNA, 418 bp, Triticum aestivum
  Clone ID: PAT_TA_71102
tttttttttttttttttaaaaataattagtagccaataatccctaagttattctgcttctgcagtctgaacattacactggcatatatacttactgaactacacttgcatagggacaggatgtgagtttcataaggcacaaaataagtacggtagtagccagtaacatactccctccggccggaaatacttgtcatcaaaataaataaaaagggatgtatctagatgtatattagttctaaatacatctctttttatccattttgatgacaagtatttgcggacggagggagtacaaggttatgctctaagctaagctgcttccacggtccaaaggcacccacaatttaaagtttttgtctgggaacacacacacacaagattatgccgaacttgaatttgccaatgactcgtccatg

SEQ ID NO: 71103 - DNA, 394 bp, Triticum aestivum
  unsure (1)..(394): unsure at all n locations
  Clone ID: PAT_TA_71103
tttttttttttttttttttttttaccggagctgaactaagctaaaacatcagtttaaccaacaatctcctacgagtacatacaacaaaatcccatcaacacggaatgttacaatggtttctccaaatctaatcctacaaccaatccctctttcttttcacccgaacgcatcgcaccgatcaatcagtgttccgccgacctccatctatcgcagcagatggagcgcgagcagcaccaatggcgcggcgactagccgcccggaggctgccggcggtggtgtcnctgccgcgccagtcacgtcgccggtggccatgttggcgagccaggcgtcgctgctggcgcccccgaggatcacgccctgcccctggatgccgccgccaccgccaccgccagtg

SEQ ID NO: 71104 - DNA, 491 bp, Triticum aestivum
  Clone ID: PAT_TA_71104
tttttttttttttcacttaatcaatttttaatttacatacaacgatcgtgttgactgctagataattaaataaaatttgaaaaacagcatgtccccagacattcacgaattatgtttaggtgataaatttgcaaatcacactcttacgtagtcatacaatgtattttacacatactaacttcgaacaacgaaaacttaaaagcaaacacccagtagtaataatgtaaaactttgagtgtttgtcatctttttagatcttaatatttctcgagattactccttcttagcgttcttctgtaactttttgtaagaatttttgaagaaattatagaataggatgaagaaaattgagctttgtgcaatagctaataatatacaaccacgaggtctgaaattaggatatttgaagccgattatgatggcctgtactatatacaaggtgaattgaatgatttgcatttgcgtgattgccttcttgtagaattgaggaa

SEQ ID NO: 71105 - DNA, 516 bp, Triticum aestivum
  unsure (1)..(516): unsure at all n locations
  Clone ID: PAT_TA_71105
tttttttttttttttttttttggaatcacaatgtttaaagatggtaattccaaaaagagtaagaattctccttngagaccagaaacatatgttggaaaataagaactacacagattttccatggtcaaccattgagaagtttaacgcatgacaaaactgcagtgcatctagtcagcttgcttctttgtagttctataacagtaccttgctctgaagtggatttgagtttcactcgctccctcccgaggagaggcgctcctcacgcacaagaccagtgtcctcgcactgctgcacccgtgatgcacccttccttctttcccgtccttcttctcctacctctcctcctccctggatcctcctctgtctctcttttctaccagaaaaatcgaagccccgccatgaccttggagctctccctgccagccacagaggcccgcctccaccttcgcgccgccgcgccggatccctccttctcccgtgcccgctggatcccgccgtcgccgttctgcatcgagc

SEQ ID NO: 71106 - DNA, 431 bp, Triticum aestivum
  unsure (1)..(431): unsure at all n locations
  Clone ID: PAT_TA_71106
ttttttttttttttttttaaggaaataattaacaactttattattgcctctagggcatatttccttcactgagaatatataggcggaagaaataggtcggtagagtcatgaggggcccagaagggtggggggcgcgccctaccccctggngagcgcctcccgaccttgtggccgcctcatgactttctcgacgtgcactccaagccctctggatgtcttttggtccaagaaaaatcattgtgaaaatttcattccatttggactccgtttggtattccttttctgcgaaactctaaaacaatgaaaaaacaagaactggcactaggctctaggttaataggttactcccaaaaataatataaaacaacatattaatgcatataaaacatccaaaacagataatataataacatgaaacaataaaaaaaatt

SEQ ID NO: 71107 - DNA, 432 bp, Triticum aestivum
  Clone ID: PAT_TA_71107
ttttttttttttctttttttttttacggcagctcaaaaccaacaattactccaattgtatcatcctcctgggtacatatacatattgtaggccaaaattgttaaatatactccctctgtaaagaaatatatctttcagatcactatagttgggaaacgcaaatggtacaagtctaagcaaccaacggtaacgtacagtgaaaatcacaatcaagacatgcagaattacagtctgaatccagatactagttctttccaaaaaggagagggttgtccagtggatggacttcggtaatcatagtaatcaggctcataatttctccacgagctgcgccctcaaagtattgcatcttttctctgcattcaacagcttctaaatgtccacccaattaaatgcataacacggttctccttccgttccggccctaggttg

SEQ ID NO: 71108 - DNA, 481 bp, Triticum aestivum
  Clone ID: PAT_TA_71108
ttttttttttttttttttttttcccaggagaatcttacccagaatagtttcctctcacacattaatgcaaacacactaggggaacaaagagctagcgatatatcttaaaaatttataggaagccaagtttccatagctacagagattcatggtaagagacacaacaaattcttcgcctccaaatcttactggtatactagcgccggatggacgagttcgcaccagcgcttcttcttctgcaaccacaccaccacccgcccgcggccgcttcaaactccattttctgcttcttcaaaaggacaaactctgtcgaacggacactgtgtgaggtgatggagtgcttgcacgggaggcgatagatggactgctcgcgcgtgaggtgacgaacttctcgtggtggagagggaagagttgttcggtcggtcgttgaccaagcactgacgggcagcagcggcttcgtgctcggatggagacgatattg

SEQ ID NO: 71109 - DNA, 465 bp, Triticum aestivum
  Clone ID: PAT_TA_71109
ttttttttttttttttttttttttggatcccaaactggggtttctattacttggaggaagggaagataaggtagcacgccaccggcgggctagggttaacacccatatacaataatcatgatcccaaaatgaagggaaacaagtagctatatagccattacagaggagtagttcagctaaaagaaaaacagagcacgtggagctcctggaaagtaaacagcgacaggctggactctggtagccgctagatcgacgatcgacgatcgacggttgatagcagtgattcttcagatagcagtgtatagcctgacaattccccccaattgagacaaagcttgtcctcaagcttggaatgatgggaaaaccttctgaatggaagccgagtcctcccaagtggcagcttcaaggggcaggttaacccatttgactagccaccgcaccacctggatactgatgttaccttga

SEQ ID NO: 71110 - DNA, 409 bp, Triticum aestivum
  Clone ID: PAT_TA_71110
ttttttttttttacccacaacccacagtatattggtagtgaaaattcaaaggggtctcgccccagccccaacttgttaaaacagccaagggacagccgaccagtataagttcaaacagctctcggctacaaccagacagtagctgcaggagaatacttattacacaaggcacagccgaccaatatcagttcaaacagctctcggctacaaccagacagtagctgcagcagaatacttattacagataatgcgcataacagcgttttttcaaccagctaagaaaacaagatcagcgtcaagacattcggggagccatgtagcttgggtgccgacgcaaagcaccttccaggaacaaatcagggatcctaccaaacacaagctgcctgcactgcgtgcttcgccatctcca

SEQ ID NO: 71111 - DNA, 480 bp, Triticum aestivum
  unsure (1)..(480): unsure at all n locations
  Clone ID: PAT_TA_71111
tttttttttttttttttgtctctagtctgacatgatgaacactacatgcaagaaatggcaaagaatgtcagacactcgccnggattattcgtctaagttatatacagaactgaggactcaagcggccttgctcagtttttctgctagccgtgaagctgtgtttatttagagaagaattccagatctccctctcggggggctcggcgatgaggtgcacaccgaaggccccctcctcatcgaccaatgctctgagctgccgcaccgcactgctggagccgatgtaattctttttcaccgctaggtacatcactccatatgaaggcactgaaagggcaagaacagcagagtgaattaaggtcatggttaagcaggttcagtttcaaggtagatagcgaatccgcataatgccccccaggaaagtactcactgcctttattaggcatctcatcgcaagaaagtatcttcccaacaaaatgacac

SEQ ID NO: 71112 - DNA, 492 bp, Triticum aestivum
  Clone ID: PAT_TA_71112
tttttttttttttttttttacaccaaaaaacaaatgaaatggaagatgcagaaaacactgctagattcggaaggctttacagcaaatcataatcactatcactgcacactgatgaagccaagtgaaaacagctgtggatggaaaaagagcaactattacaagagaaatgctgaggcggcatttctgtcgataccaaagcttatattacactggtgctaactgtaatacactatttattctgtctgtgttcgataaaacaaggagtgtactacacaaggcgagagaaccagaatcacctccgctgcttggatgatcctctcgacttgctggccgcgcccctcgggggcttcttcttggccttgggcgcctcgcacttggggcacagccagtcgtcgtctgggacgcggtccaggggagggtcgcagcagtcgatgtgcatgccggccccgcaggcaaccgtgccgtcctcgctaccgcagatcagcatcacct

SEQ ID NO: 71113 - DNA, 508 bp, Triticum aestivum
  Clone ID: PAT_TA_71113
ttttttttttttttttttagatcaatcaccaggaatcgatacacagagaaatttgacaaaagtgaagcaaaaaagaacagaaaacaggacgctgcagctgctcctagcagtatgtacattcactaatgtgcagagtgaaatgggacgatcaagaacacatcctggggagtgatctcgccgccgcggcgcctcctcctcgccgggaggccttcatcttggtcatctgcgtcttcatccggctgcacaccttctccagctccatcacccgccagtgcatgctgtccaggagcgacttgaggttctggttctccagcgtcagctccagcctgctcgcgtacaggaccacctgcccgttgctgtcgccgtccgcgtcgtcgtagctctcgcggtgggcggccggaggaggcgggggcgaggccggcttcagcgggccggagtggcggatgatgcccttgagcaccgtgtgctgggacgccagcgcctgcaccgccgccctcgtcgggaaccc

SEQ ID NO: 71114 - DNA, 471 bp, Triticum aestivum
  Clone ID: PAT_TA_71114
ttttttttttttttttttttttttaaagtcatttttttcacttatctgacttataagttggtgatttatttggaaccaaacagaccctaacaaacagatatacagtataaaattgacattctcaaactagcccgtgcgacacaagattgaaggagtttggattagtgatcaggcggcgatgatggagtatgactccacaatgaagagcggcctctgccggagctgttggcaccgccgcacgctctgcaccagctcctccctgtcccccacccgcgacgtgaacagcagcggcgcgctctcctcctggcccttctggtcagcctcttcctcgtcctcctcgtcggactgcatgcccgtggacgcggccgccaccgtggccgccagcgtcgtcgtggacgacggcacccggcgcagccctggcgtcacggtcggagcggctaattcgtcctcggtagttctgcagcagcgtga

SEQ ID NO: 71115 - DNA, 509 bp, Triticum aestivum
  Clone ID: PAT_TA_71115
ttttttttttttttttttaaagccttctcatggcaaatttattcatttcttctcatcagtacgcgagacattattttgaggtatacgagcagcgcgagagcgcatcacaccaccctggtatatagccccgaattcaaaaaacacgcatgcatgtcagcggtaagcaccgctgagatctgacaccagacgtatcgatgtctcaaaggataccatgcgacgtttttggagcaaaacttactttactttacatgatagccaccaaatggtgacatctgcttgagccattacgtggcgaagcactgccgcgtgacaagtgcatgtgtatgcttctccccgagcacggagaacccgtggcgccaaggcgcggttttatccagccccactcagctttctgaacttgagagggagcaagctgttggagtctgcatttctcttcttcacaaaattgccaggctcaacagcaacctgagagatcgacgaagtcgtggtgcttctctggaacctcccat

SEQ ID NO: 71116 - DNA, 363 bp, Triticum aestivum
  unsure (1)..(363): unsure at all n locations
  Clone ID: PAT_TA_71116
tttttttttttttttttaaggaaaatggaaacttttactggttttagatacacaatttacaatttgccattgattccangaagaaaccaggagatggttttagatacacaaattgtgctattacgccctatcatacatggtactagggatttgccaagaaacaggtttgtaactgatgccagcancagtancagatgcgttcttgctctgttcatctattctgtccgtccatcgaatgtgcatgcaagattgttcagtcatttcttccactggggcancctttggacgacaaccttgccggagttctccttgttcccgacgatcgtctggcaggtgagcctccacgactccggtttcttcttc

SEQ ID NO: 71117 - DNA, 312 bp, Triticum aestivum
  Clone ID: PAT_TA_71117
ttttttttttttttgggagagccaacacagctttcaaaataatactgctacatattgaactcatgctcaccagcatttcgttacatcaaacgaaacctagatccaaaagtaagtaaacactactatgtacatagaaagtgttcccgacaaaagatatatagatataaatatatatacatagaaaaataacacgaaagagaggagatcttaagtgtttaggttagtcaccgacctagatcgtgctgcttcataaactgaccatgccaccaccccgccgaacatcaaagacggagaaaacaactgtcaaatctg

SEQ ID NO: 71118 - DNA, 448 bp, Triticum aestivum
  unsure (1)..(448): unsure at all n locations
  Clone ID: PAT_TA_71118
ttttttttttttttttttttaaaattcagaatttcagtactgaattagcaagcgcgaaacaaagctgaaatgaacaatttcacantagagagtgccaaagtggattgtgaaaatggggaatcatagatgcctggtaatctggtttcggtacatcaagataactaattattacattgccaaatgaccaagctcgtactagtggaactgtcacgcatacatgatggcaaacacatgccagtacaggttcgataccgatgtccgtcggcagttcttcatgcagagatggagaacccctgctaggttgaggatgccgatgaggaggatccaaattaggggggctcggctgttcctagcttcactcggtgcggggatgaacagcctgggctacttcgcacgaaggacctcgaggcagacagattgaaaatataggaaacttttcagagagaaa

SEQ ID NO: 71119 - DNA, 328 bp, Triticum aestivum
  unsure (1)..(328): unsure at all n locations
  Clone ID: PAT_TA_71119
gagcaaatctgaagttgataagattcagttaaccacatctaaaccacatcaaatcttcccgccatttcatcatttctccttcctctagtttagccccccctctcctacgacgggtttccgcacggcgggagctaagccgcagcgtcgctcccgcctncctcggtccttgacaaaaacaccggacgggggagggcccgggaacgcgcgccgtcggagaggcagaaccggagattaccgagaagatcaatggaagagaccacacgtacatcttgacacaccctttcttcgttcgctgagtccgtgggcctgctgtttgatttctcgcgcg

SEQ ID NO: 71120 - DNA, 513 bp, Triticum aestivum
  Clone ID: PAT_TA_71120
tttttttttttttttttttttttttttttggtagcaaatatataggtccaggtttcacttaataacagaattagtgaacatgtccagtaacacatagttacatagtgccacattcaaccagagcacttctagttttacaaaatataagcacgacgttaggtaattgctccatattgttctgaagcaaggaagcacacgggccatcgaggtaagcacatactaggaacttagatagttacgacagagatgcacaagagtcaaatctggcaatgaatcttcctggtctcaaatctggcgatgaatcttcctggtctcaattgttgctgataaggagaggcacttcacggtgcttaccaaccatcaagagcatacgaaggggcatacgacctttatcaaattagaaggtaactagaataatgtactgattgatggtgacccttctcggacgctacttgctctgaagattggagttcctttcttcagcgtcgatggacggcgaagctaggcgccgga

SEQ ID NO: 71121 - DNA, 584 bp, Triticum aestivum
  unsure (1)..(584): unsure at all n locations
  Clone ID: PAT_TA_71121
ttttttttttttttttttttttcccggccggcgcatgaatgccccaatctttttttcttgtattcacaggctacatcacgactcactgttacaactgaggagtacaatggcttctataggctgggaacacacacccactagagcacgtactccatccttgccctacccatgccacgatgccaactaactccgactcagtctccctatacacacgtacgtagctcacctgcatgcactaacagcctcaacgtacagccggctttgtagctagccaagacgtagcacccacggactctccctggtgatccgatcatccgatcgtgagcccgggtttctcgtccgcacgacctcaacgtcatgttgcttcgctgtgcctgctgcatactacgtcgccatccgactacaagccacgagcacacacactacacatctcccgcatgtcccgcgcgcactcgacgcacccgacgagcccgaccgcaccaccagtgcgtcncgcacgtcccgcgcgcacccgccgcgtccgacgaggccgactgcaccagatgccatggcttattccaacacactccccctaagccacaacg

SEQ ID NO: 71122 - DNA, 601 bp, Triticum aestivum
  unsure (1)..(601): unsure at all n locations
  Clone ID: PAT_TA_71122
ttttttttttttttttttttatagacaaattttcttaatattaattcatagcggaaacctaggaatatcaaagcaatggttgaattacctttngagtctttaacatccaattacaatgtggtgcctgtgtaggcgaggtgaagccctggaatatatgacagtctagccactttgacagtggggaaaactatagaccgagcctcctcttggcacacatcttcccatgggagctgacttatacgtccctatccatcgctctgtgctctactgatgcaagcacacaagctagctagcaatggccgttttctgatgcacgctgaagttggataacctcccacgattattctgcactttggcgctgtttttgcctttcttccaagtttgctcttccccttctttgcaatttaatcagccagcacctcgtataagcataaaatattccagtgcaataagcatgaagtgtgaaatagatgagaagcctgaaaaacaatcatgtttagtcaagcagtcacatcagaatgctttgaatttaaataagaaattatctagctatcccagtcggagacaagattgattagtttcgaatagctagctggtgaaa

SEQ ID NO: 71123 - DNA, 583 bp, Triticum aestivum
  Clone ID: PAT_TA_71123
ttttttttttttttttttttttttttttttttgccctcacagcctcttcattctcattcaattgttgaacataaataggcagtacaaatgacttcacacccagccactaactcacgcacgcacacactaggctgaccgacgcattcggccactatcctacacacgtcggcataacaccatctcctcctagaatctctccaggatatgcatcacctgctaactaacctacactcggtcatgcacaaacagactcaacgcatgcatggctacatgaccgaccttttagctagcccactaaccaacccatacatgcagctaacgacgactccattcatgcaaactaactcaccgtccagccggccagtcctgcttcagtcatctacgtgtgtgccgtatcacacgaccttgccgcctcgcgcggcaccgcggtgtcacgccgccatcggcatctcgccggactcgcggtatctcacggccgtctggcatctcgccttctccacacatcttcattgaagctccgctgaagcatcagcagactagctactctctaacctatgcaacatgcatgctggtacatcatgac

SEQ ID NO: 71124 - DNA, 348 bp, Triticum aestivum
  Clone ID: PAT_TA_71124
ttttttttttttttttttgaaaacaggcaagcatacgtggttttcataatatatctctgggataactcagctgcattggtattaatatacacttgcagtttgcactgtagtctcggacagacgacaatggttcacaaaattaaaggcaatctcagactctactagctaacaaaaagtacaactaattaacatcagacctgttgaagtatcatccggtattaactactcaaaatctttagggctaaaaaggaagcaaagcttatttctctatggtgacggagacgttgccgctggtaacggcgtttttggtgaggacggtgggcagctcgacattcttgcccttcttgg

SEQ ID NO: 71125 - DNA, 312 bp, Triticum aestivum
  Clone ID: PAT_TA_71125
ttttttttttttgtaaagcaacaaacaaaacaggttcgaccgttggctggtttcacatttgtccaccataaatatggatatcagaataagcaatgaggcattgaactgacaaaatacttacatgttagcactagaccgctaatacgggaacaaataataagtagggttcacgtcctaaaagaaggaattagattgatcatcgttctccttgtccatgcttcttctagtgcctcgacccttcaaagttaaaccgttcaacctctttgaggtaacaaaaacctcggagccagcggtgctttgaacatctattga

SEQ ID NO: 71126 - DNA, 717 bp, Triticum aestivum
  Clone ID: PAT_TA_71126
ttttttttttttttttttgttgtacagacagtcaggtataaaacattagaaaaacggtgttctgatgtacagtttactacagtgaaaagtaataatactattctctagaaggactgccgcaggtacgtattctgctacgaacttggttctactttgcaatacaatcatactgaaggaactcaacaacacaagatgtgttaacttgaacaagattcagcattaaagaatgtcctgcagctgtttcaggctggggtccaactctgcgccattaccctcttcataataaccatctgaaggggtcctgtatgcatcagcaattgcctttcctttatccataacggctgatggcacggtttgcaggaggttgtctagtgctccaagggctacagcgattttgctcctcatgacttcaacagatgctgacgagtcttttcgtgaagcctttagtagcagcgagtcgagatcttccaacgctcgtaagcattcatccactgcatcagaggcagttttgccttggccattactggaagcatattgtgccactgcccgaatattgatgcgtagagaatgatgctggaccagaacgaagcaatgatctactctcatcaaaccttggcttctcgaattccaaggatttctctagatccctgaactggtcttgggttcagcagcacagccgggacgtacgtctccaatggctccagcttcttcttcttg

SEQ ID NO: 71127 - DNA, 583 bp, Triticum aestivum
  Clone ID: PAT_TA_71127
ttttttttttttttttttaagggaagtgggtctcattttattaagtggaccaaaaccattcacattatttgttctgcaaatgcaaagagaaaaattgtaacagtactgtccacacattacataactgaaacaagaagaaaaagacacaggtaggctctcttttcatcttgatcagtggaaatgcaaagactcagttcgcatatatccttgtcgcaaagaaggtttcatggctgttcttctgaagagattcatggcctgtcatagacataatccttcacgtagcggcttgttgtggtgacttccaaacttgggtcgaatgttcactgttgttatgtgattccaaaagttgcttctctaacagagacctcagcttcagacatagaaactcaagatatgatgcatttggctccagtgcaaattgcccggtgaggccgacgcccatgccctcctccatgcgctgttcgtcgtgaaagcagacgctgcacgcgccgccgtcgaccaccaccatggcctgccggtgatacgggcacagccgttccgcctcccggaaagccgcgtgatgcaggccccgcagtccggcgag

SEQ ID NO: 71128 - DNA, 500 bp, Triticum aestivum
  unsure (1)..(500): unsure at all n locations
  Clone ID: PAT_TA_71128
tttttttttttttttttttatttttttttttttccgcattccttcgtttaactgaaaagacttccatgagcttgtcatagaaacacgtccatttatagaaatcgtcgattgtttgtatcactgactcaagcggaggcagcggtcagctgggtctggacgcaggagaccacgttcttgctgagcttgacagccttgagggcgttggtggcggtcaccttggcggcgcacgcgctgacctgctgctggagggtgctgacgaaagtcacggactgggtggtgtanctgacggtgtccttgacgaggacgacggccttgtaggcggcgggcagggtgtcggtggcgtggcaaagagccttcatggcgccggacttggcggagcacttcctgtaggcggcgactccggcggtggtgacgtcggcggcgcgcttgggcaccttgatgatgttgttgaggagcttggcgccctcggagatcttcttggtaacgcagccggtggtgtc

SEQ ID NO: 71129 - DNA, 534 bp, Triticum aestivum
  unsure (1)..(534): unsure at all n locations
  Clone ID: PAT_TA_71129
tttttttttttttttttttcggacgagatactactctgcataagggaatnctcttccaagcacacgaagcaaagatctgagttcgtaagagtacatgctccagctacatggcagtcagaactgctataagatactagaagaaatactttgcactactgctcttacttgatgccacccatgtcattcccgacgttgcatgagcttccttgtatctttcttcttcaagttgcattttagaggaaatgcagtcaactactgctcttccttgatgccgccctggtcactcttggcgtaggtgccatccatgagcttcctggtatatttcttctccacattgcatttcttgcaggatcatacttgagcgttgggaatgtgggaggccagatcatcataaaaggatggatattaaaacccaaatggccgttttttgcttcatacaccttacgcagtgtcctgcacttgatgtccaactggagtgcgcatcacccatcttcaaaaacacaaagtcaccatagtccaccacctggttcagtg

SEQ ID NO: 71130 - DNA, 574 bp, Triticum aestivum
  Clone ID: PAT_TA_71130
ttttttttttttttttttgggcaaaagaacgatagtcaccagttaaaagtggtacaatcaagagtcaagctagattttcacactcaaaacaaaaaaataaaaagagtcaagctagatgctactacatgagtacatgtccagactgtctgcacacgagaacacatgacatttcaacagctcacacttgacacctccatccagggtatatatggtccattatcttttccgtcgaacttttctttttctttgaccttttatttgtccaagtcattctgcacaagcacacaactctagagagaagaaacacaacggctcgctgacgagcttcccggagaaaacaagggagcaacagacctccaaaatggccatgctgatgcggcgccatcatttcatttcctcctggaaaactaagaggagagcaaaccatcagaacatccatttcggagaagattggacgatgatccgacggggctttgggggctgttgcagctccatggagttcctcttcttcatggccgaggagaccgtcgggctcaagtagtcatgactcctctgcggcagggacgtgctctgc

SEQ ID NO: 71131 - DNA, 440 bp, Triticum aestivum
  Clone ID: PAT_TA_71131
ccacacaatctagtgtttcaacagcggtcaagcaaccaccaaacacaccatctagtgactgtctcgacagttgtcgagcaaccaccaaacataacacaccatctagtgtttcaacagtggtcgagcaaccgccaaacagtacacacacaatcatgtgtttcaacagcggtcgagcaatcaccaaacactacccacacaatctacggcacaacaataacgaagagggaccaagcaactgtgacttcaaccttgcaggaaccgaggtcgcatacgccgtggctcgtgccggagcacgccggcttgaacacggcagtggcccgcatgagaaaatcggagagagaggcgtccacagcaaccaacaatttctctcccaagtccacagaaacaacccgcctcgagagctcaaacgagccatccggatcaatgggcggttctctgtc

SEQ ID NO: 71132 - DNA, 532 bp, Triticum aestivum
  Clone ID: PAT_TA_71132
ttttttttttttttttttctaccacctagtaggtatgaatccatacggtgatttctacttccatgacgtctacaagtttgacctcgaggacgggacagaagagatggtcgctgaagccataagttggtcagaccccatcacacggagggatgctgaccctcctttcacagccgttcagctcctctccagctacaccatcaacgtccggggttctgaacttgtgattccggaaacgtgtcgagtagatattgatcagttggtggaggagttcttctcaactgaggataaggaattcttcgcaatgtttcctctgcagttaggttaatttccctgcgtccgtgtgttcttccctaactcccacttagcaatgaaatatgttggttcaaatctgcttccacttcttgatttggcattgcaattcaatcactcagcataatattaagatgacagtgtccttgacaatggcttcgtgcccaccaacgacgactcttaatcagctgaaatgccctatctttttgcactccattttgtg

SEQ ID NO: 71133 - DNA, 377 bp, Triticum aestivum
  Clone ID: PAT_TA_71133
ttttttttttttttttattttttttttttttttttttttccccgcaaaaaaaccacatgtatagtacatagtttggaaaaaaattactcaacaatatctgtgtgaagcaaaagcgtaaaaccaaaatttagattaataataaactatgaaacattctcattcaccacaaaacactatatagctgaaactggtgttcacttcctcgacgacgtaccttgcgcacatcacctccccttcctgctcgaaaaagcacatcctacaagattagcatgttttatttgaagactacagaaaatttctctgtaccagccaagtgcttcttagtggccatctcagattggttcataggacagaaacagaagcaagggtgcaattgg

SEQ ID NO: 71134 - DNA, 449 bp, Triticum aestivum
  Clone ID: PAT_TA_71134
tttttttttttttttttttttttttaataaggtgcatcagtatcaaccaccttatagatcacaggcatgggtagccagaaatagtcaaactaaaggacgaaaaaattagaagctgacaagagagaaagaattccatattcacaagtcaagaaagagcgagagtgacggattatttgctactattacaggttccacaagagcgcaccgaacccggacgcggcgatgccatcgggctgcccccagaactggtacggctccagaccgagcgcgggcacggccagctcgtcgtgcgagccaatgcccgcgtgctcccccagccacgctggttcgtaccacggctcggtgacggggtcttcccagaacgtgcccccgaacgcgacctcaacggcggccgcgatgtcctcgtcgatggatggcagctcgatgatttcctcaagctcgtcgtcgac

SEQ ID NO: 71135 - DNA, 356 bp, Triticum aestivum
  Clone ID: PAT_TA_71135
ttttttttttttttttttagaccaccaaatttggagcttagtctcagcctcattttacgatccgtgtcccagctcctcggcggtacaaaagattaggttaactacaaactaagcatctacacacaagttctttcttactgcatggctgcctgaacctctgactgtacatcagtacatgcatgtacctactactactagtacaacaaaacagtaccgctactgctactgctccaggccgatccggccggcgtggccgccggagcgcgcgcgcctgtgagtcctggacccagcctcgcgctcgtaccgagtacatgggtcgagtacttggcatgccaggcgcgtgcccgcgtaacccg

SEQ ID NO: 71136 - DNA, 438 bp, Triticum aestivum
  Clone ID: PAT_TA_71136
tttttttttttttttttttatcggttcatacacaacaacttcagctcaaggcaactagtttacagtcaagacgatcaagcatgggaaattcatccacaggtaacacactaggaaagtcatcgattattctactagtacataagttcagcacaaatcctaagattattgggcataagcagcctagtgcatgaggtacgtcagtgccctgtaacactgcaattcttgcaagtgataggcttgcgaggttacttaggaacatcacccctctctgggcaggtggtcctcttttacatactgcagaaccttgtcctcttgctcagaccttcatatggtgctttctctctgctcgagcttggtctcccaacgccatgtttttttggttggagctgacagtccagcgagcgcatcccaattgccagacatggtcatgttgttctc

SEQ ID NO: 71137 - DNA, 468 bp, Triticum aestivum
  Clone ID: PAT_TA_71137
tttttttttttttttgaacaaggatttcgctcattagtctcgaattcacaaggatgcattagtaacaaccagatccatagttgataagagtgcagctacacacaaccaacaaatagtctcactgatgccaagcaaactttgaatataaatcgtctaaactatcaacgtacacgtcgctgtctggaaacaaaccaaacggtacagggtaccaagttggtataaaataacgatgtcttggttcaggccaaccgtcattcgcgcgttcttcatcgaaacgtctcacgacttcctgaattttttccctcggtaggtacggagtttcttcatcatggaagaaattcataccaacaaaattcccttgagcatcaataagaggccctccaattccggccttggtgattttacaagtggaaatcctaagctcttcacaagcaagtttgccttttctgtcaattaacacccctcttg

SEQ ID NO: 71138 - DNA, 404 bp, Triticum aestivum
  Clone ID: PAT_TA_71138
tttttttttttttttttttttttttttttttttttttttaaagaacacaagaacaaaagcatagacacaccgatacacgtacacagacgcatcttactgcataatctaactcagctgcaatcttactgcatctcatcagtgatcacacagactgacagacgcataatctacgcatgagaaaatgcacacgaagcatgaagtggagttactggatccggctacagctagcgggtgaaggcgtagaagactatgccaatgtagatcagcatggcggaaggcacgagcgtgacgagcgggatgacggcgccccatgcagcggagccgccggcgccgcagccgagccggccgagcttcacctgcaccacgttgacgagggccatcgtcaggaacccgcacccgcacac

SEQ ID NO: 71139 - DNA, 460 bp, Triticum aestivum
  Clone ID: PAT_TA_71139
ttttttttttttttttttagtggagaaatatcttccctttaatattacatagagatagagagtagagataagtgttttgaactaaggttgaggagtagcagattgattcgcacgtgctacaatgcggctgcagcttgttttgccatattgttcagataatccatgtttattcccataaactggtccatcgattgttagaccagtacatagcagcaaatatatttatttctcccaagttcatagtgcaagtccatgaactgtcaatatgctagctaggcgaagagtgtcccagccatgacagtgacggcttctccctgaatccgcactcgccgattcgcaatatccagctccaggtatagtgtcccgctcctttgagatacctgaaacgctatcagtttttgcttccccagctttccaccccagtagggtgccaaaacacggtgtgcactgccacatacag

SEQ ID NO: 71140 - DNA, 469 bp, Triticum aestivum
  Clone ID: PAT_TA_71140
tttttttttttttttttttttttttttttttacaccacaagcatagtactccctccgtttttactctagtgtagtgccaaaaaacgtcttacattatgggacggagggagtagtttcgaccgcaatcttaggtgccaactaccaggccatgtacacacacagcgcacacatcacactgcactgaacccaggcactacctgtctaagagttccattatcatacattgcttaggcgtagctccccaaccttgtggcacttgttatgcctatatggccttccacaccacagttcttgcatcgagcaggtctccttactggttttggaacatcgccccggtctgggcatgttgtcctcttgtggccttgcagcgagaaatccaacatcgtaggtgtggacgccgtcttcacctctctcggacgcaatagtaggacgcctctggggcacgctgctgccgtccgctcccatcgtg

SEQ ID NO: 71141 - DNA, 729 bp, Triticum aestivum
  Clone ID: PAT_TA_71141
ttttttttttttttttttttttataggtactgaatattatcgaaatcagattgacttgattcgacaaggtgcagttgattgacaaccatatgatgatcttctagagcagatgccttttgaagttcatcaagattctaattggtggtttgctagagtaccactcataccttcatctgttgtcgtctccgttagtatagatatgtcactaaaggctctcagaccattctatccacatatatacatgaacggaaatgcattaacatgatccgcaactcttggttttgaatcttcgtctgaactctggctcggtgcggcaatagaatcatgctcatcgtcatcatcatgtcccatcaagtcctcctctggatctgtatcctcctagtcaaatgattcattaacagtacttgttggcaaatcatttgtcatattaccctgagtggaagatggagctagcattttccctttgtgattgcctttcaattattggtatgctgcttccaccgctgacttggctcaacatgtcttgatttggcgtgaaattaacatataactctatcacttgccacgttgtccgggacttggtcttctcaaaaatcatgttccaccctctttcctcatatagtggaattaattgaaaataatgtggtccgggagatccaatatcataacgagcttggatattgaggttgttttgagcaccgacattaacatgcccaagcccttgacatg

SEQ ID NO: 71142 - DNA, 489 bp, Triticum aestivum
  Clone ID: PAT_TA_71142
ttttttttttttttttaaaagaataaattcaaaagaaattttgcacagatctccacagaagatatcagacttttagcaatcccggttcatacaatattaatgaacttggataatctatgataaaaagcaataacagaagttcagttttgcggcgccgagtactgttactgatttcactgaagaaatacgttggtactccagttacagtattaagtgaacagatacatgttcactgcaacttgttcgcaacatagaggaggtggccgatgttcgtcggagggtagctctgcagaagcttgaggttggagctgaaatcgccggcaatgagccgtttccggaccaggatcagcattgcgcagcatattctcagcaaggtttcctgaggaccatctgggtcacttaacagagtgtcccatatatgaataatatcggcaaagttgaattcctgggttaacagcagcgttatcacctgaacgcgtagaattgggg

SEQ ID NO: 71143 - DNA, 185 bp, Triticum aestivum
  Clone ID: PAT_TA_71143
ttttttttttttagacacaaattaaaataatacaagctttattttacaagccatgggccttgagggctcgaatacataagctcgaaaacacaaaagtcagcgaaagcaacaatttccaagtacagacgtgagtcaaacaagtttgccttaagaagggtagcacaaaggcatttgcgatcgaaaag

SEQ ID NO: 71144 - DNA, 517 bp, Triticum aestivum
  Clone ID: PAT_TA_71144
ttttttttttttttttttaaattagacagatatctttttgaatatcccagcacacacaaaataagattacacacgccagacaacataacacagatttaaattagacagatatctttttgagtatcccagcacacacaaaataaggttacacacaccagacaacataacacagatttaaattacagagatagctttttgagtatcctagcacacacaaagtaagatacacagccaagacaaatggtattacaaaaaacatagcctgttgcacaacaacagcatggctccattgtcttcctctttaagaattccgagaagcatttcgtccaggttggatgagtagacacacatacggtacttgtcgtgttggcaaacctcgtagtcgatgtgctcctagatctgattcaccctcccatcatcctgttcatccataacattatgtagttgttctcctcatggtccttcctccagtccagcgtctcaagttacagctgttgcgccagttacctcttggtgt

SEQ ID NO: 71145 - DNA, 536 bp, Triticum aestivum
  Clone ID: PAT_TA_71145
ttttttttttttttttttaaaaaaatataaaataacaactttattatcgcctctagggcatatttccttcagttattgcccatggcatgcctaccactcctccatgagatattttcaaagatctttgtgtgtatcataatcttcgatgtcattctgcacctaaaaagagcgttggatttgttctttccttctaactgtccacgcccgttgttccatgagtccatagttggtgtaatccaaatttgtccacgctcgttctcaatgaccatgttgtgcaagatacgcatgttgtgattatgtaaaggatctcttgatcccaaaacctagatggtcctcatacaatagcacattgtgattgcaaaatttcaaaagccctctccacatctttcctagtggccacttgagcattatgtaagtagatttctttcttaccttgggagcttgcaattagcttcacaaaagtagcccacttcaaataaatcacatccgcaagatagtattcaacatcgtacgtgtggccattttcttggaactcc

SEQ ID NO: 71146 - DNA, 354 bp, Triticum aestivum
  Clone ID: PAT_TA_71146
tttttttttttttttttgttttttttttttttgatcaatcggtactcttgtttgatatagctccacttatgggccacattctgcatctcactgtaagcacttagagatccaaagcaaaagaaaccaaagagaaaaccaagactcgccatgatcgtagaactacagggatgcgcatgcaatcctaattaaatcctaaacaatagcagcacctctctctctctcatatgtacaccacatgaacacgcgacgacgccgacgggaggagcgcacgccggcgtcacgccttcttgtcgtcctcggccggcacgtgccacacccagaactcctccttcggcccggcccctcgcttcctgg

SEQ ID NO: 71147 - DNA, 362 bp, Triticum aestivum
  Clone ID: PAT_TA_71147
tttttttttcacgaaaaacaccatgcattccattaaatagtggtcgcggcaatatcaccggccacagcaccagatacatctatgggggaaatcagacagccacaaacactggccattgatcattgcccttgagccaaaaccagctaacaagtgtgctggtacattacattgtcgaggacaagcaccaactttgtaatctacgagtcccatttgcaactggaatttaccttcacggaaaagagtacaaaaacgactctatcataacatttacatcatcacagtatttatgcggcgaaaatgcaccctctttacgtgtctacaggatacggttgacgtcgatttgaataatgtgtctttttaac

SEQ ID NO: 71148 - DNA, 440 bp, Triticum aestivum
  Clone ID: PAT_TA_71148
tttttttttttttttttacttaattgttactccctctggtaaatctaaaatgtcttatattagtttacagaatagtacttgactaaagagccatcgataaagaaagaaaaagggaagaaagaactggacacaccgacgctctttgcctcgtgcctccctcttacacctcacacatcaccaaaccttatcatttcattgtctccccactgctcctagaaaatcaaaagaaaaataaaacgctagcaaaaaggccggcgcagagcgccaccacccaccacacaaacagccagccgctgccgtcctcggtcctcccgacggccggcgatggcgaccctgggcgtgctactgctgctgctccggaggaacgctcacctagagcaggatctcgaccttcgcttccgcctcttccgctactgggactccctacccgatgggcacgc

SEQ ID NO: 71149 - DNA, 407 bp, Triticum aestivum
  Clone ID: PAT_TA_71149
tttttttttttttttttaataccatatataatagtgtttgcacaacctcattgcgcattcaaaatttaaaataaataaacggcgcatccgtatatatgaggcgagcaacttggcaaaatggggttcatacagcataaataaacaaattaagaaacgtagtgcatgggttaaatcgatggctactaggattatgttaacgcgctctgcagtgagcatggatgccacgagcatgtggcttgaattgaccaatggtaacaccgtgctgctacggaagtaagggttagttcaactcccgactgagctcgatgtaccgacgctgccgtgcatgtcgaggcgatcacggcgcgtgcatgtcccctaagctacccagggcgagccaggaagaagcttccgtcttgcccttcttc

SEQ ID NO: 71150 - DNA, 388 bp, Triticum aestivum
  Clone ID: PAT_TA_71150
tttttttttttgggacagaggtagtatatttgttttacttactactactggtatctaaactagagttaacattacaaccaatgtttgttttacttactactactggtatctaaactagagttaacattgcaaccaatgttacaagtagcacgcatcatgtaaaaaataactgtgggggcctgcctacagttttcaattcaaaaaaagaaagcaaggtcgcccttgaaatcttgatgaaaatcctggatcttgtcctcccttcttcgctgggaatgagcttgatttatatgaaattaatgagacctttctactagacgactaccgcaagacacatccagattatgcccaggaagaacgacaaaatttcatcaactatgtcatcttcttt

SEQ ID NO: 71151 - DNA, 409 bp, Triticum aestivum
  Clone ID: PAT_TA_71151
tttttttttttttttttttttttttttttttttttttaacttgatcaacgcagatgaattgcattcaaaacaacgttgacttcaaactgacagaaggtttgcaccgcatagtacagacacacagtacatacaacaaatcgcatgacctccaccaagtggcacttgcatcctaatttagtaacatgatcaaatccatccaacataatcttcaagaagattttaggcttctccataagttatacccacgcagcttactccctcagacaaaatagatgcaccaactggtaactgctgctgctaatcatagttgtagctccatgccgattcgatgttaatcttcacaagaacattttcgatagcagctgctgggcgaggtactgcccttctggctcctccagataaattttgt

SEQ ID NO: 71152 - DNA, 431 bp, Triticum aestivum
  Clone ID: PAT_TA_71152
ttttttttttttttttttttgttcacaaacaagcatatacattgaacgcaagttgacaaacacatcattcttgacaaagcatagttttgaccatcttaacaatcacccaaaacacacaattcacaaaaacatgagcactatttgttcgtatgagagactttaactacatggtccagaacacacaagtcaatatccacatgcacaaaatgcaagctccaaaataactgaaacaccaaatgattacaagttggttggtccataaatgttgcaaagtcatcacgtccatgcacaccatttggctaagtacctggcgacgttgccctccgttcgccaccgattacccactgcaagtcgtggccctggttcccagtgagggtaccttccatccaccattcatttatctgctgcatgtgggcggccatggttcccag

SEQ ID NO: 71153 - DNA, 668 bp, Triticum aestivum
  Clone ID: PAT_TA_71153
ttttttttttctttttttttttttttgtcaaaacccaaataatcttacaagtaaaccatagagtacataattaagttcaaactttaaattagtattacatcccaataggtagaaacaacatcagtagcatctaatgcacatacttggtgttgtatttcctacgcaaccaatcaaaatgagcagcacttttagtcatgtgtaggaacatctctccctgctctctattcacaaatagttcactagcaatgaaacattcatcactacctactattgcagcgcactaaacaaccagatccatcacggaagtaagcaatgaactttcttctttcttcatgtatgactcaaagctagattgggtcctctatgctgtatctccaactcttgttacatgttcttgcataacaagtggtgtcttcagtttcttgttattaccatccacaaatctgccaagtctcttcccttttccatcagcacgtgactcacctatttgtgtctcctctagatcaatatcgtgtatgttgtccacattgaaaactgattgcactgctagattggggaatggtgcctgaagcgggattccagtgatttgtaccatcactcgtgatgtcaccaaacatgatcgataagttattctcatttcaatgtccacattttcgggacttaccaca

SEQ ID NO: 71154 - DNA, 327 bp, Triticum aestivum
  unsure (1)..(327): unsure at all n locations
  Clone ID: PAT_TA_71154
tttttttttttttttttttttttttttttttttttgacatggataacattaatgctttactttccacaataaacacatgcattcgttggattgcatggatacgaggtgtgtcttagataactggaacatatgaagaacgtcaaataccacattnggaaaaatataactagtctctaacctaatttatttgtttgttgtctggccaaagcgatgatggtcgtgcggagcgggcgtccaggagacgatgatgacgaggacccaccttgcaacggtcccatcttgttgggctggcatggtgaagaacaagtggagacagggggatctgcc

SEQ ID NO: 71155 - DNA, 446 bp, Triticum aestivum
  Clone ID: PAT_TA_71155
ttttttttttttttttttttgagcacttagaagcatgcatatgtgcagtcgattgcaaaagccaaagtaggtatacacacattctcgctcgaccaaatactagtacggatgcaggcaactctcaagttacgagacaccattttccacaaaaccgtatttactttacgcctaatggtgacactgctggtagacgtcgcgagagaattcacatgcttaattctcctcggagttgcaactacgggcggctggtggtgctgacgggcacgtagtggtctgcgccagcttcttgagcttggcgatgatggtgaccagcttgttgtcgagccggctgacgatgcaccggggcagccaccccgccgccgggtcaagctgcaccacgtaggtcacgatgcacgactcgacgccgtcgtcgtcaaggagcttctcgacgacccacccggactgca

SEQ ID NO: 71156 - DNA, 421 bp, Triticum aestivum
  Clone ID: PAT_TA_71156
aagcaacttaccaccatacctaagcaaggtaaacaaaggtaatccaatacttcaacgagactagagaagacacatatgtctccaggactacattgctaaggcaatctaatacttcaacgagactagagaagacatatgtctccaggactacattgctgatgcttgtcttaggttcccgaacagatgatcttcgtcttgccgatacggatgcacagatggagctcctccccgtgcagcatctcgggatacacgggacggtgtcgcactccggctgcgccaacacatcgaactcaaccggggccgagcagctcgccgccaccttcttctcgagcttcagccggcgcgcctcgtctgggccagccactcgacggaggaactgtacacaggcccggtgccaacgttacccctaacgcacaccacg

SEQ ID NO: 71157 - DNA, 497 bp, Triticum aestivum
  Clone ID: PAT_TA_71157
tttttttttttttttttttttttaaacctcacacaacccatgtaatacataagggaaagagaacatagttggcttacactcgccactttacataatacatgaatataacattacaacaaccaagtaaaatcaaggtccgactacggaaccaaaataaagaacaaccccaaatgcaacaaagtccccgatcgccccaactgggctccactactgatcaactggaacgaaacaacacaatgaacgatatcttcatcaagctcctccttgaactcggttgcgtcacctgcacggtatcatcggcacctgcaaactgaaatcctgcaaggaagaagaacgagtccatgaagaagacaaatggacgtagacgaatgaatcctcacaaacacgacgttatcgaaacttcgaagcgtgcaatcgggacagctctcgttcggtgcaaagtagaggaagtagatgttctcaggatgttcgtagtggaagtaggggtacatgacgac

SEQ ID NO: 71158 - DNA, 353 bp, Triticum aestivum
  Clone ID: PAT_TA_71158
tttttttttttttttttttttttttttttttttttttaccccaaatagatcatgtactcttatatatatatgcccacgatgctcaagcaatacaacgaactattccaccaaattcctctatgccttctaacagaactgaactaatcggccacgtacatacatactctgcttgacctgcttctctgtcctactccctcaattccaaattactcgtcgtggttttagttcaaattacttgtcacctaccaggaggagggccaggaagcacatgaggtcgcccacagcgctgatgaagatggcgtcccctgggtcgatgaacatgcactggccgacgatggtgagcgcgagggcga

SEQ ID NO: 71159 - DNA, 302 bp, Triticum aestivum
  Clone ID: PAT_TA_71159
tttttttttttttttttttaagttaaatgaaaatgcattggctcaaggatttttgtctcatgaaacaaggctaatttgcgaatctttacacaatattaaaccaggcgggcatccactcccatcaaacaaaccgcagctctaatacctacgaaatgaacggtctgatagctacataatctaattatctaattttccaattgacaagcagcacacactctaattctacacgttatgttgatcaagatctgaactctcagtctcagatgacggggcatccgtccaccagcacgcccttggcggtg

SEQ ID NO: 71160 - DNA, 266 bp, Triticum aestivum
  Clone ID: PAT_TA_71160
tttttttttttttttttttccagcacaaacccacctgtttttaattaagaaaaagattgattattggcaacgtatcaccaggcctgcaggattgattgcttgggtacatgtactgtatgacagcaactccccaacagctttgcttcgaaatgtacaccttgtactccactcgctccgcgcgcgtgcgaatcaccgacccagggtgaattacatgtcaaaaacaacgacgatggaggtgttcgtggagctgaggaggctgctgacca

SEQ ID NO: 71161 - DNA, 312 bp, Triticum aestivum
  Clone ID: PAT_TA_71161
tttttttttttagagcaacaacaaaatgaattttattttcgcaacaaaaaaaacagacaaaataaatgttgaacaaaaaaaagcaacaacaaaatgagatgaaaacacgcgcatgtgaaaacaaacatgcatgaatgaggcactctgaaatgaaggaaacaccctgcctcaagtacaaggaaggaaggaaggaaggaatgcatgcatgcattttcatttttcaagcggccggacacttttcattgttgtggaggatgcagtcttcacttttcttcttcggcgctaaacactccttgaagcatttcaagtttt

SEQ ID NO: 71162 - DNA, 330 bp, Triticum aestivum
  Clone ID: PAT_TA_71162
tttttttttttttttttttccgggccggcggacaaaccccgccgtgggcgcacacaccccttaatcttctttatcttttcaatggctacatcgctggctcttccggcacacttaatcaatacatggaagggctttttatacccggacgcacacaccaggctagctaccacgcacgcaccgaccactactgcctatctcgcccagctacgcacgcgatccgcatgccacaccggccgcgctcaaacgcatgccacggcctgctcggatcgccccggctcctttgcaaccaaccaactacctgatcctacgaaatggaatacgaggcacact

SEQ ID NO: 71163 - DNA, 353 bp, Triticum aestivum
  Clone ID: PAT_TA_71163
tttttttttttttttttttttggacaaaaaaaaattttcattctgaatgaagacatgaccaagtcatccatctaactgaaaaaactgcatctgccaaacattaaagggaagtgatggttatttagtcagacccaacaagaattgctcatcaaggtagggatccctctctgacagcatgtcatgtctttccacatgcatcgactaaactagtctactacaaataattcttgtttatttcttatcccaccattgctgaaaggaaaagtcctcggtgtgggatcagacccgttgcattcttcctctgtttttcttttcttcctctgtttctgttttgaaagaaacagaggattaat

SEQ ID NO: 71164 - DNA, 483 bp, Triticum aestivum
  unsure (1)..(483): unsure at all n locations
  Clone ID: PAT_TA_71164
ttttttttttttttttttttatcaaaccacagaggaattgagtgaattattgatactgccaaactggattgttttttttttgtcaaaatgtacagaataatgcctttgtataaactgtaaacaatggctttgcataaaatgtaaacaataagattttcagtggtttatttatgccaccacagtccacatacgaatagacaataacctaaatgaaagaaatttggaatgaatcaaagaaaattagctgtgcagcttatgtgggttcggccgactcgccgtcgtcacgctgctggctgccggtgggctantcgtccatgggcggcggccgatttgtgccgctggccaacgggagcgggggggcggctggctgctgtgccctgtgtgacgatccggtggcgggcgccggccgctaaaaaaaaagtgtttgttgtctgtgccgtgagttcctggatgctgggctactgcgtgttgcgctatgctggt

SEQ ID NO: 71165 - DNA, 436 bp, Triticum aestivum
  unsure (1)..(436): unsure at all n locations
  Clone ID: PAT_TA_71165
tttttttttttttttttttaaagattgacaagatttgataatgacgtgaaggttcaatacactaccngtagaatattcttcaggtttcagccacttggacaagcaaccacaaagattaagcagaagggggtatagctttcactgttcgaaatatagatgacctgacgtaatctaaatttgttaggtggcttcacgagtccaagttcagtgtggcatctgccctggcctcgatatcgttcttgctcctgacgacgcatctcttctttgtctcgtcgtccaggtacccgagatcttcagccagtgcaatatgtgcatgcagcagctcttcgagtttgtcagcaggaactgaactcttacctttctcgcatagtatctgatggagttcttccttgccgtggttctcagagctgaaatgatcgtgaattctcattgcttc

SEQ ID NO: 71166 - DNA, 407 bp, Triticum aestivum
  Clone ID: PAT_TA_71166
gggccccccctcgtgccgaaaaatcccgacatacaaaggtaagctcagcacacagaataaaaggagtggaacttcagtacagcctataaattgtcatgttcacaatattagaagtaagctcagcataagcataaaattttgtttggcaccaccacatcagaagacacctttattcttcactattatcagaacacgcctaaataatgatgaacttatttcctacagagcacaaagctgagcttgtagctagtaaaacgtggggcataaagcagaaactagacaccatgattgttctaggcataaaattggttgtaataaaacttaaagtgataggcctatagaagtatcaacatctctctccacagacatccccaaataatcaacaggcaatatggaggaggggtggt

SEQ ID NO: 71167 - DNA, 302 bp, Triticum aestivum
  Clone ID: PAT_TA_71167
tttttttttttttttatttttttttttttaccacacacgaagacaacaccaatcaaatgcagagaaatcgcaaaagatacagagcgcagttcggtctgcataaatcatacgccaatgaaaacaggagttaaatagaattcaggggtgcgaaacagccaatgaaaacccaacaagacgtacgagggaagctggcgaatagacgtacaaggcaaagcaccttcgatacatcatctaatcacacaaattcgcttggggaagctggtatccaattgagttgcagacttgcggtaagtagcaggact

SEQ ID NO: 71168 - DNA, 438 bp, Triticum aestivum
  Clone ID: PAT_TA_71168
ttttttttttttttttttttttttttttttttttttgcaaccaaaacaaagcatgctctaacattaatattaggcaaaaaagagattaccttgattcacagcaggatacaatcatgtagaacaaagcaaaatacccaaggcaaacataacatttctgctgccatgtgtttgtaatcaaggcaattcactactaactgaaaatgtgacaaaataactagtcgccaaacaagtcatcatcactatcatcagctggatttgcacccacgtccctgctagacttcttttcatcaacaactttgacttgctctggctggccatctgatttataagcccatgatgagcccagttttgctggaacagagtccccgtaaaggtcatcatacataccacctctggatgtgcttttaactttgttaagcatctgttgtagcttatctg

SEQ ID NO: 71169 - DNA, 169 bp, Triticum aestivum
  Clone ID: PAT_TA_71169
ttttaaaaaaaaataaacggcgcatcattataaatgaggcgagcaacttggcaacacatggttgatacaacatacataaattaagaaacatagtgcatgggttaaattttgatggaatgttacgattatgttaccgcgctctgcagtgagcatgcatgccacaacatgt

SEQ ID NO: 71170 - DNA, 297 bp, Triticum aestivum
  Clone ID: PAT_TA_71170
ttttttttttttttttttggtacaagaaaatctatagacaaaggttttcccacgtccatgacaatagagcagtcaggtgaccatcttagaaagttcctgactaatgacattttttccacaaacaaaagcaccaaatagcaccatgttcctccaaaagctgaggggagggatacatcacacacgatggagccatttcaaattacataagactgggatttaatggcgttggaaggaaatgaaaaatcaacatctgtcctctaagaagaggtgtgtccacaccgagctttgatgcatcag

SEQ ID NO: 71171 - DNA, 222 bp, Triticum aestivum
  Clone ID: PAT_TA_71171
ttttttttttttttttaaaattggggaaggaaatttaccgaaatacaatgtccaaataccatcccgggaaaactttacagttattttcccaaaattacatgtgtgggtatggtgaaaccgcatatgtacaaaacatttgcacaaactgtacgccccctgctaattgaatcagcaaaggaaaaagcttcatgtcaaccccccacttaggactaaccctgcttg

SEQ ID NO: 71172 - DNA, 428 bp, Triticum aestivum
  Clone ID: PAT_TA_71172
tttttttttttttttttttttttttaaccacaatagcaaatgtcattatcggatattggtaacacacaagaacattcagtttgagactcaggtcctccatcccacatgacacatttctcaagttgatcaactccatgccatgattgttctcgccagagaagactggccacacaagccagcactagcctccagggttcgagtactagtcgctgtcgctatcgccgtccgaaccaggatagtcaatacaggtactactaccaccgccatatgcttcgctgcttgggtgaacaacaggctggcggttttcgcagccatagcaacgccctgcatcattttctccaactatacaacacatgatcacatcattctcactccggaaatagaggtcgacttcagagaagaatagcttggtactgtcggcatcagca

SEQ ID NO: 71173 - DNA, 405 bp, Triticum aestivum
  Clone ID: PAT_TA_71173
tttttttttttttttttttatttttttttttttttttttaaaagggaaacataaattgtttcacttaacaaacacatattttgattatattcaaaacaatatcaatgcctaaggcatgttaacaattatcacaataattctaatatgcgaccttaaacaaaaatattttttaactaaaatgacattcatgttacaatatcagggggaaattgcaggattacaattgcacggtggaattctttttgagtctgtcttgcagcttgaaaccaagcaaaatcaaacttgaccacctcccgactatgattcaacaactgagggaggcatatttttctcatattcaacaccggcaagctcagggcgtaagtcccacatatatttcatcatattttaactacttttccaacc

SEQ ID NO: 71174 - DNA, 524 bp, Triticum aestivum
  Clone ID: PAT_TA_71174
tttttttttttttttttttagcttgatgccacatccattcacatgtttgatcctcacacggaccaatcttgaaaatttttgttgttcaataaatatcaacagaaggaattaagcaaataaaataattctaagcaattaagaatctacaattgacacataatcatggtgctgatagcggattgaccattcttttaaaaaatagtaccaaagtcagtaaatgggagacttctggcttgtgagataatggaactgggtcttctcatattgctcaagtacatcctttccttctcatctaggagctgaaaaccgacaacacagccaacgcaggtagctccatcatcgaacacatccaactctatctgtggagctctacaggcggactgctattagtgcggaaaaaaccgctccagcggcggcctcactgtggaacagcggcgagtcttcaccggatgaggcggctcctgcgtcctcagcagcagcagcatcctcgctagatgaggcggctcacaaagcagcggttgttc

SEQ ID NO: 71175 - DNA, 621 bp, Triticum aestivum
  Clone ID: PAT_TA_71175
tttttttttttttttttcacaaccttatcttcttttgttgagttcagatatggggcggatgggattcaaaattctatttcatcatcaatgcctcgcattgctgatagtagcgcattaaataacccacacgctccagaaacacacacaaccatggcccacgcaagcacatgtagaactctcatggcattctggttttgacatcgaaaacacattgctctaacccatgtgctccttgtcttcttcagtatgcacttcctgaggcctgacagtgaccaaagactcagtcaatagctgtgcggagctcactcaaagccttctcgacttaatgaagcctcattgttgtactgcagtcacatcatgattcaggtacagagaggcagcgtgaccgtggagaaaatctcatgaaagcaggcggcgctgcgcttgagtaactggaacaaccatgggagcacctttgcaaaatgtgaagcatgatgtccattaggaagctttgctcaacaaatagattaagttgtcgcaagatgcatgaaaccaaactctgttccttgatacaaattcaagcagaacagaacagagattgcatgaagaaaaaaattaaagtacagttaaacacaactctgg

SEQ ID NO: 71176 - DNA, 456 bp, Triticum aestivum
  Clone ID: PAT_TA_71176
tttttttttttttttttttttttaccccacctgaatggtttcttaccagtttgggttcaaacagaaacatagagtacacacatttcatgacttcatgtcatgggacacacgcatagtaagtacattatcgtatcaccacaatgacgttgcttttggttgatgtcctcttcttcttgtattagtagtacccatacccatgaaccatgatgatggttgatatggtcagatctttaaggcctcctccacactctctttgcatgcgccgaccgtattgtagatgtgcatgaagtcgcggaacgcgaccctccggtacctcgccgacctgccctcgacaacaatctccttggcaggccccaccacacagtccatggtcggcatgattaaagcagccaccgtcgtcctccccaagacaattttgggcacgggtccgatgctcgatgctccggagcacccgtt

SEQ ID NO: 71177 - DNA, 513 bp, Triticum aestivum
  Clone ID: PAT_TA_71177
ttttttttttttttttttttttttgttcgtgtacgtgacatgtttgttcatatctgttgcggcttacacaaatagctttacatgtttttttcgtcaatgtacactttaatcacagaactatctttacttcagtacatattcacccattgttctcgtgtacgtgacatgcattgctgctcacttcctgaataacttgtgagagacgaagaagccgagcgagaaagcagcgatggcgattgcgaccacctccttgttgttccttgccttctccaccacgctgtccgcccacttcatgtccgtcagctgctccaggccccctgccacgcgctctttccagccgctgcacgccgtggccttcttctccagcaccgctttggcttccatggcagcggccgcagccttggctttctcttcctcactgcgctgtccaactccagccgccaggctctcctcgtgaaccaacgatttgtccttctcgccggtggcaacctccggctccggcgccagcttttc

SEQ ID NO: 71178 - DNA, 517 bp, Triticum aestivum
  Clone ID: PAT_TA_71178
tttttttttttttttttttactaaataaattattcattaatgaaaaaacataatttacaaaattattttcaaaatagcctcatttgttcttgaaaaggagaccggacgtgattctaagaaacaaatactaggaaacaaatcaaaattaactaagaccaaagcattctcaaggggaagctcccattcaacgcccgataagacgctagggagtggtagtccgattaccatacctaaaccccttggatttgattttatggcaacggctgcagagcttcttcacactcaactgaaccgtggagggaactttctccacgacatatttaccaataacccccagccctttgtgggcgtgcatgatcatactcctgcttttcgggttgcattcacctttttccccgacacaacatctttcagcgtctccataactactattgtcgtatatggcgtccaaggtaaggcgctcgagtgcagtctcattctcaagaatatggcaggttagttcggccatgctctttgc

SEQ ID NO: 71179 - DNA, 424 bp, Triticum aestivum
  unsure (1)..(424): unsure at all n locations
  Clone ID: PAT_TA_71179
ttttttttttttttttttttttttttttcagcggctcacacacacttttgtggctcaataaaaaaaggctcacacacttttgcacaaaggctcacacacacttctactcttctagctaaaaaaaagggctcacacgcacttctagctaaaaaaaagtctctcacacacttctagctaaaaaaaaaagtctctcacacacttctagccagactactagattttttttgtcacgatagagactacgttcactcccacaatggactgatgtacggttgctccgcggacgcctcggcgccgtaggatgggtagaaggagcantagcttctcccttcgtcccactccacggccatgccgtccgagtaccactcccccacgcagtcgccgttgaagaagccaaagccggcgccctccatctcctccgccc

SEQ ID NO: 71180 - DNA, 507 bp, Triticum aestivum
  unsure (1)..(507): unsure at all n locations
  Clone ID: PAT_TA_71180
tttttttttttttttttttttntaagccaataataatttgataaaaaatatacgctcatgtcattaaaaaagaagatacataaacacactagaaaatacctatacatgagcaaaaaaagagccaaaaaaagaacactatgctactctacaaccagcgccgcccccatcaagcaaggcccaacgctcgtcgaacatcaatcacgggtcgtcccacattcctagccgtttgatccacccctccacaaagtcgtgagaacacatgtcttcgttgttgaaaatgctcccataaaccaatatctgccacatgataaaaaaatatatcacaatatatagtattatagccagtaggttaaactagaagtaacttactactcccttcgttcctaaatataatttttcttagagatttanatatggactatatacgaataaatatagccttattttaaagtgtagattcactcattctgctccgtatgtagtccatattaaaattcctgaaaagac

SEQ ID NO: 71181 - DNA, 327 bp, Triticum aestivum
  Clone ID: PAT_TA_71181
ttttttttttttttttttttttaaccaccaacctaagtaaaaaacattagattccccaggtatataatcaaccttgtcggcaaagtcacaaataaaccattggcatgcttattcggaaaaatcgtcatctattcatcttcatttacaaaataacatttaaaagggatcggcatttgacaaatcatgggcatccaaagacaacacatcatcattttgtatgaattccaattgagcgccttgaaaacctctattttccatttctaccaccctgtattgatcagccacccattgtttgttgatcctatgacttaccccaaatttgagttc

SEQ ID NO: 71182 - DNA, 592 bp, Triticum aestivum
  Clone ID: PAT_TA_71182
tttttttttttttttttttttagtgtgagcaatccttcaaatgtcttgccttatattactgctacatagaacaaaaaaaatacatcaaattgacaatgtttaatctcttctatgttagtataggctacatgtagacgacatttaatctgtagtagtagtagcagtattgctatgtaagggagcagccaaactccagtaatttgttagaatatcactttggatacatgactgcaggattaatacattattgattattgtaggtagatcagacctttattgtaggtagatcagaccttagaagccacttgcagccgcacttgccggcacccacgacgtgccaccccacctggccccaaggcgcgccgtcccatggtccgctgggtgtggcgtcctccggagctccgccttgcgcaactgctcctgctctatcttccaggtgactaatgtgtctgcctccgtgcgtcgcgtggatgagcgtgttatggaaccgaatgatctacccaatctgaacagtagggaaggtgcatcatgtacactatggtgcatcaagttccgcattaatctgaatagtagggagcgtgttatgtcattc

SEQ ID NO: 71183 - DNA, 482 bp, Triticum aestivum
  unsure (1)..(482): unsure at all n locations
  Clone ID: PAT_TA_71183
ttttttttttttttttttaaaggaaaaaaaatgtcgtttaatttacatcaagggcatccatcgaatgaattataacaagccaacatacacaagtacttcttacacaactagacgtgtaaatccccgcaaaaaaaaaactagacgtgtaaagctaaatatcggccgttgctgtgcgtanaattttaaaccatcaatatcacaagccccacgagccaaacacgtgtgcggaccaccactgtgttccccgccgaagtgtgcgcgcctgcggccgtgtcagcgctatgcactggtggcgatgatgcaggagcgtcatcgtctagtgcactggcctcgtcgggcgattcaagcgtctcagcctcggtaatggtcgggacactcgcgttggacgatgaaccgtaggctggaccgggtgccgcggagctcccttgcccgacgagctgatgcttggtggaatgattgctgcgctgacctgcatgacggat

SEQ ID NO: 71184 - DNA, 630 bp, Triticum aestivum
  unsure (1)..(630): unsure at all n locations
  Clone ID: PAT_TA_71184
tttttttttttttttttaagattcaaaatagatgttttattgcaaattataatgtgcatgcttactagtactactgattagaatcagggccggccgtactagacagtgtccagccggccacacacacccacacactcacgcacacacagcacacagcacacagcgcacgcacacacacgtgcgacacacacacacacgttgcacaacacacccacggccatggccgtggccagcagcagtagcagccggcggcagtgacggagggcagcagctaggcaggaggaagagcagcagcagcaagcagcaaagcggcagccgtaggtagccggagcgactagcagcagaagtagatagcagcagcaaacaacagcggctgcaagcatcagcggagcagcgcaacaggaacgggcggcgagcgcggcagcgggctancgcgcgggcgaggagtgggcggacacgctgtagggaaagaccggggcgtggtggagcacgggcgggcgcgtgcggagacgcggtcaacggcgcggtgagcgccagggagtgcgggcgccggcgcgagcgccgaccatggcggcctccgcgagcacgactacgacggcgatggatcgagggggctataggggggatctg

SEQ ID NO: 71185 - DNA, 497 bp, Triticum aestivum
  Clone ID: PAT_TA_71185
ttttttttttttttttttttttttttttttttggcctagtgtgacttcttttatagaagtataggagtaatacagtttcatcccactttaataatctttacaaaatgcatggttttattacagtaaaaatgaacaaaaccatacacctcaagaaggatttcgatgcacatagaccttcatatatatcaaagagaaagtttccaaaaaggaaacaaaaaaaagagagagaaggggggcacatcggagctgttctgctctcgggcccaaacaatttcggaaatcgaaggaggcaaaccgaaggaggcgacccagtctcagtggcgctacgaggaccagctcctgagcagccccggcctcccgagcatctggtccagcgcgagcacgacgaccatggccagcgacacgtccatgcccgccggccgcaccaccatccggaacacgtccgtgcccaccgcctccttgggctgcacctccaccaccgcgcgccgctgctcgtc

SEQ ID NO: 71186 - DNA, 341 bp, Triticum aestivum
  Clone ID: PAT_TA_71186
tttttttaaaaccatgcccgtccaaggaacaattcaacaatctatactaatcacaattggtttaattttacacatagaagtatatgaatgtttgtgtctgcaagtcattgatgcggccaaagacagggttcatacatatataatctacattagatgtagaaccattaatttgggtggtcctggaataataaaggaaaggttacaacactgtttgtgtctgcaggtcatcgatagtgccagacactgagcagtaaagattgaatcacgaacaatctcgatctcccatggagatagtctaatttggtagtacagtctgtgccatcctcccatcttacctttac

SEQ ID NO: 71187 - DNA, 396 bp, Triticum aestivum
  Clone ID: PAT_TA_71187
ttttttttttttttttttccaacagcaaaaaactaaaaaataaacgaggggagtacatgtacaaaaaaaaaaaccacacggacaaccgtgaaggactgcatgccacaccccgccggactgcaattccacttccctcaactttctcggttccatgaaaaaaagcaaaatcccacaggatgaaccaccgaattgacccaaacaccattgggagtgttgtttaaggatcaattaaaacaaacatgcagcaaaacccaatcgtgagctgcaagcatgctccatgcaaactgtgccggcatacaaaattttttgtcaaacaccgtgcgccgcccccttactcatctccggcgtactgcatgcaccccaaactgtacttcatctttttgcttcaggacctgc

SEQ ID NO: 71188 - DNA, 426 bp, Triticum aestivum
  Clone ID: PAT_TA_71188
tttttttttttttttttggtctacaatattcgcttttatggacaatcgaaaacgtaaaaaaaaagagaagaaaaagaaaatggggtcccaactacacctgattaatcatatataacaatggtaatcatcaataatgaacgatgagtgatggtgacgaggaaatattgatggtgatccatgcaagaagaagacggcgacgatgatctgatccatggaggcgaggcgacgacgcatgatcatttggcggcggcgtgggtgaagccgatggcgatgtgggcgaggcgctcgtactcgcggtcgtgggcggcgacggggatggcgcgcggcggggcgcccctccaggcgtcctcgcagctccgggacgcgcccagcgccgccatgagctgctgcatggcgaggccgtacactttggcctgcaggttgtcc

SEQ ID NO: 71189 - DNA, 401 bp, Triticum aestivum
  Clone ID: PAT_TA_71189
tttttttttttttttttttttttttttttttaaaaacacgaaatttaacctcatgttgattcaaaaagaagaggggttggcacatgggagcgcgcggtcctgccaccggaaaaaaatataaattagctttttttaacacagtacagacacaagcgctcatacatacgtgcatacgctcacctctatgaacacacacgcacaccctatccctatgagcatttttgagaaactgagccggcatatcatcttgagatttacgacgttactgtaggcgcctcatcgtcgacgggaacatctcctgccactgaaagtgtatcgccggaaatcctgaaataagaaagtatatcattttaagatttacgaagtcatcataggcgcctcgtcgtcgacggaaacgtcta

SEQ ID NO: 71190 - DNA, 330 bp, Triticum aestivum
  Clone ID: PAT_TA_71190
ttttttttttaatccaacttcaactcaccaggtgtttacttccattccattccatatgtatcacagccaatgtaagatcgactcaacagacatgatacagattatcaaaatatgttgtgttacattgctctgggatcactcccaaatggccaaacgtagatcatctcgtcccagccggtgctggccaacagcccatcggtgagcacgctcatgtcgatcccagctacaaactcggtgtggtggccgtacctttgcagcagggcgtcctctttccggtaatcccacatgcagaccgtcatgtcgtaggagcaggacatgagcatgccctgc

SEQ ID NO: 71191 - DNA, 288 bp, Triticum aestivum
  Clone ID: PAT_TA_71191
ttttttttttttggccaacgggggggaaagtaggtattcaaatgtcggtggatacaacaggagcatgaaaaataacattttgcttctgtcaaacgtaccaacaaaacaagccatttatttaccccagaaaaacccccccgtacccccaagctatttttcaaaggaaagctgctatgcacacaacccaaagcaaacgatttgtgcacaaaacaccacatcagtgcatcagtgcaaattatctaagtgcaacaaatggctaaattgacatcgtgcacctgtcgtgcatgt

SEQ ID NO: 71192 - DNA, 445 bp, Triticum aestivum
  Clone ID: PAT_TA_71192
ttttttttttttttttttttttaagggaatgacataacatatctaaggaactgagcataagttacagccatgttactttcactgctgctgctggaacctctaaatagtaatgaaatgggaaagaacagacagttccaaagggaaagaacagacagttacattcctccaggaagtgctgctactcccttggtttatttgcttcctttctaagttcaccttagaagacacacacgatgttatccctgacgaagttgtagaatatggacttgtgtttgaccatctgcagtgttttgtcgctgggcaccacctccacaccagaaatcacagcacccatctcagttgggtggcccgtgtcttcgtcctctccaaactcaaagattttggtaatgcaaaacctcccagctcccaagtacacaaagctgcaatctagcaacacccaatcctc

SEQ ID NO: 71193 - DNA, 196 bp, Triticum aestivum
  Clone ID: PAT_TA_71193
tttttttttttttttttttttttaaaccaagcaaacttcctttttcggggacccgcgcgagcagcagctccgcagggcaaagagttgcacgcgagcatcagcaccgttgagttttttttccccccgcttcgggacgaaaacgtgactttttatatagatccggacatatgtagaacgatatttatgactaatcaca

SEQ ID NO: 71194 - DNA, 538 bp, Triticum aestivum
  Clone ID: PAT_TA_71194
ttttttttttttttttttttttttttttttttcaaagtaagaggacggatactagaaaggcaagagtcacaaacaatctctacaccaatccaagcaagaattctctgttatttctaagaaagagatctttctaactgtcatatattcacaaaatgaaacaaatgcttatgagaagctaccgcgacaccaggcggagcctaaccgtcaccgtgttttccttctgcaattcgtgtatgttttccaactgaataaatccgttcaggtaaatccacattgttccaggttagaagaaagaaccacgaagtcttgatctttcacacccgacccaaccaacacaagtgctgcggcagagtgcagaacattctgtaaaaccctggctggatctttcaaccacctgcagttcttcatccggttaaagaatccactgcatgccagtatgccactacacaacatcaactggcacagagctggaacttcgatggcgatcactgagctccggcgccgggacagcagggacgacagcaggttcaggttgctg

SEQ ID NO: 71195 - DNA, 356 bp, Triticum aestivum
  Clone ID: PAT_TA_71195
ttttttttttttttttttttttttttttttttttttttttcttgttgaacaacggatccagcagctttgagcagggagctaaactgaacagaagaaggggaaccaaaaaaaaaggatgatgaaaatcaaactaaaaaagaaaagtccagcctaatctaaaactattcccccggcatcatcacgaaaagttgacgcagacgctgccgttcttggggcatccgcacaacgggcacgcctgcacctaggccgcgcacggcgcccacacgcaaaggtgccggtacgggaacagcaacacgatggccgcgccgtcgccgcaccccttgcaccttccgactcccgtcggggccggggtgccc

SEQ ID NO: 71196 - DNA, 328 bp, Triticum aestivum
  Clone ID: PAT_TA_71196
ttttttttttttttttttttttgggggctaaaaaaaacgtgatactattcacccccccagatcaggttgtcatttttgtacaggtcgcatttcaactatttcaccctgaaattttacacacatatgcttcacattgttgtttacttggaacaatttttgtcatatttttttgaaaccgaaatttttgaatttgaattttttcaaaaaatcggcctccatcaaggccgagagccaaaacgccattctctgcaattctgaactagattgtgtgtttgcccactgttcatttcccactcaaatcaaatctctctttctctagtaactatgc

SEQ ID NO: 71197 - DNA, 484 bp, Triticum aestivum
  Clone ID: PAT_TA_71197
ttttttttttttttttttttttaataaaaacttgaaaaatttaaccggtctcagttgaagttgcattgtaatgacctaacatcagtaactaagctgtcgttctgtgagcacacaagaaccacaaaccattttcagtaatcttattaagccacctaagtgcggtgtgagcacggcacttttatatccctcccgcctaatatatacaaccagtgtttactccatcacacagtccttatgttccagcttctaatctacaaattgtacatcggatgtagcattatccactgtaaacatctacaaaggttagatgccaatacctgatgtgctggcgatattttaagtctcacacagtcatcattctgtttcaacgggtgccctggttcttatcagtggcaggtcctagcactgtaatcacctgcggcatggtcattcctccagaaacaattatttccgtagagagctggagaatcatgctcgatgttat

SEQ ID NO: 71198 - DNA, 331 bp, Triticum aestivum
  unsure (1)..(331): unsure at all n locations
  Clone ID: PAT_TA_71198
ttttttttttttttttttttttttgagtcgcaaaaatgtgacattatagattttcatgaatacgcaaagaattgcatatcatttcaatgataggtagaagagaacagttacagcagagagatggggggagggggcaccacactaaaaagancacatcctaaacactcgcctagcccaaacactagccactgatggcaaagagaaggacgcatggcacacaaaccgcgcaagaccaacacatgaaacctccatcgcgcagccaccaccccaacacaaaccaaatcaacgtacccccaccttatgcgcctaaaggagttggcaagtaggatgc

SEQ ID NO: 71199 - DNA, 477 bp, Triticum aestivum
  Clone ID: PAT_TA_71199
ttttttttttttttttttttaataaacttaattaattggctagaaggaaagaaccgcgtactccaaccgccatcatttgcatcattgcatgccatacaagaaaaaactaacaaatacttctagcttattgattctagatttctaccaccacttgtattactaggaacaccaagccaacttgccatcgcaattccggtttgtccatgtttagtaaccttatcctatattgtacatatcacggcatgcagtgcatccttgagactcttggcatatacttccagcctctttaatccttaacgcgtggattcacatctgggcgggtccctgttaatccgttgatacttacaaggtacacaaacccttcggaagctgatgtgatctcgttcatcctctctgcctttgtagatggtgttgtaagcagcaccagctcgatctcgttcttcttggcttcaatgctcagatcacttgcctcggtat

SEQ ID NO: 71200 - DNA, 531 bp, Triticum aestivum
  Clone ID: PAT_TA_71200
ttttttttttttttttagcaaagcatataaatccaaatttcagatatgttagctctgtataatgtatgtactcatatcgagtaaaagataatacttagtagataaatgcgttggtacacagccataaaactgaaaccttatatgcacaccaaagattattgtataccggcccatctatagtattttccatggatactggtccgactaaaattcactgtgataagtcacctgatttggtggaccaccgcaaggtagcccacttgtcagccaaccaagttaataatcagatggcttaagacagagaattttggtccaccaataaacttgtttgatgagctcgcttcttggctgccatttgtaggacactagtgcagctgtggacggcgatttgctgcctgcaggcacaggttggagctgcgacgcacagttaacccaaatacctcgctcatttccagcgactccgggcttgtcccacccggaatcgcccagtcaaattggtacagcagattggcaagcacgagctcaatcgtc

SEQ ID NO: 71201 - DNA, 359 bp, Triticum aestivum
  Clone ID: PAT_TA_71201
ttttttttttttttaaactcttgggcagcgggccgggctcattcatgcgtgtaagaatcttttctactagtagtatatttcctttgtactcgtactccacagccgtgcaaactagaaaaaggaaaacgaaaaagatgggttttacaatggcgatcttggtcaaatcgaatcattcattccccactcgccgtgcacatcagcaacgacccattctttccgcgagcgccgacgggggggggggaacgcgccgtctcgctttcgctccggtggcccgtgccgacttgcaaacagtgtgttcttctgttcagcttctaacttctctgtttttttgtttttgtttgtttggatggacggatatg

SEQ ID NO: 71202 - DNA, 414 bp, Triticum aestivum
  Clone ID: PAT_TA_71202
tttttttttttttttttttaattacctactgtctgctaaatgactccacttcgtcaagagaacaaagagtttttgaaagagcaagactaagttgggataaacaggcccgtagaaacatggggaataattcaaaaacttgacataatgggacttcatcatgaaaacaacaatctgccagaagtctgtctgtgaagaaagtttttttttctacatacttaattatggcaacgttttgcctttgaacctcctgttccacttccagtacgcggaatgtgcacttgagaacagtgtgcctttattttcttctttagttcctggaatgagtctggtatatagtggtactcatgaaacatgagccccctcgcccactccatatgattgcaatacgtgagaagatgatgagcaatggtgaaa

SEQ ID NO: 71203 - DNA, 527 bp, Triticum aestivum
  Clone ID: PAT_TA_71203
tttttttttttttttttttttttttaacacacaaaaagtggccaagagcacctcgaggatacatgtagtactatgcgggggatattacagatttacagggagcatcctaggtagtgatatgaacataggatggctgcattcccctaactacgtgctactcgagaagacacgaaaccaagcccatatatctacaaaagactgactgattggggaggtacaaagggtcacagaggtcaaaatataaccaacaccacgagccatggaaacttggaaagtaggggtcctccttgttctcatactactgtatatcgcaaacaaccacgggggagcgcgtctccatatcatgaacagtcttcttcttaagcggtccaaaagcatcatcatccagaagaaagccctgctatgcacgaccccgtctgggtctgtgttggtgatgtgtcaacaatctggcctcatgtgaaactccagcagaactgttctgcaaagctaaaacttctggaataggagcattgggataccacctacag

SEQ ID NO: 71204 - DNA, 539 bp, Triticum aestivum
  Clone ID: PAT_TA_71204
tttttttttttttttttttgtcaactaagcaaaataattacttaaagtcttacatcccgcttacgtcaccttattatacttgctctaagggcgataaatgcgatacaaggaaatgctgctacctggcatagtgtaccacgcaaccacctctcagttgtgtgctgaactttgaggctcgtatcacggtatcattttttttaaagaaaatttgtaagggaagcccttagggtataagtaggaacccaaatccctgaggacttgaacccagatggtgggattgtatggcaactctcctcatccaaatgcgtttggatcacttcctcacggagtcatctataggctggtatcactaatatgttgtcatggctttgccatagatgcccagattgacatatatcttttatttcttttcgtcgagcttttcccggtgcttcttcccagcacgatgatgtgccagcgctgtaccactattacactgcaaattgcattgctcacagaaatatactatctgccgtttctccaacttttctgagttcgca

SEQ ID NO: 71205 - DNA, 343 bp, Triticum aestivum
  Clone ID: PAT_TA_71205
ttttttttttttttaaagggcaacaattactagtcaatactgaacaatcaggctactggaacatacattgtaaaaccctaaatacatttgtgtaccaccaaaaaaacatcttaatttgggaaaaagacagccaaagtgcaacatcaatatacaatcaggcttctgaacaataactgccagcagcccaacagttctaatgaaataaaataagacaaattcatttacttcaaaataataaaacctggccaatggttggccgtttgaaaaaaaaataaggaccaagatgtttgtgtgaaaaaaaactgaagtcatatcatctgctgcacaaccaactacggggttg

SEQ ID NO: 71206 - DNA, 531 bp, Triticum aestivum
  Clone ID: PAT_TA_71206
tttttttttttttttttttttcatggaatgcgcagctgcacaaacaattacgattggtataatccaaacaaggatttttggtcatgaccaaaaagttggtacagtaggctttgatcacaatccaaacaccccataaggcagagaagaccaagacttcatatacacagaaacatcaacaactttaccttcgggacacaagatgctgaaaactcaggatctttgatacagcaaaccgtggtataagaagatatctcgaggattatgcggcgtaaaaagctacttttgcgaagaacaaccagatgaagcacaggcgattcatcagcaattaacaggcaggactcggaatctgtcgatgacccacattcaacttgtcagagcatatgagcctctagctctcaggtcatatcataagagatgatatagacttcaggtcgcgctagtgtcctcaacagacttcttgtactcaggcttgagctcatgcgtcccttgattcggtcctctcttgttgtagacgcaaagatcgttcattat

SEQ ID NO: 71207 - DNA, 438 bp, Triticum aestivum
  Clone ID: PAT_TA_71207
ttttttttttttttttttttttttttttgacctagaaacatgataattcgatactattttcaggtcatacagcttccatacaacatcatgccatatgaattaccatatatagtcagcttccatgcaacatcacgccaccatggcgtcaacatctccagtatgcttcttgctaggtgatttcagcaacggcacccctggtcgtttaggtatttgctgtgtacctggagcagtttggagatatgccgagatgctacttgcgtcgaagccccaggctaaaccaagagtcctctcggcgcgaaactcggccgcttgcgtgatagtcttggtctgcatgtcaacagcaagcacccaagctgtgtgttcgctttggcggtagtcaatcttggcgaggaagtgaaaaatggcatcattctgcaggctgagggtgggcaggccaac

SEQ ID NO: 71208 - DNA, 457 bp, Triticum aestivum
  Clone ID: PAT_TA_71208
ttttttttttttttttttttttttttttcaaaaaaagcaaaaggattatgcagatgcacatcgcatatatattataaagtttgatcatcaaacattttacaatgtatgcaattcattgattacacatgaagacttccctcataatttagcatctatagtttctagacatttgagcagtacaagatgtaacaaacacaaagaataaagcctgtaagttctgtgtgagctcagggcatatggttaaggcaaggtgccttgacgaatcttacaggaacattttcaacctggacaggaaaaggcaaaatgtcaagtcatgtagtattaaaaaacattctatccattacatttattacgatactcagaatctacaaaagtgcaccaccccaacttttataagaaaaacggctacatcaagaaaatttctcaacaaatttcccttcaaggcatcaagtgaata

SEQ ID NO: 71209 - DNA, 506 bp, Triticum aestivum
  Clone ID: PAT_TA_71209
tttttttttttttttttttatcagaagcgtctcacctcccttggggaggccgcgtagtgctttattgattgatcggggcttatcccgtgtagcgcatacattgttctgttgcagacgtggttggcaaggagagaataaagaagtaagaaaaagcaacagtgagaagtaaataagctagtggtagacggtgagcgaatgcaagccttccgatcttcttctccgtcgtcgatccccagccgttcattatctgaaccggtacagttaactgaacactagaacaccttgcaagttcagtctgacaatgcccccttgcgagcgcgatcttgccttcaagtagctgaaggttgactttgccatgcttcgactgtcttcttgaaaaaggctgggaatgtatgcttcatgaaatccacatcttcccaagttgcatcatccagtggaaaattctcccattgtacaagccattggacaaccggtcgattgttgcgaaggatctgttgggtctgaaa

SEQ ID NO: 71210 - DNA, 544 bp, Triticum aestivum
  Clone ID: PAT_TA_71210
ttttttttttttttttttttttttttttttttttttagatgaagcaacaactcttgcctcttacgtaaaaaaccataagagtaacccacattatttggcatagacttcaacgccaatttatgtctcatgggccatttggcacagcgggtgatctagtgaagtgacgtcgatttgttgattctatgactcccggcgaaattcaggcaatttatctgaacctgaagcgcgtacgcacactggacatgtgttacatctcgaactgtgcgtacccgaatcagtaaatcgatgaacctgtaataacttttaactaatctcgattttcttgttcttcttcagccttcgtgttatcccgaaaatgcatgcacctgacgtgtgctgatcaagaggaagccgcgtggatgatccgccgcggccgccggcgccttctttcggcgccccgggccgctgtggccccataagtccggccgtgcgcggatgggtcctgttgccgccagcgccttgcatcggaggcgccgcccttgccgccacatgcatcagctctagc

SEQ ID NO: 71211 - DNA, 327 bp, Triticum aestivum
  Clone ID: PAT_TA_71211
tttttttttttttttttttttttttttttcaggtcgggaatagcgcaaatctattcatgtcaacaaaacggaccaacaacggcggccccagcaatggaacgctaggtcgatccgtgcatgagccaaacaaacagtagtttgttttccgtacaaatttcccgagctccaaacaaacagggaatgagcacagacaatttccacgaatcttacacttgttgtgtgcatcaataaattcagaggccggggaacagggggtggcacctccttattgacaaaaaaagacttagtaattctaactaagctgttctccacgaggctccgctattt

SEQ ID NO: 71212 - DNA, 353 bp, Triticum aestivum
  Clone ID: PAT_TA_71212
ttttttttttttttttgcagaaaagtccccccattttttagaaattaacccgcagtacacgctttactcagtcagaaaatgtttcgaatttacaaacaggaccctgtgttttcatctattcaacccgcgatctgcagaacggcggcggcgcgacggctggagcttgcagcgaacggatccatgcacggcaggggctgggaaggattcggaggcgggcggtgaggacgggggtcgccggtgacgacgattaaggccggagcgcgacttcccgggagaattcatggcatctggctcctgtcaggaaggagacgggaagatggagggaggaaaaactggagaaaggaggggagacg

SEQ ID NO: 71213 - DNA, 222 bp, Triticum aestivum
  Clone ID: PAT_TA_71213
tttttttttttttttttttggaccaagaggcccttgtatttgttccggaactacaacctgcgtatcaaaataaaagacgtttttttacagtcaaaaaacatcttatattttgaaagaggaagtacattgtgattcaattctcttagggctgccaactctgttattacggatttaaaatgagaacaaaactgcagacaatatgaaatgggacacaacccattc

SEQ ID NO: 71214 - DNA, 381 bp, Triticum aestivum
  Clone ID: PAT_TA_71214
tttttttttttttttttttttgtttttaaagaatagcaaactcgcccttttattcatgccaacattgttacacaggagagatctacgatgtaagtgtaacactgtttgcacatacaataacggccccaaaggacgataagtgtacaaacaaaacattcagcaaactatatggaacagtgaccgacgccttcagatcatttggcagctccattcaaaacagagtagcgctcacatctctggaacatataataattaagtaccctcgatttccttcagtttatttcgcacgcttgcatggctgcacgtacgtacgtacgttcatccgaggtcctccctcatcagaccagcgaagtcgtcggcgtgttccttggtgacgcagct

SEQ ID NO: 71215 - DNA, 454 bp, Triticum aestivum
  Clone ID: PAT_TA_71215
ttttttttttttttttttttagaaacactaagggcataaagttttcactaaaaccacagtacaggaaactactttaactgtatgttcatcatagttttcagaaacttgccaagttctgaactaattacggtattccatagtaattcaatgcagaaagaagtacagaacagctgatttagctatcacttcagatattgctatggtatacatgcagaaaagcatctagcctctgcactgaagttcagtgtgatcactgaggtaggagagcgccacattgccataatactctcgcccaccctgcaaacgaagcttgtcctcctcccttcccataagagaccccaagtctccagatagaacttccaaagcagcatcatactttgcctgttgttccagaattgaaacatagagagaaagtgcttctggctcatgtaaactatgtgaacttatgtgcttt

SEQ ID NO: 71216 - DNA, 345 bp, Triticum aestivum
  Clone ID: PAT_TA_71216
ttttttttttttttttttgaagctgaagagcagaatcaaaaaaaaataataaggtggaacagggcacggcgagtaaggaaccttttacttcagtgtctacagatatacgtgttgctgggcaaaaaaggaagcaaacaaaggtatatagacccaaagggacagccacaaacacagaactgaagatgaagctagacaacaacagtaaggccattgtcttgggtggaaacaatctgaatacaagcgatctaggtacaactttgtgtcagatgtatgaagaagggaacaatgattcttataagaagcagaagacggaactcaaccttattcccttgagatcagcggatc

SEQ ID NO: 71217 - DNA, 374 bp, Triticum aestivum
  Clone ID: PAT_TA_71217
tttttttttttttttttttagtactgcaacaacatacatgtctttacatacacttgtataaatatgtcaacccattgtgtcacaaaagtaagaaatatgaacttttcatgtaagagtagcaggcatataaatggttttacaaacatacacatatacaaagacgaaacaagaatttttgttgtattatatatctctcttaaaaaaatccttgtttaagtccagcaaatgtaacccggtttgattaccgttataaagaagacactaaaataacttaagattgctgaagtaagagcatggttacctgcaatatttcttacaatcattacctaaagtaactccagggaatgagagattacctacaataactctaggga

SEQ ID NO: 71218 - DNA, 531 bp, Triticum aestivum
  Clone ID: PAT_TA_71218
ttttttttttttttttttttatgagatatttgttatagcagcatgaaattagttttaaacaacacatctcagacagctcaaggttcagacaaatacatattactaatctgacaatacataatgtatataaggaggctggcagtgagcagtcaggatgcaggggaaagatgcttcgatagcaggataatgagctggttgctcggcaacatgtaccacaatcttaggattgctacaggtgttctttcgatgccctcccactccgcagattgagcatttcgcttctttccttttcttttgaggggtgtcccctctttgtggacacgtcgtgctcttatgaccagggccacaacatatagtgcagaatcgtgttggcttgcttgtactgcatccgataactgtatcaagttgtgatgcaaccttaacttttttgctctttgcagaccggtcatcatatggaggcttgtctctgcgttcgttggtcgaccggctttgcgtttgcgttctggagctgataatccaatgtaatttccg

SEQ ID NO: 71219 - DNA, 606 bp, Triticum aestivum
  Clone ID: PAT_TA_71219
tttttttttttttttttatctaaaagaagcttatttttcaactttttctcctgagcctacatacatacacagccaaattttaggccagtctcaggcccctgctttatcatgaaagcaaaaggctctaaactaaccgaaacagaattcacttcctatatgtatacaaatacaaactagcatccaaacccaatgccaaaggattacaaaaaagcaaaatggtaagtcccatccatggctgctgcgtctgtcttggcgtagacaaacagaaacatgattgatgatcctccattgcttcctggagtagaaacatcagtaggaaactcgatctcgatgacttcatttctctctgaaagtccaccacaaccacaaattggctcccatagcgtcattctgtttcacaacacccactaaaagtctagttgcagaaacaggccaccaactgatggtagaaaaggaactgcaagacgatgcagaccacgggcttcaaaatgccaaccaacaaaaacaaaaatgttgatgcgcttcataggctcgatactccaaatgcttcctgcattacaagggctcggtcagtactcagtaaaaaaatacttgatggatcaagct

SEQ ID NO: 71220 - DNA, 597 bp, Triticum aestivum
  Clone ID: PAT_TA_71220
tttttttttttttttttttgatcaaactggggtgccattcttgcattgcatgcccgattattaatcaattacgaataaaacttagtacgacacatgcatatataggtagacgaaagcaacacaggagtaggcagtcatgtatgcacctaccgatggaccatccacatacacactgttctcactactgattaaacagtgaacagaaaaggaaaaggtggcgaaaataacactcttgatgttcttattttgcggattgctgcagcctgttctcgcttctcatcatctttgtcaccgaccctctggagattattaagaagatactccctgccggtgttacatccttgcgtcttctcttcaccggcgagaagtgcggtagttggctactgtcagaatgaagttcgctatgatcaaagccaaaagccctacacggagaatgccgctgtggtcgctctggtcgtcgctctggtcgctgcgcggcgccagtgcggtggagacctcgaaccgaacgtggcagttgaagccaccaccgcggccgccgcgccaccgtcgccgcgggcagcatccaggtcccagtccatggcctgcgccgagtcctga

SEQ ID NO: 71221 - DNA, 332 bp, Triticum aestivum
  Clone ID: PAT_TA_71221
ttttttttttttttttaaaacaaaaaactaagcatttttcaaatatgaagtttttttacaaaagatgcatagtttgtgaaatattaaatgcaaaaagaacaggggctattctgcaaaactgccaaactcctaaaaaaaataggtaaaatgtactatgacaaaaaacacgaaacgggccgtatctagctggcccaacaatgggaaaaaaggagggcgctggagctggcctcaccatgggctcaccccaataggaagcaaaggaggccggcctgcctgaggcccacgcgggcgctggatctgggccgcggggttgcagggctggtcctggctgg

SEQ ID NO: 71222 - DNA, 458 bp, Triticum aestivum
  Clone ID: PAT_TA_71222
ttttttttatttttttttttttttttttttttttcgcaccaccaaagttgattccacccaaattgacaaagtgtttatcatcgaaagattgaggcaccgactgagttgatttgtcagttttctcgaaaagaagtggttctcaaaaataaaataaaaatcaacattaacaatgactaatatgttgtacggtgttttcgaaaaggaatgtaagcccttaaaattaagaactcaacaccaccaaaatatggctccattcccatgctcccatttcactgcttaggtgaccaacttctctatcatcaagtttcatgtgattttgctcatccgaagcaacatgcaatcaaatctaaagaaataaaataaaataaaataaaagcaagctaaaggagaagaaaaaggttacatcgcattagcaaaagcaagttgctttagaatgcataatcaaagcccggtgatga

SEQ ID NO: 71223 - DNA, 229 bp, Triticum aestivum
  Clone ID: PAT_TA_71223
tttttttttttttttaaaaccacccctgaaaaaatttatctgttttcaatgtcagagtgaccaagcgaaacagcatcaaaatggtggcaatgaaacaaaaaaaaaactgggtccaaagttggctctgatcgtcaaacagaggtttgcattctgcaaagctatacaacagtctacttgatgacctcaaaaaataaaacttcaggctggagcttgcattccttgaaacgtt

SEQ ID NO: 71224 - DNA, 281 bp, Triticum aestivum
  Clone ID: PAT_TA_71224
tttttttttttttggccaaagctttgtcatattatactaatactaataataaagcagacggaaataattacaaatgatgagttccactagtagctactagcagtaggtagtacgagtccccatcatttcttcaaaatttcaaacagctagtttctttccccccctttatttaaagggcagtgtgacgagccaaataggcacagccagcgtggatggttgcagctgctcgtgctcggacgctcaagctctccgcgtcaacaactcggacaatcagattgggg

SEQ ID NO: 71225 - DNA, 438 bp, Triticum aestivum
  Clone ID: PAT_TA_71225
ttttttttttttttttttttttttttaggccaactgcagacacatgcattactgcaccactgcaacacacaggttaaaatctgcatgaagttcgacacaaagtgtaaaactgctgatctaacaagggcacaaagtgtaacatcacccagtgcaaaactgctgatctgactacagcaaacgagggaaatttacagctttgcagatgaaccacaccagttcgaggggacgattgtcttgcacatctccagtccgaggaggtgatagcctacttatttcgtggatgctaacctataactatgtacaaagcctgagtttgtttgaccttcactagcggttgcaattcttacaatagtgaagagctttactcattggagcagcgcaatggtaacagaagtactgtttacacctgcacttcatgagcaagcacccatcgatctt

SEQ ID NO: 71226 - DNA, 452 bp, Triticum aestivum
  Clone ID: PAT_TA_71226
ttttttttttttttttttataaggaatccatcatccatccatagttttgcaagtctccatcatccatacataggttcataagaccagtatcgtaggtcagccaacagcacaagatcatgcatgcctggatgcacacatgggcatacaagtccagttacaggacaaccaaaagcacaaccatccatcaggtctacatgcacacatgagtacatttgtaggttcacaagtaaaagttttacattatggagaaaaccgaaaccagcaaaagacccttttagctcaccaaacacacctctagaaccttgtggatgcaaaggcattatacttgtgacctgttaataaaaagagaatgaccaattagatcagctcggatgaacacatgttccaaacatagaagttgcacgggctaaaaaccaaatcgactcatccagatgaaaaagatatgtgtgtgt

SEQ ID NO: 71227 - DNA, 222 bp, Triticum aestivum
  Clone ID: PAT_TA_71227
ttttttttttttttttttttttcgatcgaagactgtaaagtgcattcttgtactaacgtcattcggtcacttcatgattaccgctgtgcatactaatatttgtaaatgatgtaatttcttcaaatgaacatggactatgcttgtttgcgttgaaatggtgcagagtccggggggtgatcctattttttaatagaaaaataaacacggaacacgacgaagcca

SEQ ID NO: 71228 - DNA, 541 bp, Triticum aestivum
  unsure (1)..(541): unsure at all n locations
  Clone ID: PAT_TA_71228
tttttttttttttttttttagcgttaagaagaagggttgaatggtcggctcctgtaccagtagtatccgtagactggtcccaaccagtccatagacaaatacaatatccattttgtaggccgcgttggagatgccctgagctgtcgaatccactattcattgcaaggtttcacaggaatacaggcagttttgtacatcccagacgagcacaaacgcaggcaatatcagtagtgggcaatcactcactcctgatcctgaggcttgcggggtggcatgttcatgtacttgtaggtggtgaagccgccgtccacaacaaggttctggccggagacgtacttggcatcgtcggatgcgaggtacacggccgccttggccacatccaccgcttcgcacgtcgcgcccttgagctcgcgnaggccgccgatgatggcggccagctgcgcctcgtccgcgccacggtacagctgcgagaactgctccagcaccagcggcgtcggcacggcgtgcggcgatatgcagttgatccggacgccgtggcggg

SEQ ID NO: 71229 - DNA, 381 bp, Triticum aestivum
  Clone ID: PAT_TA_71229
ttttttttttaaaaaaaaaaaaactcaagatggggatatcaatctccctctttccttctcatgtgctccggccaagcactcgagcatagcagaccatagtaaaacgaataaaaaatgctttcaacaatgaatatcttcatgcattataactgtgtaaaatctagtttagggacgaataaaaaatggttttcaacagcgaacatcttcatgtattccttttcaggtgagaaggaagtttttgaccagatttcaggagacaacccaaaattatcaccagcctctcaagaaaagcatctgatgtggccacaaaatggccacaatgtagcagattccaaacaatactttgccacacagaggggccaagatgcatttcatgaaaaa

SEQ ID NO: 71230 - DNA, 453 bp, Triticum aestivum
  Clone ID: PAT_TA_71230
tttttttttttttttttttttggacttattcaagctaatattcttgatagggcaaataacaatatttgtttttacaccaagatgtagacatgaacaaatgtatcagctgacatgtatggagcattaatgagcgaaggcactacaggcattgttgaaacagtaagcactttttaaagaggccctaacaacatgtctctgtttcatgttaaagagaacatagtgtaaagtatggcaatggaaaataagcagaagaaaggggttgcaagaatagacataccactcaggaacactcgttcccttgctttgtcgcattctttagagacaaacaggattgcacccttccttgtgcatcccttgtagaatgtgggatatagctcgatgcacttcttggtatccttcagtacttcaggcatggcatccgtcttggtgtaacaggaagccgtgttgccgtat

SEQ ID NO: 71231 - DNA, 425 bp, Triticum aestivum
  Clone ID: PAT_TA_71231
ttttttttttattttttttttttttttttttttgcgaaagaaataaaacacaatggatctcaagatcaacatcaggtgcgttcatccgaccacaaaagacggccattcaacacgaagttcgataccaaaagcgagaatacataaggagagccaactacgaagccataatcactaagcatactaacaagtggcgtaattcatctgccttgtcgatgtacttcacaaagaccgcctcacatggaaccttgatacgcattggagcagctgtgaattaggagaggcgccatctaatagagcgaccttttttccaaatgtccttccaagcggttgcttgtgtcttccattgtgtcaggaagatctccaacagagtagtccatggcaaccacatttctaatgtgcacagaaaagtaatgcatgtatctgac

SEQ ID NO: 71232 - DNA, 322 bp, Triticum aestivum
  Clone ID: PAT_TA_71232
tttttttttttttttggtttttattttttttttgagagatcatttagttgataagaataaatagaaacggtgttaaaaatgagaaacagattagaatacattgaaaacccaaatgagaaacagattctagtaaatcgaaaatgcctggctcaaatcatcaaaaatctagatctgctactggtgtctactgcgggttgggtggcctggagttggcggcggagaccctggatccccactcgaggagctccttgctggtgtcatccttgtgcgccaccacctcgatgaagcacaggcagtccttcttgtccccggtcgccgtctc

SEQ ID NO: 71233 - DNA, 516 bp, Triticum aestivum
  Clone ID: PAT_TA_71233
tttttttttttttttttttaggatgaatggatattgtgttgtattattgatctgacccttgtaggggtatatatagagtacaacgtgtgggtgacttgaagtacaagacaagtcatagtatattaaaactaattctatctccatctctcgccttatctctaactaagcatatttatattctaacattccgcctcaagtcgtagcgggagtgaagcggacgagtacgactgaatttgaagtcttctgcttttgtcgtcttcttcgctgcgccatcgtcaactacgtttctgatgggtcagcacgtagggcggtgactgcgtccccttctggtgtcttccttgtctctcccctcttccctcccgcagtcacagcgggagtggcgtgaacgctgctgacgacgcggatcctgttgactagagttgttaccgatatgttggtgtaaacatagccattaatatcaatgtcgaggtagccgatcatagtgatgtagccgtggtcgaggtagtcatggtcgat

SEQ ID NO: 71234 - DNA, 449 bp, Triticum aestivum
  Clone ID: PAT_TA_71234
ttttttttttttttttttttttttttttcccctgaatttccttgttaatgttctgatttttaatttacacaaaaaatctgtttcttttcaaattttgtgctaactgggcaaaaccagccatcacgtcatcatcaaaacagctctacaaaccactctgcatattggcgactaattgtccctggccaatcttggtgtttggcttgggcgtgtctgtttctcccggccgcgacaagttaggtcgcacaggctcttgccacaggggcacttgtctccatgaatgacaacaacttcttcggcggatcttttccgatgacggcgacggagttcctcaagctcacacttgagggtgtcgacttgctgttggagtgaatcaaccgtgtcctggtatttgtttatgagttcgtttgccttctcaggaaacttcttgtccaaccatttggtgaatttgc

SEQ ID NO: 71235 - DNA, 425 bp, Triticum aestivum
  Clone ID: PAT_TA_71235
tttttttttttttttttttttgaccgtccgggttgtgtccagacccaaatctgatccatatttgaaacggaaatgagatcgaacggacacaaaacagaaaaacaaattggacacgactagggagcaaacatgtgctccctgacgttccctggcacacaccccatttaaggaaagattccgcccgtccgtctagaaacgaaaaaaaagaaagtccaagcacttggcccccctgtcccgcgtagcaacccacacatccacgcccgaatcacttgcgggaaaaggacgtgagatcccttttccttcccatgcctccgtccacccagatctcgatctggatgaaagctccatctcgtgcgtgtctcctttgatggccatgaccatgcatcaactgaaagtggatgttgaagcttcttgcttgggtgtgt

SEQ ID NO: 71236 - DNA, 341 bp, Triticum aestivum
  Clone ID: PAT_TA_71236
ttttttttttttttttttttaaaaactaattcttcacgagcttgaacaaatacactcctccaaaccgacatactactacatagttagaacatcactgcgtttctcgttctctaggcagccaacattagcatgcatgcacgcgtacgtagtcgtgcatgcagacatgtcagagatagatagatggatagattgatgatggattataacgtcagtcctgaagagtcgaggctcaagagcagccaagcctaagctcaagatccaagcctcctccccctcctccgacccccagctccaggtccaccaccaacgcagccttggccgcctccgcggtcgccgcggtg

SEQ ID NO: 71237 - DNA, 433 bp, Triticum aestivum
  Clone ID: PAT_TA_71237
tttttttttttttttttttgaacacaaaagaaaacctgttttcatcattcctttcccacaaatgtatactaaactctattttgtccaactagaaccgctgaattcgaagttcactttgcaaagcaatgagcacatctgcgacatagaatgtgattttgatgggttattagagcaagaaacaagcacttcagaagggtacagacatccatggggttcatcctgggaagaatgcgtcgatgatattggcattgcacatgcatatgcttagtggtgtacataggaaccgtcaacgtgtctactatctagtatctacaaaaaaaatggccaagggagcaccactaatggagcctactgcacatggtatgataagtggtaaatggctagcatctcattatccttccatcgtatgcagccatgcaagtggtttctgtgg

SEQ ID NO: 71238 - DNA, 405 bp, Triticum aestivum
  Clone ID: PAT_TA_71238
tttttttttttttttttttttgagtcctgaggctgaatctgacacgataaatatgaagtttttacaagttacattcgcgctgccgttggagcttaactccaagtggtaatctgtaaataaaacagctcactaaggttacaaatgcatctacaaacaacagtggcacaaagaattatatacagcaactgcacacatgagtgcatctgcatctagcatcctacattatttactgtggcaccatctgaagcttcatcaggatgccactctactagcgcttggttctccggtgcttcgacattgttgctggcatcggaagatctgaggtcaagcgacccttcaatcgagcaattagacatctctaccagcattggacagaacccgcaagagcaagatttgcaaaccctc

SEQ ID NO: 71239 - DNA, 469 bp, Triticum aestivum
  Clone ID: PAT_TA_71239
tttttttttttttttttttcagaaatgcaaacagtgcaaggagtgaatattcagttgaatactgataaggtacaatcggttcgatgcaggaagcaaatgtatacatgcatccaacaataacaacaacatatataatccctcgctagtgaggaaggagtggggaacaagtgctactcctgcccaccatcaagctttattacaggagaaaacccaaggcgtacgtgatcgtgtatcaccttggagacaaaggagaaacaaacagttcgacaagataactagtagcacaaagcaaactgataactcgatattccggaccggaaggaaatgcggctatccattttccttccgtgtatgtatgtcatcttgttgctccgtagaaaagaatcgacgtccacttccttcgcgaggattatcataaatcagtaacattcgatatcgattgtaatgccagcatggttggggatgcatg

SEQ ID NO: 71240 - DNA, 368 bp, Triticum aestivum
  Clone ID: PAT_TA_71240
ttttttttttttttttttgtttaaaatagacttttcgaataaattaaagaggttcaacaatgtagtacgtacgtacatgcttgcatgcatgacacagatatggtacacatggtacaagctaaaccacgcttcctcactcggtcactctagcttccattgactctcctgcagttcctccgaacctccccctgcccacccgtgagcggcttgatattccccatgttgatcatggccgcggcaaagctcctgaagaaagccttctcgtcgctcgcgaactggccgacgatcgccgccgttgtcgcgccgggcgccgcgagcagctcctggtcggactggaggaacccgcggttgccctggaggttggtgaa

SEQ ID NO: 71241 - DNA, 594 bp, Triticum aestivum
  Clone ID: PAT_TA_71241
gagtgtctgacataatctatctactaacacatgggtagaaaatattaagacagtactcaataaacaattgtcacttgtttatcagacttgggcatcagaatttgccactataataataactggtaacaaggattttcgcacagcaagatatgccactatactttactatttcgttctgaagcagtagtaggctactagcacatctacttcaaacagtagcaccgtgtatttcagacagaagcaattagttaagcaggatttgtaagcggggcaagccagaggcttagctgataggcccgctccatttgctccctagttccggtatagcctattcaaaagatgtttcagataattacaatcctatttgacaggaagacacaaacactacccaatctagtttaccttgacttgtgaactctatttctctgaaaaatactcgcttaaatctatggggtatcacatttgtccttaccattgttttctttggtatcaatagagtactaagtgtgttatgcttgctgctgatatacaatatatagcatacttccacgcatagttaaacattaatcttttattcaaaatatttgcatatga

SEQ ID NO: 71242 - DNA, 568 bp, Triticum aestivum
  Clone ID: PAT_TA_71242
gtagccgttggagagacaggcttcagcttccccatttgcaacaaaggggcacagtgacaacaaatgtccgttcaggctctgctatgaatacattgcacaaattaaattaacagtacaatgaacagaatagacaaatcaattccagaaggggcaatgggtttttcgtcccaaagttgagtggctctagttcatttatccatccaacctcaacatcaaagacctatacagcagacattggaacactaaaaaaaaattctcagacatttatcatttttttctcagccacttcatacacatcacacagacgaacaaccatgcatcctatcagcatgtacacacacttaaacctaggaatggtttcacatcagatcaaagccagcccagcccataggactacacgcccaggatccaaaccaaaaccatcaaaaaaaattgagctagaacccagaccaaaccaaactgtatgttttttcaatccaacccaatccaaaccgtttctcatttttgggatgaacccacaaactcaaaccatggacgaagcccttaacatgatagtttcatcttttgt

SEQ ID NO: 71243 - DNA, 329 bp, Triticum aestivum
  Clone ID: PAT_TA_71243
tttttttttttttttaaaaagtggaagaagaactgaatctgcgtgaagcaccccacaaatatcagtgtcttcatctaatagctacgaacaaacaaggtgctattttcctaattctgttcatgactacagaatatttgctttaccacgaacaggaagccacgaagcaaatcacggagaaactgacggagaagaatatgtccgacgccttacttcttctccacaaggacattcgtcgtcgtgcgtatctgtcctatcgttggaccgcggaggtatgaagatgattgtgcggccgcagcctgcatcatcgcggcgtggcagagcccacgacg

SEQ ID NO: 71244 - DNA, 526 bp, Triticum aestivum
  Clone ID: PAT_TA_71244
tttttttttttttttttttttggaaacgaaacctgatcctcgtacatccagctggcccaacttgcagcatcaaggattacacaagaatgactgaaaactagtgacaatgttcactgattgtaaaaaatgttccatcatgcaatagaccaaaaatagtacaagcaatccattctgattcacgagtttccacagtttgcaagacagcagcacacagcttgtgcaagattgttgcttgtgtctgacctccgggctcgaaattgcgccctcgccgaatgcactagcggctgatggtcctacgagacacgagggtccaggctcggacacattctctgccatcgcttcgtctgcggctcaaagcttctccagaactatgcaccagttggatttgtcgtagaattggtcgacgatggctgcatttttcatgccagcaactagcctttgaagttctccttcgacaaaaatgtgataatagcggttgtagaccacagtacccttcttatcatctttctttgccaatccattctgt

SEQ ID NO: 71245 - DNA, 193 bp, Triticum aestivum
  Clone ID: PAT_TA_71245
ttttttttttttttttttaggaaaacaatgctgataatccaggaaaggccatcttcacatacgtgcaaaactatacagaatgtcacgattctagaaacagttttctaatcttctctggtatcctcttgatacccggagctccagcactccctaccaacggcctggctgtgcattcatgtagtagggaggaggg

SEQ ID NO: 71246 - DNA, 535 bp, Triticum aestivum
  Clone ID: PAT_TA_71246
tttttttttttttttttttttttaattcaaaatacttaaactatatttggtcctgattcacgaaaaaatatacacattttacatgacaaaagtcaaataaataagctcattttacacactccaatcacagacctaatattacacatcaattttcagttattctgatctagaaggatggttccaaattgatcaaagaagcaaataaaagaaaaggccattgttggaacaaacaaaaggtgagattttgtatcagggcctcacccaaccacatttctgtccgttctcttggaaaaactgtatatatgcaataacctgcaatagaaaattgtgtcaagaatgaccaactgaataaaatgggttgcatcatataatcaataaccttctaggtgtgtgccttgtttcttttatgaaaatcagcaccaaattatttatgtgtgcatctctagttagaaccaaccaaaactaataaaatctctgaggtgaaaaacacataaaaattaatggactaaaaatatagcaggattgagcaccacat

SEQ ID NO: 71247 - DNA, 342 bp, Triticum aestivum
  Clone ID: PAT_TA_71247
ttttttttttttttttttttttttttttttttttttttttttttaaaaaaaaatgctgcttgttctgcagtaatagttctgcaacctctaatctaccaacagttacaccaactaggggacggaaattcgttctttgggtgacactagaagagcaattgatgattgttctccactagtactactgatgaagaacaaacacagagcaagaaccgttttttacagacggaaatgaaaccaaaccaaatcaagtggtggcaacggctggcgggcgggcgggctaccaaccggagatcttggccctgaggacggtgcacttggtcttctggaaggcggtggcggcga

SEQ ID NO: 71248 - DNA, 393 bp, Triticum aestivum
  Clone ID: PAT_TA_71248
ttttttttttttttttttttttttacatccagttcatcgattaaacaatcatcatagtacaaatattcatgaaacatggttttcgcaccaacatagagtgccacacgaaattgaggaacaagtgtggagcaaatgctcacagaaaaacactagaaaatcctcagaatacaaataccttagattacaacatttaaattccagatttcagttttctgcaatgcccaatcggcttgtgcgcgtggtatggctgcggccttccataccacaattcttacaccttccaagcttctgtgacttcttcggtgcatctcctctctcagggcaagttgtccgtttgtgcccctcacgccgtcatatgctgcagaatcttgtgcgcttactcagacactcgta

SEQ ID NO: 71249 - DNA, 293 bp, Triticum aestivum
  Clone ID: PAT_TA_71249
ttttttttttttttttttttttttccaggcaaacaaaaagtgcattcccattgtcaccccaacgcaggtacttgcaaaatttattttggtatcaaaacagtcatcaaaaaattattctctggtctggaggatcatccacctcacacttatccaaggtacatatttagggacttgcaaaaggaaatgcaaactggacccctaaacattcttgcgggcgtacttgtcaggttcaccacccttgaaaaggtcttccataacatcgtcattcttggcgctttcaaagctggaaccaa

SEQ ID NO: 71250 - DNA, 324 bp, Triticum aestivum
  Clone ID: PAT_TA_71250
ttttttttttttttttttttttttttttgggaaacggtgcaccgtgtttatgtaatttttcctaagcaagctagcagcatggtttcttttcattcctcccaattagacaaaatttgggagaagagaaacacgaacagagttgcaactaacgctacgttaatcgcaaaatttagaaaagtggagtggtttctctccgcccaagaagggagggaggaaggccaagaaaccgactaggccgacgagaccgccggccggagaaggcgcgcggcgagcgatcaccacgtttcctcgtgctccgacgggctcctcccgaagccgccggtg

SEQ ID NO: 71251 - DNA, 343 bp, Triticum aestivum
  Clone ID: PAT_TA_71251
ttttttttttttttttggcccctcacaaaaataaccagaaaggcaattttatccctaacacacactgatttataaagacttcaaagttttaccacaaggtccaaacaacactgccacccacaaacacagcaggcagatttttttttaactaaacaaaacccacggggatgccatccccgcccaactaaaaccgaaccaaaacgctattgggtcggccaaaatacttcaaaagctgccgacataggactgccggctgtacccaaccccgcccaactaaaaccgaaacaaaatgctatcgggtcggccgaaatacttcaaaagctaccgacataggactgccggt

SEQ ID NO: 71252 - DNA, 451 bp, Triticum aestivum
  Clone ID: PAT_TA_71252
ttttttttttttttttttaggatgaactcggctttgaattaacaaagccatcaaccggccaggcattacagccaacaagtgccagcccaacgccacttatagagaaaataaaacaggagtagcccaaacatacatgggtgctgaagattgctagcggttgttgacgagcaggatgacaatcacaacaggttgaatggtacgaccccgcgctcacatgatgccccccatctactgctttttgcgtgctcatttgttccctctcatctttggtttcctaagttgatgcactatatcttctagcacttcatttcccacttgtgttcccattcaatgttctgtgccctccaatcgtaacgacccttgcccatattgctcagcctctaattggtagagcagtgatcctagaaacatctttcagtgtaggtgcaaggtccccaaaacgaaagtgaaa

SEQ ID NO: 71253 - DNA, 416 bp, Triticum aestivum
  Clone ID: PAT_TA_71253
tttttttttttttttttttttttttgaacccaaagagtcaatccgtgctttattattacaaacaaaaatgcccgcgcgttgcaacgggaaaaaatcacatgcccttccaccacccacctcgcgggaaaactgcaagctgcatccaaacaatccctgcccaccatcaacaccaccacataccatatgttttacacatggttctaggccgccaccattgcctttgcacgacccaagcctctatgatatgaatcaacaacctgaaaatttcatcgcaggtccttgctggttacataattattgccgagggcggcgcaaatggtcgtctgtgtggctagcggcatgccttctgcagtgatacccactccatcgtcgaatctgccctccatgacagactcaccaccaccacttgcctgcgg

SEQ ID NO: 71254 - DNA, 517 bp, Triticum aestivum
  Clone ID: PAT_TA_71254
ttttttttttttttttttttttttttttatgcatcccaaaattcagcttcacttcacagggagagagctcaggaaaacaattttttttttcttacaaagctggcaaagattaaaaaaacaaaaaacaaatgtatggttccgatttatgcttgcattagtcctaaggatcttcccgccgggtgtctattcaggcatacgcaggcactaggcagattcatagtagttgtccagtaacttccagatgttcttgaatataggcacgagggcgaggagcgcgatctgcaggtgctcggagctgttcaggcggatgccgacttgcccggtccccttgttgctcaaattcagactggcaatcaggttgctagaccttccagcagggatctgagactgggcattgcacccgacggcgagatccccgtgccagtccacgacggagatagcgagggtaaaaagcatgcgcccaatcgggtagtccttgtctctcaatgtggcttccagacgtccgccgtatgcagcg

SEQ ID NO: 71255 - DNA, 468 bp, Triticum aestivum
  Clone ID: PAT_TA_71255
tttttttttttttttttttaaatactgaaggaggaaaattctcacaactgaaagtagctacagaaagtattctcacaaaaaaaaggaaactgaacggtgatgcaatctctgtaagtgagcacaagttcatctttatatttgttacacattacgccaggcaagttaagaagtcgggacgctggtggggaaggaaaggcaattccgtcacgcccgtgccgggtttcaagctcccgccccttcctccgaacactccctgataattcagttcatgtcacagggcgagcgtggcgtgtcctgaactttcattagccctgcgacgcgactgctgtcaagcctgtgtgcactctcaacggggtcagagattcagagagacaaaatatttctgctcgctgacaggcaggagcccaagttcactattccttttcaatgaactttcttgatgtcagagcttccttatacatgaataag

SEQ ID NO: 71256 - DNA, 503 bp, Triticum aestivum
  Clone ID: PAT_TA_71256
gcacgaacaacgacctcttatatttgacaagtgttacagaatcaaagatatcagaacttcaaatgtaataacatttacaaaaataagtgcacagctggtatctggaatgtgacatccatttgaatgcaaaacgctttgcaaatgcacatgattgtcagatggcgactagagatctgatctattggacagatttattcatcacatggaatataaatactagaataggtgtacaggtaactttaagttcaacaaatgcacagtaaaataaaggaagtttggcaatcaataaaaaggcaattaataaaaaggtaagtgataaaagggcaagggcaataattatttggtaacttcatgcatagctttggccaagtatccaacatttttgcttgtaactccggccatagagatacgtccatccttagtaaggtagatgctgaactccttggtgatgcgttcaacctgttgggcattcatgccagtgtagcagaacatgccaatttgat

SEQ ID NO: 71257 - DNA, 405 bp, Triticum aestivum
  Clone ID: PAT_TA_71257
tttttttttttttttttgaaaaggaggtaaacccccggcctctgcatcaatcgatgcatgcagccatctttatgaactgatatactaatttagttctttttacttaatttaggcaatatcccatggtaattgctttgttcatgtaatttggcctaaagcacttctgaatattgtctcaaaaagaatctttacataggaaataagtttacatgcagagttagtttatgttccattttgtattgtatagtatctgcaaagtatttccgtaagagaatatgcagggtggactacagagctaaccagatcttagctagttctaccaaaatattgcagttttttcaacataggagtattaaactactaagccagaaaaactataacggatacgagcccattcggaatgta

SEQ ID NO: 71258 - DNA, 364 bp, Triticum aestivum
  Clone ID: PAT_TA_71258
tttttttttttttttttttgatgaaaggagaacacaccctccaatttaattaaaataaaactgatgatacagcggcccgcgttttaaagttcaggcaacagcagttacaacgctacactaggacaggatcactaagttcagccaacacaagacagaacaacaaccaccaggtagaacacatcactcatcaaactgaaccaaccagcctatcagcacaggaactaagaccacagatctctaccgtccatcaaccactgccgctgcaaggacgagcccttccaactcccatctcagatacattacccaacaattactctcaggatcatacattacaaggcttgatcatacagtttcaggagggaaa

SEQ ID NO: 71259 - DNA, 450 bp, Triticum aestivum
  Clone ID: PAT_TA_71259
ttttttttttttttttttctttagaaacagcagaaaataacatgcacaaaacaaagcatcgtttaagtgtcaatacaacattaaacagaattgatcttcaacgttcttcacttgaaacaaatacaacattaaacagaattgatcttcaacgttcttcccttgaaacaaaacctcgagagaggttcaatgatccattaaataggtaggcatgagtagacagacaagcaaacacatcaggccagaacagcgcaagatgcttagagaggtgcgtaaaaaataagccaatttctcttaagcaccgttgcttatttgttgagcatagacacttacttagacacctctgctatagaaacaagcaccggtacttaagggaaaaaacaatttatttatacaagcacttctctaaacaccttgcagtgtacatggtcttatgaggcatgtaagctcgcc

SEQ ID NO: 71260 - DNA, 540 bp, Triticum aestivum
  Clone ID: PAT_TA_71260
ttttttttttttttttttggcgacaagcaagaaagttatctatccaccaattaaaatggatggcaatacagtcattagagccacaaatcgctcatgtttagatacagagtttaacagctgacatcagtgcccagctagcccctcaaacagagacatgtttgatgctacaaaagattggcctgcgttatgtgtgtgtgtcttatccttcttgtcagaaagccattagccaagcagcgatctgcccaatggcggcgacgattgctactacacttgtcctgtgaccaagtcttgtttgtaacggccgaccgagcaaaacaagaagaagctatgaccgagtcttggggctgtgcctcgtcggcctggtgtggaaccttggctccctgggaactgtctggggcttcactgaccttttgggcatgaatggcctcgagaaatccggcattgggtgcgccctcggcacctgctctttcctcagcagtttgatctcaatctcttcatccagcttctgctgcctctccttctccagctccagcctctcca

SEQ ID NO: 71261 - DNA, 499 bp, Triticum aestivum
  Clone ID: PAT_TA_71261
tttttttttttttttttttttttttcaggcaaaaaccaaatgtcaggacaatcttttctttaagatgatgtcagggcaatcttgaaggaacatgcgtaccatctttttacaattataaagaacacaaaggctgattcgtactttgcaaaaagatgagcatttcaaaggctaggaacaaagccacagcccaacaaataaatttttcgagtacaaaagttctacacggccactatagtacgaacgtacgatacagctctagttacacgcttcacatcagctggtatgtatgtatgatacagctctagcacatagcatccgcttcaagacacatacaatgtgtcgatcgcgtgcaattcagtagctgcttctctcatgttcattcgttcgttaggatcctggcttgcgcaagaaagtgccactttcagcaaggacagcaggcaccggtggacttcgttttctccttccagattatcctgagaacagtcttgacattcttctc

SEQ ID NO: 71262 - DNA, 518 bp, Triticum aestivum
  Clone ID: PAT_TA_71262
tttttttttttttttttcaagaatgttgattttttattttgattttaccgttcacatgaactcatttgagctcaagctcagaagggtactttcggccatagacaattgcttagtttggtttgccacttcaactgttgaactcgtcctgcgaatgcttttttacgcgtatcaccaacccaccgaggaaatccttatggttggtaaaattctcaggacatacttgtgcatagctaattattgtacaattattagtaccacaccatgcctctatatctctgaccaatgttagaagtcccggcaaagaaatcgagcactaataataaccggagttgttggcaatcatggacaaagtcaagtatcaacctgaaattgctgagagagagcttgaaaacttcccacgatattctgctccatggatatctgatgatatatatatgtagggatgtcaaggaaacatatctctttcttggtcccctttcccaagtctctggatgtctcctttggattttctctacatt

SEQ ID NO: 71263 - DNA, 537 bp, Triticum aestivum
  Clone ID: PAT_TA_71263
acaaacttataaggtagtaaaccggggcacatggcgaataatttttcgtcagtgcaggagggtagcatatcacccctgcatcaacaaaataaaatgacagggttcaccgactagcatatttacacaaggtagttcagcacctagagcataggaacagtcatagaggcactgatagcagaagatgacactacaccgaaggttcttgggctggaagctctgagtagcatggcacatagtaccgatacccctcaaggccgtctcgtatctcgttaagttccccggtgctgatattgtaagagataagcttcattgtcttatggtcagagaggacaacaagctctctctccaactcgagagcgagaatccgataatcgcagttccaaaaccagtcagggacaccaccgatgcctccattgtcatagcaaaccaagtctttccttccaaatgcatctgccatgttaagatggcacttcagggtccaatgccataaacgatgagcataatcctccaaagtccaaactacaatggaatgaccac

SEQ ID NO: 71264 - DNA, 374 bp, Triticum aestivum
  unsure (1)..(374): unsure at all n locations
  Clone ID: PAT_TA_71264
ttttttttttttttttttttttttttttttttttttaaaagaagtcagaataatattacacattacagttcactactnggagtcgacctatacgccgggtgccacggacactcggcggttacatatgagcacatattacaagcatataaaattacaatcccagctttaacagagctcatccagtgtaaagtaaaatagcactgagcaggtacgtgtatgaagatatgaggtcacaagtcaaggacaaggcaggattttctaccgccccttgaggtttacgaggctcatatcatgcacatggctttccccggctccgtagttacggtgtgcaaagcacataagctcttttggctgcgggagctcaatgtcttcat

SEQ ID NO: 71265 - DNA, 542 bp, Triticum aestivum
  Clone ID: PAT_TA_71265
ttttttttttttttttttttttgaatacaagtccaatgatatcaattgtgtgtaacaaacccacatattactggatcataattgttagccagagtttgatattcaatagtcaaagtacacatcacatttccaaacggagagagtaatatttttctcatttcaacacaaaacagttctttgattgcaatagcttcagtagataaaataaacacgttgagtctgatgtgagctcacccagcagacaactcatcatcgaaaattatagtctcaatatcaagggcctgaactgcactcctaatttcagcaaccttccctgaaccaatataagtccttggatttggacttgaaagcttttgataggtcgatccgagaaccatgagcccagcagtatcagctaactgctcaagctccttgagcgattcctctatgctgaagttatctcttgcggccctcttgcactcgactccaactaggtaggtcttctcttgaaatatctctttgccgttgatgagcttgaaccgggcgcgctccgccgtggcatc

SEQ ID NO: 71266 - DNA, 467 bp, Triticum aestivum
  Clone ID: PAT_TA_71266
ttttttttttttttttttttttgaacaattatgagtaatttgatgcaccagatccaacggcttccgagatccaacggctgtcggaacccgtatcatgggagcaggctaaacccggtgatattctccctacaataccggtgtggcgtagtctcctccatgtccggagtcgctctcaggtggagcctacagtagtgatgacatgttaaatgtaaaagcgacagggaacagtacgaatgaacgggacttttattgatgatgatcaccactgttgtcggctgttattgtcggatgatccgacgagccagctcaacaacagcttctcaagctccagcacacggggggtcagcccaagaagagcaggccttccgccagtcgccgcgcctcgtcgcggcccagcatcttctcgacgacggccaccgcgtactccatggcggtgccggggctcctgctcgtgatcacgttcccgt

SEQ ID NO: 71267 - DNA, 453 bp, Triticum aestivum
  Clone ID: PAT_TA_71267
tttttttttttttttttttaaaaagggaaattaaaagagatgtttggcattgctgtcaaatctgcaggcaacgctggccagtggctacgtttaatttgtacaccggctactctcttcactgtaaacactctcggctcttcaagccctcaatccaaagaggggggaaagaagctaagatgtaaggagatcgcagcttgtcattgcttggaatcccccaaaaaagttgagtaaattacaaaactagagaaaaaaattcctatagctaaaagaatcaatcgaggattcaaatgatccaagaatcgatgcccgtcgtccgctacacacagtcggccagcacgagcgatgagttgtcggcatctgctttggccgcttctgcatgctttctcttgccgccgtccacaacatcgccggcattgccgccggtgagctcgcgcgcgcgctccgtctgctcct

SEQ ID NO: 71268 - DNA, 578 bp, Triticum aestivum
  Clone ID: PAT_TA_71268
tttttttttttttttttttttttttttgagcggtgattatagaaataacattacaacgagcatcaaatttggatacaatggaaagaatccagggggtgtagaaaattattgctaagaagagaagaccaaggattcgggatcgcatagagccatgaaatctaagctcagcatacaaacttgtctgacaaaaatgatgtacagatctgtttcccacttgaaacactattttcctcaattatataagaactaaaagagaacttccagcacagctctggtgggaccaaaaacccgttgagggccgtgcctggcgatgaacagtggcaattataattcttttggcaaagctgcggaaggacattttccttaggtattccatagtatgtagtctccagaagaggcctgcattgaatattctactggggctttgacagaaggataaatggttacagatcttgggtcgattataagaccagacagggtgccaccaactatcttaaaagacaccttagcataattataagcctgccaagacagtggctcttccaagtcaactgcttgaaggtctttgttcatttttt

SEQ ID NO: 71269 - DNA, 390 bp, Triticum aestivum
  Clone ID: PAT_TA_71269
tttttttttttttttttttgcgagggtaaaactgagtttattcatagcaacaggattacagtcagctaatacaagatcatgaataatgggaggagctcgttgtaaccaacaagcggtactacaagccgtatgagcatttagctagacaatgtgataccctattttgagaacgagttatcttaaccggaataaactcccgctctagaaggagcgacttgatttcatcgaccagatggccattaggcgacttggccagggaagcattagacaaagatgaaagagcttccatagagtctgactgcaccatcaccggaagattagaccattggaggactagagacatcccttcccggattgcctgtatcttcgcttcaagtgcatcattgcaga

SEQ ID NO: 71270 - DNA, 381 bp, Triticum aestivum
  Clone ID: PAT_TA_71270
ttttttttttttttttttttaatcaatcaatataatgaatttaatcacatgataaacgtcaaattttacagtttccaatcatcatcaataatcaatcaatttgagcagaacaaatggtaaaaaaggaagaggaagaaagaatatgtatggtttcatatcacagcaaggcatgtactactatgtaaatgtgtatgtgtgtgtgtgtgtgtgttgaaggaatgggaaacagaggagctaattactttctgtatatgttgcccgatcgcttggtggctagtaatggcagtccaccagggccgacgccggcgccgggaacggcagcagcgccgccggggcagacggccgctccttcacggagaaggagaagggcgatggcgaggt

SEQ ID NO: 71271 - DNA, 497 bp, Triticum aestivum
  Clone ID: PAT_TA_71271
tttttttttttttttttttttgaactttaaatgactgtaggagatttcctagtctcattgtattaagcaagcacagtaaatgtgtaggagttacatgatttacaaaatacacacggggggcaccgccatgggggctgcccaaagcaataaataaaagaagaggaagaactctgacagcaggcaaaaaaagaaggcacttgagcagaccaaagtcctgcttaaacctcctgcgccaggcacccccacaaagacttccatgaacatgagcctggcccctcttggcatgtgtcaaccattcaaatctgtcgtttccagccccccacgttattccaagtttgctccatcactccctagcaaaggtgcacgagaagatcaagttctctacagtttcattggattgggtaaggcaaagggcgcaacagtcagatcgctgcgagcccggttccaccacgtaatgcctgcaacctaacatatctttggtgtttaggccatctgac

SEQ ID NO: 71272 - DNA, 399 bp, Triticum aestivum
  Clone ID: PAT_TA_71272
tttttttttttttgaggggaacaatcagcttctatttatcaagtagttacagtgcaggtctatacaacacagttactattgacagccctcgacaccagtcagcactcaccaccatacacaaaactgctcaaaacttcaccttcctatccactagttccatgcttgatcaggtacttttcgtatcaacaaaacaaaagaattgcacaaatcgaaagaagacaggccaggaacaacagtagggggaaattttggttagtttccatcaaacgtctggaagttcaaagacactgccaactgattcctgtctctgatgaccagaggcagatgactgatcctctgatgcctcaaggtcaacagattcgtcatctgtcctgcccggtggaagcctcctgccatgat

SEQ ID NO: 71273 - DNA, 515 bp, Triticum aestivum
  Clone ID: PAT_TA_71273
tttttttttttttttttttttttttttgggtacaactgcagtactgaaaatactgctacaacaaccatatggatgctacacagcaaaaaagttaatttcatggatacagttgccatacccccaaagtgaaaatctgtgctacaacaataatccagtacttagcctattcaacaagtacatatgtccaagattcttcactacgttggcgagctgcaaacaattgtcagaattcttcttttcatggttaccgatgaatgctgctctccttgaggacctccaagaggtgcttctggcagttcaatgctggtcttgcttgaaagtttcagcaaaactgactggagggccatgcatcacaataaggtcaagggaatttcatcccattgttgaaataattttacttgcccatgaagggagaggtgctcggaatgtgacaggcaatccagttaccggatgcacaaacgataagctttctgcatgcaacgcatgaccatcacagtccacaccgttccactcga

SEQ ID NO: 71274 - DNA, 514 bp, Triticum aestivum
  Clone ID: PAT_TA_71274
tttttttttttttttttttttttttttttttaaaaaacaattatatatggtattataaatgagatatcacatgtacatgagcaaaatacaacttgtgtgctttgcccccccctgtcatcaaaaccaggattttcatctctaagagctagctagctgccaacaaaatataccaagcaagctaccattgtttgttattactaacaattctaaaaagaactatctgatcaaccaatggctccatccatcagcacggcctcaagcttcacgaccacgaggatccatccttcttcagtcactccaagagctaccaagagccagctagcagcggtctcttgaatacaaagcgagccaagacggcaaaaccatcaatcaggtccccggaactgatgatcctgtacaatcaaaagtatatctagaggggggggttgttagactacttgaccaaataaaagcttaaccttttcccaattttaatttttagcagattttagcaacttagcactagtcaagcaat

SEQ ID NO: 71275 - DNA, 366 bp, Triticum aestivum
  Clone ID: PAT_TA_71275
ttttttttttttttttttgatatctagggttataatcacaccaaacatagtcgttggaatgatatgctggacggtacagctgttcaacaaatcttagtacatcttgtgacacttgaacatcttcaccaagtacccgaaatgcaaattcaacctagaccctcttcttccgagcagaagatgcaggggaaggcggcgccgagcatgagcagaggccgcgcaaaattgcaatgacggcaaacacaacgtatggagcatacagctgaagcagcctcggcgttgcccttcctgagcccagcatctcaccaagtattgcggacatggaggtgagggtggagacgccggccatgagcgaggtggtggcggccc

SEQ ID NO: 71276 - DNA, 378 bp, Triticum aestivum
  Clone ID: PAT_TA_71276
ttttttttttttttttttttttttgaaagcaagcgtaaaaaatccccattaaagcgcgacaaggcggccacagggcctgtaaattaaatgtcttcctccttcacacaacccaaaaagggaggaaaggagatgatctgctatcctgggcaaaatcattatctacaaccaaaatgatatcaatccccaacgaacaaggcaaaaccagccagggaagccttctcttctccccacgtttcatccctaagctttaacttaactatatatatatcccattttccccatataaatcaacataccacccaccgagccagaaaaaaacacaccaaaatgatgttctgatgtggtcggaaaacctaccgcaccaacccggctcgccgg

SEQ ID NO: 71277 - DNA, 515 bp, Triticum aestivum
  Clone ID: PAT_TA_71277
tttttttttttttttttttttttttttttttaaaaaaacgttagcagatggtcatgtttctacatcatcaccatccctcaaacactacgccaagttaaccgaatacatggaggtaggagttctccaaaatcattggtatgcagaaaccaatacagacaacggaaagcttggtacaattttgggtaacgaatcacccaagttagcttaaaagtgaaccaccatcgctcaaactataaaagcatgcatacatcagccagaaaaaaggcgactgatcggcgccgggtgcgccggcccaaaatttcggccggtcgcaccctagccgcccgattagcccaccacgagccgtaggatcctcgtccatccagttcgctttcttctttctcaccccgttcataattcagatctgaagaaacactgcaggacatggcggccacccatcattgctgcgtcgcgcagcgcgcggctgcccttccccgtttgtcgccgtcgacagccgccgccgctgatgcttgccg

SEQ ID NO: 71278 - DNA, 383 bp, Triticum aestivum
  Clone ID: PAT_TA_71278
tttttttttttttttttccaattcacacttaaaatctttaatttggcacctcgactacaaccatcgaccagacaccattcggttcaaaatcgacaaaataagaaaaaggaaaatggaacaatcaagcgcacaagaaccaatgtttaagcttaaccaaggaggagggggaggaataaattaacagagaagagaaaatctgacaagatctgagccaaactggacttaatggaaaacggaattgcaagccaaatcaactgatcagagcatcctgagtaccatggccgcggcccccacggcggcggcaaggggaccggctttgcgggcggcaatggggggggcggcggatttggaggatgacttggcggccggcgaggaggaggagg

SEQ ID NO: 71279 - DNA, 483 bp, Triticum aestivum
  Clone ID: PAT_TA_71279
ttttttttttttttttttatttcaagataattcagagtttaccagagacatttggagggatttgaatcatatacagaaagaagcatgacagattacattcaagcatttcgacgaacacacggcatgctgcctctccgagatcacaccacaatcgctagagccaagaacagggattgcaaatggaaacgggcacctatccatcagtgcttcgacctcggcgacgtcctccttgccgccggcgcctcagcggtcttcctcttcggtgatgtcttcgccgccggcgccttggcagtcttcctcttcggcgacgtcctcgccacagcaccagcagccggcgccaccgccttcctcttcaacgacttcttcgccggcgcctcagtggccggggcaggagcagccgcagcgactgccttcttcctcagcaggaccttggccggagccgcggccgcgggcttcttcttcccgccgccctccagctgcgcg

SEQ ID NO: 71280 - DNA, 538 bp, Triticum aestivum
  unsure (1)..(538): unsure at all n locations
  Clone ID: PAT_TA_71280
tttttttttttttttttttttttttttaacaaaattaaaaattttatcatggattaatcaattgagaaagaatccagctacaatagttagttaacaaagaataatatccctgccaaaagaatagcaattggccgctcgcattaggaaattatactcctataaaggatggtggagtaccctccaccctgggcgcctcacgggcaaagagcgcctccgagccatctgttgctcggtggctactcgggggcgtcgcgagccgatccgatttgctcgtatggctcagatcagggcgacctaattgggatatccatgacaggtggatcacccgcgagccggccaccgtcattgggcggcgtcgggaacgcccgcaagtgagccaccgcatgctttcttgcatgcgaagccgtgccctgaaccgcctggcggcgtcctcgccccatgccaggaagggtcggttgcgacaggcacgctagtggctanagagcgcctccgagcaatccatccggcgattgcttgccatgggggcctctcgggggct

SEQ ID NO: 71281 - DNA, 320 bp, Triticum aestivum
  Clone ID: PAT_TA_71281
tttttttttttttttttttttttttttttaaccgcgtaagcaaatgattaagagctagatatccagtagcctacaatcgacgtacgccccctgcactgcatcaccgcacttcgtgcatttttgtttcatcattggccaatactgcatgcatagcgccagttgcagtactgaagagaactacgagtagtactactactacactagataaggttctgttatttcccgcaaaaaaaaaaaaagataaggttctgttactactagtaactgcttaacagctgatacataacacaagtgcaggaagctagactacctgagatctg

SEQ ID NO: 71282 - DNA, 419 bp, Triticum aestivum
  Clone ID: PAT_TA_71282
ttttttttttttttttttgcgacaagtcatcacatgcataaaagcattacatatacagaagtacaggcgtcctctgtttcttaagtagaagtaaaagacagcaacactgagccgctcaactaaagcagtgacaatgagctacttacaaagttcaaaagaattacaggtatctctcttgccatgcaaacaaaaaatacaattgactaaagggttgtatatacaggtggacatcaactcggatgataagaagtttatctcaccttgctattaaaaaaactcatctcatactcagcagtacacatataagcatacactacaaatatgcacttgcgggttcaccgacagaaggatcagcaaaccctgcaaactcgcaacatttctccataaataaaggctacagccacagcttgatatcacaa

SEQ ID NO: 71283 - DNA, 464 bp, Triticum aestivum
  Clone ID: PAT_TA_71283
tttttttttttttttttgataaagatgaacttacgtcaacttgttttcaatagttcacaattattatttccatacatcacaaacaccagaatacttcccaatagtttaaaagcttcaattgaaaggaaagcaagagtacaaacacaatactaccgaattatggagttccaagttcaaaaaaaaaagatgatagtagagatgactaggaaactgctacattttttcaattaggaccggaagtgaaccacagcaacagaagccaaacccaacccctctgttatctgcttccgctcctcagctgtaggtggatatcttgatggacatacattgtccttgatctcaggatccaagtcatcacagcgcccacacaccttctgtcgtacagagatatctctgttatattaaccgcatgttccacaatacacctaatgtatcgcataaaattgccgtcgggttggaacccg

SEQ ID NO: 71284 - DNA, 344 bp, Triticum aestivum
  Clone ID: PAT_TA_71284
tttttttttttacccacggtctgtcaggttgccagtacagtgttctgcgccgtcgaatatttacatgtgcagttgagcacttcgatcatactttccattagcaagcagcgcctggcatgcatgaagcatgccaatcgatgccggaaaatggtgccgcaagggcttgggcatgcaaagctgtgctaccttgttgtgctgtgtccggcaggcaatggcatgctttcgttgcgcgacggatgaactcacacgatgaccacggggatcatttccgtgcccacgggccgttggcttcgggcggcgccgccgctgccgcccttggggggcgcgccctccatgaccggctg

SEQ ID NO: 71285 - DNA, 472 bp, Triticum aestivum
  Clone ID: PAT_TA_71285
ttttttttttttttttttttttttttcgagggtggccctaagccagaaatgcttaatggatcctcgcaacaaaaatgccactgattcaagatcctattacagaattcccggccatgacatccatgatcagggagggatggtgatcatgggtttgagcacctaaagctctagcaagaactagaaaaatctcagcatgaaccgatcagggcttgggccttgagcacattctctagagtcatggaagggtcgttgaagtagacggtctgcaccatcttgtccctctcttggcgagcctcctcccgctgccgccggactaggacttggcgagccgccgcaatggccgcgcgaaacgcattgtccgcttcaaaggggtcctttggtttcgacggcggcaccgggtgagctagctgcgggatgcttgccggtgcggtcgcttggacccgctcgccggactcctgctgcttcttggtca

SEQ ID NO: 71286 - DNA, 264 bp, Triticum aestivum
  Clone ID: PAT_TA_71286
tttttttttttttttttttttttttttcaagccagtagtactaggagggcggaagatctcattgatgctactacatgtctacatgtgaaggtctcattacaattacatgctctatttagaacagtgatagtagcaataataaaagaagaaattaaggaggaagagaagaagaagaagatggattggtcaaagatagctttgaccacctcccaatcgaagagagtaacaagctactctacctacaagcagggaggtctctattac

SEQ ID NO: 71287 - DNA, 620 bp, Triticum aestivum
  Clone ID: PAT_TA_71287
ttttttttttttttttttttaaaagcacaaaaaactctatatatgtattggtttgtatactactcgtacttgcatatacattgaggattttataggataaaaaatggatcaatgggaagcaccaaacaccaaattcgaattccatagtgacaacaccaaattgctaactaagaggttcagttgctatatataacctttctacaaggagtgaggtgacattgggggaaataaattaactccaaaaatggagaggatcaggccgtcgttgggctgggagctgcacacacagactgcacgccggcatcgcgtggactgcaaaccgcttcttcttcatctagacaacaggtggcggctgccgttgacgaggagcacgggatctgcaggggtcctccattgctgctcgtcgtatcggcgggatgccggtgatggagcgggtccaaggagcagcgccatgtgagtagttgccgtcggcagagagacgggatcgaggggctgttggccactgccatctggtgctctactacactgcacgcctccgatttttggactgcacgcacgcacgccgcactgcacctcggggagcactaccctgcacatccacacccccgcccaactgcctg

SEQ ID NO: 71288 - DNA, 363 bp, Triticum aestivum
  Clone ID: PAT_TA_71288
tttttttttaaaagtgctaacacgtgttttatattgttccacctgggtttgtacacgtcaattgagtagaaacaacgagaatacaacatacggtcaatgataaattttctacatgaagaaccagacaaagaatgccgtaaatttatggttgtagtgacatgaacatgatatactaactaaaaagtagcagtgtatgtttgtcccccaatagcagtatatggatatgctaccgggctgttggtaaaaatctcttctggttggctatgctgctgcttgcgctaagctgcaaattgccccatctgttgccaccctgggcagaaaaaagctcacttggctgcgattgatgatcaatacgcttgtttt

SEQ ID NO: 71289 - DNA, 350 bp, Triticum aestivum
  Clone ID: PAT_TA_71289
ttttttttttttggcccccaagaataacaatgtcgaaagttatgtgccaacatcgctaacacatggaccaccacagcagtagcatcaacctctacgcgatcgcagcaagaaacgaacaaaggcagggccggaacaactcgacagcacgaaaagctacacccacatatccgcacgaacatggcagccggattccaccaccggacgggacgcgacgtcgatacaaacgatggacgtacggcgggtcactccgggatggcgacaagcatgggccgccactgtctccgcatcatcagccgccgccggaacccgccgaacatgaacctccggtactgctgcacggccgcggggct

SEQ ID NO: 71290 - DNA, 410 bp, Triticum aestivum
  unsure (1)..(410): unsure at all n locations
  Clone ID: PAT_TA_71290
tttttttttttttttttttaagaaaataggtacatgcataataggagtcttctatcaacatcccttcttaaaacgtatacatgcatcagaaatacatgcttccacccatccacatcagaacagaaggacaatatacaaacaaaaacactgacaaaggggggctaaccttgctgattgctgctgtgggttagcatagctatggaaggcattaggtgcaggggcgtgcanaatatgcagtggagaaacctggacaagtggagatgctcagatttctcgtccgtttaacacactacagcctanagactaaacatcgtgcaggggcggtggtcaatgcgaacgtctcgtcaatggagtcatcccgacggtcgtgaacgcgaaggaagggatcaagaacgatcagacagtataac

SEQ ID NO: 71291 - DNA, 306 bp, Triticum aestivum
  unsure (1)..(306): unsure at all n locations
  Clone ID: PAT_TA_71291
tttttttttttttttttttattcctatagtatttattagtaagatgtgacagcaatatacatagatccatatggaagtggaaaattacaacctatgaaccacctgacaatgactgtaaacagcttcattaacgtgccagcggcagtagttgtaggaaacgaccactcttgacgtgtacgtgcggacggcacaagaaaaagtatggagggacgtggacgacagcgacgccgcgccggcgtccgtgcggcgtggtgcggccgggcctanacgaccgccgggaaggggctgaggcgcggcgaggggcgg

SEQ ID NO: 71292 - DNA, 412 bp, Triticum aestivum
  Clone ID: PAT_TA_71292
tttttttttttttttttttttttttttttttttttaacaaggcaaacagggactgccatttttcaaactgggcatcattttgatgcaacataacattcagtggtaggtatttgtacaaaaggcttaggcatcaaacagttttcacgaggcataaggcactattgcaaaaggtaaaccctctaacagaagctaattaagacatagtggcaacatcaacagcgtcgaagcaagctgttcttggcaccatctgatcatcgccggcgaatgaccggtgcgaatggctcatgctctcgtgcctgagcctgtcttttaaccttgtatagttttttctccaaatggtggcttctgtccttcatattattcgccaccacttcaatgttcataagggtttcattggtggttttgtccacag

SEQ ID NO: 71293 - DNA, 259 bp, Triticum aestivum
  Clone ID: PAT_TA_71293
tttttttttttggaaaaagggccgtccttaacttgatgtcctggaacttaagctataaaagagcacactatataactagggcaatacaatctggccatggcaatgtctacgattctgtccgttgcttcttcttcttcgcccgctctcgctgctcctcttgctgaatcaggcgatattcctcttcatcctcttttcttgcaatctttgcacttcttctctcctccatctgtaggggggcaaaacctgcttccatgtccct

SEQ ID NO: 71294 - DNA, 309 bp, Triticum aestivum
  Clone ID: PAT_TA_71294
tttttttttttttttttttttttacacagtcaaaatataattaaactcttgggtatatacagaggaaatacagagcaaacaggggggggggggggggttacaatgcaagtaaaactaatgcaaatagggcacattacagtgtaaactaatgcaaattacactaaaaacataagaaattacagtgcaaacctgacataaattacagagtaatcaaggcatacaatcaagaaagcacaggaattacagtgaaaatgggagattacagtgcaaaaagcacatgaattacaaagcaattatacagtttacttt

SEQ ID NO: 71295 - DNA, 405 bp, Triticum aestivum
  Clone ID: PAT_TA_71295
tttttttttttttttttttttttttttttttcggaaaggggttacaaatttccccacatttacatggacaccgcaacttgaccatcgaaaaccctaaacgcaaattgctacaaagcacaaattcaaattgctacacaacaagcaccaattttcccaaacagaaacgcaagcactccctgtaatcatccacaatgtgcacatttatgtcctctcacacatccaccactcaacattctatacaccaacggcagaaacacacagctattacggaggggagtttgtatcacatctcaaacacctcgcgaattccggccccagggcaccacctggttaacacacacatacatacatacaccggtgagtgagctctctcattcgcgcagcgcccacaaatatgttacaaaa

SEQ ID NO: 71296 - DNA, 464 bp, Triticum aestivum
  Clone ID: PAT_TA_71296
ttttttttttttttttttttttttgaacacaactgtttttgacttgatcagtttataattaggacattacgaattaagttgcttctgcagattgtttctactagtaatcccttccaacttaacgcgtgcactaaaattactaaacgcgtgctcattttacttccgctgttacaccaacaaggatacagaaaaatcagttactttagcaaaagcactattccggcctggctagcagagcagagctggtaatcgatcgatcagtggctcaaaggattgacgacatggcctgcaaataccaccacgccactgacatcctccatgaggaagaaagcgaaagggtgatctgccacgaagtccacagggcgatcacgtaccatgccaaaccccgccgacatcgccacggtgcctgcggcggccacggtcccgcgctcatcgactttgacgacgcactggtggaccacgga

SEQ ID NO: 71297 - DNA, 490 bp, Triticum aestivum
  unsure (1)..(490): unsure at all n locations
  Clone ID: PAT_TA_71297
ttttttttttttttttttttgtcaccagtattgataacatagcctgcagctaatgcaatttacaaaaaatatatttaaaaatacacttacataattaaatcgaagtacaaacagtacatgtaaattaaaccaaccgcatacaagcagagaaggcaaaggaaccagcacaagcaggaacggttcagctgcagatcttcagcggcaaacggcactgaaagaatttgatgctgctacaatgttgctgacggagagtaattgatccgacactcacggagttgtaggcagcagccattcctccagcttattgacgatccactggcttgcttaacatctggattgtgttgtccacccaatttcctcaaatgtancatatgagatcgggaaaagagggagcggtggggaaacgtggaggggaagcgagggagtgttggcagcgtgtcctcctacgctaaccctgatctgttggattttctgccaagccatagccatc

SEQ ID NO: 71298 - DNA, 537 bp, Triticum aestivum
  Clone ID: PAT_TA_71298
ttttttttttttttttttaaacctgaaattgtatttatatagtaggtatagaaacaaaggcagattacaggtagatcgaaatatcaaataccgaacaaggttaactgataacaacatgctacggcacacaggacctaactaaccttaccagtgatatacctcccgattttcaactacttttgtacacctaatatatacgaaaccttttcagcgtgggtgctaaaacaagcgagaacatttgatttggtggtcttctttgagcttcgtcctctcatctcttgactagtacacacgctgctatgtcgaggacaaactgttacagttttctggaggtgcataagggcagttccgctgctgatatgggtgatatataactgcaacagtcatcaataacacaggttagccaacactgagcgctactgcaaagtttttcatatgtggtcctttcgagagaaaaatatggttgatcaggtaatccatggtctcttttgacatattcaggcaccatcaataatgtcaattgccatgctaactgtt

SEQ ID NO: 71299 - DNA, 342 bp, Triticum aestivum
  Clone ID: PAT_TA_71299
ttttttttttttttttttttttttttttttggaccgggattcaacggaccagcttcctttaacaaaaattacaagtgtaggggaaacaatgtcagtagcttgatcgaaacaattttgacaaaaaaatatcacggggatgcccagcctgtcatcaaccgaatgaccaaaacttagttatttctttttcttaaaggttcggcaaacccccccccccgtagggggctattcaaatatgggaaaatcaaaagggttggtctttgaccccccttctgaacctcttgaaaacaacaaaaaaaaaagccccgaaaaggcctttggatgggattccctgtccaagtccaa

SEQ ID NO: 71300 - DNA, 532 bp, Triticum aestivum
  Clone ID: PAT_TA_71300
tttttttttttttttttttttttgaaataaaacgcctttgctcttggaaggatacacaactttctttagagtgcgaattacatcctaatagcacaaagcaaagcacactcgctcatagcaattaatcacaaatacacaacttattcaagatacgtatgcggcaacgatgttattgtttactcgaccacaaggtcatctcattctttaaaatccaagtgctcacaatctacctgcaagaaggtgctttgtgaaactcatgttcatcttcctgatgctcattttacactacagtagtgagacctttttagcatactcgacctttcggatgaacacttatttctcacaactgttggacaataaaaattacaagtttgagtacatatcttactttatcaatttgtataggattcaatcaattggaattaggctggttagaaataaacaaattccaagatataggaaaagccaaactgggttaaaacagctagaaaaaacacaaaagactgcatattttcacatcacatcatcgtta

SEQ ID NO: 71301 - DNA, 352 bp, Triticum aestivum
  Clone ID: PAT_TA_71301
ttttttttttttttttttttttttttttttttttttaacagtttgcacaaatgtgcagctaatttccttgaaatcaactcatccgccatcaatctgaaagcaagcaaaaacaaccagcagtcaccggaggtccacacgcgcactaaacaagcatatagcctttgcgggggaaaaaatataagcaaaagcaaccccccaaaacccacattgacaatttctggatcatggaacaaggatccccaccccccccgggggccaaagagaaatcatcaacaactaaagaattaaaacaacaccatctcctcccaacccttgaaaaaaaaaatgtgatttgatgcaaacttcccaacca

SEQ ID NO: 71302 - DNA, 248 bp, Triticum aestivum
  Clone ID: PAT_TA_71302
tttttttttttttttttttttttaacagggggaaccaccaatttgttagccaacttccgacaaaaacagttcagcgactttgctgcacagcaggacaaacacggcaacaacacggtacaccagtcacacaagccaaactatgtttctcaccaccctacagccctagagggtctaccacatacaagataaccaactctagactgaagttgattaaacaagacgggtaatcaagtacaagggttctgacc

SEQ ID NO: 71303 - DNA, 392 bp, Triticum aestivum
  Clone ID: PAT_TA_71303
tttttcccaaaaatttgcatgtcatcacatggaaatgtacaatacctgctacaactgaatggagcactgcaggccattatgatggcttttgtattttatatgagttacaaaaatcttggtatggcttgaaattattttgccatcttaaaaattgtttcttcaagcatctgtacacttcttcctcggcaggttgaatgtctaaatctgcggaagcaaaatccatcctcactggggtgaaatcaaacaaatcagatgtggtttgttcaggcccaaaatcaagagttccagcttttccacaaacaaatgtcatgaagttctcatccttgtatggtgctgcagacgtttcaaaagatgtacgatcagcggcattttgctcttcgttttccttcttt

SEQ ID NO: 71304 - DNA, 285 bp, Triticum aestivum
  Clone ID: PAT_TA_71304
acacatcttgtcatatgatcaaatggtttcgcgaaaaacaatactcagacaacaagatgtgcgaactcgattttttacacgactctcattaccaattctgccccggattacacttacaacgactcatcagcttaacgttggcttgccacgcattacttgactgtaaaactctcacgcggaccgaggttggccgtaacctgccaaccaacgcgagaacacaacattgcatcaagcgaatcgaccgattgttaggtaagcgtcacctccacaaagagcgactcgctg

SEQ ID NO: 71305 - DNA, 327 bp, Triticum aestivum
  Clone ID: PAT_TA_71305
tttttttttttttttttttttttttgctctgaaaaaaaagtatattcacaaaactcattctttcacaagttgacgctcgccgtcacgtctcgcctaaccccgtcaagttggttaggaacgggttgacgtaatcaccgaaatgcccttgcctaacgccggtacccgcatcgtcgtcgaacaccatccactctttcgtggtcaccgtcgtcaacgccatgccggcgccctccatggggaccaccagcgccttcgcttcgttgtcctgctccaccgtgcatccgccgtcgtcgacgtcggccatgatgagcttctcgaggtccctgatgt

SEQ ID NO: 71306 - DNA, 593 bp, Triticum aestivum
  unsure (1)..(593): unsure at all n locations
  Clone ID: PAT_TA_71306
ttttttttttttttttttgaaagtattcgaataactcaaagggatacataattgagttataagtgtacattccatatgtcaattaccgcactgctccctccaggaactgcagaggtacgctccttactatgtacactttgttatcaaatgtcagaacatataacatactgtttctattttatgatatatatgctatgggagctgaaactatgtatattgttttcacagagtatgctaaaagctttacaagattgactagaaactccacacacacctagatgacccttgtggaaggggtgttgcaagtctggtgggttgattagaggagccatttggaacaccttgaacctggtcgtttgtatttggcttctgctgctgctgctgctgcacctgctgctgcttctgttggggctgttggttcattgtttgaacttgttgcccggcagctggttgcattgttgaagcattgtctgtcgaattttggttaggtaagcctgaaccaggtggaggtcgaggcctgtcnccctgctgattataattattgttcctgtgctgattaaacttgttgaaattggaagaccgcatctgcataa

SEQ ID NO: 71307 - DNA, 605 bp, Triticum aestivum
  unsure (1)..(605): unsure at all n locations
  Clone ID: PAT_TA_71307
tttttttttttttttttgaggtcaaacaagagcatccaaagataagattttgcatagcaaagcagagacatttgtttgattgtctgccccaaaaccaagtccaaaaatttatatacaaacaaatacagtagatgaactgaagaatgaaccaaacaattgaatcttctttcctctgctagtatgtttctttgagacgctgtaaaagtttctttcttcttttcctcggatacgagttaactagggccctcctactactgagcaactggaaatttgattctttgacagagcttggatcgaattttaagctcaagatcgtttaaggaacgatgggcaaaccaaggccaccgatggaagagaggagcatctaattanaagaaggctgtgccggcgaggccgcggtggaggaggttgtgcgcgatcttgtccctggccttggcggcggcgtcggagcgcacggggttgtccagcacggtgaggtcgtcctccacctccacccggagctccggcggcatggcctcncctctggcctcgcagatgttgtggagcacgcagcaggcgccgagcacacgggcaggtcctggagcttcacctcggtgcgcttctgc

SEQ ID NO: 71308 - DNA, 446 bp, Triticum aestivum
  unsure (1)..(446): unsure at all n locations
  Clone ID: PAT_TA_71308
agaagatcaagagacaaagcaggagccatccgtcgccggatgcacatcatccaaactttttgcactgcacatagagaagaacaaagctgcaaagatgacagaacagagttgcacacaggaaaacttcttagccgtccacaaatcatccatgttttttcgattgttggctgaacctcatgccggggggcgccagctgaaatgcattagaaagtttgctgcactgaattcaccccaatcaacagcaaaaacatgggggtgggnggggggcagcttactgctcttccaccgggaactgcacggccgcgacgcacgaactgcacggcctcgacgagcaaactgcacgacacagcgatccagcaaaactccggcggacctacaccacccatgaatcgaactgcatcgggagcctccaccgtcttcaggccagctcgtcagaggggagggga

SEQ ID NO: 71309 - DNA, 544 bp, Triticum aestivum
  Clone ID: PAT_TA_71309
tttttttttttttttttttgaaagaacaaatgagcttaaaagcatacatattcattcattattttttacacggccacagaatcaacgatgcagtgcctaacagaactgcactagggaaagacttgcttatacaaaatgaccatccattcttactacctttttctctctgtgtttcccataaacaacaaatcaaacttcaaaatgaacatcaatgttctcttctccttcttactaagtgcactgcaaatgatttcctgaaagaaaaaaagagtgagatgcaaaacaaaaagtaagctgctgcaaaaacaaaactaaactaaaccgcagcgacgagacgagtggcctgcatcaatttttcttccacacaacgacaaagtgagatgcatagaatattcaaccttttccaattacaatcttccaatttttttacatttggcaacaaagggaactactgtgagagagaagatcactgcagcgataaaatgatgcatgttgcagaaaggtcatacatatcttaccacaaccgtcgatggatgaactacat

SEQ ID NO: 71310 - DNA, 578 bp, Triticum aestivum
  Clone ID: PAT_TA_71310
ttttttttttttttttttttttttttttttaagaacaaatctgatctagactgaaagtatctctctacaaaaaaaaaggggtggtacaaagctagctagcgagctaatagctacagggctgccacgaacaacaaccgctgatgatgaagagatctcggaggaccaccgggttgattatgtacaagcactggtccatgcgcgattcagcagcagcaggagcgccgagcatgtgatgtcttgtaccaagaaaccgcacacacgcgatggtccagcgccatagctggggtgcacgggcgcttttccttgatggccggccatgtgagacgcgccaatgctgccgttcacttgctttcaccgggcgctccggatgaaccggtcactgatgcaccggcaggccgtaattctggaacgacctgatcctgccgtcccaccccgccgtgacgatcacccggccccaggagttcgccgtgctctgggagcagttcctcagaagcttgtgctgcgtctcgtccaggcttgcgccgatcgagccagacggcagcatttcctctggccaagttgccgaggcgcctttgcac

SEQ ID NO: 71311 - DNA, 400 bp, Triticum aestivum
  Clone ID: PAT_TA_71311
tttttttttccacatcgccaaatagtttccaaaaagtttcctacttggcaaaaattagtttgtcccaagcctcgcttttacaacaaaattgtcagtatcaccctcgaataactaaacaatttgcaagagcaacttcatccagtacgcatgatattaagttcaaaactcagatcaaagcagtggcatggctacattctatcgttgctaaacaaattctatgtatccacagcttcatatattgttacggctttgcacaaggatgatcaggattgagcttgtaattcatcgagcttccaggctggaagctgaaaactgctctttgcaggtccagctaggcgagcgcataaaattgtcggctctcattagcgatctgcaccgctgatgatcattgatgggtaag

SEQ ID NO: 71312 - DNA, 467 bp, Triticum aestivum
  unsure (1)..(467): unsure at all n locations
  Clone ID: PAT_TA_71312
tttttttttttttttttttaaaagatatacttgaattgatcggagtggaatgatattacatcgatggagtagtgctccttttatagaggattacaaaccgactatagaacgcatgtgctgacgtcaagtgcctaaatgacatcatgacttacgttgtaaagcttagctactaagccacgcctcctctactgctcaggaaattactactgccgacatgcagctactactaccttctatcacttcatagctaagtaataactactactgccgttgcatgcaagttgtgctgctacatgcatgtggaagaccatccgaagaccaggttgacccaacattcatggccttgtgctcaccatcgcanagtcgcgcgtgccctgcactggccgtcaccatggccgttgagcacgacctgcgccgcgtgccgtcgggaccgtcggcaccaccacttctggccacactttctggag

SEQ ID NO: 71313 - DNA, 600 bp, Triticum aestivum
  Clone ID: PAT_TA_71313
ttttttttttttttttttttttttttttttgaacagagaaaataatcatgcaagatatgaaacatgtgcttagacaccatctcctttgtcctagtaaaatcctcagtgggccagaaaacattccatcactaaatgaagtagaacgccgggacaacatcataggctagatacaaaagcttgggcttgtaaagaaggcaatacaattttcaagatgggcatcaactacatcatagaaaggcttggaggctttactggctaccaccacaggttggtggtcttggcagcccaagttctaattaaatttggtatatagcatcttctagacccttctcttcacacgttgagcatccgctggagggcaagtcaaaggggtcatccattgacaaatcatgggtatccctgttgtgtgtgaaatcatcgctagtgccacatctcatttcaattcgagcatctggagaagctctacttgtgactcgtagcaggctgagttgatgagcaaaccatccgtgctggcggtggtaaggcaatgtgattttcatttcctctagcccttttgtattcagaacaaagaacctggcaaagtcaacatatgaactcttg

SEQ ID NO: 71314 - DNA, 627 bp, Triticum aestivum
  Clone ID: PAT_TA_71314
tttttttttttttttttaagcaattataattatcatcacattcaaaacatgtgtgcacggagtttcaaaaaacaaaaaaacatctgggaatgtatctaaaaacacaagagtggtcaaatgtacaaacaaaacatccatcttcaaatgctgctatgcatacaccaagaatgccttcatcgccccaagaatgcagcacgccgcctctagacgaacatcttacctgcctcatgaagatgctccagtaattttcgcacgttagcaaattaccaagacaaggaaatcaagttaggggccaaaattcctactccttggcgtaccagaaacaccaaagcctaaaagtttccgtatgcaaccatcaacaacccaaaatccaactcataattgaaccaaccagaaccaatctcttatataacaccaaaacaacttgttgatccatgctgaaattctgtcatcatgtcccccaatgagcacctcataaatatgaccaaatttggacccaagtgctaaaatagccagccaatgaacctcgacaaaacaagtctacttgaccaactccaacaattgtgacaccataaactgcagcctcatgtgaatgctagttactgcatgcatcatccatccactata

SEQ ID NO: 71315 - DNA, 613 bp, Triticum aestivum
  Clone ID: PAT_TA_71315
tttttttttttaagcgtatgccaactgaacgcaagtcacataagaaattgtacggttcgtttataaagccaggcaagcgcctcttttctaaaaaaaagttgaaggggacattgagaagagcgacggtatcggcaatggtatctgcctctctagtccatctaaatcatgatcgactctatcatggttcaacctcaatgcgaaagggcgacatggacatgattcttatccatgatctatcaatctccagacaacgcctcatattggcagcaagccagaatagatacgaaaggggtcatcgttaacttccatatgaagcagctaactccatcgcctaaaaacagacactaagacacccttgaattcaaaccttctccaactcaaaagaagaaaatcaacccttctcagtttgatttcaacgtccaggagagtgagaaccagtcaaagcaaagagacagttcttggaaaggaataacaaatcaacagtcacctgaacaacatatatccaaaaggccggatcagagtactccaaatggcgcacggtacattgaattaaagtgtgatccatctgccaagtgatgactaatgactaacacgaagaaggatatctgccgtt

SEQ ID NO: 71316 - DNA, 520 bp, Triticum aestivum
  Clone ID: PAT_TA_71316
ttttttttgggaaaggacctatggccatatattatgcatcacatgtccttacaaacacattcatacaaaaaataaaaatacattcatattctttggggtgccaaagtcttcctccttctgcatccattggcagtgtgtcgtaagcatagctcgatgccacctctaagccactgccttggcaaagcaaacatttttaaacccaaaagcttgtaaaagcagcggccgaaaagtcatcgatgtgtaaaccaaaagacctttgggcagcctccttggtgaagcaaactttttaaacccaggagcttgtaaaaaaagcaaacggaaaagtcgtcgatgcaaaccaagagacaccggcagccacaatctgcaaagcaacgacgaccctggagaaaaaacaccaataagggtctgaagaagctccgaagaccacggaagccaaccgaatcttgactgatccaccgaaaacataaatcgatcggatcacgaaacacccaccatagacatggctccacatgtcctctgt

SEQ ID NO: 71317 - DNA, 472 bp, Triticum aestivum
  unsure (1)..(472): unsure at all n locations
  Clone ID: PAT_TA_71317
tttttttttttttttttgtaaataacatccaggttcttcgcccatgcaaatgattgcatatcaaaatattttctgtcaagtgatgatcagtgatttttttacataataggaattaataaacaatgaactaaacctgctcgaatgctaagaggtttctaacaccatcaggttagaaaaggataatgtaatcatttttaaacacatcatgatggctccatgtccaggtaaatctttgtggcagcaacaatatagtagaggcaacagaaaataaaataaaaaggttgttcctccgttgatgttcgtcatggtgccgaggaacatttccatcccgagaaagaaacacaaacgaacgttagttagcaatggaacataaatgtattgaatacaggatgaggcttangatgatcagttgactggaaaaaattcatagagtcattgtgtcattcatatatggaggaaacattgttcgttt

SEQ ID NO: 71318 - DNA, 468 bp, Triticum aestivum
  Clone ID: PAT_TA_71318
tttttttttttttttttttttttttgcacacacttgctatattctggactcaaacacagatacaagtgatagagctgtactagcactactactacttacgctacagaagctagcttgcttctttgttctggcgctggatataaatgaaatggccttattacaaccgaaggacctggggtcctttatataggcccggctggaggtgctcagcactcacactcgaaactaccacgtacttaccacaccaagacttccggtcaagtctcttgcaccggctaaggaaactcactaggaaattgctaggtaagtaccacttccttacaggccaaggaaggtactgcccgttggtgcagcatgcatgcgtccgagaccatggttgactcaacaatggagactaatgatgttgcaaattaagcacaaccagtcatatatagctagtaacaaaatctgcatatgtacatactctca

SEQ ID NO: 71319 - DNA, 463 bp, Triticum aestivum
  Clone ID: PAT_TA_71319
ttttttttttttttttttacattcaaccaaggaacatctgaattatagaacggtgatgaagaccacctgaagaaaaatcggtagtcgcatatctaattttctttacacgtgaccatagcattgggactatcatatttatatgcaatatggttttgaggctaagggaggccatctcaagaatacacaggatgtgagattgcatacccatgttaatttgcaccccaaaaacagcacaaagatcacacaccctcttgttcctgaactctaacaatcttcctgcaccttatgtgaccttctccctgcctctgtggtgaccttcttcctccatctgttcacgagggtagcggcaccaggcatggttcgtcatcctccctggtctgcacacatagacctgcctctgtgttgaactttttcataagagtagctcaatcgaggaaacttacgatgacttgaacttctgaag

SEQ ID NO: 71320 - DNA, 522 bp, Triticum aestivum
  Clone ID: PAT_TA_71320
tttttttttttttttttaaattaaatcattctttgattatcaattattgcacaacactactgtacatccaatctttccggagcttcttcaactgatgctattgcaatgttgaagcactccgttgcagccctgtcactgcactggcaatcttgccatttgagcttctgatctgcatgcttgcagtcctcctcgtcctaagcttcggcatgaagagggtgctaagcatcttatcaaggccttcagcgctgtacttgacgtacttgctcgcgctgatgtcctgctcaacaagcggcccgtagttctgcatgaagctacggtaaacaggcactatagcctgcaccacaaggtggcacaccctctgctgcagatccttgtctggtatgatccacgcagactgcttctggtacatctcatcaaagctggcgttgaacgatttgagccgctgcttcaccaagtcccttgctgtagcctgacccttggagaacaagataaaccctccctgctcagcaggggcgcaagcgt

SEQ ID NO: 71321 - DNA, 644 bp, Triticum aestivum
  Clone ID: PAT_TA_71321
tttttttttttttttttttttaagaaaataaataataactttattattgcctctagggcatatttccttcagtatctctgtcccaggggccacagcaaatccaggcgggccagcgcacacaccagggcttggggcggtccaagaatacgcgggcggtgcactcccggacggcacattagttgccggggatctggggatatcagatacctgcaagggaacaatcgaaaagaatgttagcaaccatgtagaatctagcatttaagacgatttgtttacctcgaagcctgcatccactccgttcttcgctgcgtgcttgcggatctgaagcttcatcgacagatcggagtacgacgccatccgaggaagtggtagctgctcacacccttccatgccatgctcatggtagtcacagaagatgatcttcaatttgtatagtcaattaaaccaaatgaaatcagtgaccatttcgcataactcgcatgcatgtgctagtaaacgaacggattttgcttggctaacctgaggaacaatgaggcacccctgaagagaaagctgaggtgggtcatgcaacaaatcatccctcagttttgctgcagcctctctcaacccctccactacttagtcacacaaatcatattccgata

SEQ ID NO: 71322 - DNA, 490 bp, Triticum aestivum
  Clone ID: PAT_TA_71322
ttttttttttttttttttttagctcagtacaccggtacagaccgtaacgatagcaacgcaccaggccacacgttacgatggctcggcgactttctcgtcttgccacaggttctttcttcttgtttatggcattctaaagacactactttctccgtctcaaaataagtgtctcaagcttagtacaacggagggggtactatagaggagtcttgagatctaagcatactgaaacagaacaaaagggggctaagggaaacctaactagccaatcgcttctctttctaccacccgccttgctttggcatgcagaaatgcactctgtgcttgcacatctaccgttttgccggtatgacgtatctgcccctcattccctggccatctcctttgttgctcatcctaaactcttgtctcacccaggcctcctccgcatccagccaatcctcatcacgaacaacaataactcattgaaatattcttctgacattcgcct

SEQ ID NO: 71323 - DNA, 541 bp, Triticum aestivum
  Clone ID: PAT_TA_71323
ttttttttttacttgtgcatcctactgcggtgtagagatttctaccatacaatcaaagttaacaatgatcctattgcagtccatatgatccacaaggataagaccatgaagaatagcatatgcttcagtcgtaccaccatcatatacttgaccgattaattgggttgttatgacaataaaaaatctgcggccatcaagaaggatagctctagaagttccatgattcatgtcctcgtcaaaatacgcatccacataagtttgacataacattttagcggtctttcccagccatgatgtcggacgctacaagatctagttgaagctctctcattgttcaaatcaaaataatgatggccctgccgaatgacttggggtttgaacgcgttccctagtgatagattatcgcctttctcaccacacgtaccaaggagcaaccatgatcatgatgttaagatcagcatgaccaatcattggggaacgatttcattcagacataggaggcgttccaggcatgaatctgaaggtaagccgacatgttacg

SEQ ID NO: 71324 - DNA, 540 bp, Triticum aestivum
  Clone ID: PAT_TA_71324
ttttttttttttttttttttttttttcgacgctgcaaatattttttagcgcgcggcgctaccgcgcgtctgttgaagatgcttttacacgttaatgctgacgtttcggatgcaacattgtggcaatacatggagggacaagatcacaacggctcttttgtttagccgaacaaatggtaaaccttagcgagttagcgtgccaacactagtgtttttgattgccgattccagcttgaaggaatcgcagccgatcaccctaccttacccgcacttggtggtggccacgacggggctccggacgcggtgcttcccgtccgaccactcaatgctgccgaacacgtagccggcggccgcggtagcgtcgcaaatttccagcttcaccgtgaactccttctcctcgttgattttaccgaagctcagcgtgcctggctgcaccgtgatcctgacacccgcagctggctgcacgacggtgacgttgtactggagccacggccccgcgcccacgttcctcacccggcgcttcaccgtggtggtgccggag

SEQ ID NO: 71325 - DNA, 584 bp, Triticum aestivum
  Clone ID: PAT_TA_71325
ttttttttttttttttttttaattaaaatattagaggccatatgtggtcggcaacatacttatgctatgagtacatcttctgtcaacatggacggacggatgctgcagcgcatacttatgctatgagtcattaacctcaggttacgactttgttgtgcccggttacgaaatggttcttaccggacacggtattgtggctccccgatacaacattgttgctcccagatacgatatttttgctcccacctacgtcattgtgggtcccggatacaatattgtgcttcccaatcacgacatggtggctccctgacgcggcatggttgctcccagatacgacatggttatccccagttacgacatggttattaccatatacgacctggtagctcccggatacggcgttgttattcccaattatgatagtgttgtcgttcccggccacaacattgttgctcccagatctgacaacgttgttggtcccagctatgacatttggcgcatgcttaagttgtcggcgaagtgtgcttcttccgctacgcttcagatacaatgacatgttagtgaaactgatacctggtgaacat

SEQ ID NO: 71326 - DNA, 434 bp, Triticum aestivum
  Clone ID: PAT_TA_71326
tttttttttttttttttttttttggacaagggaaaacacataatccaaagttcatagttcatcacaagttcacaacaacattgttgaaagtgcatggttcatcacaacatcattcaaggtccatagttcatcacaacagcacacataattcgaagttcatcacaacaaaagaatggcacgaaattatcacgttgacctcaacaatccacatgagaagatcatgtagacatccatcttcaaaatatcaagagcaacacccacatggcgaatatcaattgttgtcaccccccacatcaacaatcttgggcaacttgatattctcaacatcgtcctcctcatcttcatccctctccaccaaattgaagtccttgtgaaaacctttgatataactagcaccacacaccaaggcttcgaccatttctggtttcaaagaa

SEQ ID NO: 71327 - DNA, 568 bp, Triticum aestivum
  Clone ID: PAT_TA_71327
tttttttttttttttttttttttaaagatagctcccttatttaatctcgcttcaaatcaaaagaacaaagcatactgtgttaaacttataataatgtaacaaaatctatatacatgtatatactgatgtgctactaaaaaaaccattgtaaaagcagcagccaatgggaggagcagcacaaacaaccaagctctttgaagcaccgaagtattgggagattcaaattgaatttcactctttggataccaagccaggtcctcttatgcacttgtgtgctctttttggcatgctacttcaacacacggaaaaaataattgtactcaatatcctccggctgaccatatgtatcagatttgtgagaacatcttgggtaattttcacgaatggccgcaggtgatagaacacgctcaagtcgtcaagatagccggaagcgtggttgacttcctccccttcatcgttgcccattgtgtccgggaagtagtcatcggccaggaggtcggtcacctcccaaaaactcggacacagtaggtgccctcactggtcatccactctatctcgcgcgtacgct

SEQ ID NO: 71328 - DNA, 465 bp, Triticum aestivum
  Clone ID: PAT_TA_71328
tttttttttttttttttttggttttttaaccaaaaatatgttattgtcatgcatgatggagcgaaactctccaaaactcaaaataccttacacaaatcaacaacacaaaaaataaaaatcctatacattaagtgcaagcagcatcctatagtgcgaacacccatttttcatctagtaactcacactgtacatggacatgcagccaaagcttcagtaattacatcacgcgtacatgcggtggttattgaacaattacacaaagatccacactctcagaaatgacatctccccacctagttatcatcatagctggtctttttcatcatcctggcaaatttgccaaaatctatctccccatcaacattttttcatctgcctcttgaaaatattacttggatgtcttttggagggtgatttttttcacccaactcttctggtaatatgctgaatatcaacatctgaaat

SEQ ID NO: 71329 - DNA, 460 bp, Triticum aestivum
  Clone ID: PAT_TA_71329
ttttttttttttttttttaatatataggatcgatcctaataacataactcaaatgtcatccttacataactcaaatgaaacattaacataactcaaatgtcatctttatatctcaaattccacatcattacaataaattactttgacagaataaaaacttaaattattagctagtagatctccgtgacgatctttcacttcgaattctttgatagtctgcccacatcctgttggcaatttcatctctcatagaattaccaaggtccctttgattgcttgagggtgtaggaacatgtcgaggtatgtcatctccatcaggaagagtgacaaatagaagagggtcaatttgcatttgttgcgtatctagccattgttcatcacctctgtgactccggattatattgtgaaatacagctgccgccataggaattttgacttgagtgtcaattgggtaatgtgt

SEQ ID NO: 71330 - DNA, 538 bp, Triticum aestivum
  Clone ID: PAT_TA_71330
ttttttttttttcccgagcaaccggcaggagctctgccttttcattaagaagaagagaattgacaagtttataaggaaaaccggccgaaaaccgatacatctacgatacacgcacacgccagccccgaggctgcgcagcactcgagtcgacgacactgtcacccaagtgaccagagacgacaccctacaacagaacactgggctccggagccgccgctcggacatccacaccggccccgaggtcaggcaccagcctagtcgatggctccgccgccctagaggccaaagccaacaccctacgcacacgagatctccggcgccgccgcaccgacttccactccggccccgaggccgcgaacccacctagtcgatgaccatgtcgccctggtgaccaaagccaaccaccacacgaaggagattctcggagccgccgctccgacttccacgccggccccgaggccgcgcactcgcctagccggtgacgaagatgcaaagccgcagagccaccaccagcagatgaaggaccggaccttcaaag

SEQ ID NO: 71331 - DNA, 505 bp, Triticum aestivum
  Clone ID: PAT_TA_71331
ttttttttttttttttgtattgtcagtacataattatcatgtgagagggagacaaacacacataagaaacatgcatatttgtgaagctcgcgatctgttcagaatgttccaacagagtggattgatgacagttaaagctagcaaaacaatgggcaaaatatgctttgcatctctcatgtgcaaagtaccaaatggctccatatgagcttctctcggcacaaacagctaaccgttgccaagttctagaattgagtctaccaagcccaggccaaccgctctcatataagttagccccaaaatagaagagatcctactcaggtttatgagttatatgcttacttatgtttaggcatctcgattgcatgccctgagaactcaggcttgcaagtttgattggtgccttcttcctcggatgtgactctcgaaatcagatcgagacaggcagttagcattgcagatgttgcacatccatcttgacacttcagttcccttgccatctccctgc

SEQ ID NO: 71332 - DNA, 349 bp, Triticum aestivum
  Clone ID: PAT_TA_71332
ttttttttttttttttttttttttttttggcagaggaattaaattatataaatgccaaacaccaggaaaaaattcttgcacacaaatggttgagttattcaacacccacaacaggaatagacagtgtcgattatagtttacgacctcacaccaattgaatacatacaatatttgaaagcataacgcataaagtcatagcacaattcaatcttacaccacgagcaagtgctttgtcattcaaaagccataaacgaaatatttttgcaatctgaatatcgtggggcatgaacatatgtgtgttgggcaaatccactgcaggcatatgcatggaccgcatatatgccttcca

SEQ ID NO: 71333 - DNA, 630 bp, Triticum aestivum
  unsure (1)..(630): unsure at all n locations
  Clone ID: PAT_TA_71333
ttttttttttttttttttttaaaccacaaatatgcgttgattgatgacaccagagacactcgatcggcttgattggatgcgtgcgcgcgtgcgtgcaatgccgccgccgccgccagagccaagctgctgacgagtgtacagcacaatactcactcatgccgttatacaggttcagacattaattgattacttacgtactacttagcgctcgggagcctgtctgatcgactccgcacttgtactatgtactctacagtcgtcctcctccgccggcatgttctatggtaggtagctaaggcaggcaggaggagtagcttgttattcttcttcttccaggagatgagacgagatgcatgaggaccgtctctgaatgatccatggccaaagacacaagaatcagctgtctaaatagtaggtactaggtatagctaggtgtgtggcgggaggttatctctcaacggcagccgcacgaactgcccgcgcacccgcgggcgctgctcggccagtctcttcctgctctggtaacgcaccttcttcncgaagttcctctcttttctcttctctctgaacttgttcacggcggccacccggcgctcccgtttcatgtgcatcatgttgcttcttttgtcg

SEQ ID NO: 71334 - DNA, 612 bp, Triticum aestivum
  Clone ID: PAT_TA_71334
tttttttttttttttttttgaactccaaaatttggcacttgagtaccccagtagttaactgcacaacacagcactgcacactgcataaccatttttttcaaaatgcaaaataaaaatgaacttcattaaaactccactgcaaaatgtttttcaatacagcttcctgcagttaaacatccaggagctggaatagcgggaggatattggggaagaagagaaccacccacgcgcaggtgtgccgtgccacaccctgattcctgacgcggcagagcccggccttgcctcagacaaagcaacaggagaaggtgtggtgcagccagcgccatggatatcacagtaaactgcaaaacaaaatcccgtgagattcaaaaaaatcaaaatgaacttcaagcagcgggtacaatgcgtatgagggaggtgctggagccatggcatgacaacgggcgtgatcttgtgttggggaggccggccaccaaagaggagggaggaagcagtgggagggaggcccgcgctcgccggtggtggaggcttcgggtgttggggcaagcccgagggaagaaggggaatgggatccggtggtggaagctcggtacagcgcggatcatgccggat

SEQ ID NO: 71335 - DNA, 537 bp, Triticum aestivum
  Clone ID: PAT_TA_71335
ttttttttttttttttttttttttttttggatgaatattgtgttgtattgacctgaccctcgtgggggtatatatagagtacaatatgtgagagagacttggagtaggggacaagtcgtacatgatttaaatcaatcctatctctaactcctaatctctaatttaaacataattatacttctaataagcagaggtgggcgttgtcacagggctgcacgcggtcagaagtcagatgccaacaaaattggtcagctttagatttgcgtaacaaattactcaaccctgtaaaactagtcagcttttgcacaaatctctaaaaaacaggacagctcattgaatggtatagataggaggtaccacgtagctcggtctacaaaaaaccacgcaatgtgatgtcccaagccagcgttgcttatccaacagtaacaaccacgagctttgttgaaccatcatataattttcaccacgagctttgctgaaccatctagtataattttcaccaggaatgaattgcttcatgaatcccgcccgcttcaa

SEQ ID NO: 71336 - DNA, 590 bp, Triticum aestivum
  Clone ID: PAT_TA_71336
ttttttttttttttttttagtaatcacattatctatggctgctgcacgccaatgttttaataagaacaacaacaaaaaagcattcttatcacaagagtgctaaatacaatacaaccttactttctttttatagattaagattacaaatgaatagtctaattagttaagatccacaatccttggtagcacaatcttggacaatagcgccccaaacccctatttacctcttacagaatcgttgccctactgcagcgcgccgtgatgtgactattctggagtgcagcaaggccgaacatgcagacaccgcaagcgccctccttcggcgaggcctcagcccacgcacgccgtggtcgtccagtccagcagggtgcttttgccgagtcggctgttgtgtcgggcgcgtgtgtgatagcttgctacatgctactgctgcgtacgtgtgcttgcttggtgggtgtttgctgtgttagctgtcatgcgcacttgcgttgtgctggataggaaaggagatgactgcaagtcataggcgcttacttgtcttgtaaaactacagaagttttccatttttcatcacatctttccaagcattc

SEQ ID NO: 71337 - DNA, 538 bp, Triticum aestivum
  unsure (1)..(538): unsure at all n locations
  Clone ID: PAT_TA_71337
tttttttttttttttttttttttttttttttcgangatctgctaagacaaggagcatgccgcctataggccgagacctgtacaccaatgaggagtgcacctcatctcggctggacgccgtattcgatggtccgtcaagacaaaggaaacacatcgttgaaagggtcggtgaagacgtgtcatcgcgtagcaccatcttcttcgtatcgcaagctccatgttgcgggcagcactgagggcgtgtgtcatcttcatgggctccagattgcgggctccagcttgatgaggtaaacatcatggtgtattatcccgctagctccatgcctccgtcctacgcggcgccggcttgatgatgttgatgatagacgccagtcctggcgagctccatgtctttgtcgtccttcgcggcacgtggcgacatcctcgcgagcttcatgcctccggtctagcttgatgatgttgaagttggtggcgtcctccttgcgagctccacgccatgattctctatggtaccgggttgatgatgttggcgatgggcg

SEQ ID NO: 71338 - DNA, 550 bp, Triticum aestivum
  Clone ID: PAT_TA_71338
ttttttttttttttttttttttgcggctgatattacacatccagacacagacttcagagatatattactgcaagaatgctgatattacacatcaagacacagaagtcttcagagattcaggcaagaatattcatgctgatattacacatgccaatagggagccatgttgatattacacatcaagacactgattgctactacggatcactcacttacttcaatacatatgcaagccttaatcgatggaacaacaggccattcaacctctactattttcctatcaagtagaaggtactgatctacatgcaacctgtgtcctccaagcttcaagttgcctttgacatgtatacgacatccgacgggaagacccaaaacatgtctaagtaaagggacttcaaattttttctgaccgacaggatatagaaggactcgacttttcaagattgtgaacttagtgtcatacccttcaacgtatagcgtaagcatacctcggaggttaaactgctcctcattcaagggaccatcaaaacctaacctaactgtacatcta

SEQ ID NO: 71339 - DNA, 578 bp, Triticum aestivum
  Clone ID: PAT_TA_71339
ttttttttttttttttttaagaaaaactgaaatatatatagattggcataactaagtttgcgagtcgctgctgcgacacaccaattagcctagaataaccaaaagaaggatgtacaagccgtgtatgatacaactggctctgtcaagttaatctgcccagctcgttcatgcagagctcacaaaaggctataacattaagactgagacccactatcatatgcaaaatgatccggagttcaggtcaggcgcaaaaggcggtacttattcatcccttttgccctggagatgcttggttaggtgctaccatggcagcagtagtatcatcttggatttgttgacgtgtccatgcaatagaatgtccaagtgcctcatccattgtgtttatgtccctgagagggcgtatcagaggagcctttccatccaacacttgattgaccaacactaggcaacatccaggtccaagttccttgtccccaactattgtagatgtacaagatgtttgaagagtagccttggctactcgacgatgtggccgtacatgtgaaagtaaaaagacctctttcccaccctccacattc

SEQ ID NO: 71340 - DNA, 395 bp, Triticum aestivum
  Clone ID: PAT_TA_71340
ttttttttttttttttttttttttttttttaagggaggcacaatcatacggcaacgttctaacaacacagacaaacaacaatggttaaaaatataacactaccgatagcaacaaaaaatagcagcccctaaaaaacctcgggcatggttcttttaaatcacattctctaaaatcagctcgtccccggtgtatcccttcccttttaaaaatatgacactacagataggcatggagatcactaacttacagagtgggtaagcaccgcaaagatgacattcatgacctgggcacccgtgtatcccttctctaaaatcagcttggccatataccatgcccccagagaatagtcgcataacaaaagtatcatgacggtgcccatgctcgatggccagtgg

SEQ ID NO: 71341 - DNA, 418 bp, Triticum aestivum
  Clone ID: PAT_TA_71341
cacccacgcaatttgatacccctctgattttcccaattagtatgttcccacaagtaatgcttagtcattaacactacgaatctactcatttagcaacaccacaaaccagtgaatgatcacgacttagaggaaatgacatatatagatagatcctttatcggaagataaagtatcccatggaaatccgtactaagtggaaacatggcaatcaacgtcagattccgaccagagatgtgtggtcctgatgaatatctttcgccccagcatcatttcattatgtttgcaaaagccaccttgatcttccgttctttctctctcctaacactcaccagtccccagatctcttccaaccaaccccaacatagtgccactaaaacatgcacaagctagctcagacctcggattcaattcttgcatg

SEQ ID NO: 71342 - DNA, 152 bp, Triticum aestivum
  Clone ID: PAT_TA_71342
tgtatagctggttaaacatgcattataccttatacatatgctagatggttcaaaatgaaggggacacggttttgataatgacatacattctgtccaaaagtggaggtacagttcctcacagggtaaggttgagttaatggctctgacaggtg

SEQ ID NO: 71343 - DNA, 590 bp, Triticum aestivum
  Clone ID: PAT_TA_71343
tacgtgaaacttcaatttggctaaggcaatgcatgtgtctagtacaaagggatgagtgataatactccggagaaggttagcaacctgctcaaaccaaatcctgaaatccacccatcaggttctctaggttagcactctaggtttgctatatgccattgtcgggcggccattttgcgcgggcaatgaaatgctcgttctggctacagcatgctcatggcactgggctgctcatcccacttctcgaatcggctacagacctggtgacttgacacttgctggagaatggagcgactgtcggattgtttgtccaaccctagcaacctctgcgaccctcgatacggacgacgaaccgcaactgctgccaacggaagtttgctcgtggaagaacttcgatggcatcgaagagagcttctcttcatgaagccttccgcagttcacaagctcaccaaggtagtcatgcaaggttttcagaatgcgcttctcttgctctttgtaagtgtctggcaatctctgtttggtggccgagggaattacagctgcaacgcttggtgtcaggaaaagcgatcttgctcgttacacatcagtttctg

SEQ ID NO: 71344 - DNA, 231 bp, Triticum aestivum
  Clone ID: PAT_TA_71344
tgacaattacgcacaaaaatcagctgatcataataaacacgtacaaaataaacatatgagacttaattcggtgacggaaaaaaacgcggcaaagcgcatgtcacactctagtatagttcataccccctgcccttccggtggtgctgcgggctttttacggagacgggtttttggtttcatcatgcgaggaccaaacggtgcgaggggtagccacggcgggaggggctgagt

SEQ ID NO: 71345 - DNA, 222 bp, Triticum aestivum
  Clone ID: PAT_TA_71345
catatgccaccgcttgaattgatttgtaaaatacatacgaaatacatataaatacatagtaacataatgtgaccatgaaagtgatgttctaaaacataatgctaaactatctagtagaagcccaattcttgacctcgcaatcagcatgtgccatgcatcatcttttttttcttggcaatctacaacaacagagaaacaagatcagtaacttatggtagagaa

SEQ ID NO: 71346 - DNA, 308 bp, Triticum aestivum
  Clone ID: PAT_TA_71346
attgtcacaatcatacagtagcggtgatggaatctcattttctaatgcatctgtgcgctgttgcaggatggagtgggcacccggtgtgcggcaagcgctaccatttcatcatcgagaacgacagcatccagatggctggccgtcgtcgcacctgctgcctgcgctgcgggactcccatggcagcttggatgcaatttcttctccaggtgcctcctgtgcaactttgacatggaaggcgaggagctggaagagtgcggctacctgcatcttgatgattcctctcacttgctgcacgccgttgttgcatg

SEQ ID NO: 71347 - DNA, 262 bp, Triticum aestivum
  unsure (1)..(262): unsure at all n locations
  Clone ID: PAT_TA_71347
tcaaattaaataatggacgggaacatacacatatatgtgctgtgacatggacacgggaataattaatgcngttgatcttcatgaccttccaatagcaatagttggtgaggtttcaatacctcgatgatatgcatcgctagagtgagctcatgattgctaaattcttctcgtcatctttgtggctcagccataccgcgatctcctctgtaaacctgtccatggccgccctcggcagcagcatcgacaccacggtcgagacctc

SEQ ID NO: 71348 - DNA, 391 bp, Triticum aestivum
  Clone ID: PAT_TA_71348
ttggaaaaccagtatgcatacatagtaagtcgggtcgaaacccatacatatggctagtatggcagattatttaggcagcacttatattttattggtgacgtaggtgcgctgatacacctgtcagagtgtgagcctgcctccagccagcactcattgagcccaccagcgaggccgaggccgatcagaccgttccagaggccaccaggcaaactaggttggggatgcgggccatgccacagatgccgagcacggaattgacgccatcgggaatgccaccgacaaggccaccacccagctggaagcccaagcacagacagtcggcggggctctgcatcccctggatccgatggcagcaccggttcttgtcggccgggcttgtcctgcccggttg

SEQ ID NO: 71349 - DNA, 423 bp, Triticum aestivum
  Clone ID: PAT_TA_71349
ttcgccttctgcctaaaaaaggaacaactcatatccaaacaaggcctaagcccggtcgaagtgccgcccaggtcatccaaattccgaaggcgggttggtttcggattctcaaaacaactatgagcccccccagtcccaaccccctccgccgagccgaacacagaatcggcggcgcgctctcggatggcagagcgagggccgggaggaggcccaggcggcggcgaccgggggagaccctcgaccatcaacagccacgcccctcctcctcctctctcaagatcccctctccgagccatacgaatccttgctccaccatcgcccgaatcccccatccgagccatctgaatgcttgccgcaccgtcgcccatacgacgaactgcggctccaagcgcgcgcgtaccgcgtctaaccgcaacccgctgc

SEQ ID NO: 71350 - DNA, 512 bp, Triticum aestivum
  Clone ID: PAT_TA_71350
ctgccccaaacatgagcagtgaaccttgaaagtgaaaaaaatggactatcgtttgagacaagtgcactgcaccttttcctctagaacctagacgtgcaatttaactttttattaggctcaacaaatatgtgcagtgcactttatcttcgtcttctcctgcaaaaatgacttaactgaaccgcattgcacttaaccttctttacaaacaaaaaagcaatccaactatcagtggtacaagagcactcccgcactcccagaagcgaatagcaaagcgatcacatccaaccacgagctgtctcgtcggtggactgcagacccaggagaagtgtagtattgcgcccaagcaaaatatgaaaaagcagcaaaattactgctgaacttcaaccgtgcggtagcctcactgcagcttttgttgttggggaattagagaaccaccacgctgtaatcgccggtgccaggccacaccctgtttcctggcgcggcagagcccgtcctcgccttagatggagcag

SEQ ID NO: 71351 - DNA, 469 bp, Triticum aestivum
  Clone ID: PAT_TA_71351
catgtccttgtttactcacagctaattctttaggtgttaattacagtattgaatcatggaagatacggcatgattctgacagggaacgggccgagtgaccttaattcagatctgcccaaaatgaaattcaggatctcacagctaatcctacttgacaaatacaatgccgcggctatgtgtcacacttctatacgatggataatttacatgatggctggctgaccttagaagagaacagccgttcttagttaaacatgcctttggcctgagagaaagcccactgaacatgttggtaccaacaggcaattccctttgctccatagcattacaagacgagtatcttgtgctttggctcttcaacacaggtccctccctccctgtcaatccagttgttcatcttacatcctaactccatgataatacatctaacagattaaccattgcaagaatgccaagtgtcagctatgca

SEQ ID NO: 71352 - DNA, 416 bp, Triticum aestivum
  unsure (1)..(416): unsure at all n locations
  Clone ID: PAT_TA_71352
ttataatcacaaaaatagatattcatacgacatagtatatatgcaaatacgtattagcaatctgcatctctanaagaagcatacacgaaccgcatgcacattaggcaaagcagtttatctgtggacaaataggattaaggaacggaattggccgagtttgagttgctctccattggtgaaccatcgacgcacctcctatagaacatcgtccattgtgactgggcatggaaactgctagttgtggcttattcatagagatcttgcacgccttcttatgaagaatgaagtcagtaaacaagtgaaaatagaaaatgtaggagtggtgattttggaatagatagttttttttttcatattaaggtccggcacaaaatgtggtcaggaaaatcacctcattcgtgtttgctttgttttgc

SEQ ID NO: 71353 - DNA, 536 bp, Triticum aestivum
  Clone ID: PAT_TA_71353
ctttgctccaaacatgtgtgattgaattacatgttcagacttcagagtaggttacacttcccaatgattaaaactctaggtccctacttggttccaaggaaacaaatatgtgtacagttcatactatactaactaatatgagataacaacagtgccgggttgtggcaccattatgcacaacaggtacagatgtaacccgtctgtatatatttgaggaaattctatatatatcttaagaagctgcagcaacatgtacatatgtgaaagactgcacacctcaacaaaagatgatgtttcatggaagccaccagatgaatcccaaaactataaagctctcgccttcggtagaagtttttcatcttcacaataatcttgacatcttgcacaaccccttctgaagcacacataaaacaatgatgtgccaagcaccatagctaagactttctccaagggaaaattgttacaattatatgcatattctgctaccaacaagcttataaacattttattgactattgcatctctcaactcaatgt

SEQ ID NO: 71354 - DNA, 435 bp, Triticum aestivum
  Clone ID: PAT_TA_71354
catactattagcaaattgtgtttgtgctatttgtggggcagttgagttgtaggtgcctaaaaagtgtaacactctaccgagtacacatgggtttgaattctggtatcccgacaccttggtggatggatgtaccttgtgatggcaaaatatggattttgtgaatgtcgtctagtcgggagtgcagtacgccatatccttgtgatccgtggggctgaaaacaacaagtccccctcagcacgacagggtggaatgcagaccccccttggacaaacagtacccacttggctatttttcagactggaccaaaatcttgacccagttggcgtctcgtgaccgccagcattggcctctcccggtggtggtagccgctctggtactgaaagcaaccaccgctgagcactgcccatgtccacggccagtcagtgcatcttcctc

SEQ ID NO: 71355 - DNA, 516 bp, Triticum aestivum
  Clone ID: PAT_TA_71355
ccattcctccctcctggctgattctacattttcttttctcttaaaactttttctaacttgtaccttgttctatgatatgtacagccagcctctcccaagaagatggcacaaggtatactacatactttacaatacaagcttacaacagcgtggcctgtgttaagtcggtcacggagcagagtctggtaaaagaggatctaccagtgtccgtggaatgacaaactggtcaacaacccgaactacgctggtcggatccgaccatcccgacgcggctcgccatttgcttgggaacctcctggtgtggctcatctgcaatggctccttgggctccatatcccagtctggatccagcatccactcttttggcaccttgtccacagccagggtgaacacctcaaggtctccattctttttgatgtggaaccgcgtgaacgccttgtaatttgctatgcgcagggaggagaaggcctcgtcaaagtgaatatggaaccagtttatacacacgtataagtagct

SEQ ID NO: 71356 - DNA, 674 bp, Triticum aestivum
  Clone ID: PAT_TA_71356
gaaactgcaagctatatgactgaatttatacagaaactgctgcagaaacaagacctatgaggctaccagaggctactacacctccagattattattaacagcctgctagttacttgcttccagctcactagtagtacattctaatctcctacttcagagtgttgttgctattctgagtgtaaaggtcctcatcttgttgatggtggcatcttacaaagaaaaggtaacctgcttttacttattattcttgttctttgccctccgaatactgaagtagaatcaatgtcaataagcattttcacaacctctctcatcgccggtcgctcagaaggggctcgagtaattcagacgatggcaatgttcaagacctttattatatcttctgatgcatagctgccggcttttagatcaagccgctgaagttatgtgatcaaaccccggacacagtttccagttcaccttcaaactggtagtctgtccggctacgtccactaagaaactctgacggcgcaacactagagctcatgtcactcttttctctcgcctttagagaatatggaagctagcgagctatgtaacaacgggtaccggcaaagcagctgatggattgagccctcgcacatggaaggactcgacaatccactttgagtcactgttatcaccactctcggtgt

SEQ ID NO: 71357 - DNA, 321 bp, Triticum aestivum
  unsure (1)..(321): unsure at all n locations
  Clone ID: PAT_TA_71357
caaatccttgcagcataaaccgaaacattaaaccgatggagtactttgcctcgntaggggcaactaccaaagcagagatctgcacctgcagcangacactagagaaacaagacagacacacataaatcaggcagttcattctccaacgctagctcagtcaggatgatgcaggccatatggcaacctcggagtagccgtcctcggtggcgcacgcccgaaacatcccggtcgtgttgtacgccatggtcacctgcccggcggccgacacggccacgagcccgacggagccccggggcacgccggccacgacgcgcgcggcgg

SEQ ID NO: 71358 - DNA, 718 bp, Triticum aestivum
  Clone ID: PAT_TA_71358
aattttgtcagtgcaaacaataaaaatacacaaagtagtatatgtgagtatataggttgtaataacatcttatattctaggacaaagggagtagcaacgtagagtaacacactagtggtgcaccgtctgaagtcgtccgaagtccagcatgaacccagcagatggttttaaactcaacagcattagtagcgaattctttttaattcggccgggcttgcagactcggcggagtactgaaccgatctttttttggaagtgtggcactgagctgattcaccaaccctcttcacagccttcttagagacccggtcgcagccttcaatgatcagagactctaacttcagtgcatgtactagcatggccactccagcatcagtcacctgtgcacagatccggagtgtgagattgatcaagcatggggcacgcgcaatgaaacgcatcccagcatctgttattgctctgcagcacacaagctcgagtgtctccagtaatggagcagatgagagggccttcatccccttgtcagcaaaaaagttggcaccccttagcacaagaacacgaatcggacaagactgaatgagcatgataaggccatcctgtgtgaagcctatttctgatggatataagggctcacaaccatcaaacgtgagttcaatagactcaagcataggacaactgacagctagagattcaggctgtcatcagtaaatgccgtcct

SEQ ID NO: 71359 - DNA, 643 bp, Triticum aestivum
  unsure (1)..(643): unsure at all n locations
  Clone ID: PAT_TA_71359
gtagaataatttcacctgaataatagtcaagaagttgataggctgtcttcagacaaagtgaaacatcactaatatggatggcgttgtcgacaagctgtgttatcattgtacctcatgggagaagaacaaaaattgcaacagattcagggcaccgagcgccgccatcgtccagaagaagtagtctaggtggcctttgtcgaggtcctccgaaatccacaccgttgtggatgcgacaacgcccagcacagctganttgaggtagttccccaccgcgacagcgagctgtgatagtgcagtgcatagggctcctcnattccgttctggggtgaccggtcatangaagagctccaacatgccaattaccgtgaacacctcgccggcacccaacacaacatacgccggtgcttgccacatgatgttcatcatttccccggtcgcggctaccgcgagccggttcctctcgagcagcgccaagtaggccatgcagagtgtggacatcgcgaagccaatgccgaggcgctgtgactgcgtgaggcctcgatcctcaccggtggcatgccgggccaagggcaccagcaccatgtcgtagatggggactagcacgagcgtggtaaccacgtgaagctggcgatggaggctggcg

SEQ ID NO: 71360 - DNA, 645 bp, Triticum aestivum
  Clone ID: PAT_TA_71360
caggtatgttcagttgttctatcggtttcacatttgagggggaagggctgatgcccacacgggccacatatactatatcaaccaaacaataaaacaggggagaaagtaacgaacatcatatcccataccttcatcctttcttagaaaccaatgccagcaaactgacaagctctttcctcacccttgccttcggtgcttgtacctttgtatccatctcaatctggatcttcagttccttccatgcaactttattcagttccttctccatcaagagcgcaatcttgccatctaattcagtgaaggagcttttgagaccaggatgctctccagcgagccgcttcacctcctgcccgactaggggatatatggcacacttttcctcaaagctcctgtcaatagtctgtccgtcgcacttctcaccctgggacatgttgagctctccgtctgcctgtttgacgtcgtcatcagcgagcgccacgagaatcttctgtttctttgccccttcctgtgccggtgctcgcttgatttttttttgacttgggcttgtccttgtccacagtctgaacgttgcactgctcagtctgggacaggtttagcaccccctcggcctgtttttttgtcccttcctgtgctggtgctcgcttg

SEQ ID NO: 71361 - DNA, 522 bp, Triticum aestivum
  Clone ID: PAT_TA_71361
tcatcacctggataactttcccctcatggtttatcatgcaatggtaacattgcccacacaacacgcaactcttctactgtacgtactagttaactatcaagtagtataacactcaaattcagctgcgccgtgcaagcattttactggtctagtactcaaattaactgccccatggatggatgctttgcaactctccataacaccctgctacatgggtcgggtcaggtcagcttggctcatatagtaagcaggacccgatggtcgaatgctttcgtatgcatcaggtcagtcctccagtggacagctccagtttcctcagcacagaacaagcttcacatgatccccagccaacgcttccttccatctctgagaaaggaatgccgacgcttcttgaccggaagacacggtgccttgtcgtaggcctacgccctctgccgactctgggttgccaccgactgaaccgctctcatctgtcacgacactggatggagaacggtcctctgctgccggtgtaatggtgcc

SEQ ID NO: 71362 - DNA, 521 bp, Triticum aestivum
  Clone ID: PAT_TA_71362
ggaacaatccaacaggtatccaatgcagccagtctcactcatcaacccatacagacatacagtgtagtagtagcagtattactgacggctagccaaataaacacacaaaacatatagtagtatatattgtataagtattatgttcttactaaatgaaagaaagaatctatggaagcagacttggagtgagacctagctagagcctagtagagaggatccatgcatgcacctagctagcctccatgggagatagaaaaaaccaatgatcaatggcgatcgactcatggatgcgcatatcaatgtcgacccactgcagacggtggacgcttcactctagcagaagctccagagcctcatcatgtcgccgtcctcctcgggctcctcccaggtgcaagagaagggcgtggcgtgaccggcggcgatgaggtccatgagcttgggggacgcgaacgcgtccagctccgtccacagctcgtcctgatctcccaccggcgagccagcgctggccgcggcggacatcg

SEQ ID NO: 71363 - DNA, 624 bp, Triticum aestivum
  Clone ID: PAT_TA_71363
ttctattcaacacataagtatcaagccattgagggaacatgaccggggagtaataaaatcgtgttacaaagttccagccttacaggcatatcttggcaaattctgaacttccatctagctgctaccacatttcacggatggcgaatcatctgccgtcaggcctctttggagaaggttcagcagagatcgcctgagttgggttcagccatggcggtgggtcatggggtgttcccccacgagtgctttgagtctagcatgcggagtgtagaagctgacaactggaatcagattacagaagccacgatgaccggacaccttcctcacccgcttggattgcagttcaattgagaagaggccagcaaccgtcactacgaaagtgacatttgcttcgtgagcaaagcccaacacttgcactgaatttattgcatccacgagagcatcatttggaagcaaaatattcaagttgatgaccctgctaagtacccatattgcatcagtgccgtaacttggctcttttgtccacaatttgagacgctgacccaattcttcactaaccccgagtgcaccgctctccgccagcattaggttatatctattgtccaacccatcatcatcagacatgta

SEQ ID NO: 71364 - DNA, 631 bp, Triticum aestivum
  unsure (1)..(631): unsure at all n locations
  Clone ID: PAT_TA_71364
ctctaattataggacagctgctggtataattctgtataaagatggaaatcataatcaaaataatcttttagtgctttttnaccctgaagcatctcaatatttgtggaaagagatggtgttaaagatgcaaatacaacatgtactgctaaagaagccacatgtgtcttctgccttgtctatcattctaaaggaaaaccaaacttgcagcgccaacaccaagcaatagactataagagaatgaaaggtacattctctatccagttctggaactgcttcctcccgcattagagcaaccgatgacttcctgaccatccaaatcactcgtggagggatgggaagatgattctgaaaccaacattatactatacagaatacgatataaagctctaactgggagaaggttatgagatgccacacttctatcacaacaattcaatgtattctggaaagaaaaaactatcatcagtgcactcagataacttgttggcctctttctgcagcatataggtaaaagtgtttatattgagtagttgtgatcagagtccagaattagacacctactgtaacttgaatttactttttatatattatgaaaacatgcaacctcacagttattttcaattacctggta

SEQ ID NO: 71365 - DNA, 605 bp, Triticum aestivum
  Clone ID: PAT_TA_71365
tctactttttattccacacatcaagggccacgttacagttatccaagcttgcttactgtatataccaggggaagcaacaacacaagcaagcaaagaaaaaagaaataaacaagaactagtacaacgcaactcaaaacagagtattcaactctgtactgacgtcaattccatgtaaataggcataattcctgtctgatcttcacacacatatattactaatattaggaaatcttttcttgaggggagtaagatgcgcaaatctactcccttcaagtttggtgaactctggtgagtaatctggcccacgcagactgcaatgagcagtgtagtatagtgattggagcggcaacgctgacctgcacaacaagacttttgcaaacccgatatcaccacgcggggcaacaacactagcacccgaacttgcctgatataccaacctggccagttctgtctgacatcgatatggagtcttagaaatggtcacctcacatatgtttgcgtagtttggtagcaaattctctgccaaatctgcaatgtacccaattccatcgcccaacagcgacagcccccctatattgcttcccagcaccttgcaccagaaccgg

SEQ ID NO: 71366 - DNA, 541 bp, Triticum aestivum
  Clone ID: PAT_TA_71366
aagcacataccaaattgattccctgtgcaaaacattctccttctgaacgaatattacactacacattacatcacgttacaggaaaacatagacagaatacctctgcagcagaaaagcatacgtcctaccaaaaccaggcaaatcaaaatagccaattatctatatcctcctcccagtcccacatcacaagcagcgtttagatgtgcaacacgctcatatccagctccccgctctcaagaacctccctaaccttcttgtcacactcatcttcttcgtcagtctgttccggtacactgaccttcgcgttcttttcctcatcatccgataactcgtccgcgtagccatagcctgatgtgcttgatcttggcttcttccttgcgtcttgcacaatctccatgatctcttgggttgtttgcttcgagaaagaaggcacgctgctgctcctctcgtagtagtctgcttgcgcttcctctgtgagctcccgcggcaagttcttcaagaacatgggtggctctttatctccttcattgtgattctcttc

SEQ ID NO: 71367 - DNA, 486 bp, Triticum aestivum
  Clone ID: PAT_TA_71367
aaaaataacactaacacaaacattatttcctcactgaaacagaaatggcaggaaggcatgcttgcttgcagcgctacaggagcaccgcagggaagaaagttggaagaaaggcatgcatgctagcttgcacagcctttgctagctgatctcagcactttgagactatggactatacccttaaggtttttgctctcctttttttttttacctacacacaaattaattaaaggacactgttggtgcagtgctaggcgtaggctggtcaccactccatggctccatgtacgggtctccaagctcacctgcgtcgatcggtcgtctacatgaagtccacctcaaagagatgcatgttattgttgttattgttgccggcgccatggttgctgttgttgttctggtcggagacctcgccgttggccgctccggcagacggcaaccgctggagcaaccgacgagcacacaggatgttgctgttgttgttgctgc

SEQ ID NO: 71368 - DNA, 445 bp, Triticum aestivum
  Clone ID: PAT_TA_71368
ttttttttttttttttttttatcggttgaagtttgacattaatttagaaaataatgtgtacaaaacaaacagccgttgacaattaaaattgaccaaaggtattgtttggacagtctttttctggatgtaaaaatgcaaacatgaggaaatcagatatgtgtatgttgggcatagtgatttgtaagctcggcaacaatctcctcgctactgttctacacattcaaaggttgccgacttgttaatttaagttgttcgacagttctgaagaacgccggcaacttgcaggctgcccttacatgctcggtatatacatatcttcactgttgctctgcttctctttgggtctttatggaaacctggtgttgattgctaacgcatgctgcaagcagctggcataccaccacggcatgatcaccaatctgttaaactcatcgatcttgtatgt

SEQ ID NO: 71369 - DNA, 342 bp, Triticum aestivum
  Clone ID: PAT_TA_71369
tttttttttttttttttttttttttttttttttttaacaaagcattaataaggaaaacaatgctacaagcaggcattcttctgcaggtcttttttttttagagatgcattcttctgcaggtcattttccgatgatgcaagaagtcatttggcctgggccgactcggattcaaattgctcttctgggctgtaaacgtttccctttgtgggcaccactaggcgccggcgcaccggccgaaactttcggccggtccaaccataaccgctcgatgcgagccgcgcggcggttggatctggaaccaaaaaaaaataaaaaatcgccccagcttcttcttcctcgggc

SEQ ID NO: 71370 - DNA, 401 bp, Triticum aestivum
  unsure (1)..(401): unsure at all n locations
  Clone ID: PAT_TA_71370
ttttttttttttttttttgagatatcgtgcaaattgtttgattaggccgtcgttgtgcatcccgttcgctttgtctcgcgtagggaggggagcgcctgcgggccttttgtttgtgggcacactgggcgccggtgcgccggccgaatgtttcggccggttcactcccagccgcccgatctactgtgcgacaccgtcagattgaagctcctctgttatttctttttaccttttcctcgtctccctgagcgctcgccgcaccgaccgcccgtcggggccgccccacgctccggcactcanctcgccccggccgctcgccgccccggccgccggttggagctgaccgctcgccgcctcggccgcctgtcggatcgccatggatgcagctccgcgactcagctcgt

SEQ ID NO: 71371 - DNA, 181 bp, Triticum aestivum
  Clone ID: PAT_TA_71371
ttttttttttttttttttttttacagagcaactattttgctttaaggtgtatatacatgaacattgcgaaaacattgtcaaaacatcaagcccatccccccctcgtccagactcttacctagtcttaactaaataaaccaccacagcattttgactgttctgatgagataaacctatcaaa

SEQ ID NO: 71372 - DNA, 506 bp, Triticum aestivum
  Clone ID: PAT_TA_71372
ttttttttttttttttttcaagtgcagaaacaatattagcacagaacctcagtatcaaacccataatggaagattcatagatgaatatggattatggactctagactactagattcaaaccagtcgaactaattctgaatctatatgattcaacaactttcactaatccatacaaataaatgggaatgcgatatccagagaaccccggtcatatccacctgtagctggatgccttagatcatcaactccttggttatggcatgcataacactgaccactttcatttggttctagagggcagcagaaatagtattttcttccgaatatctctttcacttcggcgaagaacaatgccactctggaatcacttgacctagggccctcaatctttacagtgaaattgtaatggtggaaaactttgtgatggtattccacattaaagcattggtgacagagttcctcaatctgccactcaagacccttgagattagtatttctttcagcgt

SEQ ID NO: 71373 - DNA, 424 bp, Triticum aestivum
  Clone ID: PAT_TA_71373
tttttttttttttttttttaacccaaagaacaaagaaaacctcagagagtttgctgcttaatttgccaggactgcactgcacattcagagagctagctcctagctaccaagtcggtctaggttgcaaattaaggagatatggatatggtggtgatctcatctgcctagctaatcaacccctcgccttcagatcaaccaccaccacgctaatgttatcggagctctccctcccgagggccagcctcgcgaggagggccgctgcacggaagcaccggggctcttcctcctgagaaaccgccggcgcgctgccgctgctcccagccgcagctgcaggagctctggtggggctcccgtcttccaggcattgcctggccacgtcgcaggccaccttgttggagatcacgtcccacagcccgtcgctggc

SEQ ID NO: 71374 - DNA, 444 bp, Triticum aestivum
  Clone ID: PAT_TA_71374
tttttttttttttttttttttattttttttggctcttcaagagcgattccttgttaggaaattaacaggagaatgaagatcaagggcattggcatccatcgatcctaatttctttttacagaacatgaatcaagaagaggtaagatgcctcacttcattaccatcgctggactggtggtggcgctcgccgccatcttgcatcaaggacgccattgctggacaatcagcttcgtttggcctcggcccctcgctggactgggagaccggaatcactggcttcgcgtcctgcggtaacgaggcggcgcggcctaggcgcgaagccgccaacggccgcctaacgcgcgaccgcggcgacgccttcccagtgacatatgcggctcccagcgcggagcacgcagcggccctcggcccgacggtgctcctctcggtgtgtcgtgggcacag

SEQ ID NO: 71375 - DNA, 293 bp, Triticum aestivum
  Clone ID: PAT_TA_71375
tttttttttttttttttttttttttttttaaagaaatcaataatttaacattcacaacaccaacatccatgggttacagtaaaaagcaaaaggctcgcacgaaattctgaaaaacaagaaatattcaattcagctacaacctttaactcagcgatcgagtgctacaaaatcaatcacccattgagaagcggttcgttctgcgagcatgtgtggtaaagcctcaacccctgagtgccgtcgcactggagcagtagcgctgttctcttgcgtcaactcgggaaccggctcagtgg

SEQ ID NO: 71376 - DNA, 410 bp, Triticum aestivum
  Clone ID: PAT_TA_71376
ttttttttttttttttttttttttaatagaacagaatttcattgccatcttaagttactcaattacaaccacgtagcagactggggggattcaattaccacatatcaatggctttgtcacagcagcaaaaaacaacacaatatagtatgaattaagaagacagctggttcaattaaagaaagagacctttgactcagtgggggcaaaagttgtactgaaaagtttaataaatctatcatacaaaattttcccctttctacatggttaatacagagcatcaagtacaccaacaagtgactggtatcttcagagtccacactaaccataaatccactattctaaagtaagcgatacgacaacataacaaacaaattctaagcctcttcgctcataacttttaatggctatct

SEQ ID NO: 71377 - DNA, 477 bp, Triticum aestivum
  Clone ID: PAT_TA_71377
ttttttttttttttttttaggtcatcatttaattgaaaaagagaaaagagcaacgtgcacaggtatactatccacacagataagcaaagacaagtgtccacgcatgcacagcacagcagtgcgcgcagctgatacactatgcggtgagccggtgaccgacggacgttctcactgcaccttcacctcagtgacgctcctctccctcccgggcacgcgcggcaccgtcacgtacagcacgccgtccttcacctccgccgcgatcccgtccacccgcgcgtcctccgggagcagcaggctcgcgtggtagtacccgtagctgctcgccgaccaccactcgccgtcgccgccgtgctcatcctccaccctcttctcgccccggatgaccagcgcgccgtcctccaccgtgacccgcacgtcgtccttccccagccccggcacctcgaaccgcagcctgtacctctcctcgtcctcccgcac

SEQ ID NO: 71378 - DNA, 404 bp, Triticum aestivum
  Clone ID: PAT_TA_71378
tttttttttttttttttgttcgcagaacactcatccgaatctcgttggtttcacttactgttagtacatgatgattacattctcatttgcaaataaaaaaacatgattacattctgagaggttgcgcaatgcacgctgacactgctgctgctgctgctagctggtcgcatgagaaaaaaggaattccctccggtactgctggatgaaatgcgtcggccctccaaaacccagcgccgaaaatggccgggtgcaccgtccctggaaaacaccggtaggttaagctgccatgtcggattcgggctcgatggcggatcggagcccgtggcggaccatcatctgcgcgtagaactcggcatgctccttgacggcgacgatgacgagcgcggcgcctttctggcgggact

SEQ ID NO: 71379 - DNA, 360 bp, Triticum aestivum
  unsure (1)..(360): unsure at all n locations
  Clone ID: PAT_TA_71379
tttttttttttttttttgaacatcacaacaaagatacatgaagctacatgtctgtagtacaatatacatgcctttcatggcttcacttgccgttacctagaatgagaaactatgtcgtatcagtaaaggacatgtgctacacatcataaaggaactctctttctttagggacacatcataaaggaactcagtggactaagtaagctacattcgtttcttttcttttttgagaatgactaagtagttacattcgtaatgtagaaataaacggaatctttaatanactacactaaaacatttttcaactactattatgctccagttctgctctgtatgcacgtgctaaaaaaatcttggctg

SEQ ID NO: 71380 - DNA, 545 bp, Triticum aestivum
  unsure (1)..(545): unsure at all n locations
  Clone ID: PAT_TA_71380
ttttttttttttttttttttttttttaaaaataactggggttacataggttataatatcaccagcagttgtacaaaagcaacgtatggcatcgtcggcaaccacaggtaaggttcatcttatcatagaggcaaattatatcttaagacgacaggctatgcatgcaaaaggcatgggttgctgtanatggtccgtctaaagaacatggacgatgagagtcaggcggtgctctacggtaaccttgaaacaaaaggcgcagatacatccttcatggatgtttgcacggtggcaaaactctgaccagtttctggttattgtggctctcttgtctgttcccagcatgatacgacaactggtgtgcagactgctgtttgcgagcttgaccttgagtgtgtcatcatctggtttgatgtactctttcagcttttctttggtgtagtggacctgaaaatactcacctatttctggcatcaaagtcctctgccctcaccccctctccaagcagcaaggacacaaccaacatcagcaaaggaccttaaatcgaat

SEQ ID NO: 71381 - DNA, 502 bp, Triticum aestivum
  Clone ID: PAT_TA_71381
tttttttttttttttttcgtaggaactttgaaggattagaatccttcagaatttttttctgtattggttatttgattcataagattaaatatcacaagaattttccctaacgatttctttgtactatttctcatagaatttctaacattcactaaaacctctttaaaaaaatcccttatttcttctatgatgcaatcaaacaagccaaaaaattgtataggatactcctatagttgattgagatgagcatgccatgtcaatcttatgtttttcttattctcatgttttcagttggctcgatccaaaccctttgcgccctttgctcctgctccccggttgggcaacatcgtcgcggccgatgtgatcgaagcatctttggccccgacgcaggctcctacgctcccacaagcaactgatgataagcaatggactgcccgagcccgtgccagctcaagctgccaccagtgccatgatgcatgtgcacgaacagtgctcgctatac

SEQ ID NO: 71382 - DNA, 488 bp, Triticum aestivum
  Clone ID: PAT_TA_71382
tttttttttttttttttttttaatacataagatccaagataataagtagggcttcaaaaagtgcataatgtggtacatgataagtgctggaaatctcccccaaacagagaccacgaaagccgcaacggccataccacaaacagagaccacgaaagccacaaagaccatgaatgaaagcgcaagggccatacgacagaacactacagtttacagcagaatatgtcacttggccaaggcaaccgtccaggaacagcatcatgactgaatagcaccattaatgctgcaatatggcagtggcagcagcttcagctgttgcaggtggtagccatagccttttgatctgttgctctttcggtacaggtaagtgccttctaatgtaggattgcaactgtaaacaccagaaaactgtggatgcacgtggtagctctgcacatccccttgcaatccatctgaagtgtcacatttccaagaaatgcgaatgtgattcc

SEQ ID NO: 71383 - DNA, 372 bp, Triticum aestivum
  Clone ID: PAT_TA_71383
tttttttttttttttttgtaaacgtgaaactgaaatcttatccttgtagcacaaagatgagaacaatctcatcctctttgcacacacgatcgaggaggcacagagtcaggcggtttattctctaactagttactctgctgctactagcatcagaaggcactgatccaggtttcagaacataccaagacgatccgaaagcttcaaacaactactagaaaaagtaaaagaactccattgtcctgatcattgtgccatgcatgccggtgatgagcacgccaacacggccggctgatcattccacgaaggtgccgtccagcttgcggacctgcaccttgagctcgtggtcctcgccgccagcgcggagcgcgcgga

SEQ ID NO: 71384 - DNA, 397 bp, Triticum aestivum
  Clone ID: PAT_TA_71384
ttttttttttttttttttttttttttttgaatgaaatcatgaatagtagcatcatatgaaactttacaattcttgtcctggtacaaacgcatgcacccacaacacacataggcgttgagcgcagcaacaccatccctagcactgcaagagcggccagggtgacagccttgaacatgccatcgcgaacaattgaagccgcatatgatacgagggaaaaggacccgcctttttcgcacccctaggcgccccccggtgtcgagacccagtaggccggctgaaactagcctccatcgacccgtcctgcggcatcgggcgtgagacgagcatggtcttgctgtcgggtgcgagacgagctcggtcctgctaccagacacgaggcaaggtcagtcctgctact

SEQ ID NO: 71385 - DNA, 298 bp, Triticum aestivum
  Clone ID: PAT_TA_71385
cgttgagctccttacaatgttgtcagaaaacaaacacgatgaatagttgagttccttgcaatgttcccacggttacaaacacgaagaaagtttgaatgcagtttacaacaactataacaaatttcagtgagattttagtgaaaaggttgctcgaaacacaacgatcctgtttggagaaaaatatatactcgatttcgaacattgggtggatgcaaatttacagtctcagcaaccaaggcttgctggcccgtcttcctccaaacgtttggtaatccttgtcaagttgtcaaatcctttt

SEQ ID NO: 71386 - DNA, 242 bp, Triticum aestivum
  Clone ID: PAT_TA_71386
gaaatcgtcgccgtaacaaccccgtaaagccctgtatgtctaggattattggtgggaaaaagtacgacattgccccccaccacaggccgaaaatgggatctcaaatcttcttatctaaatcaagaaagaacaagcacaaaccaccacctgggggcagagggcagtaaagcaaagcagccaactgctctgtgaagcgtaactccggtgtccggacgcctggctttgtcaagttttgaacctga

SEQ ID NO: 71387 - DNA, 177 bp, Triticum aestivum
  Clone ID: PAT_TA_71387
aaatagcacaatatcttcttccttgtgaacgaattgtacatctgggattcctttcttgatgtactcaaagatgtattttccagccctggatggatgatcctttgtggtgtcgtgttgaaatgagatgctggttactcgcaaaagaaaaagaaaaaagaaatgatatgctggttgttg

SEQ ID NO: 71388 - DNA, 321 bp, Triticum aestivum
  Clone ID: PAT_TA_71388
tgacgcacaccgatggaacacatactttgccaagcaggattcagttaatgcagctacttgcggattaaattcgtctgtactccttcaaagcctacggtagctgccaccagtggaaaatgatgactctgggggataaaagctaattacagtattggcttggatgtcgtatcaagcctatgcataccgggagaacatcattcaccggaggatggaacaaccgccacagaaatacgctggtcgccatccatgccaactgtctgctttgctagatctttcattaagaacagaagcaaagtgatcaactatctgccatccggctcc

SEQ ID NO: 71389 - DNA, 381 bp, Triticum aestivum
  unsure (1)..(381): unsure at all n locations
  Clone ID: PAT_TA_71389
ttttttttttttttttttttgagacatacatgtaatatggtaaaaaatatattcacataggtaatctatctatacattggttttatattcacttatacataatgttgcatttgttccaccaaacccgaaggcatttttcagagctatccttggagcattagaattgtggttccacttttgactagtgtttggcacataatttagatttaaatcaatatcagattctgtatgatttattgttgctggaattaatccagtgttgcatgcaaggatagtaaagagggtttctaagtttcctgcagancccaaaagatgcccatgagctcctttggttgaagaaacagctatttctttgctatggccaccaaaaactgtgtgaat

SEQ ID NO: 71390 - DNA, 442 bp, Triticum aestivum
  Clone ID: PAT_TA_71390
tttttttttttttttttttttttttttttttttaacgagcacacatgcgctcgagctcataacaggactttcgattatttacatggtttttcacatgaatgttctggcagacaaatcacagctgggaagcatgaatgtcgatgaggattggccaaaaacattcacatccgtaatgtgtagactaaatccatctgatagctgtctggcttagtcgaggctttgttatacatacacctcgtggcttgcaaatggcgaatacacgtcttcggagcagacctcccaattggttgcactcaccagccagaaatatgttgacatatgattaggcaggagacaatttgccgaccatattttgtcgtccagatcagatttcttttggttgcgaatgctccattaatatatatatctgtcgaacgaagctggacacttggtaacccttaat

SEQ ID NO: 71391 - DNA, 502 bp, Triticum aestivum
  Clone ID: PAT_TA_71391
ttttttttttttttttttgaactaacaacgataacaaatttgcaggcggactgacaacaagaacacagatgaacttaaaacaaaaatgtaaatggtgaccaactcagaggcatactgtagcacgcaggagcggcaaccaattagtcaactcatcaaggccaccaatacgcaggagagcatggtgtgggaaacaataatgggaggctacgtgtggtcgtggatgcattgtgggggttgagcgacaactgtggttgatggcaagctggaacgacaagaacgggcagcttgagaacaagtgggcggtgcgcgacatctcactttagatgcgcctgttggactgatttccttctcccataatgaggaagtagatgtactaaaagttgaagctttggatcctcatgacgaactggaccatactggagttttgaatggtggtgaagcttcacatccttcatcgtcactcctgccatgagccaaaatcacaaacttcaaaattacgaac

SEQ ID NO: 71392 - DNA, 518 bp, Triticum aestivum
  Clone ID: PAT_TA_71392
tttttttttttttttttttaaccagaaagagaacttacataacttaatggattcatgatcccaacatacattcattttgctttctttcaagcataaaaagttcgagaaaactataagcattaccaagtaatcataagtcaaatcagttttaggtcaggctggttcagtaacaaacaactttgaaaaggaagaatcacacatcacatgaaaagtgccaggagacaaataaggtaagtgaaagaacttggattaaatggaagtgagccttattccgagcaacacacatcctcaggcaaccttgaaaacaaacgcatctcagttgacaattgaacatggcacctctccgcttctgaaatgtgtcacaaaccttacaaatgtccgactggagaggacgccatttcactttcaatgtatagctttgctttgatggtggtgcttgcaattttggtctaccaatgtgctcctcgattcaatgcataatctctttgggtgactaaatgttgccattctcatctgga

SEQ ID NO: 71393 - DNA, 539 bp, Triticum aestivum
  Clone ID: PAT_TA_71393
ttttttttttttttttttacacaaaatatattaaatatatatacgtacacacatgtaagtgtacactacagattcattatgctggttacaatgttacacttacatagcacgttcgcagtcactctaattctagtgaaggacactcttcactcttgcgcattgcagcccccataggatgttttaattgcatgcattttgctggccaccactttcatattcattctttcgcctggtactgggtgcgtacaggaaagtgctagttgcagcacagatagcaaacattgatgaactgaattttctgaaatcttctttgattgagcaatgtccttgcattcttcactgagattagcatcaatgacacgaactatttcatgtggaaagttgctctccacaaagtcgacaatgctaactccatccttgaacaatggatctgttggtctttttccggtcatcatttccagcagtattatcccaaaaccgtaaacatctccgcaagttgatgcatggcggccacctcccgcgtactctggaccaatata

SEQ ID NO: 71394 - DNA, 635 bp, Triticum aestivum
  Clone ID: PAT_TA_71394
ttttttttttttttttttttggatagacgtgccaaagaggccgtgttcacaaaaaaaaggcagatcacacggtagtttacatggtacatcacaagagctggtgggatcatgtatcatcgggtacttgccagagttagaataggtggtcggtgacgtccatcgatgatcaaatccatggccttgtgtgaagaaagcaatttgtgcaaacgcctcaagctcttgcgccttcagaaattgcctcattggttgtatccttaaagcagtggaaataataaatctttggtgcaatcaaatgaccaaatagaaaaggcctattaatggtgcccttttattcacatacatcatttaagcccttctcctcggaatatggaactagatcagtaaatgctgacttgcgcatggcagcaaccatattaaacctagtaataattaaatcttgcataggcaagtcacatgaccaagtaatatattgtacaccgagaacatgaaacatgtggcagtgctggccttgaagaatatcgatagacagtttaagagaacatagccttatcaccaatgcatagcgtaatgcgtgcatcataccaatgaccatagccaatgactaaagcacaacctgatttttcttgcggctatag

SEQ ID NO: 71395 - DNA, 379 bp, Triticum aestivum
  Clone ID: PAT_TA_71395
ttttttttttttttgatccccaaagagtgtccgttcaaaggctgtgacgaggccttcctctccagaagggaacttaagttccactccaagaactgtcactggtgcgtgcaaattcaatcccattgcttgcttgtcccacatctaatctaatctaatctaatctcagagtatttatttcttcactaaatcaaacaatccatcatgtctgctctgcagggccaaaaacatcaaccacctcaaaatggagtgaagaccgaggtaatccaattttgtttgttttgctgctgctgcatttcctcctattgcacactcgaagcattccttcagttttgggcaaggccactaaaaacagagtgtcaggatagcaaggagctgctct

SEQ ID NO: 71396 - DNA, 463 bp, Triticum aestivum
  Clone ID: PAT_TA_71396
tttttttttttttttttttttaattaagagcggtgttcatcccattcaaacggtaagatagcagcagacacaggaagataaccaaggccgccggacgcagatccagcggcccaaagagtccacctaaaaccctcctaaaccaaccacgggagatctcatcggacggaccaggggaagacacgacacacgactctcttatttagatcgacgacacgacacgggacacacggggcgatgacgacgacggcgaccggcgggcgggcggatctagagctggccgcagtcggcgatgacgacctgcttggagcaggtgccgctgcgggagcccaccttctcgatgttcttgacgacgtccatgccctcgacgacctcgccgaagaccacgtgcttgccgtcgagccaattgcaggggacggtgcagatgaagaactgggagccgttggtgttgggcccggcgttggcc

SEQ ID NO: 71397 - DNA, 321 bp, Triticum aestivum
  Clone ID: PAT_TA_71397
ttttttttttttttttttcatgaacagctagtgtagacctcgtgatttccgatatagtgtaaagcaggcgcttctcgtccgcatgatacaagataagattgcatgcatacataaggttagaagctagctaggtttcgttctaaaaaactagctagtttaccacaatggggacggccctgaggggcacggtgagcgtgctgacggtggtgaacttctcggtcatgtccagctcgtcggcccacacgccgtccgagagccgccactcggacctgtgcagcagcgacaccagcacgaacggcacgacccgctccgccgtcggta

SEQ ID NO: 71398 - DNA, 416 bp, Triticum aestivum
  Clone ID: PAT_TA_71398
tttttttttttttttttttttaatccttactagttgtagagatttttggccacatcccagaatccgaaaagccaccacaaatgcaatacagagcctaaaaaggctcaaatggtttggccacacggtacatcatatatatgccattgcctacacagtaggcatggcgtcttcaaactactgaatatattaagatacggactagtattggtgacccaaattcgtatcatcaaagaaatgcgtcacccaggacaaatggacatgatcacatgcgaagtatctgcttttggggcagcacatcagaagttcacacagagcatggaagcaagtggcttgattcctgagagctactcctgggtagtagtagcttttatcttgctcagaaggcctcctggctttagttctttgatcattgcagc

SEQ ID NO: 71399 - DNA, 340 bp, Triticum aestivum
  Clone ID: PAT_TA_71399
ttttttttttggggggcccaaacccaggaaatgttttaaggagatgaactaattcacgttacaagcacatagcaatcacctgggatatctgaaggaagatacagatcaaagtccaaccaatcacataacaatcacctggtacactatttgaagccaacaaaatacatgccctgcttactcctgcatgttttgctggcgttgcctgattctttgagtggccttcctctgctcacggaataatcttggtatctccttccatgtcttcggtttaaacgccattacttcataacgggcatctagccatctgtagtcgaggctgtccagtcgttgctgcaggcat

SEQ ID NO: 71400 - DNA, 333 bp, Triticum aestivum
  Clone ID: PAT_TA_71400
tttttttttttttttttgtgtgagggaagaacgaagcagtcattttgatgaagctacgaaataattcaacaaactttctccccaaactcgataaccaagcaaaatcctcgcagtagtagcgactgacaagaagtgaaaaaaaaatcagaaagatcaagcaagatgctgatcgatcaagacaaacaagaatcgaaaaaagaaaagaaagtgttttttggatattccctaaacccttcgtgaaattcgtagctccgatcctgaaaagaaaggaggcagaaagccggtcgccaaagtactagcttcgctggccgtgcaatctgtggaaaagtgtcg

SEQ ID NO: 71401 - DNA, 414 bp, Triticum aestivum
  Clone ID: PAT_TA_71401
tttttttttttttttttttttttttcaaagagaaacagctaatttaacatgcaaactaggggtctaaactcacatggctatagtacagtcaaaatgggaaattctatatattgaactgaacaacatttacatacttatctctatatactattgcagggtagagcaaccattttatcttgatgtcttctgcttctggaccttgacatctttcaactttagcttgagcttcatcatgccagcttggacttgcacttcatttttggacgaatctattttgactacggtagcttggttcttgagtttaggaacgtaaactaaatccccaacttctgggatcccaccatcttcatctattatcttgccattagcttctgcgaccgtgatgctatttgtattctgcgtctttttaagggc

SEQ ID NO: 71402 - DNA, 396 bp, Triticum aestivum
  unsure (1)..(396): unsure at all n locations
  Clone ID: PAT_TA_71402
tttttttttttttttttttagctgagcaaatctgtgaagataatncgccaacaattctgttcatctgcagatttcggacatctctnggaaagaatgtactgctttacaaaatgcttgcttggtttcatcaatgggcaatggcatatatgcactacagagcaacaagactgctaccataacagatatggacctctttcttcagcagctatcgttggggtttctagtcttttatccatctcctttttctaggatgcccttgcttcaccatataaacccggccgtaaacccagcttcttctaggtccagacagagatctctcgactttagtacggtactccaacgggcactcacagacatggcattctgccttgtggggtgctttaatggacttatccg

SEQ ID NO: 71403 - DNA, 488 bp, Triticum aestivum
  Clone ID: PAT_TA_71403
gacacaacataaaaagcaccaccacttttaatacaatcaattttctccatccatagtgaccagatccagttgctaaggatttatgttagattagacaaaaatggtcttagctgcacacctgcagtattatactattatgcctagttaattactcccttaacaccgtcaaactgttcctcgccacatgtcattatcttcttattacgagcacatcataccaggaccctggtcacgtttccgatctccctttggcccgacaaagctcgctttgtgatcccaactactgcaatcctttgaataagttcctggcaacctgttcaacaatgttgatttcccaaacaaaggacacaccgcaaaacaacacatgcatctccactttttatcacattgcatccctcaccagcacaaccaccaccgttctggtctttgtaggagtataagcaactccctcttataaaatcatttcggtcatccgctgagcaatcttg

SEQ ID NO: 71404 - DNA, 518 bp, Triticum aestivum
  Clone ID: PAT_TA_71404
tttttttttttttttttggtactgagaggaatttctcagtgggtaaaagcaaacatacaacatagataaattacattgtcttagcacagcacgatgaattcaatacttatgcatgatgagagtacagttcgaaaaggagacagatttctaaggtgaagctataagacagagcttcatatcttatttaactaacacaggagactaaacatggagattgaacgtaagaaccacactggttcccgcctaacagaagcaacccatcatagtgaagctatacatatagagcttcatatggcgatcagatagctcagcaggctgaacatgatgctcatggatatcgcatataatgagcgtagtcgtcgttcatgtctggatggcaatcttcagcagaatcttcatcagaatgcccagtgtatactggatcagccacgtcctcatcagagtacatgccttcttcctccaggaactgagatgctgtggttgtagtgttttgcagtgcaattactgcatcatgaatc

SEQ ID NO: 71405 - DNA, 307 bp, Triticum aestivum
  Clone ID: PAT_TA_71405
ttttttttttttttttcaacgacatgaaaggcacatacaggcataccaactactctgaaaataatccatgcaaaatgtgctttacataaggtttgtacatcaaatccaacgttggggtctacccaaactgaacatatatcctggctgccacataacatggatgactgccctctggttattattcatggtccattccgcttcaacccttttgtaaaagcgggtgtctcaaaccgggagcaaggctgtcaaactccgacagcaaaactggaaatggcaaccagggaaaaccgaaggaaaatgccgtaat

SEQ ID NO: 71406 - DNA, 632 bp, Triticum aestivum
  Clone ID: PAT_TA_71406
ttttttttttttttttttgtctgaacgaaaaaattcacctttgcattatattggttgcagaccaaagcgtagaatttttgaatgcgttgaaaacatcacatttttgtttgagtaggtaaagccaagtacatcgactaaaaccatcaataaaggttacaaaccaacgatctcccaaaagagaggtggtgacggaaggaccccaaacatccgagtgaataatctcaaagggagtttgacttctttcactactagtaggatacgtggcccttgtatgcttagcaagttcacatgcatcacatacaagcttatccttgtagcaggaagcaaaaagagaaggaaatacacgagataaaacatggaaagacaaatggccaagtctgcggtggagtaatagcaactcatctgtggatgaggtaaatgcagcaagtgcaagcggggctgcaacattgtcgaggtagtacagaccatcacgctcggtgccagtcccaagtaccttccctgtcttcagttccttgagatgcatggtaactggacacagagccagcaggaacttcattggatgcagctaagagttttgatttaaattcctcgagagcttgtgcagctgctgctgataattcacttgtggatga

SEQ ID NO: 71407 - DNA, 368 bp, Triticum aestivum
  Clone ID: PAT_TA_71407
tttttttttttttttttttgtcatcaccaggaaacatctcaaaaatgagtggagaacaatatgattttttgcagtacagctgcagggagcatggggggaaagagaggagatttagggtgcaaattgtagtggttagttagtgaagtgctaacggtatcactgacaagaactggaggtgagacgcagaaggcctgatccctactacttctacgctactaggatcactgacggctcagccagccaagcaggtctagtctagatgccgcccctgaagaagggctcgccgaggaaggagctggagtaggtgccgccgccgttggggaagagcgtgaggaggcagacgacggcgagcacgaagccccacgcgt

SEQ ID NO: 71408 - DNA, 414 bp, Triticum aestivum
  Clone ID: PAT_TA_71408
acccagacatgaatcgattgtacaaattttgtttacattagaagtgaagataagagagatgtgtattgttcagaaactaaaagagcaaacatttcaatactctatagtacaagagcattgtagcatacaaatttgaaaagaagataagagagatctgtattgttctactagtattgagttgccacaggctcctcacattagtttactctcccactcacagtaaagcatcctatggagcaacactatctaacagtacccggcttcagatctcgcgctggtggccagccggtggtgtcacagttttcaaggcgcacacatttcaacctgtacatgacaaacaacgctaaaggctccagtataatgacattgggcaaaacaaaacaaagcctcagagtttgcaccctgcgacgacgt

SEQ ID NO: 71409 - DNA, 430 bp, Triticum aestivum
  Clone ID: PAT_TA_71409
tttttttttttttttttttaaccacaaaagaggataatagtctctcgaagctgggtatgctatatacatcttagttccatgtatataatatatgtatagccatttctatcttatggctactttcaaatgaaaatgttttttatgtaatagactcttgcttcaacttatactcgtcactggactactatgagtatactcgaagacccatctataaatttaatagccttgatcaaggagcaacgattaactttcacttaattgagtaatcgcattaacctgaaggaaaccacaatagttatataacttcaggaaatggtgaaacatcaatgcacagattaactcggccaaagccgctggatggaagctatgctttttctgagcgatgcagtacacacttcatgacatgtaaaataattgttaaatctaagat

SEQ ID NO: 71410 - DNA, 363 bp, Triticum aestivum
  unsure (1)..(363): unsure at all n locations
  Clone ID: PAT_TA_71410
ttttttttttttttttttaaaaggaaagaatatattcaatattggactctatttngtagagttcatcgcgggagaatatagtggtgcaaatagattaaagttttatactttgatctaagagaaataatcaccaaaagagggctagatatgcacgtacagaagctagccagatttctagttcgtgaacaccaggtcgcatagatgcatgctctcttttaaattttctatatatacagaggaggtgttgtgcgctgtctagtcgtctgtcaggcaaaaagaaggtgccgccactccaaagatggcagggcccacctcttgtctccagttacgttccagctcccacgctcggccgaaaatctgtta

SEQ ID NO: 71411 - DNA, 218 bp, Triticum aestivum
  Clone ID: PAT_TA_71411
ttttttttttttttttttttttttggcagtgtcagcaaagcatctactactgctgtgctggggcaaacaaaaccattggtatgacaacacatccctacaatccccttgatgctgctactcactcagggtaacaaaaaaaatttgctcaacatatgcgaccgggtactaactgtcaacgccgaggaactctgtgaagcttgggtattggggcctcccac

SEQ ID NO: 71412 - DNA, 302 bp, Triticum aestivum
  Clone ID: PAT_TA_71412
ttttttttttattttttttttttttttttttttttttgaaaaccttccaatacccctttaatgtgcagtttttcttgtacagagctcattatattaaattcagactatcttcaaatccataacccattttctaaatcaggtttcatccacaaaggaacactgctgtgcacaaactaaggccagcacaataagtcaaccttaaaaaatataagcagttaattcataaagtccatttagtaataacaatgaatacaggtagatgccacaacaacaaaactcttagttacttttcatttcattgt

SEQ ID NO: 71413 - DNA, 419 bp, Triticum aestivum
  Clone ID: PAT_TA_71413
ttttttttttttttttttttaaaacgaatcgcactatttaattaaggtcgaccttgatcctgcgccctaaatgttaattacgagctctttatataccaacaattaacccgaccgaaaaatgatccgttgatctatatacgacgatctacgagataagctagaagcgactcatgcatggcagcctcctacgggagcatgcatgcatgcacgcacatgacatcgagctagccgccgttctaccgcggcactacgtgcgcgtgtaatacatgtctgcttgctacgagcggaaccacccgaggtcgagccggccgggctcgtacccggcggcctgtgtcggctgctgcggcggcaacggtgcccccccctcgctgccgtcgggcaccttggggaaccgtcccttgacgcgcggccgcatctcg

SEQ ID NO: 71414 - DNA, 501 bp, Triticum aestivum
  Clone ID: PAT_TA_71414
ttttttttttttttttttacaaacaaattacatctctcaagtaaattgagaggattttacagttgatctagtacacagttacaaacttacatttctctaagttacaaagttactgcataagagtggcttacccctggtatgtttgcctcagttcatgaatctagctgagagtacgagggcaaatcttataggcaaaaaccacgggcaaatacacgtgcccaagttcaaacactgacagctaagatttaacagccttgatttgaactatgttaaacaactacctacatcgagaataccagttgaactcaaaattctggcgaaccatcttcagtgcaaagttctttgaaacgggacagcaacaatgttaaatccagatcagctccatgcttcttccaagcttcctcaaactgctgccccttgcatttctggagtagcatgagtatttccattatgtgatttctcatcatctcacggctctttcgtgtggctgactctttatac

SEQ ID NO: 71415 - DNA, 439 bp, Triticum aestivum
  Clone ID: PAT_TA_71415
tttttttttttttttttttgttgatcacatctatattatgtcatgcggctacagagttagatacagggctgggctgagttgagcgagttacaggcatatacatatatatgtacacacgtcacacgagtaatcaatctaattagattaaaaagggggttttgcacctatgacatgaaccccaactacagtagtaagcagtgagcagctagacattcatggtctggtttcactttcaattgagcagcacctccacatgacatgtacctctatctcaaatatacacaaggtggcaacacaggcagacggcgcgcaagaagcctcgagccgtctgtctaccgttgctgccgggacaggaagaactcgtagtcggggtgcctgtttctgcgcttctggtcctccttccacacgtcggccctggccatggccgccgcggcttggt

SEQ ID NO: 71416 - DNA, 247 bp, Triticum aestivum
  Clone ID: PAT_TA_71416
tttttttttcccccccacgggagagctttatacataattattagcaagtgacaaaggcgtaaactaaaacgtgtaccggacggaacgataaacatatctcagggcacaaggttaggtggttaacaaaaccctttgcatctaagcaagaacctaaaacaaactcaccgaactttcttccgggatttgtaatggaacccaccgggtggggacggcaaaaactctagcgggaggtgaggcggctctccct

SEQ ID NO: 71417 - DNA, 397 bp, Triticum aestivum
  Clone ID: PAT_TA_71417
ttttttttttttttttttacaaaacactctcttttcatttatagcatgtacgtagaaactagtactgcttattaaaacttacacagaaaatacaaaccgactcaagatcataagttaacacccacaccacacatgcggtatgactagagtactgcaaataggtaaaacaaccaaccgttctcatatatacttggatacggacaatttggttgtttccattatttccaacacaacaggtacatcatggctcaccgagtcgcataataacggtcaccaaaacgaccgttgcgttgggcggcggtgctagagaattctgcgacgccaggatcagagctgcgtggttgctcgcgcaagctgacgcggtgggatctgcgacgagaagatacacgaggacgtt

SEQ ID NO: 71418 - DNA, 562 bp, Triticum aestivum
  Clone ID: PAT_TA_71418
tttttttttttttttttttttttttttttttttagagccgaccgaaaccttgcttatcattcacagcagacttggtttcaacataacttgtgctgcaggcatgtcatctatctagcacagcaaacttggcacacataagaagaaacacctgatgagcgtattcacagaggcagaaacacctgatgagcgtattcacagaggcagaaaccgaaagctcaaagaagcaaaacaagaatcgaccaaacaaccttgcttggaaaatcgcacaatagaaaaaagaaaacaaaattgaagcagacataacaagaaacgcctcaaagaagcaaaacaagaatcgaccaaacaaccttgcttggaaaatcacacaacagaaaaaataaaagaaaattgaagcagacataacaagaaacacctcatgagcatcaacaaagtaacataggcagaaactgaaatctcaaagcaaaacaagaactgacccaacaaccttgcttcagatctcatacaagagatgacacgattatttgtagatcactttcagttaactccgtctcgctgtcaagtg

SEQ ID NO: 71419 - DNA, 304 bp, Triticum aestivum
  Clone ID: PAT_TA_71419
ttttttttttttttttttagtgagcaatctaaaagcaaaaagaaagaattataagttcacaacagtaaatttcatttctgcacccaacaaaccggccggccgatcgagaggtctattctaactagaccatgtttacaagctaaaggtacgtatcgttgtgacgcagtttacgtcttggcgagtcatcatcgctagctggctctaatagctttgcttaggctcatcgctgtctatgagcccgagcgccgcctcgaggttggtcaccacgtttgacatggcggggcggtcctgtggctgtggccac

SEQ ID NO: 71420 - DNA, 357 bp, Triticum aestivum
  Clone ID: PAT_TA_71420
tttttttttttttttttttttttttttttttttttttaagaaatcaaaatgcattttttcatcaacagctgcttgtaagttgccagatacactgcaatattagagtcgcatgcattacacttgtactcagcacataatcaccaaaaatgctgaggagaatttcccctcagaactatatcagatggcgcagttgcagcacaggcaatgcccacactgcatgactatgacattggtgtgtgcgcttctttctgtaatttcagttgcatcatcagctcaggatgcatgaacactctgttttcaagggactatatgaacatgctttggcggtttggcctatgtgtctccatttgccaatca

SEQ ID NO: 71421 - DNA, 479 bp, Triticum aestivum
  Clone ID: PAT_TA_71421
ttttttttttttttttttttacaaaatcttatattatcaattcaaatattcatggtgcatataaccaaatctcatggaaacatattacaatcaattggtgcagcaaacagacgggatatcatcaggttcagatagtggaccaatacacttttactgtgatagaagccaactcatgctttatctgacgtcgaacacatccatgtagcttagctttgaaggaacaacaacgctcaacactattgctaccaaacctgaacttcaacttcataacagtggccgacgtgactgcaaccacaaatcttctcaggccacgcgactgatcaatagtaccatgaaaaagaggaatttcttcatagttctccataatataaattaaggaactcagagataaactgaagccactatgtacttctgatatgacaacttctattgttgcctccactgcatgctccacatatgctaaagatatgtcaactgtg

SEQ ID NO: 71422 - DNA, 345 bp, Triticum aestivum
  Clone ID: PAT_TA_71422
tttttttttttttttttttttttaagccgaacaaaacttatatattgccccaagttcaatgtgaatccaaaagtttatttgcagtttacaagacaagttgaaacaatatcttcacataaaccattcaccaaaggtcaaatcgaagcaagaacacaccagatgcatgacatgagtcctctagcccttgacgtgcgcaatttcgtcgacgaacctttcaaggtcccgttgcgaggacccacccgccgcgaccgccctcacggccttctccttccactccgctgccttcctcctcattgccaccgccttatccccatcgcccattagctccctcacggcagcctcaac

SEQ ID NO: 71423 - DNA, 105 bp, Triticum aestivum
  Clone ID: PAT_TA_71423
ataacaaaacgtaatatccgtagtggcgataaaattacctgagttctagtttttttactcctctgactagtcaagccacttctaggcttctagccaagagagttt

SEQ ID NO: 71424 - DNA, 466 bp, Triticum aestivum
  unsure (1)..(466): unsure at all n locations
  Clone ID: PAT_TA_71424
tttcagtcaccacttaacatcatgacttcttaaacatcaaatgggctgtgcctatggcagggcacnactggaaacagtgaatggccgaattacatgtaaactctgaatatttttgatgccctacatgatcatcaatttcagttatggttggcaatcatgcatgttggattgcccaacctacttctgagtatctatacactacactggcattccatctaaaacaatgtgagaatgaatcgttagcattcctagaatcataaagccggtcaacttgagaataacacagcaagcactggcagcaccgcagttcctcaattcagtaaatccaagccttgggcatttccagatacccactcattagtctttttgctgaaataattcacttctggtgactcttattttggttgattggacctctgcttcaacatcattaacaactctccggcattttggaaatccacaataa

SEQ ID NO: 71425 - DNA, 262 bp, Triticum aestivum
  Clone ID: PAT_TA_71425
ctttctgcaccgctgcatcttttacagatgtatatagaacatacatagcagcaatatcagtaacacaaatatgcaacaacaccacaatgatccttgttgaccagagcatggtctcttgtctggtaatattgaccagaaaagaactggtaatgcaggcacgattatgccgagacaacctgcaggttcacagcttccattcagcaagcgagaaagcaggtgatcgcaatccgcaatcaacagcagagaccagaagggtagtttc

SEQ ID NO: 71426 - DNA, 392 bp, Triticum aestivum
  unsure (1)..(392): unsure at all n locations
  Clone ID: PAT_TA_71426
aatcattgtcatagatatcagcacagaggcaggcaataaacaaaggaaaacacaattggtgacccacaaaacacaagtgggataaacaatccttggattccccttctgatcactacagagaatgttaatagaatcagttttaacctacgaagagctcaatgcaagtatagaaaacaaaccactacanaagagagcacctgcatttctaaaacaggccaccatcaatttcctttggacgacgaacatgcggactgtagatgcccttgggcttgtgccagttgggagggcggcggtagagtgatcccctcgattgccctccgtccctgcagagaacacaggcaggggttagagaagtgcaggcacgagccacatcgttcaagaaaacacagggg

SEQ ID NO: 71427 - DNA, 390 bp, Triticum aestivum
  Clone ID: PAT_TA_71427
ctttgttatattttgtcatgggccatctgctttctctgttatgtaccaattgttgtcgaacacacgcagcagccttatcaatgcagcacacttacatcggcatgacctactattctccgcctctggtttcccctgtataattcatttaaacacacttgaagcaccgacgcccatggctgctgcttaccttccaaaacaataattacatgaatcagtgtttaccgagcagccgcagacgatttcttgcattcactttgacaccttgtcctctcgacgtttagccagctcttaccgtaccttattctgaatctaatctcccaagaattgcagaaagtaagtcagtcatattttaaaacccataagctcatacataatctgaactcagtactc

SEQ ID NO: 71428 - DNA, 205 bp, Triticum aestivum
  Clone ID: PAT_TA_71428
attctcatgtgtttacttgccgggcacaaagtttgtggcgaaggcccacggggggttcttgacggggtcggctacgtggtcagcgaggttctcaaccggacccttaccggtgacgatggcctgcacaaagtagccaaacatggagaacattgcaaggcggccgttcttgatctccttcaccttgagctcggcaaacgcctctgga

SEQ ID NO: 71429 - DNA, 404 bp, Triticum aestivum
  Clone ID: PAT_TA_71429
tttttttttttttttttttgtaaaacatggttgcatgaacacagccacgaacagcacgtatctctatttttgatgcatcgtatctctttattattatgtgggtggttctcttcacatctaatacaagctgagtgaaaacggaccatctgtgctgtgtaaccaatatctgactcaacccatcataggctaacctgacacgtactatcatagatagaattatacaatacagtaccagctgcgtgattcaccaatacgcactacgatcctggagttctggacatcacttttctctctgcaagacagccggcagctagagactatgggagcatacaaggcggcagaccacttcaagaacgcagcgaacccccgccacttgtataagaccgtgcgtacatgtgtatctg

SEQ ID NO: 71430 - DNA, 368 bp, Triticum aestivum
  Clone ID: PAT_TA_71430
ttttttttttttttttttagctgaaacgatgacacttctcctgcttaagcaaaatcctgaaatggataagtactgctgacacctcaccaaggttcagggtctaaatttgcagggttgcgactgagccgtaccataaaactacggaacaaacatattaggtagcacttagcactgtaatacttccagctttacaaaaaatattatccatgttatgtttgcagggctacacactctacaagaagggctagtggttttccattcacggagaacctgtggcaggtggctttggagcctgatttttctggttggctgtagattgggcagcagaggtctttatgttccccttcactcgcccattgacttctttg

SEQ ID NO: 71431 - DNA, 286 bp, Triticum aestivum
  Clone ID: PAT_TA_71431
ttttttttttttttttttacattaagtagatggagtgtttcttgtagaacatgataatattacacgggatgttagtaaagtaagtttttcattaagttggagctgtgttttcacgagctgtgacaatgtcatcaccatcagcagatccttgatattagagttgaacattttgtcaaactcttcaggagacatcttcgggacagagttgatcatgtctgttaaggctcgaccaacagagttgtcaggtactgctttcccagcaaggacatcttccacataggccagg

SEQ ID NO: 71432 - DNA, 370 bp, Triticum aestivum
  Clone ID: PAT_TA_71432
ttttttttttttttttttattagatacaccatctcagaccaaagtgcaaaaacactggaaaatattgttcaacatagaactcacaggactacagtgcataatgagggaagaactacccaagtctcataacaaagttcataattcttatctaacagcaaattcatagcttcacaatggaagttcaggggcaacatattacgggctcaagcaccaagagatgtcttcagtcagattgaacccccaaagtacctcatgtatgtcttccgcccatatgtcaaagtcaccaccaaacccatccagctggtaatcaggatgttgtagatcgcctgaagaacctcttgccctgtaaaacgtcctgagacgcttgtcg

SEQ ID NO: 71433 - DNA, 433 bp, Triticum aestivum
  Clone ID: PAT_TA_71433
tttttttttttttttttttttttttttttttttggtttgcaagtgccccctcacattttactcaaacttgaccatgaatctgaccagtatgaaatccaagttatttatcacaaaaagtatactacgagtacatctgaaatcatctgcttctaactataacctacaattacatattatacccagtagtacagtttgttcatctaaactgggaccaacctcccctcagaaactgctgggatatccaacttactttgtgcactttgtactgcatcatcataatcagggaaaaccactgactgaagcgaaggcgcaatcttgttaacccgaagccatgttgcttcccacaaactgttctccccgacgctgcttgtcgtcgataagatcccgctcactttcatcgccagcagtatgttcttgagtagctctgtggcgg

SEQ ID NO: 71434 - DNA, 298 bp, Triticum aestivum
  unsure (1)..(298): unsure at all n locations
  Clone ID: PAT_TA_71434
ttttttttttttttttttttttttttttttttttttttnaaagaaacagatataaacaagcttatgggacaaggacataaatgttacgcaccacaattatatatataaatcacagatgctacaaactgaacaagtttctacagcaaccagagtatacagggaatagattcaactaattttcacacaggcacaagtctaaaactaaacaaaagtactttacttgaacacttaacatatctgaacattacaaagtactgaacatcacacttgtcaagattacagacatttgagatcaaag

SEQ ID NO: 71435 - DNA, 354 bp, Triticum aestivum
  Clone ID: PAT_TA_71435
ttttttttttttttttttatagttattagcagaaaagttttaatttgacttgatagcgatgtttttatacttaaactatttcatgtatttcattttcaatttactcatctgatgttaataaagtaaattgaaatgaatgtgaaatgttgtttacaaattgacgaaaaagaaaatcaaatcaatgttctgcttgatctttagttgtaacatcgcaaaatgttaacaagaacattgacaaaaaaaatggccggtagagataactttcgcgcaacaggttgattgaaagctatgaaatcaattaatttaaaaacgatgtactgttcagtttgcgagaaagtaagtctatctctggaa

SEQ ID NO: 71436 - DNA, 200 bp, Triticum aestivum
  Clone ID: PAT_TA_71436
ttttttttttttttttttggacgcacgactaaaagctttttatgtagtactagtacaacttaacagcatcaatcacaaatgaacaccgtgaatcacacaagtcgcaacgagttcctaatttccttcaagcgtcctatatatatccatcgaccggcattgagcccattgatcacaaccatcttctacgccgcacgaaagtg

SEQ ID NO: 71437 - DNA, 394 bp, Triticum aestivum
  Clone ID: PAT_TA_71437
tttttttttttttttttttaaacagaggaaattggcatagaatcgttaagtaggtgtactaaaaagcacacaaaacatgtactaaaaaagaacacaactccttagcgtttgcattagcctcctatggcagaggtgaacggtctgatcgctgcgtcatcgcacggcctcgtgtggccgaggtgaacggcctgtggtggtaagggtgaacggcttgagcgttgcatcgtcgaacggcctcgtgtcgaggcagtgaacgacctactcaactgctccgtgccaccgtccctctacgcataagtacacttgccgcctacccgttgtcgttggatgtaccttgccatagaccacatcggattttaagattctagatggaacttcagcaaagtgaagtgaa

SEQ ID NO: 71438 - DNA, 367 bp, Triticum aestivum
  Clone ID: PAT_TA_71438
ttttttttttttttttttttattttttttttttttttttttaccccagatctgaaacatgattaacttaagtgtaaacacaagaatgtgtaatgtctggacagatttagccaaacagaagaagaatatcagctcccccctctccagttaatgtcggcgtctaaaaaagggtaaagcgcggctcttgacaaacttagcactaaccaaatgtggcaagagggggacaggtccgaaaacaaggccttaacacaaacatgattagtaaccctcgatattgattttcccgtctgggatgaagatcggtagcagcgcctgcaccaacgtaccgatcctaggatcatctttgctgcagcatatcttgattctct

SEQ ID NO: 71439 - DNA, 388 bp, Triticum aestivum
  Clone ID: PAT_TA_71439
ttttttttttttttttttaaggcaaatatttttgtattttttctgaaaatgttttagaagtgggggagatgaaaacgaagagaaaaatgacaaataatgtaaattcaaaagatgagaatttatgataggtacttgataagcttgatgtagatcctccccggtaatggcgccacaattttttcctgctacttcttgagcttgcgttggtttttttcttgaagaggaaaggatgatgcaacaaagtagagataagtatttccctcagctgagaatgaaggtatcaatctagtaggaggagcacacatgtctccaatagttgtacgcgtgctttgctgcgccgtttgtcagaccattagttctgacttgtgctcaatgcacattcatttgg

SEQ ID NO: 71440 - DNA, 251 bp, Triticum aestivum
  Clone ID: PAT_TA_71440
ttttttttttttttttttgcaaaaaagcctatggtttgctaaaatcaacccgcagtactacaggaatcaagtaaaaaattctctcgttggtacaattcctcgctccagtccgaggccaccgccgtcgccctgcccggccttgcccgcgccaccatcgccctgcccgttctttcccggcgccgtgcgcgcccgccgccctaccaggctgcacctgtcgtcgtgccaggtcgcgcccgccgccctgctagcgt

SEQ ID NO: 71441 - DNA, 543 bp, Triticum aestivum
  Clone ID: PAT_TA_71441
ttttttttttttttttttagttcatcttatagattggatcaatgagttcagtcacacagcacacaacgggagaacaagaaaaattgacggggggataactcatcccaacaatgtcaaaagagctgccgattcagggcggcgtacgtgcatcagttgacaaagttctagagtgcaaagcatggcaagggcaatccagcaagcttttgctcaggaaccctcacctccacaaacaagattaatacaacatggagtaaaaagaaagcaaacgatcatctgagtaacgatgatgaggttcttcgatgaccatggtagatgtccaaatgatggtctgcttctaagagcgcagggaatcatccccccttgccatgaatggagctcacaggaaaatagggagatgattggccgtcttcacttccagcatccaaaagaagcgcacagccattgatcagttcttgcccttctccttcatgtcggagtgccggaacccctcccagagctgcaatgcggccgccgcgccgaagtggctctccgctgtggtggggg

SEQ ID NO: 71442 - DNA, 356 bp, Triticum aestivum
  Clone ID: PAT_TA_71442
ttttttccatggcaacgccggattgctagccggcaaccccatcgagtatcttcatatttttcgaggtagtgtgagggcatagctagcagccgacaagctccgattgttcccgccatcgtctctgtggaggttccatcgcccgatcgtcggatgcacctttgaggtaaatggagatgacgccgggctgcacgtcagcagccccggcgacaatatcgtggaggtgttaatggtgtggggctgtacgccggcatggtggaaatggcgcctggttgcgaaccggcaacttccgtgttgtcgtggcggcgtaaatgacgccgggccactcgccagccgtccctccgatgtcgccatcaacg

SEQ ID NO: 71443 - DNA, 336 bp, Triticum aestivum
  Clone ID: PAT_TA_71443
tttttttacaaaacggagttttccaaaagctcaaaaaccgagtttatacaaaaaccactaattgacgtttttatacaaacgcgttttctacatgcatcacgagatcgaccaagtccgacgtgctggtcatggtaaactccgccggccgtgacggcagcttgacaaagccaaaagacatcgctgccgatctcggccaggcagccggagcaggttgcgatgctccatctagccctgagcctccatggcggacgcggacttcggccggcggccgtcgtgttcatcggccgcttcacaaccaccgtcgtcgtccatatgctccagcttgtacgtagtcgt

SEQ ID NO: 71444 - DNA, 283 bp, Triticum aestivum
  Clone ID: PAT_TA_71444
ttttttttttttttgccgccgacacggtttcttcacaccaggccaagccggccaagcagaggcgctacattccccaggtatgcgcaaacatcgtggttctactaatgcattgaagctacatatgtagtaccatttggtggtggttactgatgtcacttcttcacttgacaattgcattctgccgaaaggactctggatgcaccggacctcgttaacaaatactacctgaacctaatgggctgggggagcaacaacgtgctgtccattgcgctgggcgaaacca

SEQ ID NO: 71445 - DNA, 401 bp, Triticum aestivum
  Clone ID: PAT_TA_71445
tttttttttttttttttttttttttttcgacaaatccacatttatttactgcaatccatatctaagacattactacaaattacaatacggtacgtgtgagtctgaatcaatcctgcctaatggcaaaatgtaatctcaacggccccactatatagctagctactcatagccccgatcccatatatatactcataggcaatatgctggagtacgtacgtacatgtccacgtgtatcaccaccgactcagcaacgcaagagcaaggaccccgtcggtgtggagtgggctcaccatcagaggttcatgtccacgacgagcggctcgtcccccttgtgaacgtcgaacgcgcgcctgacctgcttcccgccggcgccggcggccacctccacgacgtacttgccg

SEQ ID NO: 71446 - DNA, 335 bp, Triticum aestivum
  unsure (1)..(335): unsure at all n locations
  Clone ID: PAT_TA_71446
ttttttttttttttttttttttttatcgacccaaccaaaactcctcttcgccattacaagtcttcaatcgcagccacaatgactttcttcacttctgtcaacgtcgtggaaatctatatttagacaggtcccatgacactgacaagatagcaaagcttcgcacgacaccccngaagcctctttggccgaagatgagggcacatccgaccggatcaattccgatcaagatatctactaacgccatgagccaaaaaccgagatctccgagaggaagaccggaacccatcgatgtccagatcgaggagactggcatgaagcagatcaaagttttgaag

SEQ ID NO: 71447 - DNA, 363 bp, Triticum aestivum
  Clone ID: PAT_TA_71447
tttttttttttttttttttttttaagaaagaggcacatctgctactatcataacagcataatgtactttttttaacagaacagtacaatggatttcattgctctctcttatgcgacatgctccaactgccacaacttgccatcctattttgatcctgaggagctcgtgaccatggccattcaccctggatcagacgcgctgggagcttgtagcttgtcttggtcatactgctatcctgtagatgatgtccgcagccaaggaagatacatggggccagccttgcatgtgtgcttgcttcatcggtgcatgcatcaccgtagcagccaagcaagtaggcatcatcaacatctcctcaccactttc

SEQ ID NO: 71448 - DNA, 295 bp, Triticum aestivum
  Clone ID: PAT_TA_71448
ttttttttttttttttttttgactgaaaaaatgacgcatcctagtcccagctgaagaagcatcacatggggagtaggaaacacaacacaacaggattttttgtcacctcactagagagagagagagagagacatggtggaaatccgaatcatcactagttagttataggaagttgctcatgcggtggctgctaaacaagcagcaacacagggatcagcaacaatagcacaggagtcagcactagtgtgggggtcatcaccgtcagttagctacagattctgtctagcatcaggtc

SEQ ID NO: 71449 - DNA, 238 bp, Triticum aestivum
  Clone ID: PAT_TA_71449
ttttttttttttttttttattctcaggggaagacttgtatagaatatgtccttagatgagatcaatgtgatcaaattttttgaagatacaaaacatgttcaaaaattccgaaaaaaatgaagacacacattcatgtgtgatgtacaagctcaaaaagtttcagcacctaattcgaactacacttaggtgttgtttggataaggggaacatacagatcgggatctccataagccagaaa

SEQ ID NO: 71450 - DNA, 399 bp, Triticum aestivum
  Clone ID: PAT_TA_71450
tttttttttttttttttttgtctcgaagaatcaaagtagcagcgattgagctatttatgcattagcaaacagtacaggaacttctccgaacattcattagtcagaaccaagattctaaaacactggacctcaaaccaaagagataaacataaaacacacagaatgagacgtcatggatcggaacataagcagcaatccgacatcaaaatctaaacgcctgatgcaacacgggagatagtcaaaggcgtgcacactaaagatgcaagcacgaccaattgacaggtgagctcgtcgcaacttgcttgaaaagtataaagccactcaaataaaccacaagctgagtgctgatttatcgaagcgagtcaatgagccttaaatcttcatgccaattgatcaatg

SEQ ID NO: 71451 - DNA, 317 bp, Triticum aestivum
  Clone ID: PAT_TA_71451
tttttttttttattttttttttttttgtttttacaaatttaaatagacatgtttaatgtaattgagggtcatacgctatctcataatacaggtggagttacacacagaagtgaatacgatgaacctttacaagaaaactacacatacacacacaaatcacaacataggaagaatacaaacatgaaagacaaccttcctttcattgctgacctgggacatgaacaaagcatgatgatacatacagacgaaatgcttcagctaagctggaaccaatcccagttcttcatctttttttgcagcaaccaaacagtgagcgg

SEQ ID NO: 71452 - DNA, 262 bp, Triticum aestivum
  unsure (1)..(262): unsure at all n locations
  Clone ID: PAT_TA_71452
tttttttttttttttttattttttttttttgaaccaaagatctttagaaagcttccatgggaagaacatcacgtcttttacattngagacatcacaagcatacacatcaattgtacagcaaccgcccttctaaactacaaacaagccgcatactaaatttgttaccaagtgtactttcttgctgattacatggttccagaaaaatcggagtctgagacaaccagacatgatctgtactagtatgggaggtgacattatcagt

SEQ ID NO: 71453 - DNA, 338 bp, Triticum aestivum
  Clone ID: PAT_TA_71453
tttttttttttttttttttccgacgattttctttccacttcatttaccggattccacatttccaaaagggtgcaaaatgcaaagtatcctcacatgtggcctccatccttgacgacgcacacacgcagcagtaccccgacggtatgtatgtagtcctgtacaacacctgactctgtctgtatcgctgtatacacctggacacgacacccgcactgtacttgctgctactagtactagtataataacggcggtgagcggcgaacggctacttcttactgcgcggcgccttgccggcgggcttcgccgccatgaagctgcccagctcggctttgcggagc

SEQ ID NO: 71454 - DNA, 321 bp, Triticum aestivum
  Clone ID: PAT_TA_71454
ttttttttttttttttgttttttttttttgaataaaatgcatacgaaaaggatgtactgtttaccaactcatgccccatatacaactataaaaggtctaaaatggaaaaggcaatatctatacaagtgtatctactactcatgctaatatattttgcacatataaataattgcatatatgatctcctacctactaatttgcttacgaaatatgacaccatcatcctattgaggacaagtacaagatatgtgtagtacgcgacatgccgccacaccttcattgatgatccaattgttgcttgtcatctactagtggttgggg

SEQ ID NO: 71455 - DNA, 411 bp, Triticum aestivum
  unsure (1)..(411): unsure at all n locations
  Clone ID: PAT_TA_71455
ttttttttttttttttttttttttttttttttaaaacccgtaaaaaatctttattcacagaaaaggtttccgcaacactatttgttttacgtcggtaaaagttcagcaaatagagatcgaaaacctcttgaaaaattctgaaaattgaaaaacatgtgaattttaactgccaatattatttagacgctcgtattgagaattgttaaactgtgttcaaacatttcccgagagtgtttaatgaataaataagtttagcgattatttgtgtcttttcaaatgtacagtgcacatctgtcaagcgttgctgtgagtccgctcccggccgtgctgtgtcgcacggcgccggcagggtaggccgaccattcnacacggctgtcggctgggcgggctagggggaggctgtggtggtgg

SEQ ID NO: 71456 - DNA, 288 bp, Triticum aestivum
  Clone ID: PAT_TA_71456
tttttttttttttttttttttttttggaacggggggagttttttttaattgaaccaagcaccaatctgacggcaatctcttgcctgaccaaacagcactgaaaacatctcattacaagtataccgtgtcagtacaagttccatatacaacccatcataatttcataagggagtcaatatctcacgggcgcatgggctttcataaaatgatgagccaactattggggaaaccgctaaatctacatacagttgtcctagtacaaaaattagcccacaaggaaactccatg

SEQ ID NO: 71457 - DNA, 427 bp, Triticum aestivum
  Clone ID: PAT_TA_71457
tttttttttttttttttttttttttttttaaaacatataaaattttatatgtataaaaaatatatcctacaacaatcataatataattgaaatacacttcactcgcaatttaactcaaccatgtatatagggagaaatgatctaaataattatatgttgtctttagcttcatttgcactccgcaaccctagtccatgttcgccacctcagtagtgacaaatccggctcgcaatgcccccttccacccatgattctcctgtttttatgatctctgctatctgggcaacatccagattgtagagacgtcattctcttgagcacatcagacatatgtgtcttctattgctacttctgcttgagtgtgctggtgaatgatctcatttggtatgtaacagatagacaaaaaaccagttgtgttgaacaatca

SEQ ID NO: 71458 - DNA, 301 bp, Triticum aestivum
  Clone ID: PAT_TA_71458
ttttttttttttttttttttttttttgaaacaaagaatctgtgcatgttttgcgatctctcttgaatgcatgcatgtatgtacaggaagaaagaatgatgggtgaccttgaagctctcgaactagaaatagattcgacgaggatcagtgaccggccagttaaatcagaggttaattcctactggtagttcttttttcaaatgaattcctactaactagtactccctccgttcagaattacttgtcgcagaaatggatgtatctagatgtattttagttttagatacatccatatccaagac

SEQ ID NO: 71459 - DNA, 349 bp, Triticum aestivum
  Clone ID: PAT_TA_71459
tttttttttttttttttttttttttttttagccaataacacatacaatttcaaacaacagccaaacgaagtaatttacagtcatggcaatacaaatcaggtattcaactataaaatacacctaatattaacatggccagctccagggagctaaaacacatagttgggtactggttttcttcgggattcttctcctggggctgacatattgaactcgatgctgcagaaggctgatgatgtggtggtacagagcaggccctttgtggctggctagatgcgcccctccccttgctcctcgagcaggacaaggacggcgaccactaggatcgttgagatcgggatgctggggg

SEQ ID NO: 71460 - DNA, 204 bp, Triticum aestivum
  unsure (1)..(204): unsure at all n locations
  Clone ID: PAT_TA_71460
tttttttttttttttttagaaattatcaaaaacatgaatgccccntgatgttacaagccccacgattccatcacaacggcaggtcatccccttgtcatctactggagatgcccaaaagttttgttccttccaaatggtgaaccagaatcttatcttaaaacctaaatgaacctataggggaaagacaggcctttcccctataaa

SEQ ID NO: 71461 - DNA, 458 bp, Triticum aestivum
  Clone ID: PAT_TA_71461
tttttttttttttttttttttagcaaacggaaggggccagctcgttttcaacgacttgaacaaaccttacacatctgctgttccacaaactaggtccactcaactgcaattcatcaccgcgactcgccggcgttactggttcaaaccacagaagtctgttcaagcaaacacctgcgccattatgcgacccctaacaaaccaacaaggacctccaacgaactgactaaactgagtaaacaacaccttcttaaagtcttaacgacgacgacgcaaaggatcggtggaaacagatgaacaccactgttgatcaaccggcacgctttacgcggcggacgatgtggaccttcattgtgcactccttgcagtgcctcagccgctcgagaaggcagacatcgcccgtccgcagcccgttctccttggcgaactttacccatccacccacaaccctgttgttctga

SEQ ID NO: 71462 - DNA, 291 bp, Triticum aestivum
  Clone ID: PAT_TA_71462
tttttttttttttttttttttttttttttacgggaaacatgtttttcattaatctcattggggaaataaattacaagatcccataataaaaaaattgcgctccatggcctactaccacagccgggctgactatggcgattgtgtgatctcctggttcccggggccttggaaaatttccatttaattacccccgcgggttgctccacaaaatacctccaattgagctgtgtggtcgtcttcattgtcttcacttcgcgttttccatgcatgatgatggtgatgtctgtgtgg

SEQ ID NO: 71463 - DNA, 303 bp, Triticum aestivum
  Clone ID: PAT_TA_71463
ttttttttttttttttttgaattcaaatatgtatgtcatctatatattattaaaaaaataacctccaatagaacacttgcgaggaattttgttattgataaataaagaaacaggaagccgtgttaacctttaccacatgatttctgccatggtgccttcttcaaaaccacacacctttgtatcctggaaggaggccttcatgggagctcgatgaactgagggacacttgacacctagcaagttggtactcggttcttagtagactaatatgtaaaaaaaattggcatgacgtgctaatgtata

SEQ ID NO: 71464 - DNA, 412 bp, Triticum aestivum
  unsure (1)..(412): unsure at all n locations
  Clone ID: PAT_TA_71464
ttttttttttttttttttttgaccaaccataaaactttgtttngggaaccaagcccttcaaaaccaaactggagatagtgcaatacactaagtggttatatataagctacgaacgacacagaaggttgaagagccaaaaacacttgctagaatggggtaggcgctaacaagaacatttctttctgttggcaagcaaccaacgctactacgtacgtacttactagcacaattctacgtaacagggaacggccactctggattcagccttctcgccgcgcgccctcgggttttcttcgaatcaactctagtcaagggaggcaaaaaaaggttacggtgcattgtctcacaccgactgacttcaacagccaaccctttcatctgcttctaacatccatcacaagtggcactccat

SEQ ID NO: 71465 - DNA, 367 bp, Triticum aestivum
  Clone ID: PAT_TA_71465
ttttttttttttttttttatttttttttttagatcaacaggggaggagctccattacttcagcagaaagaagcccaaaaacatcaggttcgatacataatacatcagtaatagaaaagagaataaaacctctataacctcacactagttgaacaaatgttacaaggatcaaaacatggtcagcctctctcctggacttgagcacagggggatttggtccacccaatcttggcagcaggttttggagatgtagacagaggagatccatcttcttcaacatgtgatccttgaggagcaggcgccagcgccatttccagacatccaaacggcaccattaaaaacaatactactccctccgtaaagaaata

SEQ ID NO: 71466 - DNA, 456 bp, Triticum aestivum
  Clone ID: PAT_TA_71466
ttttttttttttattttttttttttttttttttttttagcagaaaggcaggatttggaatccattttcaatctacaagttccacatgttacatttatatacaattccgaaaggtccttgcaacgtgacaaaaaataactgtacagcctagaaccgtatatatacaaagaaagagcacgtggaccaatgtgttctgcaaatataacatcataatctcacgccagcgaaagttcttcaacgcatttgacacctcctggacaaaaagggtggagggaaggactaatgccgacttccatgcaaaataatcttatcattcgaatctcgtgaaatgatgatcccatgaaaaaagttagttcttgatggacctctgctgttgcccgctcaactgagcactgcagagatgactcctcaaattagctatgtacctatggataccctgctggttgaatggtgaaag

SEQ ID NO: 71467 - DNA, 355 bp, Triticum aestivum
  Clone ID: PAT_TA_71467
tttttttttttttttttttaaaaaaaactcacaccaaatggttcaagatgtaatgtacacgcaatgcacacaaaatagttttccacacagcatatacacttcagttacaaaaaaaaggcatatacactgccggaacagattctcctttcctaagctctgcatacacaatctcagaaaagggaaaacttctatcatcccatgcatccatgtatctgaactcctacaggcacaccatgattctcacaaagattgagagtttcagagaagctgctattgcagacgcaggtgatctcattgtcaattcagaaatatgggcaacaggtaaatcacggagaagccaattgctctaccctct

SEQ ID NO: 71468 - DNA, 233 bp, Triticum aestivum
  Clone ID: PAT_TA_71468
tttttttttttttttttattttttttcgcaaccacacactggatgccatcactgcgagtccatacacacgcacatgtgcgctacgcatcacgtacacacattacactacatcacaaaagtgtcgcgtacaattcgttcagagcacatattcaatcaatggcgatcgatgaattgagaatgacgatcggcgttcgtatatatgaagccgcagcactgcactagtgtcttttgag

SEQ ID NO: 71469 - DNA, 251 bp, Triticum aestivum
  Clone ID: PAT_TA_71469
ttttttttttttttttttttaattacacatcttttattgacgtgagcagacaacaacacttaacggttagacttggcaacacgctccaattcatccttcttcttgatagcataagagtttgatgagcccttagcagcgttgattagctcatcagccacacattcagcaatcgtcttaatgtttctgaaggcagcttcacgtgctccagtgcacaacagccagatagcctggtttactctcctcaaggggga

SEQ ID NO: 71470 - DNA, 213 bp, Triticum aestivum
  Clone ID: PAT_TA_71470
ttttttttttttttttttttttttttttcgtcgaaaacaaataatttagcagcaaggtttaaaaacacacaaataacctgtgtctcgttcacgccacatgtttattgcccaagtagcaacatattattgactcgatcattactctcttgtacaacttgacagtccaacaaccccacaaactatggccgctggggcctgggatccaaacacaca

SEQ ID NO: 71471 - DNA, 305 bp, Triticum aestivum
  Clone ID: PAT_TA_71471
tttttttttttagcaaatcatggatggtacacaaaccacataaatgtagttggaatttcaggaatgaggcgagcatacacaacatataacaaaaagaacaagaccgccccatgtgtgtgaagggaaacggcataccgcccaagtcggaactacaagcatagaccaacagagatccggatgtaagtgcatatcatggatggtacacatacatgagttaaaccttgaagccatggttgttcctcaaaccactagccttctcaaacttccttgttttggccaaggttctcaaaactgcttccacctag

SEQ ID NO: 71472 - DNA, 329 bp, Triticum aestivum
  Clone ID: PAT_TA_71472
tttttttttttttttttttttttgaccccctctctcttctttatttgaatttatttccgttttccctaatatgtactgcatgaaacatgttcttgcatgcaggcgctaattagttagcgcagatgcagagcgcagctcagtaatcctgggcgggcacgggcagctcacgcctggccgctgccgccggctcctcgggttgctcggtcatgacaaactcgtacagcgcgccggccagcccggcgccgatcagcgggccgacccagtagacccagtggtggcgccaggtccagccgacgagcgccgggccgaacgcccgcgccgggttcatg

SEQ ID NO: 71473 - DNA, 511 bp, Triticum aestivum
  Clone ID: PAT_TA_71473
tttttttttttttttttagaaaagggaacacggaatttgagtcctctaatttcatttttatgatccagctggaccagccggagatcaaatcaatggaattatgatgaactgcagcaaagtatcaatgtcaaactcattcattcatttgcatccaattttttggtgtaacataaaactgaatgaactaaaactaaatcagattttttctacccatctccttctgaactatcttgcactcttgcctcttttccgctagtatgaacaattaagcgagactgaaaaactaaactccatctctcttgatggccaccacttttggcaataacgcacgcggggctgctactgttatcttgaattctttgccagcccgaccagcctcaccgacgacggcatgtcggcatccttctccccttcctggcctccgatatcgtctcgagccccggcgaccacggccgctgctgcctcgccccaccagctgcatgtagtgcttcctcagctccggcgtgctgca

SEQ ID NO: 71474 - DNA, 442 bp, Triticum aestivum
  Clone ID: PAT_TA_71474
ttttttttttttttttttttgcacgtgttcggatagccaactttatactgtatttgcacttataaatgtctcgatggcgctgaataaaacaaccattcaacagcaccagctaccaactgttagtcgaccatcactcgctagtcactactgctcactgtcagcagagcaaacgctcgaggactgttgctgtatcacgtgtcaggatatgatactctgcggtacagtcctgaagccgcacagtcaaggaaattttcaactagatggatcgccaatcctgcatggagaagaactctgaacccgcacatgccatagcaccatcgcaatttatgtacacagagtatacagggcctcctaatggacaattcaagtgctccaaccaagttaaaagacaagcaaaatcagctcgttttctgccagatagcaagcaagcaaccttgacatc

SEQ ID NO: 71475 - DNA, 525 bp, Triticum aestivum
  Clone ID: PAT_TA_71475
acattaattctcttttacacaacccattatttgcagcaagacatttttctcttttacaacatatatgtaacattattgtaatgattcaaatttataaccagatcaatgatgaagttatgctaaaccttcatcacttctgaacattttcaacccatatccaaaagggaacaagggatcatagttagcatctccaacatttataggcagttgatcagaagacctaaaccacgatacaggcaatgtacccacgaaatcatgatctccaaagaggcaatcagtaattcccatgccctcacttccaggtagccaggcagcaactagagcatctatcttctccagaacttgtggttcaataaccaagggccttccagatacaacaaccactagagtagggactttactagcaacacgagtaatcaggtctgaaccattaaatgggatactaaggtcagttctatctcccaacctttcagcataaggaacctcaccaaccgcaacaatagcataagaaaattctccgctttc

SEQ ID NO: 71476 - DNA, 181 bp, Triticum aestivum
  Clone ID: PAT_TA_71476
ttttttttttttttttttttttttggttcgggaacacggggtttcttttttattccgggaccgatgttatcaacacaaacaatttgtccccaattcgtttgcgccgcccgattaacagggtttaacattacattacgtactccatctgcaccggtgccaacttatccatgaattgagcggt

SEQ ID NO: 71477 - DNA, 442 bp, Triticum aestivum
  Clone ID: PAT_TA_71477
gggccccccccgctcctcgtggtcaagtaacatgaatgccactccgtgatttttctcacacgcgaggaacagagtaggacgtgccgacgaagcagagcacaacgcgtgcggtcgcgtgaggcgggcccgcgaggggcgctggatgtcaccaccgcttggtacggtagaaacggacggtcgcgcgtcgctttcagcaactcgtctagtcatcggcgccgcatgtccgcatgcaatggaccgtgtcaggtggaccttcaaggaaatgggacgaggtgtggcggtgtggttcgatgactgacttctgtttggccttgttggcacacctcgcaattatttgtccgtccctcaaaaaaaaaatctgtcggtcggccttgccccgcgtactgggaatgctaatatctttcaaattctaatactactactcccttctctctcaaagcat

SEQ ID NO: 71478 - DNA, 509 bp, Triticum aestivum
  Clone ID: PAT_TA_71478
tttttttttttttttttttttttttttgaaacagaagagattttacagaagtgtcaaaaacagaagagaatatttacatccgcacaactaaggaagagctactacaaacgaaaggcggaagagtttatctcctctctcaggtaattgcctaagcgaggagtttacaaaacttgcaccaggggtggaaaagacgccatgaattacaactgtggggtgtgaattacaactgtggggtgtgaattacaactgtggggtgtgctaattgtacagactgtacaaggcttacgccgtatatgatcaaatctttcctacaaaatgtacacctctataatctccatgaagaacaatgaaaatgatgctggttctcaagggtatgattcctagctgtgcagaattcacttgtcctatacaagtttgctcgtcattcggtgagattgcacaggggtgcttgtttgaccacttcatgcagggagagacacgacggagtgtcaatgaagtctacagttgag

SEQ ID NO: 71479 - DNA, 504 bp, Triticum aestivum
  Clone ID: PAT_TA_71479
ttttttttttatttttttttttttttttttttttttttgagacagagatcaatggttcaaaaatcgagtggcccaaatacatttttcagctggttgacatatagctaaagtgagtttgctcggtgacttgtgtaaatccgatgatgtgtttcaattctaaaacacaaaaacctttgtaaaggttgagtgatggtacaactaataatgtaattaaacacaacgagtgcatgtttaaaacaaacgagtcctactgcatttcaaaacgtaaatgcatttgttccatagtaaatactccaacttccacaggaaaatgactgggcttttttccgggtgcgatcagagcagcgtgtggtctgtctcgtttcagcaaagatgcttgagtcaagctcgactgagtggcggccgcgccgttgattggcgtgttaccgccgatgaagatgtgcagctccctgtaccactgaccggtggcatgtagcttgcagccggcatccttgaggggagggg

SEQ ID NO: 71480 - DNA, 487 bp, Triticum aestivum
  Clone ID: PAT_TA_71480
tttttttttttttttttctgtaactgaactaaaataaacttttacccaaataaatgtgaacactgggacatttgtacaagaactgaatctaatgccaatattgaatttgctggttccatacgcaagctagctaccaacatcaacttcactgatcctaaaatcaatcaccaccacaagaacacaataaagttatccaaatggttgctcgaggaagagctagctactaaatccgaccacatttaccgcttggagtagccaaccacctgtttctagagggatttagcgacgtcagcggccgccatctcgcacctaacttgctcatctccagctcttcgatgttgctactgccgttgttgttgcccccattttctgaacctatctcggcgccatatctgaacctccattttttgttttattgaactgaaccaaaaataaaaatagagcttaatttaagttaactaaaatttagaaattgaacttaactaag

SEQ ID NO: 71481 - DNA, 353 bp, Triticum aestivum
  Clone ID: PAT_TA_71481
ttttttttttttttttttttttgacatcttgactctgactgaacctcgtcattattgttacatgacagcatagatgttgctcagttaccaatttgttacctgtcaagattttcacatgttgtagttggtgacaggggatataaaacatgtggatattgttatactttgtagctggtggcaggggatatgatgaactgaccaattgttttcatgcatattctatcacccgtagttcttattacagttacatgatcatgtgacagcatggcatcagacagcacggccttcaccttaatgcacccaaaggtgatcatcgccgaagcacacaagggtgagccataactataccgctg

SEQ ID NO: 71482 - DNA, 496 bp, Triticum aestivum
  unsure (1)..(496): unsure at all n locations
  Clone ID: PAT_TA_71482
tttttttttttttttttcaatgtacaattgtgagtagaatgagagcactaatacatcttcaagagctgctagtacattctctccacctcaatagtattgttttgcattgcattaataacagactattactccaatcctgcatgtcccaatgaaagtactatgtcctttctcttccaagtcatgtccaacaatccaatcattctgttgtccgcatagacatagctggccttccccgttcaaccctcctcttctccttctaccacgcacctgtttaacaccctatctacctcctggaccgcacttgcgctatgagctgttgtaagtattggagcaggaagtataaaagaacacaggaggggagcacgacagggcatcgaagaaatgaaccgttgctccttctccccactcncgtctccttccatagccggttactctccacaagcaaccattgtatcctctgctcacgtccagccatcaccgcggcaatggtttgtga

SEQ ID NO: 71483 - DNA, 433 bp, Triticum aestivum
  Clone ID: PAT_TA_71483
ttttttttttttttttttaaatgatcagtaattataattattactatacaacaacaattcctgacggtttttcatgtctgacaaacatatggaactactacatccataatctagctaattgagagcaattaatcttcacatcaatatgtcatcagatataactatatacaaagtttggacatatgaaggttctgctagccttaaagattacatgtacatcttgcaaaaaatatatgcttgacagatctacaggtgtcctcacttcaagctttgtctcaaggttctgctaggctaatctgttacatgtacatcctggttgtttaagtaatcatatcacgcatcttctagacattcagctaaccccaataacaaacaatagagcagttttcagatcgtacaatggccaagagacgttcagtcctatcatggcgga

SEQ ID NO: 71484 - DNA, 555 bp, Triticum aestivum
  unsure (1)..(555): unsure at all n locations
  Clone ID: PAT_TA_71484
ttttttttttttttttttttacattataattgcttgttagttcatttctatagcaagatagggccccattttttagtttcgcacagcgcgggttttgccggcccggccctgctcgctttgccctttttgtgtgaaggcgctgcacaaagcaggcagcagctgcattgccatgggcgctgctaggcgccgggggcgcccggcccaaatttgggccggtcgcgccctanccgcccgatgccagtcgtcctgaccgatggatctacgaacaacgcgcctttctcccgatgcctgttggctgcagttcgtagcagtggttgtagcaaaaacaacaatgcttgcagctttgcgcgtgtatggttgtagcttgtgcgagacaacgtggtagcattctccgacgaaaaagctccgatggttgcagctcccataagcacagttgtagcagcgccaattccagttgccggtcaccgccatgaatggtggtaacaaattgatgtcgccggtagtagcttctcggaaaacattgcagcttttttctctggtcgccggtgctcgtcg

SEQ ID NO: 71485 - DNA, 414 bp, Triticum aestivum
  Clone ID: PAT_TA_71485
tttttttttttttgggaaaaactgaggcaatttcataaacaaaattcaactctacaggctaacaggaattcttcttatcttacaatcatacacacacacactacaaataccgatataactcatgcggaccaaacaatatcccataggcttctgctgctccaggggctctaccgacaatctatctagtgaatgaccttccccaccatacctggaaggctcggctaaggttcgggcattccccccccctaaatgcgaagcactggaaccattcctcaaataggctctgctgctccccaaacggaagggtgaaaagggcttgccccaagctatcctccaacgctctcgcatccattcctttcgaacacctttgaagccagccgaaatcagttaacatcggcgtgaaccatccccgga

SEQ ID NO: 71486 - DNA, 329 bp, Triticum aestivum
  Clone ID: PAT_TA_71486
ttttttttttgagggaaaacttcagtcaaaattagttgatcttgtgaaacccacttacccagtattcggtccacaagaaaagcacatacacaccctaaagagccgacagatcagctctcttgttttcagtttattcaattccagaccgacaaatcggacaatttctttgcagttcatcagctgaagcaatttaacccctaaactaaagataacctctgcagatgtatagactggctccaggtagatcaatttacagtgaggaggctatactcattgactactttaattgctgtgctatgagtcaaggatctggaatgtctgaagaggga

SEQ ID NO: 71487 - DNA, 422 bp, Triticum aestivum
  Clone ID: PAT_TA_71487
ttttttttttttttttttgtgcgtcaattataaaattatatttatcaatttatataattgtgtacaaataattaaaagtactaaatatattctgtattagtttacatcaatttcataagtttataatacaacatattttttaaggtgattatacatattttgtttaacgttatagtgattatgcatattttgctcaacaacataaaaaacatagattacattatcaaatttggttaatagtttaataatttaagtaggtataataaaaacaattggttaggtatgacatgtttgtgagaagagaagttgatacgccgtcatcataaacagcaaatataaatttagttggttttaaatttctattatattgcttctgcggataaattgaattgtgaaagaagcatagaaaacacaactcatat

SEQ ID NO: 71488 - DNA, 531 bp, Triticum aestivum
  unsure (1)..(531): unsure at all n locations
  Clone ID: PAT_TA_71488
tttttttttttttttttttttaaacagaagcgagacttttccacccaagcaaatgcgtcgatagtacacaacatacgatacaatcagtttgcaattgattatccgattcgtcctcatgcatacccaaaccttatctgatgtcggagggactcgtatcagatcctagaagaggactccacaaaagttgatgctgacggctccatgaaattggcgtccgctgctgcataagttcttaacatgcacaccnatggagagacgatggagaggaagagacggctggtcaaccttccacattcctaatagcaatcggaggggcttgccttcatcatggttagatctcgatagttcttttttcgtgctctgtcacatgacctcgaagtatttaatagcgccatccaatgtagcattatactgtgcactgtgcagaacattgaacgtaacattgcttaggcttgactttcagatttgtaaaaatcaaacactatgtcatatcaagcatctttggaagctgcactactgatcacatcctca

SEQ ID NO: 71489 - DNA, 387 bp, Triticum aestivum
  Clone ID: PAT_TA_71489
ttttttttttttttttttgagagatacgggacgtcttttttattagcttataaggactaatctacaccgttataattcggacccacaagattaacggctctaattttctaattaacatggtaatttctagagagtctgtaattagtataggtatagatgtccatagccaagtttccatatgtccactatgtgaccataatgtgtgtcctttcccatcttggttgctgcatcaaagcagacatgactgttttggtaggtgcttttttgatcttgggcgatatctggtgatcaaggggggcttgcctggttgctctggcaagaaggggtcgtcatcaccgtagtcgtactcagtggcatcagcaacggtctcagggtctaccggagaag

SEQ ID NO: 71490 - DNA, 444 bp, Triticum aestivum
  Clone ID: PAT_TA_71490
ttttttttttttttttttttttttttttcacccaaatcaaattatagatctgcagcaagaagctgctgctgctgctacatgctgctgacgacgatgtacagtaaaaaatccaggcaaatacaggtaaggcaatcaactacaactactactaggtggcaattacagtaagggactgatcgatcgagggatccgtcctgtcaaccaagaagataagtaccagtaggggaagtaaaactgctactgctgctgctcctgctgctgggaaaaatcaggattaaggaggtgaggtgataatggtgggagtatgtgtaacgagcgagtgaaagaaaaagttgttgttgatgaatcggtggttggttggttggttaggctataatgcttcttttcttctttccggagcatctttttcccttggcctttctacacggccggccggccggccgg

SEQ ID NO: 71491 - DNA, 563 bp, Triticum aestivum
  Clone ID: PAT_TA_71491
ttttttttttttttttttcgaaagaaaaaagttcttgaatggaaggagtacaataaaattacaataagagaaatctctctgaaacaaacagtgggtatacacacaaatagtaataataataatgttggaaaggctaaattgaacaacatgtggtaaaccttgttatagtaataaccataagaagaagaaaaccatcacacaaaggagagaggcagcatatcggtgcaacataattaagttggcagcaatgccgacggaaggtggcgccattgttgatttgcactgacgtgtttgatgaagtctgcattatcgatcagggttcttcaacgaacaaaaggaagggcacgggcctattattatggccatctacagccagttgccattgagctcttattccgccctggacctgaggatggagctcgacttgatccagctgattcatatgtgcaatctcaatgccgggtgttccaggaagaacatccagtgtttcacagaggatatgaagcgacacaagatcaggcagcgcgccagcttggattgttatgtctagccttggcttgcac

SEQ ID NO: 71492 - DNA, 496 bp, Triticum aestivum
  unsure (1)..(496): unsure at all n locations
  Clone ID: PAT_TA_71492
ttttttttttttttttttttttttttttttttccggttcgaacccgggcgaagccaaattttattttcgttttctttacctccttttttttgcaacatctatttttgctactcgttcatccaacacatagccacacttccagacacaggcaaatgcccgttctaccacgacgcatgcaactgacaaactgtacaaatccaggagaacaacagcacaggagaggcagatcattccgctcagacacgcgtcgaggcgcgtcattttcatcccgaagaaagcgccgcgacagcgcgagcgagcgagcgagcgagagggcaacagatgagcagcaagctccgggggaatccggcattttaccggttacggtagacaggaaagctcaggggatacgatcccacggccagttgcaccgggcaggccccggtgagcancatctgaatctgatggtcgccaggaggaccatgtaacaacaatgtcgtgcacttggctgggttgg

SEQ ID NO: 71493 - DNA, 481 bp, Triticum aestivum
  unsure (1)..(481): unsure at all n locations
  Clone ID: PAT_TA_71493
tttttttttttttttttttatggatagtttctatactaagcataggcagagtgtataagaacatgtgttacacatagtttttattgcttaacatttttgcagttggacaggtcacatgttacagattngggagtcttccccttgtattagtgatggtacccacagatatgataaaacaaaaagtaactaataggcacaaagcctttgttttctcccaaacagatagaattagagcatgtaaatgcatactctacttgcgatgatagcattcaggtctttatgtgtttgctgatggtgtaacttgcacaagtaactccacacttagtccgacagagtgatgacgagtttgacgtatcaatggagccgccggatcagttggatgtaagatatcggggacgatgagtcgtcggccatggcggtcgaaaagcacacaccaagccacctaattaacttgttcgtcggcgcacatggagcagataac

SEQ ID NO: 71494 - DNA, 438 bp, Triticum aestivum
  unsure (1)..(438): unsure at all n locations
  Clone ID: PAT_TA_71494
ttttttttttttttttttgaaaaaacagatgaaaacgaattattttcatcgcggctgacaattagcaattccgtaaaaaagctttgttccatgcaccgcgatcatctcaaactcgcttgtggagctctcgccggcgaggctgcatacgagctgagtcgactacacagcggattaatggtcggacgtggcggtttccatgaagttcttaacgtcgttgacgagcttcccggcgtcggggagcttagggaacatgtanaagccatggatggcgtccggaaactccaccagctgcaccgccttccccttccgctgcagcatggcggcgtaccgccgctgccagtcctgcagcgggtcgagccctccaaccaccaccatcgccggcgggaactcctccggcaactcgggctccggacacgcctcaccggtcacatgcgccgc

SEQ ID NO: 71495 - DNA, 547 bp, Triticum aestivum
  Clone ID: PAT_TA_71495
ttttttttttttttttttaaaggaagaaagagaaatagatacatgatcgaagaatgcaagtagaggatacatgaaaacaagacatggaggacgacaacctcgatacaaactggaatctgcagctaagcaaatcggaacggacacctaacagattacgaaacagaacatgcatacaacaagaaaagacaccaggactactgaaggaacgaaaaggaattgatacaagctgctggcatgaagcagcaaagactgatgcagaccgagaccaagacccatgaaacatagccaggattgaactactcattagaaaggctgttggcgcgcactgaggaagcagaggaaccaccgtcagaagtcgaggcagccgctccatcataagaaactctggtagcacgctcctgtgcttggtcgaggatggcagcaacattgagatcacaacgaagggcgatttgcttcagcttgcccctggtcaggggcgcgggcgtctccagcagcggcagctggaggagccgttccaccgctaccgctttcgccttattgcgcctcg

SEQ ID NO: 71496 - DNA, 592 bp, Triticum aestivum
  Clone ID: PAT_TA_71496
tttttttttttttttttttaaagtaaagatgtttgcatggacgtagaacatatatgattacatttacacgctgcacagagccgcatggatacatgtaggccggaatgtgtgcttatttacgtacgtacgtaacatttgtagacgtataaatattcaaaccacacaaacataaacacatgcacgtacgtatgcatgtatgatcacactcacacgcacgtactacttggcttcggcgtcaagggtgaggaacgcgaacgggcgctcgccgttgaagttgcccggggggttgtagttgcaggtgatgaagacgccccggttcccggcgcagaccacgcgcgcgcagccgatgcgggtcgacttgcgccacaccacctgcgtgtagtgcccgcacaccttgccggcgtcgcaggtgttgctgtcaagatggtagttctgcttctcgtccacccacagcttcaccgcgtcggcggccgtccacgactgcccggaaccccagaagatgttctcgccgaacggcccgccggagtgctggagccggcaatcgccggcgcgctgcgccgcccagtcctgcgcaaacctggccacgttgttg

SEQ ID NO: 71497 - DNA, 437 bp, Triticum aestivum
  Clone ID: PAT_TA_71497
tttttttttttttttttttttttaagtcaaagtttcaactggtggttgaatctggaccatgcatttggtgcagacatgtttaatttccaaaattttggccgtagtttttggtttttcttacagcctctaagtgtatgcttttcatatttcatactccctccgtccctgatacatccatatctagactaatctaagacaagaattttgagacggagggagtatttaactaggtacctggagggaagcagactgggaaaccaccgtccctgagcaacctgaacctcaaggccgcagaagcaatatcattggcattattgtcccagctgcaccggcgaggctcgcggtggacggacctaaggatactttcgatctcctcctcgaaatggtaggcgatgccgaggcgttgcaccgtgtcgacaagcctgagcttcacagct

SEQ ID NO: 71498 - DNA, 468 bp, Triticum aestivum
  Clone ID: PAT_TA_71498
tttttttttttttttttttttaacaatcaatgttgtcccattaattcatccaatagaatggtatgagtatatatttagaattaaactgacaagaagaaaattaaataggtgttacaggaacacaatttccagcattgccttcggcatgttgtcagcgctgggttaactggtgtgtcctgatggcctcaatgtcatccatgttgtgcatccatagcgagcggcattctggaatcaatggccacaaaagtggaagcaatagttcatacggaagttcttaaaaatatatgattgaggaaataactatgtaaagacgacccttgacaaagctaataggtcaagaaaactaagaatgaaacgaaatttacatgaatgtcatatttaagtttctgtagaatttcccccattaactcatggtaaacgaaatcgtgtcctctcaaagtcacaagctcgtctcataatgattgtgat

SEQ ID NO: 71499 - DNA, 371 bp, Triticum aestivum
  Clone ID: PAT_TA_71499
tttttttttttttttgtttttttttttttagaccaatatccaccctcttcatcaccttactgacataatgacaatgatcttcttaacacccctccacttgttttgacaaaaccacatgatttggaaatggaataatagtcacttgaacacatacgttgaataatacatatgtactccctccgtaaagaaatataagagcatatagatgtactaatatgcaacactgcatgaactatcagtcacatgtatatcagcatcatggtttccactttccagtgttttcttaaatttatcaatcacgggtatatcaacattatgtttgcctccaatatagttatagtggaacaaacggaagtactcaattgatagtg

SEQ ID NO: 71500 - DNA, 281 bp, Triticum aestivum
  Clone ID: PAT_TA_71500
tttttttttttttttttatttatttttgaaatggaggcaaaagattgcctcgtatattaattaagagagaaggaaattttagctgtcttacatatacaccccttattacaagaaagggattactctcccgacatgagcaaacccctggcttcttagctcccgcgggccacccaaagtgatgtctctttcttgatgttgtctaacaagatcgtgggcggtgtccctttgtcattgaaaacacgtgcatttctctcgttccaaatcgaccatgagatgagcat

SEQ ID NO: 71501 - DNA, 458 bp, Triticum aestivum
  unsure (1)..(458): unsure at all n locations
  Clone ID: PAT_TA_71501
tttttttttagatcaacaacaatttgtataggacaaagtcaacatttcaagtcacagctcacaaattactaacaaaaagatggcggcatttcgactgaagcggctagcttaagcagcttctgtgctataggtcaaaaatggtagccgaacctactccgacaactttgtcgacacattccttccttgtgctctctgcttcttatggcacaacacagggactaggacctgtgatgtggcactgtttgcaggccaagcaagaggctgcttcctgatcttcttatcgttcctgatcttcaccggtatcttgtgcgtcgacaggtcgacactttgagggcggccancacctcctcctgctttgaggcgtcgaggcttcgtccctgcagcgccaacacagtttctccccgtgtagctcttctccgtggtaatcacctgcaagcggataaatcacgacgcggtcg

SEQ ID NO: 71502 - DNA, 399 bp, Triticum aestivum
  Clone ID: PAT_TA_71502
ttttttttttttttttttttttagcggaaatctagggactttattgaagaaatattagtacgttatttgaagactattgttgtgttagaaatttcacaagcttgagcaggttctgatctgacgagcctccctgtgcgatgctggcagacgccgcgtccttccacgtagccgcccttgcctttatcccatcgtcacccagcagcagctcgaccttgttcttgatctcctccttggtgaccacccctctctcgtcggcgtggaccttggcgccggtgccccacacgttgcagatgtagctctggttggcgaactggtcggcaaagtagggccagcagaggaaaggcaccccgtgcagcatgccttccatggtcgagttcccccgcagtgggacacgaagca

SEQ ID NO: 71503 - DNA, 355 bp, Triticum aestivum
  Clone ID: PAT_TA_71503
tttttttttttttttttttgacaaaaaacatgtcgcatttcgcaatgcgcatcatgtgtaatgcgttgtatgaacagcgtatgttgtgtgtggtggtgtatgccgtgtgggtgtgtgatgtggggtaagttgtttttgcgtctgtaagtgcctgggcgctgagctcgtccacgacgcctcttgaggcggaccgatggatgttctgcttgaacagtctgcgcttccatcagattgaatcgcgcactgtctcgtcgtccgccctcagtgttacgcgttgggatcggttcgacatgtgccgcggggctggccattgaccagtgaatcgaccacacacacaaaacctttcgcacattga

SEQ ID NO: 71504 - DNA, 334 bp, Triticum aestivum
  Clone ID: PAT_TA_71504
ttttttttttttttttttttttttttgaacaaacctgaacttaatctgattgcactgatcgaagaaacaacagattgctagaccatactgacagcaggatctcaccaccatttgtttggtccagtatacatcactcccaattcctatgacatacagttacaatttagcagccgggagcttgaatgaactacactctctgacagtcatttgtgttgttgcagtacaaattaaaagctgaaataccagtatactattgactgatctatcaaaaaaaacatagtttttcagagaaccaatacaaaacacccgttgaaaaagaaaaagaaaaatgcca

SEQ ID NO: 71505 - DNA, 488 bp, Triticum aestivum
  Clone ID: PAT_TA_71505
gagttttttttttttttttttttgaaaaacaaatcagaatgatagtatgaagtctatataaatatatggagcccacaaaacacacattccattccatttgaaatgtgtcacaaaaagggcagtcgaaggaagcaactgacagacatactggagtcaaaacaggcattggagagccaccaaccaaagtcacgtttccggcaatacatccatcctcgacaccaactagaaactcttttgacgacgaataaattgcaaactgatgctatcggactgtaaccaaggtgtaactgactgactgactgactgactgactgtaatcgagaaccgccgagaccatgtagtaacctgtttctcactttcgttaatctatctctctctcttttttgttttatcttatcctctctgtgtgtttgtgcagtttttatcttaacctatgatgatcaccgtaccgtaccgtaccgatcgtggtagtatctcatatgcagggg

SEQ ID NO: 71506 - DNA, 330 bp, Triticum aestivum
  Clone ID: PAT_TA_71506
ttttttttttttttttttttaaaccaatcaaagatatatattcttcaagtatcacataagtgaccatagtccaatggagtgaaatttatttgcggatgatacaacatatcatatgatcgatgcgtacaagtgctagtgctaggttgtcactctcagctgactcttttccttgtagacatagtttctggtgatgtagatatagagggcaagctcggccgcacttaggccagcgagcaaccagtagaagtagtcaaggtgggcgcgattgaggttgttagagaaccagctttcgcccccaccgctgcgggtgatgtggtccatgaatgatat

SEQ ID NO: 71507 - DNA, 284 bp, Triticum aestivum
  Clone ID: PAT_TA_71507
tttttttttttttttttttttttttttttggttgctcgtcaaaaattaatttgatctgcgggcacatgaccccctaaaaatgtacacgggtgtattacacatggatccctttccttcagaaattgcgaagccagagggcaacaaatgagctcacggtgcaaacatgcaacccacatactacgctaaattcacttgatgaatgcgctaagtacaccaagtatcgcagggtggctgcttgcatccctagctgatgaaagatagagaggtctgtgtatttacaaaag

SEQ ID NO: 71508 - DNA, 401 bp, Triticum aestivum
  Clone ID: PAT_TA_71508
tttttttttttttttttttttttagcaaatataaattccacaaaaatcatctgatttgtcatggctataaatctgacatcagatttaaatttgatcttacataaaaaacaaaacaaaatgccttcagaatatgcagaatcgtatggtggagtacgtactatataaacacaagcccatacagaccacgcgaatgtcatgcatctacaaatcgggagtcactcgcacggaagcacacgggttgcaccacacgcctccactccgcacgagcacaactacatgacgtgcgtattatacggcacgcgtacgctcgtacgaaccgcgctgcgctcacagcctggcctcgttgtggcactcctggcgccggaccttgacgtcggggacgccgatggcgatgcggcacg

SEQ ID NO: 71509 - DNA, 432 bp, Triticum aestivum
  Clone ID: PAT_TA_71509
ttttttttttttttttttgctttatttctccttcctgtgccccctgtacttctggttcacttgaaccctatcttgtattaggctgcaaagtctatagataacaaatgaatacaattcaggtgaggtggatttctttcccccctccaaaaaaaaatcaacactaggttttgattgccatgctgctctttgcggtgtcgggatattacattacttattatatgcttccaacattccaaacccattaggaggcgccgggggtttaacctccctttcgaagaaaattaaaaaaaaacattagaggtcacacatatgcctggtcattggctatatgacatagattgggagcaaaggtcacagattttcgcaaatgtgcctacatttcctaaagatcgtgggtgccgtggcagaagctggaactctaagaaacatggt

SEQ ID NO: 71510 - DNA, 438 bp, Triticum aestivum
  Clone ID: PAT_TA_71510
tttttttttttttttttttttttgaagaattcacagccattcattcagaagcaacacatgtcaagttcacaaccaacatatgtgaagctcacagctaacatacaactagtactctaggtcacagccacaacttgctatgggacgacagttacaaggcattacaatgtactactaagcaaactaataagagaaatatgattacctgactaagcaaagaaaacgaccgcatcgcttttttggttaagtcgttgcctgcatcaggtctgcagaaagacaaggcccgatgttcttcctggcaacaggtggagaaaaatgagtgaactgatctgatcacctggacgcctccagaggtttaaccggcatagtgtagggagaatccaatccgcatcgaagacgtcctgcagctgcgagacgatggaggggtcgtacgttccgaag

SEQ ID NO: 71511 - DNA, 247 bp, Triticum aestivum
  Clone ID: PAT_TA_71511
tttttttttaaaaatccccgaaatggcacctgcatattacaaatttaagtgtataataaaatacagatggaagacagctaaataataggtgaattattctttggtgtttgaaattgttggccaagggaaaatggaactgttgtgaaatcacttgtttggggatatactagtaataactatttttgtaacatcacaagcgaaacattctgcagttacatatatatatatatatatatatatatatata

SEQ ID NO: 71512 - DNA, 378 bp, Triticum aestivum
  Clone ID: PAT_TA_71512
tttttttttttttttttctttcaagtactagaggctttgaagcctgaatgctcttattgcttttacaaccgacttatatacaccactaaaacagctgctagcttttagtacctcatggcacgcttgttcttatctagcagtacagccaacaaactatcactagtgtagtactagatcatgactaccttagatgggtaagctatggaagccttgccgacttatatttaggtgatgtgccgacacgctcttgttattcattcaacatgtactcgggtactagttaggggtggtggcagctcctcgctggataatgggacaccggtagatttctgtcatggtaaaaatgcgttcgcccaccgcctcaccatatggagttgg

SEQ ID NO: 71513 - DNA, 341 bp, Triticum aestivum
  Clone ID: PAT_TA_71513
ttttttttttttttttttttttaagtcctgaaacaaactaaaaacgaaataactgacaagggaccagcaggggttggcatcccaatagcgcctgctgaccagaccgaccaaatggctgaaggaaactaaacatggataactaaagcaacatcagatgcatcaacaagccgtagtggtcaggccgccaccatccttcccgcagcagtcatcttgggaaccttcttcttgctcttgcccacatctgttgcctccaccagggcagagacggcgtcgatgaagtgttgaggtagttcctccttgtacagctccttgtacctcttgagcgcatcaggagaggggga

SEQ ID NO: 71514 - DNA, 345 bp, Triticum aestivum
  Clone ID: PAT_TA_71514
tttttttttttttttttttagagtaacaaaaagtttatttgtttaaaaaatcttttacaaaaacggacacatgacattttttggcaagggcgagtcaaaatttactcttatttctcttctcgcttgtaccataaattaaaaaaaaacaaacatctcgtagctttggacactttacagtacaaatgggaggcgatcagtcttgtggtacgctacgcctttacaacgttaggtacagtggtaggaggagtagcactggcattctttaaaaatcccaattctactcctttcgagaaatatttaaccgaggccatgcgcttcttagttggactagaaggtggggtaggg

SEQ ID NO: 71515 - DNA, 261 bp, Triticum aestivum
  Clone ID: PAT_TA_71515
ttttttttttggaaaaggatccttcatgtgcttactgcatagtatctgcttgccactagccaggtgatctgaggctgtccttttcagttgtgatgtcaacgtctgctttcatttcaatcgaaaatagaaccagggtaaactcctgctgttttctaaaaataaaaattcagaaatcacaacacatgatatctcacttctaaaaaaacaatgcttcacactccagatgcttcagcggtaacggcaagattgcttgagcttctg

SEQ ID NO: 71516 - DNA, 337 bp, Triticum aestivum
  Clone ID: PAT_TA_71516
gattacgattaattacgcgcacaaattcttcaaggagaagaagaacaaaatcacaacagcactctctctcgaatctacaacgacgccaaagacgccagaaaacctgccagcttcgtcacacatctcgtaccctgtatatagattgggcgtaatcttggtgtgctccccggtatttggtgcaaggttattaaacgaaataccgatgagcacatgaaaaatactaccccgggtctaagcaggtcggcgtgtctgctaacgcacgggcggctcaattatagtgttcttgcttgttaatggccgcgccgccgctcaactcgctgtgatcttgtcaccgtga

SEQ ID NO: 71517 - DNA, 260 bp, Triticum aestivum
  Clone ID: PAT_TA_71517
tttttttttttttttttatgaaactattgaggaaatgttttatcacaaattacatgtttgtttttttagataaaagaccgaggcccgacgttaaatcaatgacgcccttacagaccgaaaggcacgaaaaacaacacaaataaaaggaatatagcaacaaaacaactcaagatacaagacacacaagaaacaacaaatccgccgccacgaacgtgccgtacaggagggaaaccatggaaggtgatccatcgccggaggaa

SEQ ID NO: 71518 - DNA, 348 bp, Triticum aestivum
  Clone ID: PAT_TA_71518
ttttttttttttttttttttttttttttttaagggtaaccagtgggtgtatatttttcgtcggcgacggcgcgacaggaaccacacgagttacagtcgccagacacgctgcgcgtgattcttaagccatttttcacggacatgaatcccagagtcgacggagcaaatcgccggccggccggccggcgggaaaatttctcgcatgtagatttcatggctgcttgcacgtgggatccctacctatctgttctacgattctacctgacggcccgatcgacctgatctacatagtccggatcaaccagctagaccagccagcaacaacatcgacgtacacagatgtatgcat

SEQ ID NO: 71519 - DNA, 341 bp, Triticum aestivum
  Clone ID: PAT_TA_71519
ttttttttttttttttttggatatgtaaaaaatatagttctagatggatttgatatgtatttccatacaaacttcgaaatactaatcctgacagagacatcccgaaatacaatagctttgatagttaccatccacatagttcataactattccttcttcacaacattcacgacacaattacgcaaactcaacataaagttcagacacagagaaacagaagcgaaccaaataatcactccacggccttttcagtcgcctcaacaagccagacacaaagcaggggaaaacggacgttttcacagcagctcaggtggcaactcatcctgtaaaccgcagtttac

SEQ ID NO: 71520 - DNA, 349 bp, Triticum aestivum
  Clone ID: PAT_TA_71520
tttttttttttttttttttttttttttttaccaaaattatgaaatcacaatctcatacgtataagtcaatgagtgcagacgtgtcacatggcaaatggaaaactaatgagaacaaaacatatgttcacaagctccaggatacacttcagaaaataacatctgataagtaataaataagaaacatccggggcgcccatcagctagcataaatagcaactacgcagctagcagccaacatctagcacaaacaacaactacatgagcaaccagccatcacacatagcaaccatcagcttccaacccagcacaaacaacagccgtatcttcactcctgggtgatggttgaagt

SEQ ID NO: 71521 - DNA, 171 bp, Triticum aestivum
  Clone ID: PAT_TA_71521
ttttttttttttttttttttttttttttttttgaataaagagtctcagcgaaaagacccgtttatttctgggaggcccaatgggaggggagcccgggccaattcaatccaaatgtaacacacatccgagaggcacgaaccgaccaatcacattcacatttcacacctcggc

SEQ ID NO: 71522 - DNA, 318 bp, Triticum aestivum
  Clone ID: PAT_TA_71522
tttttttttttttttttgtaggagctatagtagtagagggattgaattatagaaggagagaacgaagtgtcacctactcaccttgggtagttgggttggataaaaaaggacaaccctctcctcctcctcaataatgccacttacaggatccagcatcttgttgttgcggggactcgctgcacttgggcagggaccgtcctgcaggctttgcagacgaaggcggggctcggccacgagccggccgccgagatccaggaaggagcccaagtgcagcggcggcagtcatgtcgatgtatgaagttgcacggggtgatagca

SEQ ID NO: 71523 - DNA, 369 bp, Triticum aestivum
  Clone ID: PAT_TA_71523
tttttttttttttttttttcgatgaattcaacaggtgcttggtttcagaaattgggtttggttttccctgcaaccatttcatactaccaactttcagctaaacaagtgcagacaatctaaaaacagatatgcatattgtaaaaggtttcaacaaacggaagcataccacgcatcttgtccgattgacatttagcctactcttctcatatcgaattccggatcctttcttccatgaatacgtattgtagaaatcataggtctcgcctagtgtatcaaaagtgacccctaagtttggtacaatgacattctccctaggggcctcggcaaagacgcggactgatttctccaatgccgtcatcttatctgggc

SEQ ID NO: 71524 - DNA, 351 bp, Triticum aestivum
  Clone ID: PAT_TA_71524
aaccaacgccctactatttattgacatatatttgagggtacacaggccgctacgttttttttacaaacaaggggcacttggcaaaatcccgggggccgaaacaaatacacatttcgttacacaaatttctgacatacatgaataaaccccggcccaatgcattttacagtcacacaaaaatcgcatttgcccgggggatactattaactcctcccctatcgcaggcctataaaagggtgccaccaaaggggttggcttgctgttgcaaattatttgcccccgggaacccgggaaaaccactatccaagaatgggtttactggtgcagggccagggccaacccctggatgct

SEQ ID NO: 71525 - DNA, 467 bp, Triticum aestivum
  Clone ID: PAT_TA_71525
gacaacggataaaatgtcatcaagttccaaacaataaaacaaagcatttcagtacaagacaataattggcactcctcagcgcacgaaaatttgataattgaaaaagcaacaaaagttcccaagttggcaatctcctggaaatcctaaaaaactaaagcctaaaacaaccgggacaccttccccatcgggctctttagggacaaacatttcacgttttgccagttctttttcaacaaaaaaaccaggaagttgaccctcatctgcacgttctggaaaaactgcttttcctccatacccaggggggcaacgggaacacccatgcaaagcacctttttcaactggaacttgactggggccttggtctcattaaccttggactcaagggattcctggggagacaccaaagttggaaactttcctgccttggtaaaaccaagtccaaaaagtcggggaatctgcttaataat

SEQ ID NO: 71526 - DNA, 412 bp, Triticum aestivum
  Clone ID: PAT_TA_71526
aaaaaaaacaatggtctggaaatatattccgactttgctacctcggtaagcaaaacctgaaaacttttttggggcaactttgggtgatgttcacttgtttaaaacaaatgaattttttaacaaaacaaacccttttaaaaacacagggggtaactttctgcttttatttcccattgaaaaggaacccccccaaccaaaataagggaaactggcagtgacttttgcggatttagttaaaaagataaacaagggggggatccattacatcccgctttagatcgttaactgaacccccccagttcacaagcaaactatgcccatagttcccccttcgctggctcctgcgtccgcattttgatttttctgtcgggaccaaccttgctggttgaggcacaacatcaaccttctgagg

SEQ ID NO: 71527 - DNA, 340 bp, Triticum aestivum
  Clone ID: PAT_TA_71527
ggaaaataaaaaacccccaaagggggtttttttttttcttttttaacaaaaacccccccccttttgggcccgcgggggttaaattttgttggttgccccccccccccctttgggggcaaaattcttttttttttacaaaaaaatggtttttttttttaaaccccaaaaacttttccccggggggggaattttaaacatttggaatgggccccaaatttccctgccccgggggaacaaattattttaaaaaagcccctttgtttttcctgggggcttccggcagggtaataagggcccttttacccaattttccgggccttgggttcccggggttaaaagg

SEQ ID NO: 71528 - DNA, 415 bp, Triticum aestivum
  Clone ID: PAT_TA_71528
ggacaaacatcaacaagccctgaaaattggtaataccccaatactaaaaaggggccgcaaaacaggaaaaaatttgaaatctggtaatgaaccaaaaaacgacgatggccacatgaccggccccatgaagggggtccactagggactttaagtcgaacccctttgcataacaccatcccaccccattttatgattcaaatagggcaaccgacccttatacattttatgaacccaatgaaaccgggggcggggtaaagggacccggaaaaaaactggggcccccccgagggccaaccaatcagggcccctttcccttagggtttgaggggggtttcttgatttaataaccaccctcctttgggttatcggggggccaaaaagtcaaattggcacaaaaaaattgcatgaacaaggg

SEQ ID NO: 71529 - DNA, 516 bp, Triticum aestivum
  Clone ID: PAT_TA_71529
ggggaccgaaaactcaaaccaaatctcctttgtcaacatgatatatgtagtatacatgtgtaccatatgtatgtatgtatcgatgctctggccgggaccatgcaagcaaaaaatatcatgacgaagtgcatgcaaaggtgcatgtcacctgatccctgtccagttgggcgtcaattgatatagtatcaatcaagccagcggggaggtgaaaattctctggccacgggacaggatagccttgggatcatactttctcttccgctccacgaacctggcccacttggccggaccaaagtgctttttctcccacccggcctggccggcgtagtacggcaggtactgcacgcacggtatccctgcctcctcgcaaaagcgtaagatctcctcgttctgctcctccagacgcccaaggtcaccctcggacaccgccgaccgaaggatcccaaccgtgtagaacacctcctcctcctctgggaacaccgctgacgtgttgccgtcccacctgtcccggttcat

SEQ ID NO: 71530 - DNA, 340 bp, Triticum aestivum
  Clone ID: PAT_TA_71530
gggaccaaccccaatttattaaaactcttcggatccccaatactttatttaatacaagcgggggaaccaatcggatgggtcatcaattttgggggccaggttacctaattaatcataatatctgggggaataccccagaagggaatcatgactcccactttaaaaaaatcatgccccaacgaatggggggtcaagggaaaattcaactcccctgccgggttgccccggggcctgggtttttccaaaaggggtaatctttgcccggagctgagggcacaaacccgggcgggattaccgccccgacgttgtacctggacccgatctttaccaacaccttggt

SEQ ID NO: 71531 - DNA, 411 bp, Triticum aestivum
  Clone ID: PAT_TA_71531
gggaaaaaaaattttcctcccaatggttgggggccaataccggcccattttaattgggtgcccaaattttccccccgggggtaccaatacctgcccccatttggggaagataccccccttaaattgccactgggggccctttttttttaaaaaaaaaaagcccacccttctttttcccgggaaaaataccaatcccccattttaatttttgactcccaacacttaacaaccaaatgggatctccacactttccttttccccttccataagggggactaacaaaaacctttatggggccagatttttattcatttttaaaaaaaaacctttaatgggaaaagggccaaccttatgaggggtttttacccctaggggccacttgggccgggggcaacttttggggggccttaa

SEQ ID NO: 71532 - DNA, 476 bp, Triticum aestivum
  Clone ID: PAT_TA_71532
gatcactctaaatcaatattcaacttttatttattccgataaaaaattgtactccacaattggtttcgttactaatgggacatgacaagctttatctcaaacttttgtccgattgccagcgacaggccactgatgctgaaaactccactcgtccgggacttggtgcgggctgccttgaactgcaccctgtttacataaatagtgaaactctttggggcggacgggagccccatgaaaaccaccttgccgatgacctgcgcccgactcggggcgtatgagttctgaaccacatgtgaactcaccttgggggggaccatgcctttgctttcctccctggcgcagctgaatctcaccagggtccaactggcttccacagcgcccatttccggcgagtcgccgtcatccaaaaacagctccccactggccgtcccattctccgcgagcgccacaagcaggtggaactcgctttggcgtgc

SEQ ID NO: 71533 - DNA, 244 bp, Triticum aestivum
  Clone ID: PAT_TA_71533
aaaaaaatgatgaaggcgttattgccataaacactgaattatgatattaaaaaggtacagacatctgcaaatgccaatgtatgcacatgggttgcagatcacaaacagtacacgaatatcaaaactctcacaaaacaaacacacacaatcattttgccgacttagactacaagtggacattcatatctctagaacaaagaggttgctgttcataacacaggggtaattggatgatgttgattga

SEQ ID NO: 71534 - DNA, 365 bp, Triticum aestivum
  Clone ID: PAT_TA_71534
gaaccacacattgagccaacagggctaataatactgatgaaccattaagggggggaaaaaaaaatccatgggaagcaaaatgatggaaaacaatggcacaaaaacagtttggagcccaccaaaaaagggaaggggaaaaggaaaaaaatccgggttgactaccccatattaaacctttaacctaaaaaccactcgcatagtctttggctttcaaaagattggttgaaaaaaaaaacccatgaacctttttttactcaaacaaaacggcatcgtcattaagcaaggggtgggcccctggaacccaaaactcaaccccgggctggtggtggatggccaaatcaaagggcacttccggagggttaagg

SEQ ID NO: 71535 - DNA, 518 bp, Triticum aestivum
  Clone ID: PAT_TA_71535
gaggcctggggggcaattattttcccgggaactgaaccgtaagacgcattctggcagaaacgatgttcctcggagtagaggagagggtatggctttgaggttggctttatcactggggtaaatgcttctccgtccatgcgcttgccgttgccgagatgcacgccagcatcgaatctccggtccaccgagccagcggcaactgtgagcaaccacggtgcagtgttggagactgaccgtggagtgggacctttgttgccagccgagcacaccacaatgatgccgttggatatagcactgaacgcgccgatggctatggggtccttattgaagctgacaccggtgaggctactgagagatagcgagagtacgtccaccccatccttgatggccgcatcgaggccggccactacggcggattcttcgcatccctcggcggtgcacaccttgtacatggcgatgtgggcacctggagcaattccggaagcagtgcccgtgcccacgccatggtctgacgcatc

SEQ ID NO: 71536 - DNA, 358 bp, Triticum aestivum
  Clone ID: PAT_TA_71536
ggttggggtttttttttttttttttttttttttttctttttttggaccaaaaaaaaacccattccgattttttattttggccccttacaaaagctgctggtggtggtgaaaaaaacatttggctgaattactttttatcccccgtgccaaaaaaaaaaaaattggctttttttttcttggggccgtggttgcaaaaaactttctggccatgccttccccataccccgggggggtacaacttttttagggagcttccttggggccccttcccatgcctttaaaacacccccccctttatgggcccccccatttaaaaatctatttttcctgggggccccccccgaataaacttgggggg

SEQ ID NO: 71537 - DNA, 517 bp, Triticum aestivum
  Clone ID: PAT_TA_71537
ccaccctcaccgccaaaaattactttgcttcacaacaccaaaggtctcagggccaccaaaggttcacccaaaatcaaaacaaaaacggatcacagctttctacttgggacattcctgctaaaaataatgggggttaaaaacaggcaatcctttgccttaccatgcattaccaggcccacccatgtcattgccatgctgcctatgcagtttgcaccaccttacttgggtccccaaagcataacaaatgatgaccttatgacaatgaccactcccggtgttctcaacaaaaaactaaccaccttcgggggctggacataaatacggggtgattacaaaatttggcgaaatctccaccaacttaaaagtctgcaggggttgtcccacaaagctcctccaaatcatgatccgcgagatcaccatcagactaactttcaaaacagcgctccttataagattactttcaactgaattctgatcatgtacagtaggcagtcccaacctgcactaactaaaatta

SEQ ID NO: 71538 - DNA, 405 bp, Triticum aestivum
  Clone ID: PAT_TA_71538
gtttgggttttttttttttttgtttttttttttttttttttttttttttccccaaagaaaagcgggccttttgggatttttttggggttcaggccggctcaaaggggggggggcattttttggggcccaaacccggggggttttttaaagccccaacccgctggcggggggggcattctggaaacaaaggaaccccatcccgggggggcctttttttaacctttaaagggggggtaataggggggtggcttgggggggttttgggaacaccctcaacctcggggctttaatttaattggaaaaacccctggccccccagggggggggggggggttttgaaaaatccccccagggggtccccgttgccgggggcccggggcccgggcctttgggccgccaccgggg

SEQ ID NO: 71539 - DNA, 448 bp, Triticum aestivum
  Clone ID: PAT_TA_71539
ggaacggaaaaataccctttaaccccccaggaaaaccccaccctgaggatcggcgcatcagtggcatacaaaaaccctccccagggaacccctggcccgtagctttgctgagcaaaacaagggaccgcacacccttcccttaccggggagcgggggccggcaggggctggccccggaggaaggggtaaaacttggcaagcgagcggtcgggcccaaaaagcggcacctggggccccgccccgcgcaccgtaaccagggtaagcccctctttgtactccaccgcccaccgggccacctggtgcgggaaaaaccaccccttccacccgttcttggcccggccccgaagtttaatggggttgaccctgtaccgggtcaacgtcaccggcaccctcccgtccgggtcgccgttggaaacccaaacccccaccccgggggccatgaacttttt

SEQ ID NO: 71540 - DNA, 644 bp, Triticum aestivum
  Clone ID: PAT_TA_71540
gcgccgcggacgactccgctaggccattgcatgtccaacccctcgcagtcttcctcactcggaagcactgaatcgaacagcagcccaatcaaatcaacacatcttgagatcgagagggtattttgatacagaggcaatatgaagatcaaaatcagagcaaatgcagaggaactggaagcacacaatgtaaccaaaaatactgaaagacaagcaagctttaccaaaaatagggctgctcttttacctgcccacaaaaggatgccattttgttcaatataattggtgatgtctgtcagtaggatctcatgtttgatctacatttttttattcactgaatttgtagaacacttgcgagtaagtacctagcaaaataaacattttctacctcaaatttgtagatcaatatccatgcctaaattaagattgcttttctttatgaagatttgtgctgctctaacgttcctcagtttccatgttcaattatcattaattccaagtaggaatgaggacaaccttgagcaaggatatgggcctgagctcctgcctggcgtgttcctacagagatgtaggacacggcgagcacctagcaaggtgtcacaaccctgcggctggcgacgatgtgtcggcaccctaatccctgaaat

SEQ ID NO: 71541 - DNA, 332 bp, Triticum aestivum
  Clone ID: PAT_TA_71541
gttttggagcagatgaaataaattgcatatatcactaatatcgacataggctcatttgacacaagttcaatgactactaccacacctgcaaaaaggaagtctagactaccagggatcaacatttccctgcaaacataaaaaaaactgctgggatcaataccgacatggatactgaaataggcataggacttcatgtcacaccaatcctctatgggttggtatcctccttggcaggggggaacttcttgaagaatgggttcttcttgatgaacggcacgagcttcttgaagagctgagggtccgtctccgggtcttgggccatctcctggtca

SEQ ID NO: 71542 - DNA, 591 bp, Triticum aestivum
  Clone ID: PAT_TA_71542
ccatccggactacagaatcgaatcacagataacagcacccgagagaaccaacgttccgttacaaagaatttgtacaaaatgaaggcggagacagaccagcctgtctgtcaatggcgagaaccggtttgctttggttcgcagcaaatcttattggttgtcgacgagcaagagctgcctggcctcggcgacatgggcctcgatggcgtcgaggtcccccttcaccttgtcggagacgtgcggcgtggaggcgtccaaacctctggcaaccagaagctcgccgaggtcccgcatcgcctggctcagcttcgagttcatctcgtccagggacgtcgtctggtgctgcaacgacgcctcgcacaccctgatctgctcctcctccagcttcacatggaaaacgctgtcctggtagtcgaccagtaggctcggcaagtccttctgctgaacctcccagacttcggccaaggtgtgatcccgcacaaacttctcggtctcggcttccagcagggagaggaagcagccctccatctccgattcaaggcgcgacatctcaccgtcgatgtcgtcgcagttcctcatgctcttgatctcctt

SEQ ID NO: 71543 - DNA, 536 bp, Triticum aestivum
  Clone ID: PAT_TA_71543
ggccacctcaacatatgccggggggatgtgtcctcatagctgcagtcgtacgtccagtccacggtaaacaaaccacccgggcgtcaagcaaaaggggaagtctggcgtacaagctcgcactgccaccaaaaatcgagcaaaaggggggaaatttggtgtacaagctaacactgccacgggaaagccgtatccacctggttttctgtctcccaacattcgcgcctgattacaccctcgttttttccgagcttccacgggcacctgatttgacaaaaactacccctgcttagggaggcgattttgaatcaccgtatggtcaaaaggggcacctccgccatggtccaactcacagtacactggtcttcactcccgaaaacaacgaggggcttcgccagctgttcccatcggcgccaacctgggatggggctcctaagcggttcccatcagcgccaatctggtatggggttccttctcaaaacaagggcaatgtcacactggcactttaaagtcaagcaccgacccacaccccatacggg

SEQ ID NO: 71544 - DNA, 579 bp, Triticum aestivum
  Clone ID: PAT_TA_71544
atataaccacagggcatgcttattaaccaatgtgcaaagcatgttcaaagatactaggtttttacaacacaacaggttgtaaaacaaacaccacaaagcaaacgttcaaacagacatataacagataaagccactcgggcacatcataggatatcagtagcaagccttgggaaagcaccaggaggcaggcttaatactcatcgccctcataaccgtactcacccttgttgaactcatcactaacttcttcatactccttcttcagggcagcgagatcctcacgggcctaaaagaactctccctcctccatgccctcaccgacgtaccattggacgaaggcacgcttggcgtacatcaagtcaaacttgtggtcgatgcgggagaagacctcgacgacactggtggagttggagatcatgcacacagccctctggaccttggcaaggtcaccgactgggacgacacctggtggctggtagttgataccacacttgaagccagtggggcaccattcaacaaactgaatagtgcgcttggtcttgatggtggccacagcagcgttgacgtcctttggcacaa

SEQ ID NO: 71545 - DNA, 698 bp, Triticum aestivum
  Clone ID: PAT_TA_71545
ctttttgagatagatatcttctccacatcattacgcccaagctctattttgaacgaatcagaatatgtggtggcactatcagcagagacactggaaagagtgctgcttgggcttccaaactcactacgataacttgcacgcattgtatcagtagctccattctttaggtaccttccagctgattgttcaatggctgcgtcccgtttcctcttaataccttccttaaaggttgattcaaccctttgcagcatcgagtgcagttgtgcctcccggctgccacgtgtatcaagggaagctaccagagcatcaaacacctcctctgagtcaataaccctccaatatccctctctcgattcaaaaaagattcttcctgaaccaggatcatttggtgatgtggaagttgaaaactgccaatatctgtttcgtctccgatcctgtcccaggggaagtgatctgtaaacatacagctgctctgctctatgaccaatatatgatttcaactgagaccgtgttttatcggcatatgcatactgctgaacagataaattgtctggtgttgcactggtttcttgccccgtgccattcctttcataagacacattgccagcattactctgttgattaagtatctcattattgtttgaagtccctgcattttcatcattgtctatatcaagattacggactggagttggagt

SEQ ID NO: 71546 - DNA, 598 bp, Triticum aestivum
  Clone ID: PAT_TA_71546
gcgcgccgcgctcccggccttcctctcccgcttctaccccttcgccggccgcgtcgtgcccagcgcctccaccggcgtgccggaggtcgtgtgcggcaacgaaggggccgagctcgtcgtcgcgtacgccgacgcggcgctcgcggacgtggacttcgccgacgccgacgcctcgctggggcgcatccaggtgccgttccagcgcggcctcgcgctgtcgctgcagctcgtacggttcgcgtgcggcgggttctcgctcacctggggcaccgaccacctgctcgtcgacggccacggcctcaccacgcttcccaacgcctgggcggagatgctcgtcgggggcggcctctcgtgggagccccaccacgaccgctcctccctcttccggccccgttcgccaccgcgatacaccccgtcgctggacgccgagttcgtgcgctacgacccggccagcctccccaacgccctccttgccgccgccctcgtgcgccgcaactacgtcgtggacgccgccgacgtcgaccgcctccgcgcggcggccagcggcccctcccgccgcgccacgcggctcgaggccctctccgcgcacgtctggaag

SEQ ID NO: 71547 - DNA, 196 bp, Triticum aestivum
  Clone ID: PAT_TA_71547
ggccccaaaaactaatattacacacccaaaagggtcggggccaaatcaggtacctatccacaaggaccaaaattggggccagttggggggtaaatatcccttccgttaacataaacatgccccaaattattggtaaatcctaaaagcttaaaccaaagttcattccgggggttaaacacaccccttttcaaaaaaa

SEQ ID NO: 71548 - DNA, 474 bp, Triticum aestivum
  Clone ID: PAT_TA_71548
cacaggaagaggtaattcactgttgagaatagtaaatgaatggatgatcccggacacgaggatttacagcaatcaaggttcagtttcagttaatccggtgtgggatctagtctggaagctagaggtccctaccaaaattaaaatattcatttggcgggcacttcacggcctcattccgggtatggccgtgcttgcccatagacacatagaggtctcgccgatctgcccagtatgtcaaacaggtcttgaggatatgaagcatctgttgtctacctgcccacgtgcctcccaggtttggcgtgctcttggactggatctggatgaaatcatagaacaagcagtgcaggttgatcgctctggctcagttgtactggaggacattctcaggaggccgagaggtccctctccggttcttggtcagctgggactacatgaaacagtagcaggggcatcttggtacatttggtgggagcg

SEQ ID NO: 71549 - DNA, 246 bp, Triticum aestivum
  Clone ID: PAT_TA_71549
gggaagctgtacaaataattaatgctatatctgacaagtagacatctgaatggcattagtttcacattcaaagacccaacaatgtactgcaagtatgtaaatttaatctttctcactgaaacccgaagagtggacggacttcatctgagacagtgtacatcgaatcgcccacgctaaacaaatgcatgctatgtatctaccccagttaaatgatactctgatcacagtgctgcccacattcccttt

SEQ ID NO: 71550 - DNA, 413 bp, Triticum aestivum
  Clone ID: PAT_TA_71550
aaaaaaaaaaacaagttgattctaatcaggggtaaaatggtttcactcttgcaacaaatgtcctgccctgaaaatcatcaggcaaaaggggagctacaaccctctttcataccccctgggaaacccagcgaaagggaccttgcttcgcgatgggcggctgttctggggggaaacaaaagtttctaaagagcggagggtttcatttattcaaaacatccaaaggaccacctgcccttcaaatggggatttaccccaggcttgattaggccaacgccttttcctttgacagctccggggcggccgcatccatttttttcctcaaaaactcatcgatcgggaccccttgaacaattgtccattcaccaccactgcacgttcctgggaaggagtaaataaaaccaccgggccccccg

SEQ ID NO: 71551 - DNA, 322 bp, Triticum aestivum
  Clone ID: PAT_TA_71551
ataatactttttttggacatcactaaaccttttttttcaagaaagacacccaaagggcatcttagatctgataatcattatccagtaaaacagccagtacaacggaaagacaattggaggcagaacggccagtaaaaaaattaaaattacagcgaaaaccgtactagtctttttcctccaaatgattgccgcccaccaaagtgaaaatcacactgaacatcaaaaagctgacaacaaatgatttaccatttttggcctatttgtaccacatgttctgctactgtggaaatcagtaaaaaacttctgttacttaaaatgaaaa

SEQ ID NO: 71552 - DNA, 420 bp, Triticum aestivum
  Clone ID: PAT_TA_71552
gacaaaaaaggaggaccatttatgcaatgtccacttactgaatatgtccaatatggggctcccaaaagactaatcaagcgtgctgcttaacacactgtcatgtccatacatctaatctggtccacttctggcttaaccgcacttacttatctagtaaatgtaggagcatataatatattacacgccatgaggatcagggcttgattttgccatgcagaaaaacgctacatgaaaattacccattgaaccgcacaaacccacttctagctgccaggggggaaaggtcctaccttgcgactcaaaaccaaacacacgattcgtttcctgtgctgatacaaacggacatgcggatgaggcccggggagatacacacatcttgggggcacactcttttcgcccaacttgtgcacactaaaaatc

SEQ ID NO: 71553 - DNA, 585 bp, Triticum aestivum
  Clone ID: PAT_TA_71553
gcgaaaacaacagacaaatcggacctgaaatttctgctgttttataagctaggactcacaaggaaataaaccttgacgttagtgcttactaaagtatggacttgttcacttattttcatgaagtttcacccaaacatcaccacttttcgcctaggctgcaagtcctttggagcaaaaaacaccctcacaagaaactgaccatacttgaagaccgactcgtctggcgaactaacagttccagccaccccattttggaaagtccactggaacaccattttctccacttgtaagcgaacatccaattttcccttctccttcacagcgacaacatgctggtttagcttcccaccaccaacgaatttgtcatcaaacagcacaatctcatgatcaaagccacagctgaaagcggtaaatctcaaatgatgaggatggtcaaccattgcaaagatttgtatcacagcctcaacactcaatgaaggaacatgaagtctatctccaagctgcaactgttaccaggaatccgtcctgttcgcatctcatcaaaacatgactggaaataaatctcaacatatgcagagagcaact

SEQ ID NO: 71554 - DNA, 610 bp, Triticum aestivum
  Clone ID: PAT_TA_71554
gaatcaacctttcttttttatttcaacattccttttttcctttcgaggatttatatcaacattccttcttttttgaagtgttatatcaacattcccttttttagacaatttatatcaacattcctaaacactttgcctcgtacaaggccttacagcccagaagagaagacccatcaaagtttcggacggccccgaattctgtgctagatgtggccatccttgtctaaaaaaaaagatgtggccatccaggattgtaatttgtcccaaaaaaattctagaaacacaccgattttctggttattatcttttcgctcccaatttttccccctctttttttttggcaaaccccgattttcctctcgagcaaacacttgacacgcctacaatttccattttgcaacgtgcggcagctttcaaggccccgtgcatgcaccggagccacgcatcgaccaccgaaagttatccaaaaccagcggcaaaccaggacgggagccaaccaagcagccgcgcgaccatgaagtgctggtgcacacatgcgcccaagggagcaatggcgacgccgctctccagccctttctccgtccccaccctccgcgccccgctctggcac

SEQ ID NO: 71555 - DNA, 567 bp, Triticum aestivum
  Clone ID: PAT_TA_71555
acgtgtatactctcttcctgccgagtgtatttcccagctaagattatcatcatgaacacaagtgcatgtcagtgcatacatgcacgacacggcggcaccatatgcatgcatggtgggatcgacagcgcacgcctagaggcaggacaaacctgcagcatgcagcaaggctacgacagtaggcgtgatgcctcccatcaagtgttgcaggtgaggcaatcgtactgtcatgtccttctttccgccagcattggaacatgatgatctgattctctttttttgaacgtgtcgaccatggcttaacagttcacgccaggtcccgttgtcacaaaggctaccaaggatcgacacaatcaaagaaaaaaagaggctgtctgtggcttcactgaaatatcaagagcacaagaggaaaatgtgtcgcgctgcatgctgccgtaatttggtgctactgatatgctcccaacctcggcaaagtgatgtaatggatctaataaaatccccaggaatataacagaaatggatttatgatttaattactctctagtgtgtattcgatctgcaatgcacact

SEQ ID NO: 71556 - DNA, 170 bp, Triticum aestivum
  Clone ID: PAT_TA_71556
atatttttttgcgggaaacaacaaggattcatttgttgctcctacccaaattgggcacaaaaaacatttaccgtaatacaggccatgcctgagggatcccaccaatgcatctggccccacgggataggggtgtataatacaaaaaaattttacatgatggccaaaaaatt

SEQ ID NO: 71557 - DNA, 432 bp, Triticum aestivum
  Clone ID: PAT_TA_71557
aacataatcacagtagaattaactagaagagagcaacatgcaggtgtaatatccggcaataaaatggtactccccctgtcccataataagtagtgtcaaaatcgttcatatattatggtaccgagtgaacagatgaatgcatctgtcacagcacgatggggtcagaggcttgggaccctttccctccccgggtcttgaacctcttggcctgcacgcagctaagattgctcctccaaagcggcagccgcttacgcccattattatggcctccgacctcctcactgttctaactcacttccgatgcctgctcttgccccgcctggccgcattgaaccttcgccttctccttccttgtcggcttgccacaacattccggcacaggatgatcggtgccgtattgcgccggttcatgaggcacaggcccatgtggat

SEQ ID NO: 71558 - DNA, 587 bp, Triticum aestivum
  Clone ID: PAT_TA_71558
ggcgcaatctcatcaactgtatattgcatttgcatactgcatgtcaaatcacaagttcacacgctgccactaaattaagcacattgctactactagctcactactaatacattcgaatcgtccaatgattctcgaatgacaccagtcacaatttcttgttccaagttccaacaagccgcctgcctacgacgccgtgccgccgcacgagacggccgccttctcccgccagtcgagaagcacggcgacggcgacgtattgcgtgatggcaccgacgagcacgaagacgtggaagatctggtggctgtggccgaccacgtcaaagacgccggggcgccacttctccggcacgcggctgacgtaaaaccaggcgccgacagcgtaggcgagccccatggccacctccagcccgagcgccaggtagcaggcggcgtggccccagttgacccaaagcgcgtgcaccgccgggatgacgccggacatccccatggcgaggaacagcgtggcgcggaggcggcggtaccgcggcgaggagcacgacggcgagagcagcacggccacgacgagcgcgccgaggacggtgatggcgg

SEQ ID NO: 71559 - DNA, 495 bp, Triticum aestivum
  Clone ID: PAT_TA_71559
aaaaaaaaaaggcttttttatcaatttgaaacaacttctccccaaaaatcccctctttggggcaaaccccccaaaccccctaaagctaatagtttattcggaggaccaataacccggccagctgcttcacagtaaccaaaccacaaactttttcaaaacaaagtccccaaacgggacagggaccgccaatctctcgcacagccccgccccctcctccagggaatccttctcccccccccatgcgaggggggtgggaaacttgccttccttgaccaaagggggggtttgaaccctttcggccccaaaacaggggaaaacggacctgggccacccggcaaaaaccacaacctttttgttcgcggcaaaactttggtaaatgaggacccccccccgggggaccccctgctccacaacgttgttgcagtcgtttgcctcaacttcaagctttttgccccagggggggggggggccccggcccccgaaaatggggacccc

SEQ ID NO: 71560 - DNA, 627 bp, Triticum aestivum
  Clone ID: PAT_TA_71560
gatactaacagatgagaacttcaatgtttattgagaaccaaggaaaacaaagaacagactcaagtaaatagattggaattcaaagggaaatcatatgaatcagtcccctcctccttcaacttcagctaaagggtattaagacgagaaaagcatacaaaaggaaaatctaacagcaaagtacaaggaataacaaggatatccataaaactgaaccagtctgttgtctacctcaccccagcaaggaagcttcagggcagggttagacggtcgagcaatttggcttgtaactcatcttttgacctcacagactgaacaggaagcttttgtcgtaactaatctatgttatttgtgtccctgtgtgtactgtcatcgtccaactctcactggtattgtcttcctttcttcattgcaatttccagcagcagctggagtttcaaatttcctcgtcctcgaccttctcccagcaacaacatggtttgaaacagctcttgattgcctgaccacctcctaagccatgccaccaatctttatcacattctaatctgatcttgttgttgtcactggctttactaacatttaggggcttcagttttgcacacccagtgatacaaacatatgtcagttcat

SEQ ID NO: 71561 - DNA, 370 bp, Triticum aestivum
  Clone ID: PAT_TA_71561
ggctaaaccaaaccccacgggggaaacaaattttggaaaaagggaaaaaaaaactttcccctggcccacaaaaacaaaaaaatccttttgccgccccaaaggaaaaaaaactgaatttttccaaataaacaaccaaactttaaggggaaattttcttcccccaacccaacaaaaggcggaaaacctattatgggcccattttattttgggggcccccccctttttacccatttggggggcccaaccccccccttgttttaatatacaaaaaaaaggggcccccctccaaaaatgatcccccaaaccaaaaaaagcgtttcaccccccaaaaacttttaggggtccagggccacccaaaagggttcaaacc

SEQ ID NO: 71562 - DNA, 393 bp, Triticum aestivum
  Clone ID: PAT_TA_71562
acaaacaagcaaacggttcccaactcccgttttataatataacccaataaaaaaatttaaccctgataaggcaactaacaaggcactggaggttacaattgtcaacacggttaaaaaaaacccccaactcatttggcaaatgggccgctttaagcttaacccaccgatacatgccggcaaaagctgaaatgctaaagcgagggcctcacttccataacttccgcaacaaaatgttcttttggggatcctttttaataaccttggccacggccattttaaaatcctcctgggggacgtgcacccttttttcgcggagggcaaacattccaacttttgtgcaaaccgcctttaactttggtcctgatgcaccgttcattttttaaaaaatttttt

SEQ ID NO: 71563 - DNA, 549 bp, Triticum aestivum
  Clone ID: PAT_TA_71563
gaaggcaaacacgaaacttcctacgatcaacttacacaaaaatgctccgggaaaacataaatttcccctctctctctctctatctctctctctctaattaatctgagctctgactttctgaagctaatatctcgatctctaataagctattgtgcttcaggatctcgaagcgaggcatcaacgaatctcacagctgcacccctcgccgccgtgcaaccccagccggttcaagcacaagcatatcttctgcctctccgagtatcccgtcctaagaacaccatccgcttttcggcttaacggcggctggtagggcgggcttatggacaggttcaggtcgatcatgcccacgccgaggttccccgccagtgacggcggcaaggacacgctgtcgtcggcgtcgctgctgtggccgctcgcatcgggcgagcagctggagccgcccgcgaggtggtgagggctggcgccgctcgccacgacgggggacgaaggcgtgtgcatcccctgcacggcggtggtgccagcattgagcgggcggtgggtctgcgggtc

SEQ ID NO: 71564 - DNA, 305 bp, Triticum aestivum
  Clone ID: PAT_TA_71564
aactgaggccaaacagtcacagtatgcttgcacactactcaaggatgagcaataaatttggtggaacaatgctaaacttatttaatacgctgcgcaacctcctttgcaataagcctttccctggccttgatcttcgattgcgattggtagcccgtgacaccaccaccccacttgttcctaacctcatcaaatttgtcgttgaagttcgccttaataacctcaaggatcttggtgaactaaggcttatcctgattgttcacaaaaaaactgcctctgttctgtgcctgaccacagcggacgcgtgg

SEQ ID NO: 71565 - DNA, 164 bp, Triticum aestivum
  Clone ID: PAT_TA_71565
atcccgacgagggggcttttattattctggaaactaagacgactcactaattccacccccgacctgggtctgtctctacctgacaacagtccacaactccaaacaattaatctcacgcatacattacggtccatgaattgtgcacccatcaaaaaacaactttt

SEQ ID NO: 71566 - DNA, 275 bp, Triticum aestivum
  Clone ID: PAT_TA_71566
gccatgcttgttattattttgttattacccgtacattgctctttttggctttgccacacatacaatgtgaaaaaaggatgatctcccttttaatttaccatctctcgttcaaataatttaagggattacccttatggatatatatgatcaaaatcctcctctgctgaaacaccaaccaacaggtttatcgtgtttaatccaaccccggccggttcaggccatgaaactcaacttgaactcgtcgtcccccaccttgacaaaatgcaacccctggt

SEQ ID NO: 71567 - DNA, 325 bp, Triticum aestivum
  Clone ID: PAT_TA_71567
ccccctggattaaaaggctagttcctaatgaggatcaacattttatcacctttcccttatccttacaaaaccgctgaaataaaaggacagcttgcccttctgggttcaaatccccccccccgtaatcaggtctgcctcctccctccgtcgcctgtcatttgtaatgacttaacccatgaccccgtttgctgaacacccacttgattttcctttgaaataccaaaccccttggttttctttcttttctttttttaacaacccttggctgctttggaatttgttaaaaaaaaaatttcattattcttccaaaccgaatttttgcaag

SEQ ID NO: 71568 - DNA, 338 bp, Triticum aestivum
  Clone ID: PAT_TA_71568
cctatgtccaaataccatgaacaattgtatgctcgtttttccaaaaaaggggtcgggtggctaaaatctgacccgtttctaactaatctccaatacaaaacaaggcaactattaccataccctcctgtaccgtagcccacgctcttttttcctttcctggacaacaaatcacctgacaaaaaaaaggaacaaaattcattaaaatactggcgtctcccaagaccctcctttaacttgcatcacacaattcatttgggaggcgccatggcccatgggaaaggggaaatgaaaagaaagagtacaaaaacatcagaaaggcctcctgggagacagggagt

SEQ ID NO: 71569 - DNA, 588 bp, Triticum aestivum
  Clone ID: PAT_TA_71569
aaaattgggcgcgcatcaccacaccaccagtctataagctttccgttcgtgtcacaacagtatcaataaataagattggtactatgacaagtgcttccataattaaccaacaatggtcggtgctaattaacatatgtgcgtcttctatctgtatccggactggccatggaggctgctggagagagccgtttggcgcgaacggggctacggataggcctgcttgccgttcacatatgtcgccaggacgtgccccgggatgtcgtcggcgaactcgcgccacgaggtggacggcaggaccacgaaatcggcgtacttcccttcggcgaggctgcccacaacatggtccaggaagcaggcgtaggcggcagatatcgtgtgcgctttcaaggagtcgtctaggggcaagcgctccgtggcgatccagggcgcctcccatccaggcagttggcgggacatcgcggttttaatcgcttgcaaggggtaaatatctgaaacctggaggacagagacacatacagttaactggctggctacataacttcgccgcaaaaaatagctatattacttgtaaactgattttcagttact

SEQ ID NO: 71570 - DNA, 427 bp, Triticum aestivum
  Clone ID: PAT_TA_71570
gacgcgccctcgctgttccaccacccgctgccgcagcagccgcacactccccccgccgccgcgcggggctgacggcgccggccaaccgattcttttctgctatagtggggcggcggaggcgataaggcgggacgtccctttcttcctgttggccgctggtggcggtggatggtgtccataggctggtggtggtggtggtgctccggcaattctttcattttcttgtctcgttcgccattgtataaaatcatacagcagtagaactcaattttgttgtaatagtcacagaatttgtcaagaaaaaaaaaaaaaaaaaaaaaaaaaaaaaaaaaaaaaaaaaaaaaaaaaaaaaaaaaaaaaagggcggccgctcgcaatctagaaccggacccgtgggcggacccgtgggcggacacgtgggtcaaca

SEQ ID NO: 71571 - DNA, 418 bp, Triticum aestivum
  Clone ID: PAT_TA_71571
ggggttttttttttttcttccatggttgaattattcttccaatttccttgttttaaatgctaccaaagccttctgatgatgtaaatcctattgattgatggtgaattcaaaaaaaaaaatttatttcactaactatttttgggcctgacttggatggagcagaacaatccctctcacaaaacagtgaaatcagaaaaaccctttactcacctgtgctcgtgctcggtccaaggaacccccctcttcttcccttgtcccggggtccgaacgccgtgccatttcccacagccaaccccaaaccgccgtcgggcctgaacggaaacggcttgcaggcggcggaacccgccaagcgggaccacaacggcccggaacagttgttccaaaaagccgaggccggtccattccttaacgcacgggg

SEQ ID NO: 71572 - DNA, 638 bp, Triticum aestivum
  unsure (1)..(638): unsure at all n locations
  Clone ID: PAT_TA_71572
gctgcctgatgacgccttgctgcagggtgcggccttggtcattcgtgttcaaaatggcgggcttggcgagcagctcctgtgcgtccgggtcagtcttgtaggagttggcgacctcctagagccactggggttgacacatggagagcgcgtcgagcgccaggaggtggccgactcgagacagcgcatccgcagcagtgttttcggtgccctttttgtagcgcaaggagaactggagaccgaccatcttggccatggcctttctttggagttcagttgccggttgctggtcacctagggcacaaaggctcttgtggtcgatgaagatctcgaatggggcatgctggagatatggtcgccacttgtcgatcgccatcatcaccgccagaaattctttctcatatgtgaaaagcttctggttgcgcactcccagcgccttgctgatgtaggccacggggtaaccatcatgcgtgagtaccgcacccacgcccgtgtcccaggcgtcggtctcgatggcaaacaggcggttgcagtctangagcgcgagcacgggcgtgctcaccatggccttcttgagcatgacgaaaccgtcctgggccttgtcgctccactgaaatcccttcttggtaagcagctgggtc

SEQ ID NO: 71573 - DNA, 581 bp, Triticum aestivum
  Clone ID: PAT_TA_71573
cttgtttttttttgtttgcagcaggtaaacaccaaaacttgtaataaaaccagtgcaacacatgataccacgtagtagctccgttacaaaactgtctcctcttctcaactctaaacttctctccctcgcaataataagaaaagaaaaaaagacctatctaggcctggggctggggctgggcctgcgactgcgactgcgactgaaatgcgccacctaaagccgggaagtcggccggtgtgaactccttgtcctgctttggcctgggaccttgccactgcctgtagttgccgccctgctggtatccgccgccattgttgtacccaccttgctgcctgcgctcaccaccctcctggcgctcctggtaaccaccattgccccggccaccaccattgttgtacccgccttgctgcctgcgctcaccattgtaggcatcctggcgctcctggccacggccaccattgttctcctggtaacctccattgccacggccaccgttgtacccgccttgctgccggcggtcgccattgtagccatccctgcgctcctggtaaccaccattgccccggccaccaccattgttg

SEQ ID NO: 71574 - DNA, 343 bp, Triticum aestivum
  Clone ID: PAT_TA_71574
accaaaaacctaaccatcacattcaaatcaggtctggctttgcatgtatgctaaatcaattagtacctgctaattaaccaaccaaaataacacagttgcttttgacctgggacaaaacaggtgcaattcgctgtcttatttgccaaatctttccaacgtcaatccaaaacccaagacaaaaacggggacaaacccacgtctgtctgtctgtctatccaagcgtaattcaattcacctaaaaacaaaatcagtcaaaccaaattttttcgggaggggcggcgcgcctatcagtcagtcgtccaggtaatattaggaccccggggccttttgcttccggtccttg

SEQ ID NO: 71575 - DNA, 607 bp, Triticum aestivum
  Clone ID: PAT_TA_71575
accatttaataagactcacgtttcagtatattgagacatagatagatgcgatatccatgcatgataagtttgttcagcacaaaagtgtggccacacaccgcaagaagtctgaaattttcatcatacaaggtagctatctacttaattagtccagcaaaaagaccgataactgcgataactgaagctttagctacccattcaatcataccaagcaaaaaaaagaagctttagctacccattgaatcagaccaagcaaaagacaaacaactgaaagaactccatcactccaaacctgtggagattaccttccatccatgcgtttatgttaaactggaatgtaacatatactgaatccccaagttttttcctgtcctacttccttcacccatggcgtcagtaatagccagatatgtttcagagtagaattgattttgatgaagaaaatgagaagataaacgactggcttcaacgcaagagtacacattaactgaaggctgttgacttggcatccacccaggagtcttgcggtcaatctgctctatgtagtgttcagatgcttgagctttatctgccgtccctgcctccgcagcacagattcgtccgcact

SEQ ID NO: 71576 - DNA, 208 bp, Triticum aestivum
  Clone ID: PAT_TA_71576
gaaaaacatgggacggtggtctataaagattgtctacacacatttacatggagcaaatgttccaaaaattaatttgctgatttctcccgaaaaaaaacattccgtgcacagatgctacgatgactgtatattatttgctgtatggaatgtatgctaatatggactaacagtcctacatatggaattgtcttcggttttacaaatcctg

SEQ ID NO: 71577 - DNA, 533 bp, Triticum aestivum
  Clone ID: PAT_TA_71577
agatatgcaaacgaacttactgagtgtgttcatttattcattcattcattattttcacaatataggcattgcttacaagaaaaaggtgaggtctatcttgtctctgaactcaaatacacagacagacatatatatgtagtcagaagagcccattcattgttgtacttgtagggtgaaaaacaaaataaatataaaaagtcgagttagtgatctgaatctgagaagacagacagacagacccattcatcaagttgaggagttgttcagccacccctggaactggaattggagttggagctgaaattgggtctcctgagcttgacaatgaattctttgtcatcgtcgtcatcgtcgctgctgtactcgactcttctcttggccttgccggcggaatgatccatgttgtggcgcgctgtggaagaagaagaaaccacgggtacaggtttcttccagctctctgcaggtttattgttgttattgtgcttgttgacagtgctggaatttgacgacttgatggggatccctgatttgat

SEQ ID NO: 71578 - DNA, 393 bp, Triticum aestivum
  Clone ID: PAT_TA_71578
ggggggccaaaaaaaattttttcaatccccctaacaaaatatttcccgaccagggttttttttttttgcaaaaatatttccagcccagggttaattccatgacctttttaaccagaaacggaaaacctcaaaacacctccggttccttttttaaaaaaaaaaaaagaaatttaatgggcaaaattttttgggcctttttgggcttgaacaaactgtaaaaacgggtttcaaatccccttttaaaaaaaacttgaaacccttgccacaagggcaaatcacctgaatacccccaaaatgggggaactaactgaccccccaatttttttaacccctactaaaaattgaacctttttttaaaggcccaaagaaacttcaaaactttaaaaaccccct

SEQ ID NO: 71579 - DNA, 568 bp, Triticum aestivum
  Clone ID: PAT_TA_71579
gttttttgcaaaagagcaaagaacaatacattcgccgttcatttctttgtgcatagttttatatctagggcctgttcggcaatccaccggctcctcaaaatccgcggatctggggagcaccgtttcgcccgctccgaaatttctaactgcagctccatctgctccaggagcggagggataccgaacgggcccctagtcatatcaactacactacactggcttattttttcaaataaatggacaaattcaaatttcatacatgtctggcatcaacctgaatctttgattgacaacagcgacgaacattctatgataatgttgcgatgaaagcatccaccttggcgttcacccctcttgacaggaacttcatacagattggaggtttcaccttggcaagagcaagcattgactggggcaaaacccacaacccatcgccacaaatcaagccggaagcaactgcaggtgcatatgtgtctgattttactctgtccagcctttgccagacaaaaaggatcactgtcccgatgaacatatcgatgccgaaatatggtcctaggtagaatggtat

SEQ ID NO: 71580 - DNA, 646 bp, Triticum aestivum
  Clone ID: PAT_TA_71580
ggaacaaaggaaggcaacctttatacttaaaatatgcatgcaaaacaaataaacatcagaactactttgacaatcaactaaaaaagtaggatggtgcctacatgaaatccatttgatctgaggtacactgttaaccatgtttcttgttctcagaaagattttgcacttcataaagtttccgggctatctgcagtacatggcaagccatgtgagaatcgagatctggttaatgtatcggaagagctgaaaaaagaatatgttgctacgtattggaagggcacaatattagttagatggtcgatgcaataaagtgtacttgtaaatcaaggttcagggagatcaatggatccacttactgtagtggaaccaacaaaagactacaccaacaagagatgtcgtgcgcccacgagctcccacgaaccgcacccactggagaaagaggagccactgcacaggcagcaccccacgtcacataaaggacaacttaattcagatgtgatatcagacatgtggcttgaactattcaatccaattgtttagaatataaaacaaaagtattatggaatgtgcggcaaatgctgtcaggaatgtaaaaatcaaaagactgacattcacaccgaaatatggtatatatgaacctgaaatt

SEQ ID NO: 71581 - DNA, 330 bp, Triticum aestivum
  Clone ID: PAT_TA_71581
atacaagctggactagcaatcctagaaacacatgatacaagatgttaggcgtgtaatatacagggggactgtcaaaaacttaaaatgaggtctcaacaactcattttttttttccagttcttcgttcacagggggggggggtatgtaaaaagcatttaacaagttcaccggcaaaacagctactcaaagtacagagttccacaaacaatggagctaggcctctatggacaggttctttttgggtctgctcaacttcaaccggggtgtggcatcagctttcaccacggccagcttgtcgtcgtcgctcgacgttgccgccttcacaggggc

SEQ ID NO: 71582 - DNA, 382 bp, Triticum aestivum
  Clone ID: PAT_TA_71582
ggaggagcccaaaggaattataccctcgacccatgaacaaatccgggaccaaaaattggggggacatagggggcatccttacttgcatagcacatgacctcaggggaaaacgggcaaaacacttctcatttacttacaaaatcatggggggctttgttacatcggcagtagggggaaaaaatacatgacatcgggggcccggccgaaaaaaaaaataataatcccatgggtcatcgcctatttcccatgggggtgcaggcaatctaaaaccccgggggtttctagtaaacgacaatcggatttgttctgaactaaacttaaagcagccgtctgacggatcaccatcctacaaaggcccagtttttccaaacatgttcaggga

SEQ ID NO: 71583 - DNA, 346 bp, Triticum aestivum
  Clone ID: PAT_TA_71583
aaggccgcggctgccgccgtcgaggagcagggggaggagaaggcggccgagcctgtcaaggaggccgaggagccaccgaggcaggtcaagctcgtgttcggcgaggacatccggtgggcgcaggtgccggcgacctgcagcatggctcagctgcgggaggccgtccgcggcaagttcccgggactcaaggctgttcttgtcaagtacaaggacagggagggcgaccttgtcaccatcaccaaccaggacgagctcaaatgggccgaggacttgactgatccggggagctcgcttcggctctatgtcaccgaagctgacccggagcatgagccttatgttgaggatg

SEQ ID NO: 71584 - DNA, 397 bp, Triticum aestivum
  Clone ID: PAT_TA_71584
ggatagaatgtgtaattctcttgttgatgatctctgtaagactgtcacatcaatgtacaagcacgattgtgccacgttcgactgagtggctgacgcccgtgtagggaattctccagttacatttttgcctcctaaggtagtattatgtacgtacgtgtaaatgataactatgcacaatttactctctctctcaaaaaaaaaaaacacttatgcacaattggaatggtgacttaagaatcactgctgttggttatctacatgacggcagcggtcttctggttctgggatagaacctgggtgaaccattcgacggacgccttgggtatcctcgtcaggttgttgttgtaatcgatgtaatagaggccgaaccgcaccgtgtaccccgagttccactccc

SEQ ID NO: 71585 - DNA, 313 bp, Triticum aestivum
  Clone ID: PAT_TA_71585
acacatgttttcttcaaaaatacctttggccgattccaccatgaaaggaatcccaaaattggggaggtggcttccttcccgggccaaaacaaaaataccaccccggcctcctttgctcacaaaaagggggccccaaaaaggaaaaaaaccagcgggggggtccctgacttccccctaagggcccccctccccaaccttttccacccttccccagtcgccccccccaaaggacggcccccaccagcagcccttccctccgccacccccttttggtggggctgggccccaaaccccccctaattgggctccccca

SEQ ID NO: 71586 - DNA, 238 bp, Triticum aestivum
  Clone ID: PAT_TA_71586
aacatggaaaatgtcagtttatctggattaccaaaatatacaagtgacttccatttaagcaaaccaatatgcagctactgctctgttctctaacgttgttcctgtatgcataattttaacttgctgctgaccatcctctgtggattgaattttgcggcattgacaattccaattaatgacatcaaagggaacaaaataggaataaagagctcatggacgaacatcaatcctttgttat

SEQ ID NO: 71587 - DNA, 290 bp, Triticum aestivum
  Clone ID: PAT_TA_71587
ggggcccaaaaccggcccaagtttccccgcccccaaaatttttaaacctattaacccccggccatggaacaaaacaaaagggggggacccccgggaacaaaataactcggcatgaatccgcccaaaatgggatgaaacaacaaagggttgacccccctgacaaaacaaaagggggggaccccccatgggcccaacccccccttcaactatttaacccaggccgaaggggcacaaaagaacaaccttcggcaaaaagaacaacgggtggagcaagttgggacccaaggaaa

SEQ ID NO: 71588 - DNA, 122 bp, Triticum aestivum
  Clone ID: PAT_TA_71588
attggacacactgaaacattcattactattattggtctcactgaaaattcattaaattttgtcacaacaggttctgccttaggatagctctattattggtctcactgaaaattcaataaatt

SEQ ID NO: 71589 - DNA, 377 bp, Triticum aestivum
  Clone ID: PAT_TA_71589
aggcctttttcaaaacaaaaaataatattctaaaaaaaaaaccagggacctgtcaaaaaaaaacacactaaagtctcaaaccgctctacttggggcacaagaaaggggataataaaaatactaaaactcggaccaacatgccgaaagaaacaaacccaaatttgaaaaggggtccaaaactacaaatcaaacggaaaacggaagggggggtttaaaaaaaaaacaacatctttattcaaaaatttttgggaaaaaaactttaaaaaaaaaacaccttagtggggacggcccaacttttaatcaaaaaaactttcataaattgggaggggccaaccggtttcccccatccagggggaaacgggaaaacaagggcccat

SEQ ID NO: 71590 - DNA, 136 bp, Triticum aestivum
  Clone ID: PAT_TA_71590
gggatgaaagcagattgaagaaaaatatactgaaaacagatggttcatacaaaggttctattatcttactaaacatttaaatacggacccactgattatttattggtcctttgacaacaataataaattaaaatct

SEQ ID NO: 71591 - DNA, 303 bp, Triticum aestivum
  Clone ID: PAT_TA_71591
gatggaatttgatgccatgaaaacttgttactgcttttttatttggaaaacagagagaaagaacggttgttgcacgaccgacctaaacacacaccacgttcctaatgactcgtgccatcccacgaatcagatcatgcgtgcatgatctacagctccactattatcgcgtgtgatccgaagtgccatgccatcccatgactcggttcacgacatggtagaaacaggagcgacccctacctgacacatggactcgacgcacacatgcttgccgtcgagaccgactctgagtgcataccgtctgct

SEQ ID NO: 71592 - DNA, 186 bp, Triticum aestivum
  Clone ID: PAT_TA_71592
ggaccatgaccaaacaataaaacattaattaatgtaaatagttaatccattacaatatggttaattttgccggacacaatgcaagtttacataatgatatataaaatgcatctccaacaattcagtcaccattacataaaatatcccatttacacaaaccaccggcttaatgtttccttgcccttt

SEQ ID NO: 71593 - DNA, 260 bp, Triticum aestivum
  Clone ID: PAT_TA_71593
gatgcattcacgacaaaacatgcatactgaaagaagttcgatagatactacatatagccaaacacgacatacagatccatacataagttcggttacaagccataagtagtagttcaaaaaggaaaggtagtctagaccaactaggcggcgcacaggcacgtggtggagggatacaacaacgcgacatagcgatatgctacatcaacgtcggggaaaacctttgaagtctggcagctgtcgatgaaaaaaagcctggcggt

SEQ ID NO: 71594 - DNA, 184 bp, Triticum aestivum
  Clone ID: PAT_TA_71594
ggggaccaagcaaaacatccttccttcaaatttgcttatgacaaaaccatttgggccatatttggagtagttcaaatttacctataacaggaatggttctacctttagggctcatacaaaaacccctttaaatgggatatcacatccagccaattacaacagagctccaatcaaacacccaccg

SEQ ID NO: 71595 - DNA, 386 bp, Triticum aestivum
  Clone ID: PAT_TA_71595
ggtttttatcttttttttttttttttttttttaactgcactatcatcataccctttttattattccccacacaaacttttggggagtaggattacaaacaaaaaaaatggcaaggcccccccatacctatacaaccaagtttttctattccacaataggaaatggataaaaacccccccaaatttcatcaaccacacttaactttcacccaacaaactcgtgtccccaatccatcaattgattgattaattgatttccccaaccacaaaatttattaggcccaatcaaccagggtcaggcttaagctcaaacccttttgggcacccccttttttttttctctacacacaaataaaaaaagggtccctggaccccattattcaacta

SEQ ID NO: 71596 - DNA, 373 bp, Triticum aestivum
  Clone ID: PAT_TA_71596
gggccacttaaaaagtcttataacttattttttctgcagctgtcacaattcaagcaaacctaccactaccatttccaattttaaaacatggatctacaaaatacattggcataacaatgccatcaataaagcaattccattttggacaaatgctcgaaacacctttaaacaacgatccagcaccaaaatttccccttctccgaaaaagtggccttaaactttccacttttttccaactcaaaaacaatgtcacagccccccattagctttgatttgtaataaaattggggaaaggggggccaattcaagtattttttcaaaccttgtttaacttcctcatcaaataaaatgtcaaaggacccaaagcttatcc

SEQ ID NO: 71597 - DNA, 397 bp, Triticum aestivum
  Clone ID: PAT_TA_71597
ggagggcaaagcaaaaaaacctttattaagggacccattattctgattacattctgactgaaaacccgtcgttgtttttcaataaaaacccagcccaacaaaaaaattacagttttaatgtccccaaaaatggggggggaaaaaaattcctcaaaagttcaaagttttcaaaacagggggtatacactcaatttacactactgttgggagtaaatcccaaatgccgatagcttaaaggaacagggaggtacccattttccccaggaggagggttctgctacggggcaaaactttaccaagggtataaaagcacacccttgtttaaaagcccactatccaattcatgtttcaggggaaaggccaaaaaaaaatgccatttttgccaagggctgccatg

SEQ ID NO: 71598 - DNA, 163 bp, Triticum aestivum
  Clone ID: PAT_TA_71598
aaaattttagggccaatcttgtattgatctttccaaattggagcttggaacatccacactctgacaatcccttattgtaaaaattacacagtcaattgtacacttgataacttcaactcgggttaaaaaaacacattttacccataaaccgcccttacaaaac

SEQ ID NO: 71599 - DNA, 286 bp, Triticum aestivum
  Clone ID: PAT_TA_71599
ggaaaagagccaagggaaaaaaacccccccaggggggcaaaacatcaggatttcatagggggggcggggggattttaaattttttgatggccgggacccggcccaaaaggattttaattttttggggccccgggggtcaacaattccccggaaattccggaccgggcccacccggtttttttgaacaaactggttctataggggccccaaaaaaggccaaagggccaaagcgggtcccgggggaaaatggttatccccccccgggcctatttaaggcggaaaaggg

SEQ ID NO: 71600 - DNA, 141 bp, Triticum aestivum
  Clone ID: PAT_TA_71600
gggggtattttttttttttttttgacaaaatgcttaacaataatcatttccacacggataaacacagcccggtttaaaccccactttttagttactcaccctcctgctagtaacatcggcaggggactaccgaaaattaag

SEQ ID NO: 71601 - DNA, 387 bp, Triticum aestivum
  Clone ID: PAT_TA_71601
aaacgaaagggggatgatcaattagttggaagagattttgtacagagatggcagtcggcctagagtccacgtaggcacaccgtatcacacaaccgagacacgtactcagagcagagaattagcaacatttaggtatttgcttctgaatcccttggccgcaacacaaacatagacggtcccggatcttctccgcggtatggcgcgtttaaccacatgcaaaaccagcagggtccttacaatcaaccaaagcgaagtcttttgtaccagttcaccgcggcacaaaagagggcccgtgttgcatctcccctgttttacgtacagacgccgttttgtgccatcctatgtatctttgtatctttcactgcaaaattggctggagcttcggtg

SEQ ID NO: 71602 - DNA, 334 bp, Triticum aestivum
  Clone ID: PAT_TA_71602
gtgtttaagctccgggcttaatcttttacttaatatgttcaagacccttaaagcctacccgggctgacaactttagttgaatgatatgatccccaagcaaacctttccaaaatacctttagctggaaacttgaccagaccacagtccaacccgtatgaaatgggataagcaagtacaatgtgaaggcactcgagcgcataaaaatttgctgtaacgctcaatcaaaatcaagggagccttcgtagtcatcacctttacaaacttaaccggaggaactgtacgcaaaatgatcaccttttttaattttgccaccaaaaaagctctggggatcctt

SEQ ID NO: 71603 - DNA, 338 bp, Triticum aestivum
  Clone ID: PAT_TA_71603
ggggaaaacaaggggatggataaccaaattttgtcatggatcacccactggcacctaaaaaaaccccttaagggtaaaccaaccaaacaccccaagtcctccctaacatcaacattttggctggcttttgatcccacttaacaacccccgggtttttaaaggcgaaccaaaacaaactggggaacaaacttcagcttttcaaaacacaacccaaagggggccccaccattgcaaaaccctttaaaaataagtcaaactcaggccccaggtaggccaccccccaccaaattaacccggtccccttgatgtcccggcaccaaaccaaaaaaaacattttt

SEQ ID NO: 71604 - DNA, 260 bp, Triticum aestivum
  Clone ID: PAT_TA_71604
ggaaaactatgggcatcatcatataaccaaaaaaaattttacgtccctggcacggccaggaaaaacaagggttaataaacaccccatgggggataacaatttttatttaaaggggccaccccaggacaacaccccaccaaaatgcccccaaaaattacaggacggttaactcacccaaggaggaccggaaggtttctgggaatgccactggcaatggcggggggcgccactcaaaaatcccccgggccgatgatgtcctt

SEQ ID NO: 71605 - DNA, 167 bp, Triticum aestivum
  Clone ID: PAT_TA_71605
ggggtttttttgcgcctatggacccaaaaaattcctaaaaacctacggataaaactgcttcaaaattatatggcgaactcgctttctttctactggtgttacactcccgatacagcaaacaggttaaaatcattcccccgaggtcacaccttgaccaacaggcgggg

SEQ ID NO: 71606 - DNA, 382 bp, Triticum aestivum
  Clone ID: PAT_TA_71606
cccaaacaataaatatcctttaaacaacaaatcatggacatcccaccttaatatccatgtgtacaattctaaacaaataagtctgtcccttcctcatgtcctaaaaggcaatcaacaaatttttactaaaaaaaaaaaaaaaaaaaaaaaaaaccggtgacccaaaaaaaaaaaaggtgtttggaaaaccatttaatacaatggccaatggcggatcactagttcttatcttattggttaaacaaatcaagggtttgcaccaccacaggcctaaaccggttgcacccaaccctgactttctgcttgtccataaaggtctccttgataaactcaaaccccttgtgaaaacccaccggtttcttaaaaatctcatggcccaccg

SEQ ID NO: 71607 - DNA, 500 bp, Triticum aestivum
  Clone ID: PAT_TA_71607
cggcgagcgctgtcgataccctgtgcggcggcggcagtggcgccggcaccggccctcctcccgccctgccccgacggcgccggccggatgaccaccttcttctgcaggctgcgccgcaggatgctgttgatcctcttgctcctgctgccgcccttgtcgttggacataacaggcggcgagctcaatggcggcgaggagtactccttgatcttgtcaaggggtgacgccgctgcaggcgccggcgtcttggcgccgccgcctgcggggagcggcatcagcgagttgcggcgcggcagcgggatgagcgagctgcggcggggctgctgagcccctccgttgcagagcgagacacgcctggcctttgcggcggcgtctgggttggcgttctccttctcctcggccagagacatgagctggttgaagctgtaggtctcactgttgttgctgtccgaaaacggctgtttcgccatcccgaggtcttttttgggtgctgctgatag

SEQ ID NO: 71608 - DNA, 403 bp, Triticum aestivum
  Clone ID: PAT_TA_71608
ggaaacataccacagggccttttttttatccacccgggggaaccccgggtctataaaccccccccccgaaattttactttttacaaaacccccaaatggaaaagggaaaaaacgggccccaagctagggaccaccttcgaaggggggcaaaacccccacccccaacaattttttccaatcccgcaaaaaaaactaaaacccaagggccccccccgttcagggggcaaaaaaaccaccgcccggggtggggcttcaacaacaggcaaaaccccgggggcctaaagttttgggccaccaagcaacccccatggccataaacggatggaccttttcccaaagttggggttaaaaaaaccataactacccctttccataaaaatcggacccaggaccgggggattcc

SEQ ID NO: 71609 - DNA, 486 bp, Triticum aestivum
  Clone ID: PAT_TA_71609
aaaaacaaccccaaacttgacgactttttttaggaccaacatcaacggacatatttccaccaacccaaccgaacgatacaatgaccaaaccaataagccgtccccaccctgctcgcccaaaataaccaaaacttaacaagttttaaaaccgactaaaaaagctttcaccccccccaaatcccccccccgcccccaccaccataaatcccataaaaaacccgaccccattttatttttttttggccccagccttggccaccttggccccggcggaatcctttttttccacggccttgaaaacccccacggcaaccgtttgccttatttcccccacaaaaaaccggcccaggggagggtcccggccaaaggtttccccccccaggggctggggggggacctttttgaaaaacccgggttcaccgttcttaaaaaactggggccccgcctcaatttttttgaaaaaccgggggaaaattttggtcggga

SEQ ID NO: 71610 - DNA, 624 bp, Triticum aestivum
  Clone ID: PAT_TA_71610
gggggccgagtaatgcgcatcacaattcacaagcacaatatgaagtacacaacatctcctgatcataaacatttatcgacaacattggagtgaggtttgatcgtatcacaatgcaaatccattaaccctctatttgtaactcagccttcctatgggcatgcccttgtccctacaaggactgaaattgttatactcattattagccaatccaaccgtaacatgatcatcgtcacataatagcatcagtaacatcatagtatcacatagagtgagggtaacattaaacctgtccagtaagcattgttctttcgacatgcacaaaaccccccttttccttcaatttaccaagttaataacattaaacgtggacaaggatgctacttcctgtttttgaaggaaatttcaatgtgaactatatatattgacggacgtgagtgaataaacatatactaaaacgcatcaatatacatccgattcggaaaaaagtctgaacatcttataatttggaacagaagtattttttgactgagaaagccaatccaaccgcacagctgtaagatcatcgtcacataatggcatcagtaagttagatatcctttgtcccctgaacttcaatcagtaaac

SEQ ID NO: 71611 - DNA, 572 bp, Triticum aestivum
  Clone ID: PAT_TA_71611
gccgtcttctgattcatgcatttcggggggaaaggttctcactacataaacattgaaactaaccaaaaataccctaaagttctcacccctcaatcattggcgaccaactctgtgcttccgtccttggcaaccaactctgggcttccgttttctaccctctgaaggaccagctgcttttttggagcaaagcctttggctatcgacacggagcttacatccacaacaacggtatcgtcttccttgaagtcacccttgaggacaccgaaagctatctcgttctccaccatctgctggatcacccttttgacgggcctggcaccgtatttggggtcaaagccaaaagcgccgaaatgctccacagcctccggtgtgtactgaaggggaatcttctgttgcagcagcctgtttttgacccggttcaactgtatctccacaatgcgatttatctctgttgagtccagtggttggaacacaatgtattcatctatcctgttcaggaactctggtcggaatgtctgccgagcaatctcagtcacctgctttttcattacctcatacaccgcgtccttgct

SEQ ID NO: 71612 - DNA, 411 bp, Triticum aestivum
  Clone ID: PAT_TA_71612
aaaaccgaacaaacaaactttttttttccgaaaaaaaaaaaaactttttttacccaacaccacctcaaaatttcaaacaccccgccccccccatactttacagcccaaaaattcccctccataaaaaaccaatttttggcccagccccccaccggcccggcccattttatttaacttaggtccaagggggcaaaaaccccaaaagaaccccccgaccctagggcccacaaaatcggcttcccccccccccaaaatttaaacgggggccctaaattcggcccacacctttatggcccccgggacggggccccacaaaaaattcctaaaaaggccctggttaaggggctctcccttgccccccctaaaaaacccctggtgggaaaagatttaaaaaaaccggggcccccattt

SEQ ID NO: 71613 - DNA, 252 bp, Triticum aestivum
  Clone ID: PAT_TA_71613
ggactctctgtactaggtcctacttcgcatcccggccaaggagctctgccgtctccgcgccgtttgccccgcctggcgcgccctcaccttcgacccgcccttcgtcgcggcgcacatgtcccgacaccgcacggcgcccccgctcctcgccattgcctaccgcgacgacagtgaagtcaacggcgttgcgatttcggatctgtctggcaacgtcgtgaggcggattccagtcactgggtatgagattgttat

SEQ ID NO: 71614 - DNA, 358 bp, Triticum aestivum
  Clone ID: PAT_TA_71614
ggcaatgacctgacatttatttatttatttatccaaacatcaatttgttaaatgtggattttatttatacaaataatccacatttgtcaaattctttaaaggaagcccctactggatggctccacagggaaggctacaattattttcctgggtatatatttttcattggtagttgaacattatgtctatttatttcccaggttatcatgaataccaatggacgatatagcctttcagtaaacatttggagccttggtaactgaagcttggtttttcacccaaggatgtcctattaattgaccagaatttacacgcgcaacaagataaccccccaaacagagtttcacgaatctttttg

SEQ ID NO: 71615 - DNA, 498 bp, Triticum aestivum
  Clone ID: PAT_TA_71615
gagagggggaaaacatgtaaatacattgtcttgacaatacaaactatttttgctgaacaaattacactaatgatactcatactactctgcagtccccatgtaattgacacaatcaaatgcatcataattcgttctgatatattttaatggctaaaaatcattaaattcaccacactaaaaaatggaacggatcaaaagcgcaacactactaacccagaaaccccccaaaagctctaattttcacagttctgtgccaagagcatcattttgcaggcggctgacacttgcacgtcacaaagtgtggttgaagcgccattccatttgttggggcttcctccgccgtggctgctcattactgctgatcagcaggagttgctggaggaggcgatggattacaacccatcaggagttgttctttattgggtcttggtgcctacctccatattcggccctgcatgtatcgacttctcattccctgaactatgtacatctatatat

SEQ ID NO: 71616 - DNA, 531 bp, Triticum aestivum
  Clone ID: PAT_TA_71616
ggtttcagggtatcaaagaacttatatttaagaacggagggagtatttttgaaaggagaaataactatcaacgcctcgaggagaaacgtatacacaggcgattctcattccagctaaattctcaacttctgatgaagccatgactctacacagtttccgacaaacaacaaattcccgcacaaaaaatactggaaaaagggaataagaaatgtatatacaggcgatgctctcacatatcatgaatcaggacaggtactcaaaaggttggggcggctggggctcgtcgtcgtcgacggccatggcagaggcaccgggcaccggctgccctgtcgcgggggcgtcggtgagcacgacgagctcctcggcctcgctgggctgcatgtctcgtaggaggatgaacccgccgcagggggcgggcctcacggggacgtatcggctgccctcgatgaacttgatgaacttctcctgcagggggacgacgcgggctgggttcgccaggatctggaaggccggttctggctctggagcctt

SEQ ID NO: 71617 - DNA, 203 bp, Triticum aestivum
  Clone ID: PAT_TA_71617
agggatgcacaaaaagaaacaagtgaataagctgaacacaaaaggtacaacagatgaggtgccaatacattttatttggggccagaatatcttggacatattcttcgaacagggctcagcagcgatattcctttttttcagaattaacaaaacatcaaatgcatgaacccaccattcaaaaaatagcgggtggattcacacta

SEQ ID NO: 71618 - DNA, 457 bp, Triticum aestivum
  Clone ID: PAT_TA_71618
gggtttactatcaatcttcaatttttatttattccgatcaaaaattgtacacaaatggtctcaatgtcaatgggacatgacaagctttatctcaaacttctgtccgattgccaccgagaggccactgacgctgaacactccactcgtccgggacttggtgcgggctgccttgagctcaacgttgtttacatatatagtgaacctctttggtgcggactgtatccccatgaaaaccaccttgccgatgacctgcgcccgactcggcgcgtatgagttctgaaccacatgcgaactcaccttggtcgtgaccatgcccttgctctcctccctgtcgcagctgaatctcaccagggtccaattgcctcccacagcacccatctccggcggctcgccgtcatccaagaacagctccccactggccgtcccattctccgcgagtgccacaaggaggtggaac

SEQ ID NO: 71619 - DNA, 342 bp, Triticum aestivum
  Clone ID: PAT_TA_71619
ggaaattggcaccataatcctttggctccaaatattgagtaaacaataatttcttggaatcttaacaactaaacaagagccgaatgaatatacatgaaaaaatctttgaagtaacacaaaaatttctagttccagcccttacataagtggcaaaccatgaattacacataattatgggggacaacagcaaagtcatggaaatttaaaaagataacaaggcttatttatgaagggaatatgggagggcagcatgcaacattcactccaggagggtatggacaagggattttacgttgagcttcttgagggcagggtaaaactgaccacagccaacgaacatga

SEQ ID NO: 71620 - DNA, 292 bp, Triticum aestivum
  Clone ID: PAT_TA_71620
cccaccataaccctaaaattattctaattggctgttatcgcttatccaaggcattcccacaacaacaaaatggcaaactacataacccttttggttcaacctcccatctaaaattcgcccaagttgacccgttctgttaacctctaacccaaaacccttaactctcaacgcaaaaaacaaaaaactggtgacccaaaataacattaaaaccttaactcactcatggacatagtttgataatctaaaaccaaaaaaacccctgaataaaactaaacctactgcccaccggtca

SEQ ID NO: 71621 - DNA, 466 bp, Triticum aestivum
  Clone ID: PAT_TA_71621
ggtttttttgcaagttccgtccatcattataaagtcaagtgatagtcatagcaatagcacaagttctggccaagttacattaaagtgtttcaccacacatcaaaagatctactttccaaaagcagtagccgtagcacaagttcatctcctaaataccaaaagttgccatcttctaaacttcacaagttgccaacttctagacatgacaagttagcaactagataacttcacaggttgctataaacatgatctttgtcagcaaagaacttgcaaacccaagtttcaaaaattttgtcacttgcactgcataaccaaccacgcaaaccttcattgtccttgcaagataagtgcacaccaacagtaattctttgatctgtggtaattgggagttcctccaaccttttccataaactagcataaggatcaacaacttggggcattggaggaggaacggcaccaagggatt

SEQ ID NO: 71622 - DNA, 262 bp, Triticum aestivum
  Clone ID: PAT_TA_71622
agacgaaccccaaatgttttgaaaaataatcacactcatcactgactgactgactgtttgaatagcaaaattacaagtctgagtaatactagaatcttccggggtgtctctgctaccttaacaattcagttggtacagactagactagactagactagactagactggactggaggagaaaaagcagagtggaagcaaccaaggcaaaggatgtgtctccggcggagagtcgtccggtttggtggtggccggcggaggtggt

SEQ ID NO: 71623 - DNA, 301 bp, Triticum aestivum
  Clone ID: PAT_TA_71623
acccaacaaatatccgggtagggaaacaaatcttttcggaagccggttagtatttttagaccagtttgtttccctcaagcatgcccatgaccacacacttacaattttacaaagcgttcatcaccaggcggcgttcatcgcaattttatgaccacctgtaatgaacaccgccatttttacaatcgtcaaaactgcccaataaaacccccttggagcttttctaaaaaaccctgcccctaaaaccaggccaaacagttagtcttcaccctttgccattcatcaatcaaaaaaaaaggaaaag

SEQ ID NO: 71624 - DNA, 429 bp, Triticum aestivum
  Clone ID: PAT_TA_71624
atcaccatgcgccggaccgtcaagagcgcgccccagagcatctggtacggccctgaccgtcccaagtacctgggcccgttctccgagcagaccccgtcgtacctgaccggcgagttccccggcgactacgggtgggacaccgccggattgtctgctgaccccgagacgttcgccaagaacagggagctggaggtgatccactcgcggtgggcgatgctcggcgccctcgggtgcgtgttcccggagatcctgtccaagaacggcatcaagttcggcgaggccgtgtggttcaaggccggcgcccagatcttctccgagggcggcctcgactacctgggcaaccccaacctggtgcacgcgcagagcatcctcgccatctgggcggtgcaggtggtgctcatgggcttcatcgagggctaccgtgttggt

SEQ ID NO: 71625 - DNA, 464 bp, Triticum aestivum
  Clone ID: PAT_TA_71625
aaacgtgggataaaatattgaataatgaaaagtaaacatgacacataggtatgtgggagtatttaacatggaatcacaagtcaaataagacccctcaaatccagaataaaacttcacttcaaatgctctggatgaaacataactctggcctcttattagttggtgactctgttcgatgcctcaaagaagttttcagccttcaaatagctgtcccaacatctcttccaagacggcgggggtgctgtttccgcggctagcgtgctccgctagctcaggatgcttcttcagatagtcgttgtaacttgagatgactctctcgatgatagcccttcgtagcgcatctttgagctgagggtccggaaccttccaaagcttctgagcttggtaggtttgatgaaacgctgactcgaatttagccagcgaagaggtgttggtcatccaacgacgcagcggtccaggaggat

SEQ ID NO: 71626 - DNA, 386 bp, Triticum aestivum
  Clone ID: PAT_TA_71626
aaaaaacccatcgcggccccggaagcggcccccctgaaaaaaggcaaaaccccctcccatatttaccccctttcaagcccatatttaaaacctttcgccggttgccctttttggcaaaaaccacaaacccggggggggaactttaaattttggacccccggggggggttcatcgatggaaaataacaaaaaggttttttttccccggggcaaataagttttcctccgggccaaattaaaaaaatgggttatcccgggatggggttcagcccgggaacctaaccaaggcccgaggccagggccgttttttccggggggccccccattttgttttggggaaaggcctccttggggaggccccaagggggggggggggccctttaaaac

SEQ ID NO: 71627 - DNA, 452 bp, Triticum aestivum
  Clone ID: PAT_TA_71627
agcattcacatacgagcatgctttctcgagtcatgtcgggaacatggacatacacatattcttatcttaggaacaaacaagaaagataaatggaaaaggaaaacccaaagcaatgtcagagttgacaaaaccgcaatggcactttatatgtggcccgtggtgagtgagctgtttaggccttgccggactcctcgcagcccggtggcttgaaggcgatgaagctgacgcactgcacctggcgcatgttgtcgaatccgatgatgcggacatacgcgtcagggtactccttcttgacctcctccacctcgttgatcacctgcgtggcgtcggtgcacccgaacataggcagcttccacattgtccagtaccggccatcgtagtacccaggggatgcgttgggctcacggaagataaacccaaccttgctgaactcgaggcaaggcacccacttg

SEQ ID NO: 71628 - DNA, 215 bp, Triticum aestivum
  Clone ID: PAT_TA_71628
atttttttaccatggcacaaaaattaacaagttccccaggtcaaaaaaccattaagtaacaaacaaacttttccaaaaaaaacaactggttgcacactgaatttgagtccaaaataggtttttttgtcaccgccatcacgaaccaaagcactgatccgcttaattgaagcacttggcgcccagcaagggctgcccctcaaacggttcaagggccc

SEQ ID NO: 71629 - DNA, 281 bp, Triticum aestivum
  Clone ID: PAT_TA_71629
aaggcatacatagctcgtctcggcaaaacttattttaaacaaaattaacatagcagcattacacaaaaacttttgcccattaaaaagtaaaatgggtaaccaagcgttgcatacccctcgcttatcacagggataaaaaactacctaggaccaaaaggatgggacgtttcagggccggcttgctctatggggacttcaaacctcaaccaaagcaggggggcccagctcgccctcctccttagggggggggatggtgacaaggccaggccgcgggggggtag

SEQ ID NO: 71630 - DNA, 110 bp, Triticum aestivum
  Clone ID: PAT_TA_71630
acagccgccttgggcgcagtggctgccgcagatcgcgccggcagccccgccacttctcgccaccacggggccgcagtggcccacctggaccgcgccggccacgccgtcct

SEQ ID NO: 71631 - DNA, 465 bp, Triticum aestivum
  Clone ID: PAT_TA_71631
aataaggggaatatattaatagcgtgaagataccaattacacccaagctctgtaggatgcacacaggcaagaaaacataaaaaagagagaaaaagaaaacaaggacctatcacggtgattgaaactcgcaacaacagcactctaaccaccaccaaagataacagccgggccacaaaagaaattctccaaaagcaatgcagcacagacattgtcctcatgacaccatccatgcttgtatgcatggcggcgggatatactaggtagcatgcacacacgggaccttcctcctcttgaccgtgacagcgagcccattcttcatgtgaagcataacggacaacttgggctccacgacgtgcccgggcatggcctcaacggcgaagttccacagcacggctgctgcgacagctttcatctgcgtgaaggccacgtccttgccgaggcaggtcctgggaccggcgttgaagg

SEQ ID NO: 71632 - DNA, 418 bp, Triticum aestivum
  Clone ID: PAT_TA_71632
cataggaaatgcaacaatgatataccaaaaggataaaggtttaatacattatgccaacaaacgtcacgactaattactttggatccggatgctattgctctcttacaggactggaccaaatcgtttaggccaagaacaacattggataaaacttaacagactgatccattccacttactattgatcttcttcacactatatgaaaactctaaaccaaaccatttgttgcaacaacatgcaaattctgtactgcagacaattaacagagtgtttaagcatgtaaaggtaactgactccaatatcaacaattctgtgcaccaccatactaaaccaaatcattcattccaccagtaacaactctgttaggctgttacatagtgtgtctgcgtgagcccaagcatacagaggaggagggagg

SEQ ID NO: 71633 - DNA, 138 bp, Triticum aestivum
  Clone ID: PAT_TA_71633
gagtaccgtccaggatccatttgtttaacgtcctcctgataaaccagaaacacatccaatttgattggactaaaccaaatatcttctgaccatatggatctaacgttaattttggaacacatcgggggactatgatgc

SEQ ID NO: 71634 - DNA, 233 bp, Triticum aestivum
  Clone ID: PAT_TA_71634
gggggacatacaaacccaacgggtgattctcaaccaaaggaagtcagtttacaaggcaaaccatctacaaaaacggggggtatattcccaaaagatttattatcacaaccgaaaatctgaattttggcccccttggtttgaaaaaaaaaactactatccccttcaacccaatcccctatagccttttaccctgggcaaaacttctttttttaacccaaccaacatgcggcaaa
